United States Patent 9,328,346 (POLYCOMB-ASSOCIATED NON-CODING RNAS) - sequence listing, part 149

SEQ ID NO: 192461 - RNA, 1502098 nt, Homo sapiens
  misc_feature (369734)..(369734): n is a, c, g, or u
  misc_feature (455029)..(455029): n is a, c, g, or u
  misc_feature (1095499)..(1095499): n is a, c, g, or u
  misc_feature (1095728)..(1095729): n is a, c, g, or u
uugcagcagagaaggaaguuuaaucauaaggcugccgaauaaggagacagggggaaaccucaaaucugccugucugagccguuuaggucuagguauuuuaagggaguuggagugaccgaggugggggaucacugguugaagaauacaggauggugagaugaagaaacugcauuuucaugcugauucaguuccucuuggggagaggcggggggcggucuucaaacugguuggcaauagcucuuuugcuggaauucaggaucugaaaaacaucuuaagccauuuuuaaacaaacaaaggccuuaugauucuaacaucagaaaucuucucuguaggaacaaugaggaggcaaaugguuagcaucuggugcucugggacuuuugguuacgaagaagugggccaaagugcagccugauuaaugcuuaauuacaacuauauuucuguccagaacccagcaucuaauucuuguuaacccugugaggaugguuucaauagaauguuuccauuguccuuaaagggagguauaguuagucccauuauacuccagguaaugaugacagucuuggcaaaaucuuaggacccuaaguuguuugccaccucacaaccuauauuauccguccuagucuuaguuaccacaucugacugcugggaagacugagggugauuuguuuggucugugcacaaaaccuuuaaagagaaauacacauguuaguuaacuuaaaaauccacagguacuguggcaauaguuuguguaacaaguuaggguaaauaucuuucugguaagauguacaagggaagucaauuuaccuggaagacaggaggugucaggccuccaggcaagacagaagcaaaaacugacaaaacaaagccuacaggaaauuuggguaauaaguuugaaucuucuuaaaguucuuaaagugucuagaaaaagcauucuaagacaaaacuccuacaauucagcaagccuugggaaaaaggcuaaagcuuucuagccucuaccugaaaauacccacugcauagaaaacccaggagaaaaaauucaaccuaggcagucaagucugagguauugucaccccauuuaaauuugaacagggcacucuaaaaugacauacuggccuucauaagaggaacagaaagagguuuguagucaugcccauaggccuauguucuuagguaaacuaaacuagcuugauccuuaaaaaacgagagagagauggugaacaguggaaaagguucaaaauaaaauaugaaagacagccucuguuauagcacuugccauauccccccaggcaacugagugcagagcugacaaacuuaugacaugggagaaugaaauaagcuuucuagaaugcaaggaucugaguacaacaccauauuugaacaacaauagggggcaagguagucugggucuuuaacuauuuagaauacucuaaaaagagggcuggggagagaaaggccaagugcacauauauuuaaagcuauccaguaaagacuuacuuacauuucaaggugaaaucagaauacaaugaauguguuuucuagcuaaaaaucaugaucacuaagugguugauacaauuuuuuccaaucaauugcuaacagcauuuauucacuaauuuuguuuuuuauuugugucugaucuacuucugcaacuuauaacaugaacauauuuauucacaggucagaugaagaauugccuaauuuuaauuuggaauuaucuaauucuaaaaacaaaaaagaaacuauuuauaggagaggaucuguaacugggguccaugggaguuuauuaacagguuugccagaaaaaaauacaagauaccaguuaaauuugaauuucagauaaacaaguaauuuuuuuagucuagauauaugccaguauugcaugguaacccuauauuuauaaacaaauuucagagagauagauacauuucucucucucucucuccuguuuuuuugaaacugagucuugcucugucacccaggcuggaaugcaguggcaugaucucagcucacugcaaccucugccucccagguucaagcaguucuccugccucagcuucccaaguaguugggauuauaggcaugagccacuguaccuggccuucuuuaacacuuuuuguuuacaggccaaacaucacccucagucauuccagcagucuacuaugugaacugagacuaggagggauaauauagauugccagauagaucuaggcaugagcucguuagacacugcauaaaaauuuggaguagaagcauuuugacaaggaaauuggcuauagcuaucuuucuaccagagucuuaaaccuaugaucucucaacaguuagucaucauuaagacaaagauuaauucuaucaagccuugacuuuucccuguggccugagcuuccuaggagccgaacauaaagggaaacaugaagggcaauuuaccaaauagcaacugaagagaagaguccacucagugaaagcagaggaguuugcccgggggcguguuagggaggcagagaaagcugguuuacagggcuuugcagacagacuugagccuaagggccaugucacaccuuuaaguuaaguugggguugaccuuuuaaacaagaaguugugcaugacagaaggucugcuuugugaacauuggauucuggaggagcaccaccgcaggaaagacuggagaaaggugguggugggcugggggcacuggcuuggaagaagagagugaagaggcaggagaguuggaagagacugggaggcugggaauacaguacucaagggccaggguuuucuccccuccagcucuuuguccuuugcagccaccacccaaggaugcuggugaagguguuuuugugcauccccauucugagagugcagccucuuuccugaggcccacgggagggucuggguaaugacgaaaugcagucuuuaccugugucacugaaaguagacccgcagagcugcggcuucugcugccauuuccuccucugaucuccaagaggcaggaaaguccuccuugucauguuucuggagcuuuggagaaaaaaaaaggaagaggcucuuucaugggcccuugggaucuccuugaacaaauuucggggggcugggggagacugaacaaaauuugcaaauuagaggccaguagguguaucuuuuaauuguuucaguugcuacaacuugcaaauaggcuuuauacaagaauccacauuuaaaauaaucagaucauuugccaucuuguaaucaucuacugaggcugaggggggugaugauaugauauaggucuguguccuugcccauaucucaugucaaauuagaauccccagugucagagguggggccugguggcaagugacuggaccaucaaggcagaauuccccauuggugcuguucucaugauagugaguuauugggggaccuuauuguuuaaaaguguguagcaccucccuccacucucucuuccuccugcuccagccacagaagacgugccugcuuucccuuccgccaugauugaaagguuccugaggccuccccaaccaugcuuucuguacagccugagaaaccaggagccaauuaaacugcuguuccuuauaaauuacccagccccggguaguuccuuauagcacuguaagaauggacuaauacaggugaucacagauugggaugaagugggggaauggggagcauuugccauucccagaaucucccccacacucuucuaauuuucuuauguuuaacaggcaucauucauuuauuuuacuuccuggauuuugaaggcauugaguuugccaccaacccauaauccccuccuucaagguggccugugguuuaccuccuacucucuuugguuuagacucucuugcaugagcucugagcaguuuuguucagugaaccaaauuuaugauaaugacacaagggccaugagaacugaguaaguaauaaguauuuccauuaaaagaggguucaagcagggaaacaguaaaaaagagauuaaaugagaaaacaacuuacaaaaaauuaacaauuugucucaaaauuaacacuugaaucauuuaaauuccuccucagauuacaggcauauuuaaaaaauuguguguaugucucagauuuacauauagagugaauacaauuucaauucuaucagagaggauguucucagaacucucuuccuuagaaaugcucaauuuucucccuuaaccuccuauuaugauucaauuucauuaacuaaauuuauuguuccuguguguggcucuauacauuguaaaaugccgcagguuauccguucauucuucaugggaaugcacaguguaguauuuuguguuauguguuaaaagucauuugggauugagacaauuuaauagcaccaaugauagcuagcauuuaugaugugaaaggcgcacauuauuucuuugauauacauuauuucguuuaauccuuacaauaacucauaaaacugacgcuacuuaaccccauguuacuguggaggaaacugaguucugaggaaguucauaccccgguccaaagaucacccagcuagguagugggguaggugccaguauuauccccaacaacuuuugccuuuuuauucauccugagggaucuacagugucccuaaagagcaucccacagauacuguuccacuccauuuugaaaaaggucaacuuaacgauuaaaauaucgacuuuuuaaaaguugauccuuuaaaaauaauuuugccaacucagcaaaaagucuaucaacuaauaaaugacuuuugcuaucucaggccccaaacucuaaaucuaaccuagaggccucuacccuggcagcuugcagcagauggagaaauuuccccauuuauugcagcucaacauugauacagaaggcaaaacagugagggaaccauagccucgcacucccgcugagcuguauuuccacuccugguaaguaaguuugagccuaaaugaggcucauuagcauauaaccgggccacagauacauuuaugagggucauggaucuucccuucagaauuuggcugccagcacgcugauuuuacauuuugccauguagauuuaauucuccuuagugaaagaaaaccacauuaagaagucauuuccuuucuugcagaggcaaacaugcugcaguugcuacaggcaaggcaaacgggauugcuauucuucuacucaagaacuaauuuucauuuugauacuaccuugacgucuguuauaaauccaucuuaucuuauaacaauucaauaggaugacaaagagauaugcaaagcccaggaaauauggccuucccacuucugcuacugccauuggaagacacagaaauaaagcauuaaguggccucaacaacacagaucauaccagaggaauccaaauaauuuagagccugugaauguuaaugccuuccugguuauuaggcaaccgucuguuauugucauaugccuuacagauggcaacauugugccaauccuuagaagaaguuuuugggaaauaauaggaaauaaauaaaacaaaaacuaaucaucuuugcaaaaacucuguuguaccuagcuuuuaaaaguuaugagauuucccuccuaaaagccccagauggaagcaugugguucuguuuagaacagcggcacucaacccugguugguugcccacuguaaucaucuaggaagcuuuaaaaaauaaaacccaccccagggauucugauuuaauuggucuggggcagccuggguuuggggauuuaaaacaaaacuucucagccaauucuaaggugcacuuacuguugagaaucacugcuuuuugggagaaguguguagauagagcccacacacauauagaaagaauccgcuugccuuuaagcacauugcuugugauccuaucaacaguacuacugcuguccuuugcaaaccuugcccuagaacugcuuuucuucuguuuaugcucuguccaugggaugucuggccuacaaggcuugucuuagcaacacuaacaugcggaugcaguucagcagccuuugaauguuuuuaaucucugcagaaauagggagccugggaaaggcccuggugggcaagacuuguguccuagaagauccauccaggugacuugaagacuaaaaaugcuacaguuuggaguaaaguuccauuucccuaaagcaacccaagaaccugguggcugcaacuucuugccuggcuaacggagagaaagcccuaaugaucuuaaauaguaguuuauccaaaaggcaguauuugccgugggugaacuuuaauggaggaguuucacuucugauaagccuucuagauuacuuuggcugcccacaggggagggcggugacuacuuguuaacacacaagacaguugcucugucucuguaaugccaggggccagaccuagcacuggaacacugaaccagacagacuccuuuauuguucuccuggggcacccagguagggagguuacacaccaaacggcugauucuuagugagaugggauuacaaaaugggaaggcugcuggauagagcuagccucauugcaaaggcuuuugaguaucaccuugguuucacaaagaaacguuaugaaaaacagugauggagggaaagagguuaucuacggaucauccaaaaauggcucuccaagaaggcgagaguuaguuaggucugagcuugaacaaugagaagaacaaaaguuccuuuaaucucuuugugucucaguuuuccccuuuguaaaaugggaguaggaaaaagaguggugagcagugccgugccugacacauaguuaagugguauuuaauauucccugcugcugcuacuacugucagucauuagcauuauuuuuaggcuaaauaacacugaccuaaugacagcgagcacuaaaaauuccacagagguuguuucuaggaguaaaaguauuuuucaucuccaugguuccccagugaucuguaucuuuuggaccuaacuaacuacuuuguagaaggauuaaaaguuaugaucagaauucagauccaaaacaacuuauuauaaugagacacucaaaucuggggaggaaauguaccuccuucagcucuaaagugacccucacuaaucccuaauccucagagcuguccuaaggagugaguaagguauuaaucgaggcuucucaugguaaaagcuaagguccuaugguaaaagaaugugguggaggucaaagguagucaauaccccaggaguaugguugccagauuuagcaaacaaaaauacaagacacucagugacuuguuuuaggauaaggaugucucauacaguauugagacgacauccugauaugaaacaaugauuuguuguuuaccugaaauacaaaguuaacugggauucuuguauuuuauuugacaacucaacauagcagaccccuuaaaaaggugucacaggaagaacuuggcuugcauuugguaacuagguuguucccaaaguugccuggcugugaauccuggaaaaaacagaggggaucaugugcaggaagauaaaauucaaggccaucauuuugugcacuccagggcuuauuauuauugcauggucuuauugcacggaaugcaguguaaaucaaccugcacuauuuuaauuccuuaguucaccaguucuaaggugcacauuuuuucauauuuuaacaucuuugaaaucaaaacauguccuauaaccaaaagugugucauaguuuaauuggcaguguuuuucuuucuuaguaguacauaaaauaacagcacuuccaacugacugugucugggauucagugcacuauauuucuccaucucuccuuucugcagguaagucacguaaguuaaaugugacucugcuugcucugaaaaugcucaacaccaacgcugauguauuacauacugguuuccuucugaugcaacaacaauagucaaaacgguuuucacagaagcuuuguucuuuagaggaaagugcacgccaaagugacaacguuugcaaaaacuugaaccaaagucuuuauucacauucaacagacugaagucugugauggccucuccaagcaaauucuauuucugcacagcuuugaaaagagauuuaaaacaaaaaaucuaucuucagucaucccacuuuaucugcuagaaaugguuuuuggggaagguaguguuaacaggauuucugacugaagaacugauacgugucgauuuugacacugugcucccuccugugcacugaguguguuaucacaagguauaugggguaaugaugaauucccugcuguauugcucaaaccgccuuugcuauugacaucuuuagaguucuguaauggaaugcaguaggaggaaugguucacaauaauuuaaauguuuuucagaauuuggaacgaaccuggaguaaaaugccaaauugucuucaaacgggggaaaacuacuuuaaugcucuucuuacagaagcaaacggcugaauauaaacuuggauguuuuuauaaaaacauauuucauuauuaucacuuuuauaaaacaacauacagaagcagagagcuuaaauaaaccauuucuuauggguugacgguucuguuuacacagggguuuauauaaagucucaaaaggaaaauaacuguauuguuuuuuuagaucugauccucucuuauuacuuucuauucaaccaaguuuugaugaacacaugauauauuccaggcucuguucuaggucuuaugaaagaugauacaaagauaaauaagcccaagaucuuugccuccucagguucaccaugcaauaaggcagacagauucaugcauagauaauuuaauacuggccuaacuaccgaacuagaaguuccaucaaaguguucuuggaguaucuggggcagggggagacaaaauaauucuugcuggaauucaggucugagauugacuuuuaaaaaucaaggacuuggacugggcuuaaaagaugguaaugagauuuugaagaaaggguaauucugggcaaugggaacagcuucguuaaacacaugaugcgaguaccaguuccccagcaaggcaacuuguacccauggucagcuucaccaacuaauuacagcacuguucccugaugaauccugaccuggcuucuaggcagcuacuaacaaacauguaucagaguuagcaagagagcugaaauuugccacuuugagaagccuuaacauuccauuguuuaaagauggaauaggcacgcacaacaggggucuaaaagauggucuccggcccuacaaaugcaaagcugcaaacagcuuugaaucuuacugagagaaacuuauucccuuuucagugaucuuucagucccucugacuguucaagaauaaagucucagcggacuaguacguccuugauaaggcaucaacaacaccucuaagagaaagagaagagccauccagacuggcuagaauauaauaagauuguuuuguuuagaucauauuuauuuuuagggacaucucucauuuaugacaaaucaugucaagucuccuuuuaaaguaaauuuaaguuaaacauaaaagaaucaauuuuaaaaauauaugaaaugaaauggugugaaaauauggcauuaacagcuugagaaauggccccuggggaaggaaguacaacugaggugggaaagggugacucaagaugugagggugaugcauuggccuuuaaugcuuguggguggcaguuucuacugggcugaguucuagaaagcuacauuuuucauggaugcaugggagucaaaauaauuucauguuauaagaacuccgucaaaaaaugguaugggggaugguagaacuuuggguagggcaggcuuuuaaaggaaggcuucacugaagauguagcauauaaguugaggugugaauaaugaguauuuaaguaaaggggcaggaaggaauauuucaagcagaaagaacagcaagugcagaccuucaaggaaguguggugguuggguaacaggcuggaagagugagagagaggacuuggggggauggcagaucauuugcacccugugggcagggcugagaaguuuggauuuuauuuuuggugugaugagaagauaggcaaggaaguaaaaggacuagaauaauugcucauaaagaauguccuggaaggauaaugaauuaaagggagaaagugauggcaacaaucagaagagaaaguuugggagagggggcucauuugccccauaggcuaguuagcgucauggccacuaagugagaggacuuggccccucacuauagauggaccuugucaucuggcagcuuucucccuggugcuugucuguaaagcacacagagauccuggcuucccugccaagauugcucugaacuagugugaaaaucacucaguuuuugcccaauauccauucugccucucuucuaucauucacuucucaaaguucccgagaagccuuccuggaccauucugauugagucauauuucacgauucuggaugcuuucaugcuucuggcaccucccuggcacuguccuuucaguacauguuuccugccagacauggagcuuccuuugucuaugugcugguuacugagcagacuggcgcccacgcuggacuuucuugguggcccaaugaaucaccaggugcuuucacuugaggcagaaaauggucuuggaccacaaaccucugccugccacuugugauaccuuagaacgcugaaguucuuugaauauuacuuaguagaaaaauauguucauugcuucccuucucuauccugugaacuggaccuuggacuaagcacuagacugugagauaucuaugugcaaacaaauuaccuucagguccuucuacuuacugugaaaguucaaaagcccaguuccuccuccuuuucugaacagaaauucaaguaaucaauggagcauuaaucauuugauuaguugccaaagcuuugacuuaagcauaacuuacuugaguaaaagcaaguauuuuuagugcugccuguggggccaaaaugcugaaauaagcucuuauauuaauuaguggcaucccauuuucaagggguauagaguguuggauguuuaagaauuuguaacccccaaaaguaaguauuaacuagaaaaucacagugcuggaaaauaauuaugccaaaccacuguacuauaacagaccccaauugcuuauccaauuauacauugaaguaucacauugucaagccgauugccaaagcggcaaaugagacuuugcuagcaucauaauuuggaccagauauuacuccacuaacuacacuaugaauagucuuuggaacaugcuauguacccuauauaaaccuccacgaaccaaggugggcauuucagguuuguuggaguacgcccaugccaucaaaaaaaaaaaaaaaaucacuggaauugauuagacaugaaaguucacaguuuuccauugaaagccuguuaggagcaucucagcaaagagcaacugcagcuccagguucugagcagaguugauuucaauuaaaauaucaaagguagucacuuccugucagggagaccaucaguaauucuauccucaaauguguaucugagaaaaacaaccccagacacugccuccuggaucugcaacacugcucccugauugauuggccaccauuuagagguaauuuuuuuuuuuuucgagacaaggucucacucugucuggaguguaguggccagcucacugcagccucaaccucccaggcuuaagugauccagccacuuccgccuccuaaagugccgggguuauaggcaugcaccacugugcucggccuagaacuuucuuacaacacaacaucaggacagcugaagaacaggagccuggaacugggcugugaggagcuacuaagggguugauauucuuaggacaccccauugcuaugauuuucuucucaaccuuguaagggauuggaacgaucuugcccaacaguugggucugauaugucagacgaaaaucccacuguggcaagagccugacucccaggguucaguagagaaauaauuugcacucgcccaguaguucuuugcuuuucaaguaauaguaagcccuaaacaauaucaaacuugguaaaaacaaaaucuuccugucuaguccccacauugcccagucagaguaacauccaucuucguauccucucggcuagcuguaucugauaccaguauaggaaucccccuucuucacccaguggaugccugaaaccagggauaguacugaacccuauguaugcucucuguuuucuucuacacauacacaaaccuaugauaaaguugaauguauaaaucagguacagguacagguuaagagauuaacaaccaagaauaaaauagaacaauuguaacaaugcacuguucacaauugcacaaacagaagaucccugcuugcagaggaucuuagcaauuuauuuuauuuuuuuuuuuucgagauggagucuugcucuguugcccaggcuggagugcaguggcaugaucucggcucacugcaaccucugucuccuggguacaagugauucuccugccucacccuucucaguagcugggacuacgggagugcaccaccacaccuggcuaguuuuuguagagaugggguuucaccauguuggccaggcuggucucgaacuccugaccucaugaccugcccgccucggccucccaaaguucugggauuguaggugugagccaccgcgcccuaccagcaauuucaucauauaauuuguuuuauuuccuuauuaagucaggaacuuucaccuuuucucuuaaauaccuuauguccucuuuuuggcauaucugaauugccagcaucacuacucuuaugcuuuggggcuguuauuaaggaaaaugaaggguuacuugggcauaagcacugugauuucaugacagucaaccugguaacagagauggcuacucagugacuaacaggcggguaguguagacaacauggcuacacuggacaaagggaggauccgcauccuggccaggacagagugggacggcgugcaauuuugucacacugcucagaacguuguacaaugaaaacuuaugaauuguuuauuucuagaauuuuucauuuaguaguuucagacuaugguaaacugugaaaagugaaacuggagauaagaggggacuacuguaguagguuuucaauaagcauuggucaaauacgucacuaaauuacacuuuuccucccaauauacuggcuaugcuagcucaucauccccauuuuccacauaaaacaaggaacuuaaaucacucaaccaauguaacauggauaacucagagugguauuuguuuggaugagacacacaaacacuggauccacuaguggauccagacaugcagcaaacuguaugucucauccaaacaaauuugcuguaugucuagugcucuucugauccacucuauaaauuccugggaacguucuuucaguuaacauaguugaaaacaugggugguaaaacagcauagaaagcaaaacuaacacugcaaauagggaucaaccucuaagcccggagggcccugcuggaaaaccucuucugaggggaaaauugcaucucagggcaguuuucaggaauuaaucgcugaucaccaacaccucaccccaggcgccaucauaucugaacccuucugguuuuucaguggguagaaaacuggugaggcaaaagggacuagagaucucugccaguuugauuuccucaggccucuguuucuaaaaacaugcucacugagaaaugaaaugaaacuccuucugaaaaggagguuugugaugaagcagacuucggagaaggaagcauuuauucaaaaagcaauuuccuuggccagucauguucuguaagccuuuuucccccccgccgguguuucagauauugguguuuaagcaagacuguucuccuuuaauccuagagugaugucaacccacaguacucagaacaaggaaugggaagaggcauagggccaauuucugccuuuguuggaaucuccugaacauuucauuuccuauuugcuucugcuacauauggcuucuuuuuucaaagguaccuugcagagucuucggaagcacaguguaggcaaggaaacucuccaaggagaaagaaaaaucugcacuacaagaugcuacgcaaacacacaacuaagagagggaggcaagcacacagcacgcaaccaauaaugcacagccacagaauccuucucaacacaacauugcaggcagcagcaacuggguugucaagauaaaaccuauuugaagaagcugaucuagcugggaccuuugaacaauccagauccccaagcauuuaaagcuuguuucucugcagaauucauucaauuauucaacaaauaugaacauguauucaguguauuuuauaguguaauaguaaucaagcuggacaagguagugccuuugggaggcuuacauucuaggagagaaggcaggcaguuagcaaguaaucaucuaucacugccuugggagggaauaaaagagggagcuaccugagacaauauggucagaaaagacugcucugaggaaaggacagucagcugaggaguggcaagugcaaacaccccaagggaagaaggaggcaucuguauggucugugcacuggcugaaggcaagugucugaaggcgagugaggaaguucucagauagaagguagaagaugagguggagaagugggaaaaucucccuucccuuuagcacuggaggcgaaagggcuagaagacgagagacugaaugauucuuucagucacaucacucuuuucaagcaccuacuuugugcuaggcgcagaagacuauuaaacaggcaaagcuguaauaaauccaaacucagugagcugaagguagaaaggccgucccagaacagcuggacccagcacugccucugaacaugggcaaugacacuuuggggcucaauguuugcuuacugggucucucacacacccuaacaucagcccugccuauaaugaacuuuccccagaaaagcaggugagcagcaagcuauuugcacauguggugacuaccauggagcagcaaggaugcaggcugaccucacagacuucuuucugaaugcauaccauauguuuggcagagcuaaaagagcuaucccagcaccaucuagccaggugcuuggcacuggaucucauaugcuggcagaugaaaaaugacuaauaugaaaaucuauauuccaacgguacucaccaguccacuggauuggucacgauuccuucuuucuacaauaggaucauucugcuucugauuacaaaacugcacccucugaagcugcuacucacccguuggaaguuacaugcccugugcagccuacaaauccauuaaguucugauggagcuauuccaacgcccuucaaagaaccuggcccaugugaguugcacaaacaaauuggagccaaccuuucccaaaugccucucucuauuucauuuaaaaacccucuuuaaugaagacauaaagccuugaaugcaucugaaacgcuaugcuuaccaugcaugacagcagaucgucacagaggauuucaaaugcuuuuuuuuuucuaaccagaauacuugaaagaaacugagauuuccuuguuaugaguucaacuguucauuuuauaugcccuauaauugaccauucuccagaagucagcauaggcaacagagauguaaggcaacugcaaacacacacacacacacacacacacacacacacacacacacacacacacacacacacagcuuuggcacagugaaaaauuaaaaugcaaugccaggcuugggacuauuuugaagccucaggcuaggaaagcaauacccucaccuuucucagcugccuacuauguaccuaaccuuccaauuauuuauggcugagaugcuuaagauguacuggagaaacagccauggcugagagauacacaaagcugaaauauuauagagaguuauaacuucaugaaugaaaaaccuauaaaaaucacuuaaggguccuaaucuuucaguuaaucucaccucagugccacucaaggguuuaaaggaguuucacugauugguuuuuaaaggacaacgauaaaaaugcuuugaaauaacuaauuauaauuucagguaucuauguaaagguccagacacaaauauuugaaaauggacuguuccuagaaucagggauugacacagaucuuuaaaacuuucuagcccaaacauccaugugacauuuguaucccuuuggccauauugcuuucaaggcuucaaugcucuaggaaagaggaucuuacugcaguacugcuagauuuagguggagaucaaaauuaccaauguuugaaagugauauuuuuacauuaacuugaucaagaguuagaacuuggacuuauuacucagacagucugauccuucauugacaagcugugcugagaaaccauucugugggcuaaagaggauauggacucccaggauugcucuggcauugcgguugagaagauauacuggaauaaccucuuuugaaaacaguuuagcauuaccuccuaaaguugacaucuacaacaauaugacugccagguauauuaccaagagaaauucucauauguguacaagaagacaugcaugagaauguucaaagaaacucugauuaaaauagauagaaucuaguaaugaccaacaucccaccagggaguagaugaauaaacccugauauguucacauaauuaaauaccauggcucaagcaaaacaaauguuugauagugacacacagcucauagggagaaaucuuaacaauauauuaguuuaaaaaaauucccuaaagacaauaaaaauauacacacuuuaggaauccauagagaugccuaaaacuauaugaaaagucacaaagcaauggugagcauagauugaggaugcuggacugacuccaugugaggagacaaggggaugguuuuuugugugggacuaucauacuguuagaugugggauaguagcaaaaucauagguuuuguucugggcaauggguuugcagauacucauuaacaucauuaaacauaacuacuuacacaacuaaagaaaaggaggcuaugauggaaaacaaagagaaaugaucauccuugagaggcauguaagauuacaacaucggaugaccgcaguuuuccucaagauaggaauccagcucccauuccaaaauguccaccaaaguugcaacauaguagcauuugccauauaaaaguacuggaguuauuaacuggauuccagaugucugaaacugauguaucccuucacugaaucccgacuaggaucuauuuuggguauagcacuucacacagguugcuguucuuaauuaaaacuucucugccuuaagagcuuuaugucugugagauagucauccaaauguucuccucuccauaaaugugcucuuauguuuuauuuucacagcaaaaugcuugcccagauuuuaauaaacauguccgcaguaguaauauacauuucgcaugcuuuccacauuucauaaucucuuuaguccuuuuguuuauguugauucccacaccaagaaggcuguuuggaaggcuuugcagcucugucuccauuucuucugccuaucauuggggaaugaaacagcacacugauugcuauuuggguaggaaacacagacaagacguugaaagaaguaaacuaauuuccaagcaauuuugcuccuuucucucuuuuugauugauuuuggcaauaacucaccccaguucauugacauuagaguaaagccuaguagccaauuuauugcuucaaaaucugugagaguuccuaauugguuaucagacugugucuaccagaugccaaaauuaaauuucuuuuaaaucaagaaaaaagugauuuucuggcaucccagaugcaaaacaaccccgauuaacuguucuuucacauugcaaauggcuauuugggccuuggguggagagaaaacucaucuacuuacaacaggagggggucagauucuggacucgauccuucagccaaaaugcagauaaaccacaaggaacaaauacuacucuaugaaaaauggagagcugggccgggcgcgguggcucacgccuguaaucccagcacuuucggaggcugaggcagguggaucaccugaggucaggaguucgagaccagccuggccaacauggugacacccuaucucuacuaaaaaugcaaaaauuagccagguggggugguggacaccuguaaucccaguuauucgggaggcugaggcaggagaauugcuugaacccgggaggugaauguugcagugagccgagauuguaucauugcacucuagccugggcaacagagugagacuuggucucaaaaagaaaaauggagugguguuccuggcugaaggagagaugcccucgguccaauguuggggaaauuuuugcucccggaaaguggaaacaucaaaggacuggagcccaacauuaaggauggaauaauuauguuguuguuauuguuauuuuuaauggagcucuauugagugcuugcugucugccuggcaaugugcucagugccaaguacaaacaugaucucauuuacucuucauaagaguaccuaccccauccauggugcugucauuuccauuuuuagaugaagaaguuaaggcuuagagaugugaucucauagcuaguaggcaguugggacuccagggucccacucccuuucugucuauucccccuccucauauaacaauacauagcauuugcuaagcaauacagacuaaauugaggcucuaacuuaacuuaaagcucuuuugcauacagaauguuauuugaugaacucuaggguagguagaggcacaauauuauuauccccauuuuauagagaagggaacaaaggcccagggagauucagugaauugcuugagucuucugccauguuggacuaaaagccucaguguugcucuacuaaaaaggucccucaacuaaauauaacagggguggccugcaucuagucucugaauuggaacaucacaacugacagagcuuauaucguggguucucuuauuuaaaaagcagaaauucuagguaaugguccagugcaauuucgacuccaucuccuaauccuuugacaucaaaugcucugguccugacuuacugguccuggacaugguuuucuuggcacaguagcaggccuuuaccauuuuaccugcaucucucaacccuuuguccuguuuccaucucaugugaguaggaguuauucuuuaaacaacugccuuguaucucacuaccagcccuuugcacauacuguucucccugcauggauggcauuucuuccccugauccaccagcacuggacuuagguggcccuccaagaugguuccauuucaggacacuuauuguacaugccuucuaauuuaucuuccacucuauagguuuccugggggcaaaaucaugucuuuucacaauagccaaucuuuucuuugacuucccagacaucaaugucauaugguucaaucuaauaccuuaaccaugaccuuauaaaaccaaagcuaggcacauaggagaggcucacuaaauacuucuugcccagauaaacuuaucacaguagauauucagaaggaugacauaguuguacccauccucaguccucaaauaagaguuuaauuauguuauguaaaccauaugauauacuagugaggcaggaacagauacacauuguaaaagagauccagaacaaaauaagauuucucuguggccuucgccaaucuuaaaauguaacuauauuuacugaaucaaacucuuacagcauaauaaacuuacuuacaaagaaucaggguagacagccuaaccuugaguaccucaagucuuugccccuggaucccacauaacaauauccuucccucuuuuaaggaaagcuggaaagaaaaccacucugccagcagaagggcaaauaaaagguaugucugugccugcacacagagguuggcauccuacccugauuugugacccauaauuaaugucaauuucauaauuucggaggauagaagaucaacaaggaagcugaccucuggcugucucacagcuaaucaucuuuugaggcggaaacuugagaggaaacagaaacgacaggcuggagcaccaggcuguggcucggaguguguuuugggugaucugccaagcagugagaacccauggucacgugcccucucugugcuggccccacagugacaccugcucacccuccauuggguaaggugggaaccugcaucccacccuguagaaggcuuggcuggacgccugcuagucucuacaaaguuccuucucauugugugcacucuucuacauggcuucuuaauuauguaugugcacaggcugugucgaauggaguugccuuugccucugcucaccacguauuacauuuuuaaucaguauauauaauuacuuaccgcaagcugccaggccagauuuucugagcauuagucuaauuaacuuaaacuugauaauuauguuucggauaccauagcaguacacacggaacggcagacuuugcugccagcuuauuugauuccaauaacguguuuucucaauacuggacuaguuuugauuuuuuuuuuuuuuuugaaaaaaauggccaucugauaauuacuuugguuucaaaauuuccccucagauaaacccauucugcuauuuaggacagcuucucaaaugauuuacacggauugaacuguuauaguauguuucuguguauuuuuacacacacaaaucuguuuuuacuaauauaaauucaaacugaggagaaaugacaguagaaggaauucugauggucaaaugacagaauuguccauguuucaacugcucuaugcauugccuuuuccauuucaauuuggguugaugaaaaaugagagacaaggaaaagcaaaacaaaacuaaacaaaacacagaaaaaugcccagacuuguaagggagaaaggucagcuucugguugaacgagggcaugauaaguucccacacuaauaaggcucaauucaccuagggcuuaccaugugccaggcacugcaaaaagcucuuuuuuguggacuaucucaucgaaucguccuaacaacccuaugugguaauuaguuauuacuauagguugaauugcauccuccugaaauauauguugaagcccuaauccacaaugucucagaauguaacuugguuuggaaauagggucuuuguagagguaaucagguuaaaagaagggcauuagggucagccuuaaucuaauaugacugguguccuuauacaaagggaaaauuuggacccagcagcugccaugcacgcaaagagauuaagugaagaugaaggcaaagauuggggugacggaucucuaagccauggaaugccaaagaucaucagcaaacucccagcagugaaguggacacacugaacagauucucccuuagagcccucaggaggaacagcucugcugacaccuucaccucgggcuuguaguugccagaacuguaaaacgacaaauuuccauuguuuaagccacccacccagguugugguacuugauuacggcagcccuagcccucuaauacauauacucugguuaccacuacuccccguuucacagaugccaaggcucagaaaagcuaugugauguguccaggucugcacagcugucaaguggcagggaaggaguccacaacaggccuuucggacucccaugcucaacccuugaccucacccaugccugugccacucugcuucugcccaggaggcugaaagaaucaauacaacaaaucccagaaguggaugaagcacuaugaacacuguaaugcuucuaagguaaaagucaagcuuagauggugccuguuuucacauuugcacaucgccucuuuuauuuaacacguaaaaugacugcuugaaauaccugcacucuaguuuuggagggcaacaacauggaauuuaaauuuucuuagggugaggguagcgggauuauuuuguucucuucucacauaagacaauaauggaccaaaaauaccacuuaccaauuacaaaagacaacaaauaacagagcacaacucaaugaaucgaauugcagaaggaagaacaggugggcuuucccaagaugucauaauagauggaaggagaacaagagagaaugaaccugcucuauaaaggccaaagacaggaaaugagaaucauucuggggaaaagauacaaccuuuauccaggaggaaaagcaugggaauaugauaauaauuuuuaaaaaagacaauucuccaagaauaucuccuggaauagauccaacggaaagcuugacaccagauaaagaagggaggucagguucauugagggccuauuacauuugggguauguuugagggugaaaccccccauagaguguugugaaguagaagcuaucgccucccacuuugcagauggggaaauaaaguucuaagcaauuaaauaauuacuaaagggcagcuacuccuuggcccagcaaaucacuggaaaugcugacauggaagaacagcaggaaggguuguccuaagaagaauuacuuuccuucuucagacuaguagugucucuaugucuguggggaacgugcacaagcucacacucaagacacagacuucucgucauaaaaaaauuucacaaauuaccucuaaguugcucuaaaacgggagugcuuaucauuuuuaggcaugucagcacuuuuuagaaucugaucaaagcuauguaugacuccuuucccuagaaaaaugugugcacacacauaaaugcauacacuuuacuugaaauuucuagaagguuuguacacccucagggauccaugagucacagcuuuaaagcccacaaaggauacaucugccuccaaggagcccagcaacuuuaugacacacuaaaacaaacacauaacaugcacucgcacaaccuugaccaggacagucccccuccacagucacuggcuuguaucuccauguuagcacacccaccuccaccacugagggggagcucugcugugcuucguugaucugcauucacuaaucuacauuccaggccccacauaaagcaaguauaaagugaauguuaagugaauuugaaguuagaagaccuggacuugagcucuaucacucccucugggucauguuguuucaucuccuugaaucucacuuuuaucacccacgcuauuaggcagaaaucaccccgguuugccucaccuuuucugaaggauugcugggaggaacauaugcagcaaugcagguggaagccauuuagaacaguaacagugaacacugacugugugcaaacacuguuuuaaacacuuuacauuuauucauuaaucuucaugaccaucuuaucaggguggcaguguuacuauccccauuucagacaugaggaagcugagcacagagaggucggggaacuggcccagguaggcacagggcugggaugcaaaugcaggcaggcuggugccaaggccagcucucguaaccacugugcauagugccucuucaggagaggcaaugccacaaaaaaugucuaaaauuauccuaacgagaaggcaaaagaacccugugagccuucuaugaacauuaguggaguuuggaggugugggguuugcagggcuuuagauuuagaccacccagaagagcucgauguuacauauaacugcaacuagcuugugcauccacaacuccaaauucagcccugugguggucagcgaauaucgagggagaaaagcagcagccucauguaggaaguguagggccagggcccccucucaaagcucauucacauguacuuacuuugacugccacaacgaacacauuuguaggcuuuccggcuuguggcuuaccugccugugaccacaaagcucauauguaccacaaguccucuuuuuccuacuucaaacaaacaaugcucaucucccuccucugaauuuuuuuguuugagaguuuccaccuuaagguuuucaagggguccacaauucaguuguaucuugaguggaaaucuuauucuguaaggccccugucuucauucucacacagucaaagcacacuagcugacaagcaggcuucgagcagagccaugauaaagcuucaagcccugccugcccagagcucacagccccggugggugacccggaaaauaagcaggcaccugcaaaaggccuguaaagugcugugaugaggaaaauaugggcaacugugggagucacagaaaggggguaccuaauccagcauggggagagggagacacuagaggguccaaaaagcugcguaucuucucugccuuuguauugucacaaaaaucuaggaguccucaugagcucaauguuaagugguugcaugcuuugacucacuuaaucgaaaauguuuuuaaaauccugcuuagaccuuuuuccucccacuguucccugaguuagcuccuucucacccucugggucucaauuuccaauguaauuaauucccucuuuucacgaagccuuccuggagcacccuacacugccuggcaucuccugugccaucuuccugcacuuucuuccuuucuucccagggaggcaggcuucaucuugaugucccggguguggacugcagaccaacaucaccuggcggcuuguuagaaaagcagaacauaaggccccaucccaaaugauuccucaauacuuuaaagcugccucgcccaggaccuuagccaucagccccaugugacuaccaggccccuguaaaacggcuugucugaacugagagguauugcagguguaaaguacauaccagauuuaggagacacugugaaaaagacuguaaaauaucucauuaauaauuauuucauguuaauuaccuacugaaauaauauuuaugauauuuuggauuaaauaaaauauuacaauuaauuuuaucuguuuuuuuaauauggcuacuauaaaacugauagucacaugugugguucccauuauguuuauuuuggacagggcugcccuacagcgugagaugcgcugguuuggauaaugaucaagaacaggcauuggcagacgacagccacugggucaaaucuggccaggugccugauuugguaaaggggcuuuuauuggaacacagucacacucacucauuuacugucuuuggcugcuuuugggcuacagcagcagagcuaaggauuugcgacagaaacugaauagccugaagagcuuaaaauauuuaccaucuggcccuuuuuagagaaaguaugcagaccccagucaagaacguucauuccagaacuggaccgauugacuuaaaaucacgucucuaccacuuuuuggugugugagguucggcaaguuaccucaccugccugugccucaguguuuguaucugaaaacagaagaugagcauacauaccuaacagaguuguuaugaagauuaaaugaguugauauaugugaacuuccuuaaauagugccucauccauaguagguucucaauaaauguuagccaccauuaauauuacugcuagcaguuaucacaaauuguaaugacacauuuuugcuuuaacuuuuuuuccugucugucuccccaucaaauuaaagaccuaggagaguggcaucauuuucugucuuguuccagcuguuuaagcacaguuaaacagcccacacgugagauucaauacauauuuguugcaugaaucaagugcagaggagggaaguaauuuuccuaaggcuccacggccagaaaguggccaggacuugaaugugguucuaucugcuugccaaacucaaauucuuaacuucucuugauacaccaaguguagucuauagaccagcgacaucagcaucacuugggagcuuguuaaaaaugccggagcuuaggcuucaucucagaccgacugaacuaaaaacucuauuuuaacaagaucgccaagaaauucauaggcacauuaagguuugagaagcacugcucugggcuauaauucccaguuucgacucaugugcuuauuuguucaacaagcaauuaauuuagcaucaaucauuccacagagccuuguguuuggacccccuaauuccagagcugaugauuucuauucaucccgaucagguccuggggguguuuaggguuugcaaugaacggcaaugugcugugucagaagugcccuuucuccuaccagguucaaaccacugcaaugcuggagugaccucucugcacagaaaucugcuuaacauuccuuacccgccuguagugaccaggccacaggcuccggcagaugcagaaggucugaaaaucuaguuguaaguaauuuuccucuaggugccuaccucagugaauugguucuccugugcauuuuauacaucaguggucgcaccacucaaacacacaauccauucccgaguuuaacagcucaggcaccuuccuuuuugauuuuauaaaugaaugcaaaucaucucccacucauauuauaaaccaauuaaaauucuccucacacuuuuaaaaaaacuuguuaccuggcucaaagauccuuagcucuuuucuuagaaacuggcccuuauguggccuguaugugaggaugaggguguuugaaauuagcaggaaaucuuagaaugguuuccccuuugucacagccagaaguuucagauuguggucaucagaugaacgcuuuaaaugagaaaaagacugauuagcauaauucuuaaaggucugaacucuacacucacagauggccucugagaggauggaugguacagaaaggagauuaggauaaaucuaauuaguuuggggguguucucauuucucaaguggugagcgauggagaagaagugauggauggacagauggagauaaugaagccccauuaaagccuuuuuugauucucauucuccaugauggagcacauuaucccauuaauguuucugugagcuaacacagccaaaguuuggcgcugucaccucgaaaaugaauucgaauugccugcccagcuccuuacauguguccacaggaguuaaaugagccugaaaacuguauuccugcugagaagcccauccuggcagcaugggcuggaagcccuccccuuugggaaugggccuuccuccuggcugguuucuaacagcacucaggccagagucccauagcuuuucugcuccgggguucuacaacuagaauuuccucugaaaugggcuguggcuugcacguauuuccaggguacugagacagaccgcugcuguucucuucaguggaggugacagcuacaagugcucaccaucacacucugauuagggaccugagggcaggguccaaaaacaaaaaguggcaagacaggcccaugacucagucacagagaugugacauaaauaauaauacaggacauugcacaggcuaugugcaaaguaagggccugacuggcuccacuagcucagagaacagugagacagugaugggccauccaggaaacagcagggaaaggggagagacuccucgggguuugaaaaaagaaccaugugcccccugaugacagcagccuccuaaauggaccccuugcuucuacucuugacucccuacaguccagcaucauuuaagaacauaaaccagaucaaaugauucuccccuucaauaauaaucagagcugacauuuauugagcacuuacuuaugugugcucagcgcugauccaagcacauugcauauauuauuucauuucacaacagcccuuugugguauuaauaucauccuuuuauuacagaugaggaaauuaaggcacaaacaggugaccuggcccaguaaguagcagaauuuauugacaagcucagguuucuugacuucagaacuccgauucuuaaccuauaacuccuguuccauguucauuccaugcccucccaccacacauggaauaaaaucuaaacuccucucugaccucauuuuguuccagugucucccaugcucacugugcucucgucacauucuucaagaacuccaagcacgguccaugucuaggcccugugcacuuguaguugccuuugucugcuuagaaaggauuucccuucucccauauccaccuucgaaaugucaggguggcccacgcuugauucucagcucucuuacuuuauucuacugcucuucccaaccagguggucucauucaaggccauggcuuuaaauacuaucuccuaugacucccacauuuauguuucuagccuggaacguuuaaugaguuccaaccaugcguguuuaauggcucaucuaaucuuuccucucgcauguguagugggcaccuauauuuaucacccaaagauaaaaaaaaaaccccugacuuguaacucuccuacccuacuucagucuguaaaguaaauagcacuaucauccagcugguuacucgagccaaaaaccagcaauucuucuuagcuucugagccuuugcacccaauccaugaacaaauucuaccugcuuccaaggcacaucccaaagggccuauuucucuccaccuccacuauaucaucucugauauaaaccacugugauaauuuugcuugcacuuuuaccucucuuuaauccagccagggagugacccuuuuaaaaguuaaaucagaucaugucauucccuugccuaauaccuucuaacucuaaugucaugcuaggcccugaagaccucuaggccaccgucugccucuuuaaccacaacuccucugccugcucaccaaugcuccgggcacacuggccucccuucuguuuccugaacaugccaugcucauccuggauguauggcuuuugcaaucacuauucacucugcuuagaaaacucucuaccccagguuuccccgggcuuacagcuucucauuuaguuaucaguugaaauguuaccuccuuggugaggccuuuucuaaccccucuaaccaaauucauaugcauaaauacuuucuuuaucauaccaaguuucauuuccuucucacucucugagaugucuguguguuuaauugguuuuuucugucucuccuacuagaguaaucucuuuggcggucugggucugaucugguuuguucaccccucuaucccccagugccuggaacuuuaucagggaucaauaaguaucuacugaaugaagagcaccauuuauuuagaagcucacaaaaugcuaauggaggagguaagauugaagacagaugauaaagcugggacuucaauccuauagucagugggaggggaauggauaaagaguaaaagugacgcaaacuuguagggagugggaggaagucuaaaaucuuccauuuguugaaugaccauaacccaggaggcccugguaauacacaggugaacaaaaccaaaauggccccuggccucauagagcuuguauuguagcauguaguuuaaacuuuuuuccccauuuuaggauggagcagggguaagcaaauguuuuacuguaaagggccagagaguaacuauuucuggcucuucaggccauauggucucugccacaaauacucugccacuguagugaaaaaggagccacagaucauacacagacuuggcuguguuccgauaaaacuuuauuuacaaagacaagcagcagguccaacuuggcaugugggccacaacuggacaaccccugggacagagacuucugucccuucuaaagaacuggggaguacuuuaggcuugucauguagagaaacaggcuuugaaucauaagaaccuuaagggucuuguggagaaaaacauagauuuauuauuuaccuuaaguuuucuaaagcgcuuagaaaacagugaguggaccuggagcugcugaccugggguuccugcuagucuuuuguuuuacuccuucccaugaaucaacuagcuuuuguaagaaaccucacaguuacauggauuugaauauacuuaaccugacaaagacuaacucaaaguggcuaaugccuauaccagaugguggaccugcccuuauuccacuguuagaaaggaagagaaugggcacuacugauuacuuguacugauuuaaguuuaagcuaauagcuuggcauuacccugacuucagccagggaagaaaaucacauccaaguuugcagacuccaugaaacauuggccauauauuuguuggcucauuagcuuggacauaaagacuuucuagaaagagaugccaucauuaggugccacucagacucuaggggugcuuuuggaaaccacugugaucagaaacguauauauuguuaagggaagagagagaguuguucuggacagguaccgagaggcagguuccaggaagcugaagccaacagaaucaaaccuuaacguacauaagccauuccugggcuuuguccauggguugccuuuguggugguugucugccugguuuccagggagccuucaauuagaauucugagcugagaugauuuauccugugugcuacauuagcuccauuugccauuaacauaaauaaggcuuuaguuacaugaggcaggcauaaaggguauguaugccuuccauucaugaaaacaucauuuuuucaaaacaccaguuucuucuuauaagcuaaguuacacuacccaaauauguaguaaucaguaauacagaacaauaaaaggccuugauacacugauccgggcauacgagguuaucaggaaauccucaagucagugucucuccccaugggaccaauccuguaccucuuuuuccuucaccuccauuuugacuugaaaugcaguagacaacagagccaguucagugccuugccaugcucccagcacuuagcacuguucgauaaauacaugagggauaaacaaauuguaaggaaacucccaucccaugagaggagaaggauucuaaagugcaugaccacacggacacacagguaacauccaucucuuugggaaaaggaguaaaauggacuuuccugaaacaacugcuaggcagaaggugggugaaagccacaagcauagccugccucauaguaguuccacgaaaguccauuuuaccccucuucccauagaaauggacacuaucuaugggucccuguguguggcugucuccugccaugucgcuggauuuucucaggaucccugacaaguagggauuuuuggucaaucuuucauagacacucuuaucuccucaaauggagacaccaucacuggcauugaaaugcuaaggugagaacucaccaagacacacuguagguaaaguuccagcucagcuuaggguuugauauguaacgggcccaauaaaugauagugauugguauuaggauugcuuuguucuuguuacagaugaagaaguagaaugucaguggauuacagugaacaguccaagcuacaaaauguguugcaacuggaauuugcauuccaugugucugguuccuucucuauguacaggaaugaaucaggagagcacacuggcucuaccuucuuccacucugacuucucagcuuuaaucccuggaguuccagggugguauggacugaaugugugugcccccaccacuuccccaaaauucauuaacaccacaauccaguuaagauauuuguuaguagggccuucgcagaggugauuaggguuagaugaggucaugaagguggagccccaggauggauuugugcccuuauaaggacaugaaggaccagagcucuuucucuccaccaugugaggauaccucaagaaggugaaccagaagcaggguccuaaccaacaccccgaccauguuagcgcccugauauuggacuuccagccuccagagccaugagaaauaaauguuucuguuuaacccguuuaguuuauauucucuuauagcagcuugaucuaaaacacagauaccucaagauggcuacaaauucuccucuaagugcuucagagaggauuagaagauaaauuauauaucuauuuuguuuucuaugcuaggccucuaugauauaauauaaauauaaucauuuguauuauaaacuagaauauaauacaaauaaaauuguauuauaaacuaccuuaaagaaaguccuccuuacacugaaccaaugcuaauguugguuaagccaauuucccuuagaaaaaggcauguaggaucuugaaggcauuggugggcugcauucccugcacugugagcaaggccugaccuagaaugaccuguaacaucaccccugucaugggucccaagcgcacagccaaaggucuucaaaacauauggguauccuuagcaaauaagagcauugcuaagugcaugauuaauaagccagaaaggcuauggcacuugacagacggaugaggcauuucagaaagauaagucaaagugcacugugaggugagugccucccuuaacuuucuuagcugugcuacucgguucauaaaccagggauuaaguccauuuucauuucaauuuuuuauuucaccuuuaagcaacuccuaaggcuuccaggagaauuuuguuugaccuuuagcuaaaguucaacuucuaccaaguuacgaauuuuggauggucccuaaaugaucacuuaagacagauuucacuauaauucaaagaaaggauaaucccuggcccaagaguucacaaaggaaggauucccaguggucccagagauggcaaaaguuauggauuucauccugcuaaugcauuuuagugauauuuucauugugcaacauuaauuaccaaugucagccuggaugcauuugcuggguauugaaaccacgacauuuuuuuaucucuaccuggucccagaugaagauuagcuuagugcuuccuuguguccuaggcccuagagaaaagaugcagccuacgggaugggguaaccuuggcaaguugccauuugcuucuaaaguuaugauagcaguguugaagccgucacugagacucuggugcucaagccaaguaggagcccuuugcuaucaugacauaugcucuagauuugcauuugucuaaaaucuagcuuuuaggagaccucucagagaugucucagggaggaacacucagaaaaugugaagaggagcaauggacagagacagagacuuccaauuuauagugaagaacagaccuuugaaguugacuuguuacauaaccugacuuaucuaccagaucugucugauuccuaaagaaguauaugaaaaucucucaauuuauauuucaaacuccugaccuucaggugauccacccgccucggccucccaaagugcuaggauuacagucaugagcuacugcgccuggccaucaauuuugucuaaucagaguuuuuuuucccuugaauuuuggauuuuguaguuaacuacuggguuguugugugccuguaauaaagauagaguuauuuuuguccacaaaaguugaaaacagagcugccaguugacaugaaaguacaacucauuuccauccacagccucuacauccauuaaauaaagagaaacucagugcucaucucacucaugaaucagaacaggauaucugcacaugccauuucucuaacuucccaaaugcagcaggaacaccucagccccgcucucucaguaucucaguggacuggaagcacguucauuuaagaggaagggcucauagcuuucugcagacaguucaauaccaugaugcauccgauucaguuucguccauucuauuucuuauugaucagcauaccucaggcuauuaguuuuauuaauuaaaugauaauuuuggggggugaguacacaaggagauaaaugucucacaaacagacuccaagcuugcaggcaggaggcaugcagugauuuacaaaguauuuaucuuucuggcauuuuuuuuucccccaggaaaaaguaaucaucacuaccaucuucuaaaaacagagaugcuuguuuucugggcaggcuuggaaacuagccaagacagcaggaagauugcuggaauuucaacacacuugcugugguaccauggugcuagugaccugcccuugcagauauaccuugacuccccacagaagucaccucaaagucucugcuauuuagcaaaucccuaggugucuggggaguagggguccagucuggggcugcugccucuucugauuggcugccuggcucugacucugaucccagaauacccagaggaauuuguuuccauccuccuggcccacaacucacacaaaccucuaauaguacacagguuauuaaaagcaaauaauagcugggcacaguggcucaugccuguaaucccagcacuuugggaggccaaggcgggaagaucacgaggucaagagaucgagaccauccuggccaacauggugaagccccuucucugcuaaaaauacaaaaauuagcugggggugguggcgcaugccuguagucucagcuacucgggaggcugaggcaggagaaucgcuugaacuccggagguguagguugcagugagaccaaaucaugccacugcacuccagccuggugacagagcgagacuugaucucacaaaaaacaaaacgaaacaaaacaagcaaauaauagugucccaauagaagcacuugcccuaccacagcccucucucucugccaucaccaggcacuuucugacauuuccaucuuucugacaggguuucucaaccucagucucuauugagguuuugggucagauaauucuuaguugagagaggugguccugugcauuguaggguguuuggcagcauccuuggucuccacccacuugauguggugagcacacaccuccccauccacaaacaucuccacacguugccaaauauccucugggggagcugauuugccacaacccccacaccccaccagugaaaaaccaaugucuugggacaaguggaaagugaugggggaaacugaaaccucccugacgcuuugguuccuguaaggaaccacaggagacuacaucauugucaccucucccugguuugcagacauuauuucugagucaugugaaugaacuagaaaccuuaaauaggaagucagaagggaagcuggggaggagaguggggaccgaguugaaagaugauauugacuauuuguacuuuucaauuagcacaggugcaacgcuucaggauucuuggccaaaaaaugauauaaaaaugauuggaccgaccugcucuuucuaggguaaaggucugugagucauaucacucagaaaacauuuuugagcaccuaugauaucccucauccagucaaucaagagauuuaacagauucuucuucucucccucccugcagccauucuucuaggucuugccacuauuuucuuccuccuggauucucccaagagccuauucucuaccuucuaccagccuuguuucucaguauccauucucucacugaaggugaguggucuuuuugaaaugcaaaucagauggugcuagucagagggugcuagucagccaucugcuagcuucccuggcuuuccauucuuuucggauaaaaucccaacuccuuaacaaggccuagaaagccauacauugccuuuguuauuucauuacuuacaacugugugguccaacuccacuggaccagucuugccugguuccucccagagugugggacacuaaccaccacuguguagguaggcacagaagguggcuuuacguagaacgcagucacgaccuuaaaaaauguugaaucacauagugauucuuuagguucaacauccuuuuucuuccuugugcucucuccuagagaaagucaguucggugcuccuuuguccuuccugcaccaaggcuuauugaucaaccuucuuguguuagaaaagaacaagccucaggcuccaacauagaaucuaguuggcauuuaauaauacuauuuuauuuuugauuguacuuacuuuuacaguuaccuuuuguauuagucuguucuggcacuacuauaaagaaauaccugagacaggguaguuuauaaagaaaagagguuuaguuggcccauaguucugcaggcuguacaggaagcaugaugcuggcaucauggggaggccucaggaagcuuccaaucaugguggaaggcaaaguggaagcagacaggucacauggcccgagcaacaagagagagagaggggaguugccgcacacuuuuaaacaaccagaucucaugagaacucacuaucacgaggauggcaucaaggggauucaugagaaaucugcccccaugacccaaucaccucccaccaggcccuacccuucaacacuagguauuacaauucgacaugagauuugguggggacacauauccgaaccauaucaccuauuuauggcauauuauaaauguuuccaguauaacauuccagaagugauuagugaugcaaucuugccuuuuuuuuuuuuuuugagauaguaucucacucugucucccaggcuggagugcaguggcacgaucuuggcucacugcaaccucugccuccaggguuuaagcaauucuccugccucaaccucccgaguagcuggguuuacaggcgugcaucaucauacccagcuaauuuuuguauuuuuugguagacgugggguuuuaccaugucggccaagcugguaauuccaagcugaacuccugaccucaagugauccgcccaccuuggccucccaaagugcugggauuacaggcgugagccacuacaccuggcagcaucuuuccuuuuucagugcauguauucagguagaaaaagaaaguuuacuugaagaaacauaaauaguaguagcaguaguuucuagacauggcaaauaccaggauuaaugcuugguauuugggaaacaaggaguuacuuaaauuugcagcaugcucucauaugccagacguccuucagccaggcuaagaagguggagugggcaggaguaggagacauuggauuguuccuuguaaucucucaugcaaucuuuggaguuugaugcagaugucaccccgccaaaauuugagucagugccccaccuaugcgcuccgcuaauaccuucaacaccccgcuuagaggaucugucauggcgccugugagcucugagaucaugucuguuguguucacuguuguuucugcagugucugacaugcagcauggcagaauaaacaagacaccagguaaauauaucuuggcuugaugggugaaauggggguaaggagggaaacuuaucauccuuuucagccaggucugggccacaccaaaagugaaaggcagaaugagaugccuagauaauccgugccaauaaagaugcugacccaccuccuccuggacaacagagacaaaagaguuaauaaugugaauuacuuggggugcagcuuccaucucccucaccacuuaaagugucagaauuugacccccacuggcuaaugcaaaaaacacacagaagcuggcaagacaugggcuugcuugucccuccucuuucuuucuaccuggagcuuuaccuuuacaaauuuguagcacuugaagguauguuucccuagccauuucuggaucauaacaauuccuuuuuccuacugacaaaaucugaaacuuagccggaagcacucucuugccagggaaagaacugugucagacgugcgaugcgugauaaaauacuacgguaauguggaauaaugcuuucaacuguugccagggugagcaugcaugcagaaugauggaaauugccugcaaauacaaaugguugcucuguggcucaucuguaaccucaauguaggaaagcggagauauucuuuucccuccuuugcaauuugcacagccucuuguuggaaacuauggagauuaugccauugaaaguaacugccauguuuacucaacacacaauuuuuacuaauacagucuccccauguagucaucugucuugugagguucccucaauacuccagcuguuccuguggcugcugcugcgaacaccucauugaagaaaucaaggugccaaacccaaaugcuuuaugugaggguguggaggucauuuuugcauugcugaaaaugacauccacuuucuaccuuagaaacaaaggcugcauaacugaaugggauucagugcaccccuacccccuucucaguggugaauucaaugggaauuaucagagggcuggucuguauaacuagaaaagccaaaauuguuggguguuuacuauguguuagguauuuugccuucuuuuaggugaaccucauaacaugcuauaucauaaauauuauccuccucauuuugguguugaaaaacugagagucagaaagguuaacuaacaugcucaauaucucccagauaauaagugaccaagccaggauuuagucccaggucuguaugacucuaaaucuugaauuauuuccaugacaaauaauguuaaacuaaagccagcauuuuucucuuugaguugugguuaaacuuucauuaucuguggccuuuaagcauuauuuguugguuuucacguacccauaacuaucaggauacaugaaccaaugggaagucacguccucaugaagagccaguagccuaaaugugaaauuucucaugcauaccagaagcacaaggggcaaaacacacacacacacacacacacacacacacacacacacacacacacacgucaaaggcuucucccucuuuaugaaaaguaaaaugccauuuucuuuuucuacaaagggaacaagauaauucauucacggaucucuugauuagcucaauuguucugagaugauaauaguuaccauggauuagguacuuacuacaugccaggaaucaagggaagcacuuugcaagaaggauaacauaauauuuauaacccaaugauguaggcacuacuauuagucccauuggacaaaugugaaaacugagguuuagagauuauguauccugccaaggucacucgguucaguugggauucaaaccuaggccucucuggcucugccuccauguucuuaccugcuauguuaucuuguuuucuacaaacccuuccuagcuaccaucuaugugcuggauaaauaagggaaucuuuuuaccguagagugaaaaugagaaguucugaggaagugacauaguguucuaggaagugcccuccuuuaagaacaaaguaggcugguuucucacugccaaucaaagugugacauuggcccuucuggggcucaccuuucuagucugcaaauugaugguagcaaaggacacaauguguaaggacccuuccugcccuaacguucugucauucuauuaaccacauuuuccccucucccaucauuucuccugggcuuugauuuucacuuuuucauggccaguagaagucacacauacccaaggcgaggcugcccuccucuagugaacugcaaucauuugaacauccugccucaauugaaucauccugacagcuaucccuauggcuggccagucaacucccaagcacuuccuggaaaugcagaugcuguauccagggcagaaaguacuuccccugucaucucacucccucucugggcuccagccccaaggccuuuuaggucuucagacuggcuccgugccacccuugcaccagugcacaugcuguuccucugccuggaacacauuuucuucccugccuccugugguuaggggccaggcagguuucccuaaacagggcuaaaggcaggcuacgauccucauucuagauuggcccucuccuauacaguacuucucugaauuggucccuauuuauucaguuggaucagugucuuagucuuccacuauacucacccuugugucccugcacccagcccagggccuggcucacaggaaccucucaaaaccuguugguagaagaauuugcacauuaaccugccacccacaucuguguucucuuauugaugagguacaagaaaggaagaugguaggccaauuuacagugggguuaugaggcuaggucuccucucagcccacuaaugucucagaaccacguucuuugcugaguucauauguuuuuuuuuuuuaccccaucuccaaacagcaaguaaucuugcagaucaaugccugagaccaaagagacuuaugaauguuaagaagauuaugcacauaaauguaccacuaugacagccccgcuaagaagaauagugauaucgcacugcgugcuaguuuaucaaccuuugcuacuuaaaaaauucacagccaauuuaauuaaaaauauaacagcucugaaagcugcuaaaaugacuaugacaacaaucuaucauuuuguaauagugcugaagauccauuagggacuuugcacuggaugccaacuuuuuaaagcccagauaguaggggcauuucauucugcacaauuaaugucacugcauuuaaaauauugacuaucuaugaagaagaaaauaccaaacaucuuuauaacccacauuuuuuauggucaaaacuugcuuagaaaggugcuuugaauuuauuuguuauaagcugcacauuucacguucagaaaauuaaaaugguuucuacugacuaacucauuuaaucauuuaguugauuuaaugaaaaacacuaugcauuuuucucuucuccguugcuaagauuaauacuuucuguucauuagcaaucaaauauugcaggaagguuuacaucuuauucucacuuaacucauugccuuuuauuuuuaaaaaauucuaauagaauugaaaugguaucuuuuaaaucaggaauuuuccucuugguaacucguuuugucuuguggaaaacacauggcuagccugugacauugaggcauuuaugucugaauuguuuuucuagucuuuuuaggggaugcauuauagggaggaaagggaguggacacuuuagaaaaauuaugaaucuaguuuucagggccccuaacucauuaauacaucagugacauucuagcauccuuugaaauucuguuaagaagggcccuuugauuuauuagugggauuuuaugagcuaccugggaaagugaacccauuaaaaauguuaacuguaagcaucuggcuuccauugaauaaagaaucgaagccaccacauaaaagugacucugcacaaacauggcacuccucucccaucacucccaaagcuucccauuguaaaugccacuucaucacagcagugccauuugcaguuguagucucaucucuguuauccacugcuauuuucaggaguguauaaaugagcagcgaaauuccucuccccuggaaaugccuguaagagcagauucuaaaaugggaacuuuuugugacaagauuggguacaaaauaguauaauuacuguaaauuguucaauaauagggccaguaguuuaaaagcagcauuuccagauuuccuuugcuuccauaccaaaaagcauuuucuugaaccccaauugcuucauaggaggaaauaauaaaaggcaggugauagcauuuuguacuuagcauagauacaaugguuuaaggacacggugcacugagucaagaccacuaagagguagagggcaaauuaaccauuuggacaguaggaaaaggaggcauuuuaagguggcaugcaaugagccagccagcuaauuauaguaagagcagcuucccuaacuuuuacuuucuauuucaagguguucauugcuucucucucucucucuuucucucucucucucucucucucuguguguguguguguauaaaucaucugucuucaucauugcauuauugauauugauugauuguaggaggagaaaacaagaauuuuuccauuuuauaguuaggaaaacugaaacacaggcaucagugugcuguaacccuacuauaaugcucuucucuuuuuacgcacuuaggaaaaggauaauuuuuuuuuaacauuugugcaauuauuuaauaugugucuccccaacacuguaauaucuaugagagccaaaucacuaccugucuuguucaucaucacagucccagcacuaacauagucccugcuauaugguugguaggugcuaaguaaacuuuuuuuuaaugaaugaaugaauauuauuuucugaggucauuccuauuggagcauuaguaaagcaggacaaaacuccaggucacauuccuguacuauuguugaacuucuauucacccuucaggacucuggugaaaugucagcaucuuugggaagccuuucugaguucucccugacuuugccugggcuccauuaaugcuucguacuuaggccuguuguguguuguuucuuuugcuuccuucucuucacggaacuacucuuucauguggguaauuauccuguuccucaggcuuuggaugggguugacuccauuucuaacuggccuugggauggguucauaauccagaucuggccucucagggaacccuauccuucuggccaugguuauuggcucagcaaugauccuguagcuuaacuugggccagcauggucugugcaaaguuuuuauaggcauuacugaagcagcggggguggggugggggaaacccacaaucuuucuaccauaagcuaguaggaugugagccuccggcugcugguguucgcauuaccuucccugaggagagguugccugagagaagcagagagacacaaagccccuaaugacauugcuugugccccuggauccagccgcgccugaaucaacaauacuauuagacuuuucaguuacaugagcuaauaaacucguucucauucucuuaaggcucuuaaggcagguugaguuggguuucuauaacuugcaaagggucucuaauuucucuauguugcagucuauugagcauguacuccaugaaaugugggugauucauuucuguauucccaaugcugaguauaggccuuguccuuaguaaaggcuuguugaauuaaaaaaacggugcaauucuagggcaaggacauuuccacaaggccagguauuuuggggaugacccugucaauaagggcuauguaucuuuuggaucaaacucucauagaagaaggaagaccucauaaagacacccagaaaguaggggcgccaaggucaaccagaagagagaaaauggccuucagccagucaaggaguagcuuacggcagcuaagaauaagacagugggagcugugcagccccagaauggauuucccaugccugguuuuaaucauggcuaugguagucuaugucuugguuuuaaucauggcuaugguagucuaugucuugguuuuaaucauggcuaugguagucuaugucuugguuuuaaucauggcuaugguauucugugucaaauggaaugacuaauccuaggugcuuuggaaauguuaaauuguucauaagucccuuagagcuuuguuucuccuuugaaccccauggaggguuuugggccucagaacagguauauuaaaccgucuccauuucaacugguaauugagggccucucaaagucuaccuagaagagaaugucuucuacuauagaaagaaacagaugaugcaaaauuuugauuuuuuaaccuaaaguuugguccugucuggcaaaacaauugaagaaacaugacuuuccaaucuauuuggaaggugaggguuccaaguacacccucacugugaucugaaaauugugaaaaucuguacuaaugagaagcuuaggaaucaccuagaccuggguuuaaauccuagauuugccacauuucugggguggugggguggacugacaggcccugaacagacaacgucuaugagcccuaguguuuucauguguaaaacaggacuauacugccucacaaagauuugaugacaauuaaaggaaauuacagauguuaaaugcuuaacaagaaucuaguacauaguaagagcucaauguauauuaacugucauuguggugacaacaaucaugauaauuucaagcuuuuauauccaauuuuguguuggaugcuucauuagguaggaaugaacaucucaaacauauuuguccaucuaucauuauuucuauauauguuguucacccaaccaucauaucaaauuccuguuccuuuaguuuggagguccuuauuuuuugggggggggggucaugaaccuccuugaaaaucugaugaaguaugggugaugugcuccucucugaagcuccaauagcaccucacagguuccaccuuaccccacuguaccuccauccgccugcacugugacugcuuguuuauuccuuuuuccaggcucugggaggucagggaguguaucugcccagaucaucauuuucuuuaccuugcuuagcucugugccuggcagagaauagguguuugauauucacugaaugcauaaaugaaaauugcaaagccuucccccugaccccuuaaaaauucaccuacacucaaguuuuugcaucuaauuucagacccugucugaggacuccagguaagaagcuacuauuaaugacuaccuauuguaggucauuaaaaaugcaguagggaaauuuucaggccaaauaaugaagcagccuguuuuucaggccaacuaaugaaacagccuuaccacaggccagaaagaaaguguagaucgucuucucaagagaggaaggacaaagucagaauugacacuguguucgugaugaaggcaaccuuuguccaggucccuuguuuuaccaaagacgacaagaggagccagccuugcccaaggucacauggccacugguaaagagacuugagccuccuggcuuccagaccagugcucaucaaacucaaaccuucccccucuuccccucucgcacugccuccccagaagcucaguccuugcgagaauucaaugaaaauuuccuuccaagcaugguccgaagacaauguaaggaaaugcaggauuuacaugacuuuggucaagugaggggacaggacuuuaaaccaaagaguugauuuaaaucuuuuaaaaccuacagagugaagggcuugccucauugccucauuugaaagaugaaaucauucugucuuuauuuuucauugaugggaguuuggcuuuggagggaaaaagaucuggcacuugagagcuggcccagugaggauagggguugucauuuucuccucacugaggcuuagcaaugccuuuagcuaaggcccggcccauguauccccaaaagugacaaagguacaguauuucacacaggaacacuuggggagcauuuuuccaugggacacggcgugagaauccauuaaucucacugccacauacucaggcuauuucucacaagcuuagccagacauuuggguuuuuuuaaaccaugaaaaaaagagccuuauccuccucaucauaccagauugcuccagcggauaaacaucagacaugguuuuuagagaaauaucacacgaucugagaacaucugcaauucucuagaacguaccguugucagaacuugacuuaaacgaaacaacagacaucagacuuucuuucagacguuuugcacugaagcuuuccauuauagcacgaaugccuccuucugaaauggcaccaauugaaaacgcaccaggacacgaacauuaccacaacucaaauucagauacucgcauguuauuaacaauggugcuaauuccuguuucagagaugaaacuuacagaggagauaccaguggguuuuccuccauugcuacuuuucauuugcuauggaggccacaaauucaagagaucacucauucuuaaauuaacaaaaguagccaccaccuggcaaaacaucaggcccugugcaggcgcuuuauaugcaccuuuauauguaucgccucuuuuaagccccucagugguccucggagacagcugcuguuaucuuccaugucauacaucagggcacugaggcccagagcccaagugauauuguaacagcacuuccugugugcuaagcacucuccaugcauuuuauuuauaguaucucauuaaaucucaccaaauccuuugaggucagagccaucauaagcuccaaucuacagcugaagaaacugagacagcucucaaagcuaggccuaguuuccuccaaaguucagucacauuuguuccauuugacaguaugagggaaggccuuuuuuugguuaagcguauagacucugcaguuaaaccuccuggacccuacccuuguuagcaguaugaucuuagauaagcacgaguuaacuuuaccauggcucaguuuccucaccuguaaaguggcauaauaauggaacuuacuuacuuaccucaaaggaugaagagaaugcaaugcaaagcauguagcauggggucuagcauacaguaaguucucaggcagucauuagcaguauuaaaaauaauacuggccaguggcucaugccuguaaucccagcaccgugggaggcugaggcaugcggauuacuugaggucaggaguucgagaccagccuggccaacauggugaaaccccgucucuauuaaaaauauaaaaauuagcuggccauuggugggugccuguagucccagcuacuagggaggcugaggcaggagaacugcuugaacccuggaggcagaggcugcagugagccgagauugugccauugcacuccagccugggugacagagcaagacccugucucgaaaaaaaaaaaauaccauaacauuuuuucuucuuauuuuuauauaaaauaaggcuguauucauaaaggauacagggauuaaagcaaaccaaaagagaagagugaggguaaguuuaauugugugauaaggauuuagguaagacagccuaggcaacauggcaaaaccucaucucuaccaaaaaauacaaaaaugagcugggcacgguggugggugccuauagucccagcuacucaggagacugaggugagaggaucaucacuugagcccaggaguuugaggcugcggugagcuaugauugcaccacuguacuccagccugggcaacagagcaaaacccggucucaaaaaacaaaaaauacaauuaauaaauaaaaaguaaaaaauucaggauuaagguaagaggugccccgcugugcagcacagagcuccaucggauuggaaaaaguggcugccaggggaugccuccccuuauuaguucagacaggcuuauguaccggucuccuugcgggaaguccugugcugcucagcguugauggaacacacaaugaacuuuuccuugcuuuugucucuaccagaacucgacugagugcgcccugcugugugguuuuaucccuggucuugggauagguuuccauggcuauaggaaagagguggagacagggaaugccaccuucugaguucaucagaauagaagugugcaccugcagcaagacaugauucucccuaauuugcuuucaagacaaaacugugucuacugauuggguagauauuguugaggcaagaugcgguaugucuagccuguguccaacacauauggcguuaggucauuccuuucaucuccucuaauggugcccaguacaaugagaaugaaaugcaaaucccuuacccuggcucugggccacccagacccauuugcgggucucuagcaacacccccagacccucuaucucucccuuggucacaagggcuuccuuuccucuuuaagguccuuacaccagcuccuccuuugccugugacacucuguuuccagguuuuucauguacguucuucuucuguugggucucuccucgaaugucagucuucaaagaggccuuccuugugacuccauaaaccacugcagcucucugauucacuuccuuacucugucuuguuuuucugucugcuaaaauagaacugauaauccucguccuccuucucucacagcauuucuuugaugagcaaaugagauucauguguaugugucuaugaagaugcuuuuauaacugugaguaaucaccagggaugcaaaggaggguucaauuucuaugucaguucacacuggguggguuuuucuggguuuuucugaagcacagcccugagaugaauuccaagacugcaguauucucagugacaaagggugcagcaaucccuuaaugaugucugacuugggagagggaauuagaggcgugggugucacauauuugcuaucugugccaaaaauaaagucauauauuaauagaagcccaaaaucaauaauuuacaaauagcuuccucaaacuuucaaugguacuucuggaaaagugagauuugaaauuuuacucuccuuccuuugcacucuaaaaauuuauuccccugauauuacuuuuauauuaaaaacuaauuagaaaacuucauagguuucaucauauauuuaacaucauugcuaaaguucuaacacuauuuuuggaaaucaucaaaagagaaaaguguaagacagacaaggaaaacagagaaguuuuccauguuuaauauuauaagucaccacaaaguauuauuuugauauuacaauuuuuuuuuuuuuuugagacagagucuugcucuguagcccaagcuggagugcaguggcacaaucucuacucacuguaaccuccgccuccuggguucaagcaauucucaugccucagcuucccaaauagcucagauuacgagugcccaccaccaugccuggcuaauuuuuguauuuuuaguagagaugggguuuuacuauguuggccaggcuggucucaaacuccugacuucaugugauccgaccaccuuggccucccaaaauguugggauuacagguuugagccacugugccuggucuuaacaaauuuuaaaaauagugauaggcaaauacaucuaaugaaacuagaguauuauuugucauuucuuuggaugaaccaaugcauguaaggaggauguaguucuggguuucuccuguuucaucacacaguaacccaccguggcucucuccuccaugccgauauuauauaauugucaaggcauugagacagauuuuaauucauuuaauaauuaggucaauaaaaaccauuauugcugacagugccauuaaaaguccauaaugucaccuucaugggggaaaaacuaauauaguuccguuggauuuuuuccgugaaauuaauaugauagcauuucagugggugucuuaaauagcuuaaauagacauuuuuauuaacagaacuaaucauagaauuaaaacaaaugaaaaucguuacauuugcugugaugagguauccauguucacaggauuuuaucagccucauuccugugaagaaccugaacauuuacuaccacaagaacaguauauucaacuugccuggagcacugcuuagggucccaaagaggcugcccauuuguguuuuggugauuuccucuucaacaccauggcuccauuucucagagccacccuacugggaaacaugccagaaccauaaccuccuaaaccaaaaaccuucuucauguccccuuuuuggcugguaguauuucaucuagaauaucuaagacaguauuucagcucagaaaaauacuaaagcagaagggguugcaccuacgccgcccagcaauguuuuaucaccucuccuuccucagcuuaaucacuaacgguagauagaucuuaacaugaacuaagguaaacucuaguauagugcuauacgauuuagguaaauucucacuagaagagcaagauagcaggaggaaagaagauuauaccaagaguuuccucucagacacaugaaugcuaugguucugugaguuauucaaaugugcaagucacuguguauggcugcaucauugcugcuuggguaccuacaacucuucauaaucagauauaccaggauucacaagaauucagggguggucaauauugaucaaaggccaaggccacagauguagcuagcacauuauacacugacagaacgcuugcuaauguacacaaagaaguagcggcuggagccugugaggcugugcaaacaguauaggcuuuggguuugggaagacccgcauuagaucuuaguaacuugguucccaacaggaugaccaugggcagguuagcucccuucaguuuucaguuucagcaucuggaaaauggauugaugaaguccacaguuguuugacucugugguuuuuaggaugguucgaaagagauuucagaugaaacauaucuaacaaacacuguggcuggcagagaguaagggcuauucuucagaggaaagagucaucucaguuggcauuggacguauuuaaaauaugauugggaggguagccucugcuaaccuccagccacguuggugaacucucagaaagccuugugcaugcccagacaugcugaaucuaaacaaaccaaagggaagcugcacuucuccacugauuacucccuuuccugcccuuuggaagauucuagaaacacuaggaaaucuacuuaaauauuuuuuaacucaguuuuaaacaacaucucucagaaaauaccauucuuaguagaauaaaccuucuuugaaggcguacauagacuuacauaugugauauuugcaaccaaucagcauuuugggugacugggcaggucuugggaagugggaggcacaguaaaaaugaaagacuuuguuugaccucccugaguucuaagcaagauguggugccugagaaagcuuaugcagguccuacugggcaagacuauaaagccaagcgcaacagagaaaaaaauaccuuagggcacggacguuugguuucucaaggccugugauggggaaggcccugaaacuccccuaacagggauggaagaaaucuguggauauuuuguucaugagaaguagaggaaaaggggaggggagaaaguggaaacagcaacgugucuggaaaccagcuggcaccugugccuugaaguaaauaaauuggguaaagaaauaugauagcuagauaguccuagaaaugaacauccugaaaucaucccauaaacuuuauuuuggagggggauagggaagagaagagacccuuucuuccauuuauuucauuuaguuggugauauuauugggcauuaacuugggauucacuauuccuguggcaaguacuuaccuuugcugaaauuaccaaauauucucugaaacagacucuuaucagaaaauugaucuauaauacauaacggugucuugcaagaaaaaagucccuugugggggcgauuuuuuaaaaugguucacugcaggccuuucacaaucacauggaaauuuggagauugcucagauauugugggaagaggagaaagggaacaaagagagacauaauacuugagacuuuacaggcuccuaccauuuucuagucuauucgacaagagcagcagagguucauaucaaggaagugaaaaccauucaggaauacaaaaauuguuuacaaaaaacagccugugcuuugcauucuuuucuguuacuucgacaauugccaagaaguguaacugugcuugcucgguauuauuuaaauuaaauuaucaaaugcaaaugcuaaauaugaaccucucagcaaagcacuggguuauaaugccauguccucuauucagacuaaaagcugauuacugguucuggaguuacaaacaugucagacaauaauuuaauugcuuugcagguagaggaauaugcagcguucuuguucucauucuggaacucaacacgacucuuuaauacaacauaaugaucauaaacacacacaaagucuucgccucacaccugcuuuaugguaaaaagaagcuauugcaaauuucugcaaagcucaaagaaugaggcagugccagauuuuuuaaucacuaagcaaaacagguuucucaccaaguggcccgggcuuuuacuccugguucagagaguuacaagacacauuuucaaaaugaguuuaaagcuauaaugaauuucaggugcaaaggaccaccgucuaacagcuaauuugcuuccugucuucaacugagcuguuaaccauaggcagccagcaugugcaccccuuucuugggccacuggugaagacagaugucacaaucaauacucauuaacucugggaucaguguguaucuuccucaggaagagaaagggggucuuaaauguaacuaggaggacuuuguaagcauuuucugagcauugcaguggcugaguguuaaaccacaacaggacaggagugcaggagggggagagaagaaaggggagggugagagagggaagggaagaagaaaagaggccacauuucgugaucuccucugucucuggagcucuuuuuuaucagcucgugaaauucccaaggauccugaucaucucccccuucccagcucaucgcaaagaguuguuguacauuucuuugcaauuggguagggaaagaucuugaaagguggauccaacuugaacauuagacuuuugugaaacaugauacagaaauuguaguguugcagagcuguaccugcucauuugcugacuaugaugacccaacauuuauugagcacuguaugccaggccugugcuaccucaaugcuucaccuggaguaccuuauuuaauccuuauggcaaucccauaacccuauaggaagcagucauccuuuuauauaugaugcacauaaaacugucugaaaugauuugcaccuaauguaaugaugguaggcuuaaaugcuuucauuuuuguacuuugcuguguuuuaacaaguuuuugugauggauuuguucuuguuuuugcaaaaucaagaauaacuuaaaaauaaaagacuggaugccaauacaaaucucccaagauguuaaccuugguuaauucugggugaugagaacguagaugauuguuauuuccuucuuuguacauuucugaauguuuaguuucccuauauaagugaaaauauagacuuuaaaaaagaaaaacaaaagaagaagcccuucacuagugccacagugugaggagaaugaagccuaagccuaaauuuuauuaaacagcagggugacccaaugcucuguaucaaugcuagauacaccaccaagcauucgcuacgcauaaucccaccagcuccuuccaacaacucugggagguaggugucaccacccucacuguacagacaagcagagugagguuucgaguggguaaaggaccagcacuugaggucacucggguaucuggccuccacuuacccuucuggccugaggcuccauggcaugcccucugaccuuugcucauacccuggucuccagccgccugaguccuugucuuuuucugaccacaaccucaaagucccuagguccauaccuaauguucacacucucucauuuacuuggaaagccauuuuccagacuacacccauucuuccaaacguguaucaaauacucccccuuccacaaagauucucugagucaccucagccuuaguguauucaccuugguguaguauaugccacaggcugccacauggcaggugccaggccagcucaggcacacugaaugcucuguauggcuuaugcaguguuuaaaagauuuaaaaaauaauuagacuuguauuaaaaaaaaaaaauguguaccuaguggcucagguuccccuacccugcuuggcaauaauuaacuguagccaaagcgucugcccuauucagacagaagccugugugugcucuaguucccaacaguuuccuuuuaauacuccuucuuauccuuggcccauuucucuuaauucauuguugucaggccucugagcccaagcuaauccaucauauccccugugaccugcacguauacauccagauggccugaaguaacugaagaaucacaaaagaagugaaaauggccuguuccugccuuaacugaugacauuaccuugugaaauuccuucuccugacucagaagcucccccacugagcaccuugugacccccgccccugcccaccagagaacaacccccuuugacugugauuuuccauuacccacccaaauccuguaaaacggccccaccccaucugccuuccuugacucucuuuuuggacucagcccgccugcacccaggugauuaaaaagcuuuauugcucacauaaagccuauugguuugguggucucuucacauggacacgcgugacaauuguuuuaugugcccagcacaucacagguguucauugagggccagaaacuagucacuucacuacugcuauaauccuagggagagagaaugguggucugaauuacaagcagugagaauagagaaaagauauuccaaagaaucuguccucugaaauuaggggcuuuauuuauuuauuggaacacuuucuaucuugaacuguagugauacggguauacaucuuaccuauucuacuugacugacugcaucccccugaagacacgugucaggugccaugccugcccugugauauccccagcgcugccuagcugaauggugcauacauaccaggcacgggaugaauguugguugacugaucauucauuuuaauccugaaaccuggcguuuauguuuccgcuacauuuaaaagcuggcaaaacacaucuccuucccucccacucacucaauuaaaagcucaguacauuaauuaucugaauuaaagucaagagucugagauaucccucccaauuuauaaagacagggacgagguaaauuuuuuucccaaguuguagggacagaaagaagacuaaagaaugaggaccuuacaggcgagcacggggccagcgaaggauucuguuuuaagaucaucuccuggugcucauuagugcuguugcucuucaccugggugagcgggcuugcuuccauggagaagagaccuccgccagcuccugcugcauuaacggucuccgaaugugauuuggcggcagcacgggucucauuagagugggggaugugcaaaggcagaaggccucacuuugagaaaacacuuugcguaugaacaaagguggaaagaugucaggcuuuuaaagggaaccugcaucucgcuccucacuuagcaaagucaucaggagauucugcuaaguaaagaaguucuggaccuuuucaagcuauuaaaggugacccaacaaagcaaaauggcuuuguuccccaaauuucuuuuugucaguugccuugaacaaccaagccugaacgaaacagccuaagggagauugccagguaauaauaaaucccuauuugcuucaguaaaggacaucucaaagaagggauaaaauaaaaaauaucagaauuaaagaggcacaaaaaacccugaacauccggggcauguagaugcucgguagcaaugaauguauuagguuggugcaaaaguaauagcgauuuucgccauuacuuucaauggcaaaaacugcaauuacuucugcgccaacauaauacuuggggccugguucucagggguagggcuuccagcauuuuaaguagcagucugccaucaggcaagaugugcauauucaucauugauguggcuugaucaugacauauucuguuuucuugagcaaggaaagaacucagcaacaucucgcagagcgaccaucagguuauguccuugucucugguucauuugaggagaguaggaaauuaugaaacccacaagaagaguuuauggcuccuccucacacuccuacacuuaaauccaggaagagacugccaggcgucggucaaguuugaagauauuuaauggacuaugcauuaucuacacugccccauuucaaggucaauagcugucugucucuuuaucccauaaggcuagguuuucccuugaagaagaagguacugcuguuacugguagagggugccuauguucuuggcaucuugaagaacuggacaaaaugcgcaaacaaagcaaggaaagaaugaagcaacaaaagcagagauuuauugaaaaugaaaguacacuccacagggugggagugggcccgagcauaggggcucaagggccccguuacagaauuuuugggggucuaaauagccucuagagguuuccauugguuacuggguguaugcccuauguaaaugaagaggaugaaguaaaguuaugaagucauuuacuuggcguaugcccuauggagaggauagccccugucauagcucaagugugaaucagccuuauguucccugccugcagacccuauuuuccugucucacugccacuugggucuccugagaaggcccuuugcugacucugccuucugggaacuggcaagucaggugaucucuggagcugccccacgguagaaagugcagagcgaacagccgaggacugucaugcacuaagcauuuggggaaaccacccuuucucccagguuggugggcucucucgagacagguaccuguacuuacuugguauuggagugcucuaaucuuagagucuaguguaggcuucaggggagagggagcuaaggcggccauucuguuugcuuuguuuccaggccuuggguuugucucuagagggagaaagaguccuccucugucuagcuugaagcagugggaggcuguauggggcacggaauaagaaacucaaagugucccuuuccggcguguccugcucugugggcacuuacuccuucagagcuugugaagacagagauaaaggucagucaagcccaggaccagguguugggauuguucuuauccccaaguuuucuaauuucacuaggaauauuaaaggcaauuuaaugcaaucugcauuuuaaagauaaaagugauggaguucaggacaugcuuccccaaaauauggcaccuuggcauagugaauauuuucagcuaaaggaaugugagaagguaacagaaguaggaaggucuuucugacuguucgcucccuguuuguccuugcggcagguuagaagacccucauuggagaggugcccugaagaaaggaauguucuuaucucugaagacaaagggucacagagaagaaucugaacaaaacucugugcuaaguguccccaguuuauugccauuagacuacauccuuuuugaccuagaagcuccaccuucaaaguuuuuagguagccaugaccagucuaacuguagaaauggaauggaacauuggaaagacuguaaacuuggagcucuaagaacuagguucaguuuccuccacuuaucagcuuuguggccagagucaaauuuugccucucugugccucaguuaccuuacuacaaaauuaggacuauucugaggcuucaaugaggguuaaccauguacugagcaugaugcuggguaugcuacucuguagacacuacuucucuccccucuccucuuuggugacuuuuaaagaucauggggaagcugggcgcgguggcucaugccuguaaucacagcacuuugagaggccgaggcgggcagaucacgaggucaggagaucgagaccguccuggcuaacacggugaaaccccgucucugcuaaaaauacaaaaauuuagccgggugugguggcgggcgccuguagucccagcuacuccggaggcugaggcaggagaauggcgugaacccaggaggcggagcuugcagugagccgagaucacaccgcugcacuccagccugggagacagcgagaaucugucucaaaaaaaaaaaaaagaucauggggaauaaucuacaugaaaauggauguuguaaagccuaggacauuacauguguuauguggcaagagggguaaaugguagaguuaauuuuuaggccucucuuaagccucacaaugguucuaauuuuguaauaagguaacugaggcacagggagacaaacacuugacuauggccacaaagcugauaaauggaagaaacugaaccuaguucuuagagcucuaaauuuauacucuuuccaaugcuucguuccacuucuacaguuagacuggucauggcuaccucaaaaccuugaauguggagcuucuagauccccagcggcaauucccaucaaggagaauuuugccugcuugacucucuccuaccauccacagucauuguuacugcaagugaguuaaagcaguugagcaaaucauauauauauauauggguacaggguuuauauauauauauacauauauauguauacauauauauguguauauauauguauauacauauguauauauguguauauacauauguauauacauauauauguguaucuccccaguguaugggguuagaaugcagcuguggaacauggggguguccucuuagugacucaaaccaaauuaucacuggagaaacaaugagaacaacaaaaucaaaugcaaaccaccaaaauacaaguguaguccucauaucaagaaaaagauaagggaaagaucuucagaaagccccucuauuaauuauuuagucucagcucagacaguuccagaaacagaacagugauaaacaggaccauugccauacuucuggagaugaggaaaacaccagaauagaaaucuucagugggcuaguaugggacucuggcugugaucccucucuuauccaaaauucugcuaagggacuugccugagaacacacacagauuucucuaugagagcaaaauaagagauauauacauagguuagauaaugcaaugaagaucaaaaauuacauuuuggaauguuguauuccaucuuauggggcagcauuuaaucaggauccuagugcaaucuuccaucuggagccccaaauccaaugucacacauugcggguuggggugcggaagaucuagcuuaacccuagugaggaagauguccugccugguuaacuuccagcucaguggguauuaguagcauagcagggaugccaaacaggaacacacuauggggugucaucagcaagaauaagguccagagcuaugugguggguuagaagucugaaagucagaaaaggcuuuggaagcccucuugucuuccauuuuacaggugaagaaacugaggcugaaugauuuguuuaccauucagguuacacagagaguuaaagucaggacccagaccuuccaagucccaggccaaagcaggugauuauucuguagcaugugcuguccauauuccucggcagcaguauaucccagcagcagcauaauuucagaaaaggaaugagaaaaggggauauauccauuggaggguacccaggaucagggguuucaaagaugcacaauucugggacacagggugaguagucaugagaaguggagauauggggugggggugcgugaugguuuccgcaaacacaggagaaagaaacauuaacaacgugggccguggaaaaggaauuaaacuuguuugguuucauggagcagguagauaacuaguggguggaucggaagaaagcaauuuauaugucuguggugaaacauacacacauaacguaaaauccaccauuuagccauuuuaaaguauaucguucaguggcauuuagugcauucaacaguguugugcaaacaucaccgcuaccuaguuucagaacauuuucauuaucccgaagggaaacccugcacccauuaagugguaacuccccuuuccccuacccccccagucccuggcaaccacuuaucugcuuucugucucuaucaauuugccuauuauggauauuucauagaaauggaaucauacaauauguggccuuuagugucuggggaagcagaugcuuuuuuaacauaaugaaaauugcaggaugaagagugugguuugaaagggggcuugguaaugacuuaggaugcuugaauucaggccaaggcuagaaguccacaugguagggauauugcggaggggccucugaacaagaagugggcuugaaaggcuggcucuucagggcuuuucugaccuggagauggaggcccucucugacaagccccugggacuaucucccuuuuuccccacaaccccaccucugccagugaugaccagucucuacccuacgguaaaacucagguccaaccacguccacuccuuuugcuaauuuccccucuuuucauucuccucccaccuccgggucuguugacacuugcuugccaauuugccugacacacugcagacaaucuucucacucaagcauguuugaccugaacauacagcuuucugcugagcugaucuggaguuucaguuggccguuugggcagccagacaugaauuaagaacagggauaaacaaggauggcuugagcuuuaacuacaccgauuuggcccaauaggcucggggauaaucuauaagaccuaacagcugagggcaauaaaauuagcuacaaagggacugcgggguagaaacaaugucuucugauacuucacacaacacacacucacacacaaaagacaccaaaaacucuccgacagaagccuuacaacagcuuagaggagaggcauugugcuugaaaaacuauauuuuaaaaagcagagaggaaacccacggugacugaaguaucauuuucccgguggugaucauggauuucaucccaagaccuggaaaucauguuagaacuacaguaucagcccagcuuugugucuagggcuuaaacuugaaauguuguuuacauaaauaguuaaggaacacauacuggguugaagagugugcucuccaaaaaugcauguccaccuagagccucagaaugugaccuuauuuggaaagaggucuugggagauguuauuagucaagaugaggucauacuggauuagaaugggcccuaaauuccgugacugguguccuuauaaggacaucaacggagggcagaaggccaugugaagacaaagcggacacuagagugaaucugcuguaagccaaagaaggccaaagauugcggaaaggaaggauucuuccccagaacuuucagagagagcaugauucugcugacacuuuaguuuuggacauccagcaucuugaacugggagggaaugcauuuugguuguuuuaugccacucauguugugccaauuuguuacagcaguccuaggaagcuaacauaauacacucccaauucccucuucuuuuauacaauuguacaacccuauuugaaacauggaaaaggcucuuaguucucacaaaaaaaucucauuauauuuggaguucaacuucugaacacggguuuagaaacaaauagggucugauuucacugauuuucaaagggcuuucuuuguaaugacugggguuuguuuuauuuguuugcuuguuuccaggagaagagaagauuggccucagacacuuccgucuucagaccugugccucuccuuugaggaucccuuccccgaagcugccaaggagaaccuucccucacauuguuccuccuuuguuccccgcucuccuuuuccaggcugagagaccuggggccuuggaagcaagcacacgcuggcugagcugugauuccuccauguugauuauaauuuuuaucacauuauaugggaucccucuggugguuacuaggggauacgucaguuuugagagauuggaaccuaaccaaagaagcuucaaaucuagaggauaaggggacucagaguuuacaagucacagcaagcagaugcuggucugcuuuaggugccucuuacggggauugugagagggcuccuggggccugaggagggucuucugaggugugaaaggcuguacugguggucccugaaagccaucgucauuugugugaggaggaguacuggaggagcugucuuaccacaugaaaaacagcauggagcaucccagccacaucaaaggcacgguuugagccuugggcuguagaggcucagagagagugacaaauaagacccuggugagagaccaauggggacaguauuuccagacuuuggcaugaaacagauuucugagcaccucaugaaaugucugcaagggcagcuccucagagugacccucccaaaucaaucaaagcuggcccccuaucuuaauuaugacuuacaaauagaagcaugcaccuggcuggaugcaguuugccacaugguuuacaauagcgguagaauaagaaauaacuuaccaaacgaguacauuuucuuggcuggcuggggcacucagaguugacacugguaaggcuccauuaaaaugccuuuauguucugauauacacagauguguuaauuuauagcauauucaucagaagacauaaauuaauugcucucugaugaauuuuauaacaccuccuuuaugccucuccacccucccccuccaaaguacacugaaaaggucaacagcacuaucgaaugcagcacacuucaacuuccuuccaagcuuauaauuaaagcuaauuaguagcuuugguaauuagcgcauguaagcuuucugcuuucugaauuaauaagacugagucagguuuugagccaaguagacuuuucacucacugguucugauucuugaacuguguuuggcugguuaauuuaaaacaugucuguugaaaguggaauacuagaaagaaaacauacuugugauggucugcucucaagccagugugauuuaugaacaggccaaaguggaacuguugucacaagagaaaaucagaaugcucuggguuuccaauaacugaccagucucaaccucucagugugaaaugaguugugcccaguuacuaugucacauggacacaacacaacgucaaggaugcccuugcacacuuaugucacccucucauaacacaucuguacuaagcacaucaaauccucuuuauuuuaggagaaugcagaggcaauggcaguggggugccaagauauaacuaacugcucauuuugauucaaauaaaaaucaaagaggagaaaaaucauuagucaaaucagcuucugcuuuuguguagacaaagugauucuccaaauagcuucguguuucuuuuuuuagccagcaugugggcauccugcaugcccagacagaauuaaaagugcauguuuuaaaaucaagaaaucaaaucuauauucuauuaaaagaaaaaaugugauuuguuuucagacuuuagaaacaguugggauaaaaauuuccacgggugagcucauuugcuuuuucuuuucccauacuaaucucagaaaauuuauuuuuguuuuuuaaagaaagaaaggaaggaagaaaaagaaaaucacuuagugauuuacuggacuccuuauaaguccaggacaaugguggggguugcucacagcgcuaguaauuuugauacauaaagaaaaggaaacagucacugcugcagagagaggaauauauaagacagcucugggucacuagaguaaaugguuuucauuuuaauggcgcacuuacugccacugugauagccacauuuggaucuguaaggggcaguuaauacuauucaagagcaaggcacauuuggucuuguggauggcugugauugugaaggugacaagggguuauggauucccacagccucacaggcccagcugaauaggaagccuugugcccccuuggcagcucauccuaccccguggcagcucauccuaccuagguggauacacuccaguaagaucuauacacagugguucucaacugggggagauucugcccccaggggauacuuggcaauguuuggcacaguuuugauugucauaacuggugggagaggguagaugcuacuggcaucuagugagcagagacuaggaauguugccaaacgaucagccaugcacacgacagucacuccucaacaaagaugaucuggccccacaggauacuagugccaaugucauggaacccugauacagaaggucuaaacagggucugaggcccuccuugucuuugaggaagaguuaaauguuagcuuuccagauugacucuggacugaucuuggccuuauacaagucagaaagaagugagugauagcucacccacaggggcuagaucugagucagacuggaagaagucggcacacucaggguaacggcagcugccuaaaagccaagcgcugggcauuuuuauguugcagcuaaggccagcaugcugcauuauggaugagcucaugugccauggcaaacaguuuaagaacgaugcuuauauuuaaugaauccuaaaugguuuauuacagagggucaaguuucugcuuccugugggaauuugacauuuaugaaaaugcacgcacauuaauuauucaguggagacguccuuccuauggaaauucacuuuccuguacacucgacaggacuacauucccugucugcaugggcuacuuuguuguuaauccucuaagcauuaauuaaauaaaauuugcaaccgagccaggaugcaucuacccucaaauguuaugcaaaagacaguuaaaugcuguuugauuuuuccugcuaguagccaaucauuacccauagcuauuuauguucuuccuuuuguucuuuaaagcauaaaccugguaucucuucccacugagaagaaaacuacgcucaguaauuaaauuacaccacauuaaacuuacuuaaguucaccagcagggaaaauuccgugccccuggguuuaacaguaaguccuaaucacgcuugcaagccauaucuuuucugugaguuguuauaguuuucauuccuggaauuccauuaaaaaugguaaugucauuacuccuguuacugcucaaaaccaacagcauaauccugaauuuuaauuaguaauuacaauuaaucauuauuucauuaaugaaauguuuaguugguaauugucuuugagcaccuuacucccuaggcuuauaagcauuucauaacaucuaauuuguugccuguuucugaugaaguggcacugucaaccuuauuuuauguuaacacuuugauggggcucugcaucccaggccugcaccaccggcugcauauuuacaccuuggaaauguguggcuucuggcucucgauaagguucgccugaggacguacccucgcauucuuuccugccagcuuaagaaggcgacuguuugugcucccagagagcacagcaugugaagagagaaauaauaauuccuggaacgcuuacuuaauaauaaaucugggauccaaauucauggauuuuugagaggggauagagcaaggauuuggagguagucuuuggaacaggaagguugauuuuaaaagagcuuaaagaauuaagaauaagcugggaggguugucaagaauuuaacacgaggcaagauuuuuguugauccuuuugcaauagcaaagauauucuuauuuauuaggaugguuuuuuaggggugaggggaagcuugucuuccccaccaaaaggucagggacccaaguaugccuugcacacaguuguauuccuagcuccuggugcgggguugggcauacacgugacucaauaaacagcuagauaagucauuguuccugcauggccuaugguuaggcuaugaaggggguaacugagguacaagaguuaauggugguuuggugaugguagcagggugugggaugcuaggagaugccaaaucagugggcuggugugcucacaaaugaccugaugucauaguugucugucacugacaauucuaaaaggacggauucauccgacugcccucuauguaaaaaaauuuacacauacacacacacacacacacacacacacacacccgacggugaauuauucagggaggagaaagccugcuauccuuggcaaauuaaacaaggaggauuugagcaaagaaaagaugugcugcuguuauuucaaggaaguauucacagcuucagaauuaaaacugagauggaacaacaucagacuuguuggaaaaugcuccgcgucugugguguauuucagacaaguuagucagaaaauucaaaauaucuggaagaaauaaaugacggccaacaguuugguguuggccaccaggugccagagcacguauggucuuggccuaaggugagugaaagacagguuucugggucaagacagguguuuccaaauggcaauuuuugaggcugcugacauuuuacaaaauaaaagaaugugauaaagcuuaaguuuuugguuguauuuuauaaaugucuauauuuaagaaguucaugcuuuagcacacauaagacauucaacaagucauuuggaaauaacaucaaaugucgaaauuugagacccuuuauaauuaggaguggaggaccaaguggacuccaucccuuguccccacauagguccuauuucuuuccuaggccacacagcuuuuaaacauaauauuucuccccuauuauccuucaguauuuauagagcauccggccugugcuaggagcuugaaaagacagucccucucucauggagcucccaauauagaggcccuuucccuuuggacuuucuucuacuggaaauugccuuuucuuguguaguucccuuugcugacucugcuuguccuccuguucucacaaaggcuaccaugcagugggggaauaaauaugaaaaaaaauauaagaucauugcacugcagagugaaggagcaaaucccuuaacagucaugaguacacauuccagcucaugagcauaaagccacacuauucauagaaaugggugauacugauuguacacuuaccaugugugaauauugugcuuaguauaucacauggauuacaucacuucaccugcuucggagaaccuggauugagcauaauggaaauuaagaguuggcccaucccuagauccacaucuguuaccugcuuugcuggcugccugggaaugaggucuugucugucuguuuuuuguuuuuuuaacuucagcuuuggccuggagcugcagcccaggccacuauggaaggaaagggaauguagccuuuauaaaaucaucuauagccuggugggaaugucaacuaguacaaccacuauggaaaacaguguggagauuccuuaaauaacuaaaaggggaauuaccauuugauccagcaaucccacugcuggguaucuaccuagaggaaaagaugucauuauaugaaaaaaaauacuugcacacacauguuuauagcagaauaauucgcaauugcaaaaauguggaaucaacccaaaugucuaucagucaauaaguggauaaagaaauugugguauauauauauacaauggacuacuacucagccauaaaaaggaaugaaugaauuaauggcauucgcagcaaccuggaugagauuggagacuauuguucuaagugaaguaacucaggaaugaaaaaccgaacacuguauguccucacuuauaagugggagcuaagcuaugaagacacaaaggcauaaaaaugacacaguggacucuggggacucaagggaaaagagugggaggggggugagggaugaaagacuacacaucggguacaguguacacuacuuggguggugugugcaccaaaaucucacaaaucaccacuaaagaacuuauucauguaaccaaauacugccuguuccccaauaaccuauagaaauaaaaaaaaaauuuaaaucagcuagagccaagcagaaauaauaaggaaagugaauuccaagaaaaaguauggaauucucuucaaagcauaacagaaaauguuuugccauuucugguuguugucaugaagcaaaaaaacccacuugcccacuuggcaugucuuaccugacaaaaacuacaaagaaaggccugcccaggguuucugcaaguccuggaucugggaggcugugucucacagagagugacagccaagacugaauaacugugagacugugggcaagcuggugaguucuucugugccucaaguuccucuauguaaauggggacagugauccuugcucuugggcuuguugggaggauuccauggaaugauaugugacaccuggcacacaguguacacucaguuaucaucacauaugucaucuucaauaugauuuuugccaauuagauguggacuuuuugcguucauuaaaaauuuaaacaaacaauaauaacaacaaucacagugaguuuggguuuauaauacuguggauuucuuccuuggcaugauuggagauaaaagaaggaacauuccaugugaugcugugaggucccaggaaaggugugacagagaauccugagucaugcuuaccugucauuacuagugggaaugagagccaucugggaugaccuaagugcauauuguuugcagacagugauaggugcucagggagcaggaaaguggagcaugaacucacaauagaagguaggagcagagacaaucaaguccuauccuaccagaucaacugagagauuucuauucccuaaaguuccacagucuuuguaccccucucaccaugucaacuuugcucuccuugaacgaucuuauccccucucuugaaccauacucccuguuuuucucacauuuacguccccuucaggauauggcaaauugucuuaugcucaggaaacauuugcugaaugaauccucuggagaucuucagaaaaucagcauauuccaaaugaagugacugagacuuaagcaagagacccagggugggauggacagacucuugaauagcaucuugaucuagaccaguauaaacucgugggaccuaaacaaaaguggaccuuuguucagugaagaagauucccagggagcagguagaagcagauggagcuaacuccagauacaggcugugcucuccgcagaccccagcgucuucguagauaggagguuuagcagaugguguuuuugcauuaaguuucuaaauuaccaucuauaagauccucuguuuucuaaaaacuaguugccuuaaggcuuuaagauuuuaauguaauuuuaauguuuguguguguuguuaguguaccuguuucucagguuugcuaucccagauagguuauuugcuaagaucagaagaaaaucaauuggcaaaagaacaugcucacauguuacauguuauuaccaguuggaacaagagccaucugggauguaagacuauccaccaaacggguguguggaacugucccuuggcauugcacaggaggaccacuuuuaguaugauuuccugugcuguggcuaugacaucagggaggcugaggcaggaucacuugaggccgggaggucggggcugcauaaugaguucugaucgugccacuguacuccacccugggagacagagcaacacccgucacuaaaaaaaaaaaaaaaaaagaaagaaagaaagaaaagaaaaaagaaaaagaagaacaaauucagaagcuacaauaggaauaguucagaaaccauccuccagccuuuuaaaggcacagaagagcuuuguuucacauucguuucggcuuccaaagcaacuagucaagucaguuucaccuguuuuauucacaacaguuaucucuccaauccagauuccuucuuuaaaaaaagggaagaaaaaacauucucauauuucuuguuuugcuagcaagaaaugagcugcagaacacuuucagagauccacuagcuguuuuccuuaagcugaggcugagagcuucaggggcacuccaaagaaagaaagaaaggaaagauaaaacaaaggacgagaggcuggggggaagaaagagaggaagggagggagaaacuauagagaccacuguguggacacccacaacuucugguucugaggcuggugggaaaggaauuugcaauagaagaggaggggaacugagaggagagcacuguauuaagagcuuauaggaauucuaaaaagaaaaaaaaaggaggccuuugauccauuccaaagagggaggcagaaaacuucaaagcagaauaacaguccccugcacucugcccuacucuaaguacccggagcauucauuaugaaucagcccaccuccccucggcccacguggggcugugcaagccagacacgcaauucagacccacagcuuguucagccuccccgagaacacagcgugugcaagguuugggaauggaaauauagcagggugcccacuccuaagugggguuaauucacggauguggaaggaaucucuaccuuucgcagagacugcuagaaacaccagcuucccuucuuucucuucaaaggaagaugguguuuuuuucuccuuaauccugagucauuuacaguaagauacacguaaauaauaguccaggagguaaaaugugaucuacacagucucuaccucaaaaauaaguuuuuugggggacuuguuuaccauuccgaaugugacccggcagcccuuuacaaaaaguaacauuugcuuuuauuagauacagcagaucuauuucugugagcaccgcagauguaacugggauucauuuuuacuggaugucucagaagaccgggccgacugccagcucuccuggacacaggaaguuacagggugcggucacuucugcucacccauuucuccuucaacagcgcagaucacaugcacagaguucuuaggagacaggucuuccccaaggcaaaggcacacagaaaugcuuuccuucccagcugccccuugaugaaagaaacuaaacaccucuucagcauggauaugacacuagcccucggcuucuuauuuuuugcaaugacuacucugugucagagucaguaaaaaucgcaaugcagagaagagagauaaaaagaaacauccuggagaauucuccugguuauuuuuaaaauauugucucuguugacuugaagugguguagaaacaguuccauaugcuguguuucuuuuuuccuguugcaucuuauaguuuaaacauagaucuuuuaucggauacaacuucuguuaacaauauggccuacuggguuagcaaagaaaccguucuuuucuuacaguucuggauuuggggagguugcucacauuuaacuguggaaagcauuaugcucuuauggucuuugccaauucuuuucuguaacacaaaccuaaauuacauaccaauuucucgagguucuugccuaguuuggaccaaauuaggucccacaaauuccugaucuuagcaacugugucucucaguuauuuuccgugagacaauauguuugucuguacuucauauugcuuuguggagacaauuaccagugcuauaucccuauuuuucuuuuucuugaaaaaaaauuuaauuuuuagaaauuauuuguauaggaaaaauguuaaaauagaaauaagaauauaaccucuuugaccacccugcuccaguccugguccccucccuggagguagccguauuagcagacaggcucguguucuuccagacauuuuucuguauauuugcacacaucuaaauacauagucauaugucuuguuuuuguuguuaccaucauuauacaaauggaaucauaccauagaacagaugccucauaauuuauuuaccuauuccucuauuaauggaugcuacggucugaauguaucucuucaaaauucauguuggaacuuaagacccaaugugacaguauuaagaggagccuuuggggaagugauuaagacaugggggcucuacccucaugaauggacuuagugccuauauaaaagacacugaagcaagcacucuggucccuucucccuuccaccaugugaggacacaguguuugucucuuucuuccugugaggacacaacaagaagacuccaugccagaagcagagggcaagcccucaccagaaacccaauccgcuggcaccuugaucuuggacuucccaggcuccagaacuaugacuaauaaacuucuuuuuuaaauuacccaggcuaagguauuuuauuguagaaacaggaauggacuaagacaaugaauauauaccuugccuguuaauuugcugagaaccaagguuucauuuucaacauuuacuagcuaaucuagccuagagaaguacaaagaacccaggacuuggauuuuaguccaacaauacuacuaauguccagguaaucuucggcaaaugaucauccucuuugggccaacauauccucagcugucagaccagugggcauguacagugaacaacuuaguaccagguacuacaacaacuuacacaugccuaggccccagggcaccauggugauucugauucaaagcuagggcuaagauuggcuacccuuagcaaagaagaguuacugauguguaggugagaaaaaugucucacgauuuagaacaggaugggacaaacuacaucccaugaaccaaaucagaccugccaccuauuauuauaaauaaaguuuuauuggaacacagcaaugcucguuuguuuauauauugucuuuggcugcuuuagugcuaaaguggcagagcugaguaguuucaacagagaucucaugacucacaaagccuaacauauuugucacuggguaccuugcaaauguuugcagaccucugcuuuggaaagaucccuauggucacacagaggguggggaaggaagacaauuuagaguggugguggugaugggggucugagucagggcaagagaaaagaacaaugugcgagacacaacacaggcagaagcacagaaguugugacugacugaauggauaaaaguaugagaaacagaaguuaccaguuucauauuuccaacuuggaggcuugggugauugucauuaaccaagaugagugucaugaaaggaaagaagauguuuaugggaaggugaguaagauucgaauuagggacuuucugaauucaaagugcagauaaagguguccaggaagcaguuggaaauaugagucuaauauucaggagagagguggggcuggaggucaagcuugagcgccaccaucuuggagaugagagcagguuucaggugagcagaccagaccaaagagggaaaaacauagaggcaagauauuugaggaagaaauucugagaaaccccaacaguuaaaggacuggcaaaggaauaaaccugagaaggagcaaucagaagaguagaagaaaacaaacaugauaauauuugugaaagcagaagcaacugauguuggcuuuuauaagaggucuuuguugggcucaugucgggguaaagagugcucugaggauuuggugccucuugucaguguccugugguggcuuccauagaaaacacuccacacccauuaucugcaaggagacagcugcaguuuugccucuucaugugguuuccucaaacccacccccugggaaaugcaauaugauucucucacagagcagaugggaugcuaacuggaaucaccucugccuugcagaguucucccucaguugcuccaacagugccugguaguguaaacaagacuggcuuaccagugcagcauucaauaccagugcuuacccagcagccauucaaccaguccugcugaugccccaccaugugccagccaccaaagcaucuagugccaagauuacaacuguuuccuucugcuccugguucuuagaguuuuuuuuuaaaaaaaauauauaaaugaucugcauuuagugauauauuuauuuuuaauuuuuuuauuuccauagguuuuugggggaacaagugguauucgguuacaugagcaaguucuucaguggugauuugugagauuuuggugcacccaacaccugaacaguauacacugaacccaauuugagucuuuuaucccucacccccaccaaugcuuucccccgagucuccaaaguccauuguauuauucuuaugccuuugcauccucauagcuuagcucccacauaugacugagaacauacaauguuugguuuucuauuccugaguuacuucacuuagaauaauaguccccaguuccauccagguugcugugaaugccauuaauuuguuccuuuuuauagccaagcaguauuccauuguauacauauaccacaauuucuuuauccacuuguugacugaugggcauuugggcuguccauauuuuugcaauugugaauugugcugcuaugaacaugugugugcaaguaccuuuuuuguauaaugacuucuuuuccucuggguagauacccagcagugggacugcuggaucaaaugguaguuccauuuuuaguucuuuaaggaauuuccacacuguuuuccauagugguuauacuaguuuccauucccaucagcaguguagagguguucccuuuucacagcauccacgccaacaucuauuacuuucugauuuuuuuuuaucauggccauucuugcaggaguaagguaguaucauauugugguuuugauuugcauuucccugaucauuagugauaucgagcauuuuuucauauauuuuuugaccauuuguacauugucuguugagaauugucuauuuacauccuuagcccacuuuuugaugggauuguuuguuuuuuucuugcuaauuuauuugaguuccuuauagauucuggauguucgucuuuugucagauauauagauugucaagauuuucucacacucuguggguugucuauuuagucugcugacuguuccuuuugcuguguagaagcucuuuaguuuaauuaagucccaccuauuuaucuuuguuuuuguugcauuugcuuuuggguucuuggucauaaagucugccuaagccaaugucuagaaggguuuuuucugauauuaucuuccagaacuuuuauucuuucaggucguagauuuaaguccuugauucauguucuguugauuuuuguauaaggugagagaugaggauccaguuuuauucuccuacgugugacuugccaauuaucccagcaccauuuguugaauaggaugucuuuuccccauuucuguuuuuguuugcuuuguugaagaucaauugacuguaaguauuuggguuuauuucuugguucacuauucuguuccauuggucuaugugccuauuuuuaaccaugcuguuuuggugacuauggccuuauaguauaguucaaagucaaguaaugugaugccuccagauuuguucuuuuugcuuagucuugcuuuggcuaugugggcucuuuuugguuccauaugaauuuuagaauuguuuucucuaauucugugaagaaugauggugguauuuuuaugggaauugcauugaauuuguagacugcuuuaggcaguauggucauuuucacaauauugauucuacucaauaucccugaagaacacagaugcaaaauccuuaagaaaauacuugcuaacugaauccaacagcacaucaaaaagauaauccaccaugaucaaguggguuucauaccagggauacagggaugguuucacauacacaagucaauaaaugugauacaccacaaaaacagaauuaaaaaaaaaaucacaugaucaucucaaaagaugcagacaaagcauuugacaaaauccagcauugcuuuaugauuaaaacccucagcaaaaucggcauauaaggggcauaccucaaugucauaacagccaucuaugacaaacccacagccaacauaauacugcacagggaaaaguugaaagcauucccucugagaaacggaacaagacaaggaugcccucugucaccacuucuauucaacacaguacuggaaguccuagccagaguaaucagacaagagagagaaauaaagggcauccaaaucgguaaagaggaagucaaacugucgcuguuugcugaugauaugaucauauaccuaggaaacccuaaagacucauccaaaaagcuucagaacugauaagugaauucaacaaaguuucaagauagaaauuaacguacacaaaucaguagcucugcuauacacugacagcaaccuaguugagaaucaaaucaagagcucaaccccuuuuacaauuccugcaaaaaauaaaauacuucagaauauaccuaaccaagaggugaaagaguguacaaggaaaacuacaaaacacugcugaaagaacucuuagacuuucucuaucccuauauuuggaaagaagguuggaggagggguacagaaggacggagggagguagagagaguguuaaagaagaaggaaagggguaaaaaagaaugggaauagaggcauggacuagaaacuaauuagauggugaggcagagaccuugcauugcguaucuuacaugcacuggcuuggcagccuugagaacugauguguauauugaaagcaacagcacaugcuagguguccagcauaauaccugacauauauuaagaacucaauacaugucuguuauaauaauauuuuugaguauccagaggaacuaggccagccuuugaauugauaggcccuuugguaauuuucauacagccauguagcaaaacuuauauuaaauaaauugggggaauuucauauuauacuacauuccuuuugcauucucacuggcaggaguauuuagccuggaugaaacuugauacuucaaaaagaaucacuugcuaaagggagaagugagccccaccuucuguuaggaagauguggugaguacaucaauauuacaaagauucaguguguuaaaucaauauguucaaaguaguuuaaauguccaauacugguuuccaacuucuaacuuuucucuauccucucucucggccucuuuucaaccauuccuuccuuaauccuuccacccaucccucuccuaacccccaccauuguagacuaauuucuuuugguuaucuuucuaagccuuugcacacuuuucccuauugacgagcuuugcuguuaggauucuccagcuacuucugcaaagagguuuucaaaggacuuuugaaaaugcagcacuguguauguuuugguaaaauaaagcaaacauuuugugugguuggguuuguuguuugaaguguugcagucucccucuggggccuccuacugucuucugacuagcaccucaacagcaucccuuccugcugauuugcagaggguuugauucuuuuucaauagugcauaaugcugcugucuuauugccuguuugcuuuaguucauauuucuucuccagauggauuuucuaugaagaucaucccuauuuguuugaucuuuaauuucagaccuugucauuuucuuuucgaguaugcuuuuuuauggauguuucuuuuggcagaaccacuuccuaugagccucaguguguguuaauggcacuuucauuuauuaucauagacaauuucaauuucuagagggauaguugaguucuguugugguucaaaggagaaauaaauccucuugcaacuuuggcuauuuuauuucacuucacuuuuggccucagaggacgagagagaagcugagaacauuagccacaucuguccaugaagauuucuccaauaucaauuugcucccacaccugauguacugaauacucagaaaaaugcucaggcuauaaaaccaugucuaaggcacagacaguuuaagaucaggcuuugaaugaaggccucaguuuaucuuacacauuacugaagcccauucuauagaagacuaauaguuuccacaggugucuuggguggagaagggaaaaaagucaauggacugagauacuauuggucucaggaaucauuugcccaaucuacccuaggccaagcuuugaaggacaggccaucugaauucacugagugacugaaucccagcacaggaaauguugauauucuuauugauucuuuaauggccauuuuauauccaaccauccagccauccaucuaugcauuuauccaucauuuauaguaaugucccuaaggcugcuuucuugcuaaaaauaaggaauauugacagcugaaacucacuuuauuauucugccacaguuuuaagcaucccugcaaacacgacuucuuuaacgaucuccaguuuaauuccacaguaugguucccuaucugcauuauucucuccuacucugaucaucuuauuuauuuauuuagacccagggucucacucugacacccaggccggagugcaguggugcagucuuggcucacugcagccuuggccucuggggcucaggugauucucccaccucagccuccugaguagcugggacuacaguugcgcaccaccacgcccagcuaauuuuuuuguagagaugggguuucaccauguuggaucacccuacuuuaaaauuguaauauaguucccuuuuccagcaacuuccauuugguuuaaccuguucuuuauuuuuucuuugcacuuuucaccuccuagccuaauauauauuguacuuauuuacuauguuuacaguuuguuuauuggcugcuucaagaacauaagcuccucucaccaucuacucacuguauucuaagugugaggcauaugguggguauuugguaaguauguguaaggcuucuuggggaaaugacccuucagugccuuuauucaauacucaagaguguuucucagccccuaaccuggcauuguaggagacacaaugugcgcgagugcgcgcgagucucauacacgggagucucagcgugugucucauacaugcugcuggauguguggcaugccuggccccugcccaccaauugccaguagugaccuuaucaucaauguaacaauuaaaaacaccccaggacauuuccaaauuccucauauggcuccaguaaggcuuugcuugauaauuacugcaagucuuagaauaaaaccauuuuuuuacacuguguuuccacuuggcaaauaauuaguccaccuuauggcauccuaagggcacucucagagauaauacacuuucuuuuuuauaugccucccucaacagauuucaaaauccucucacacaauuaaagacagugauauuuaaugguaaaacucagcugucaaugaugccuucuaugucagucauuaacaagccaguaaaccaauauuuacuaagagcuuuugagccugacuucaugccaugcaguguccauuuuauagcacaaaugguaccccacccacuaaggcugugccuguguuaccugcggucagcaucucaucuaauccuuccucacauuuuagcaaaaaccaggcccugcagucaaagaacaaguuugacugauuucuuuucacuggacuggucaguuauucaaccaugauggacaaacugcugaguuaaauuggaauaacacaggccaagagaaucacauuuaaagucagagauggcaaaaauaacagacauuucuaugacagaacaucaacaaauaauuacugauugucuacuggauacaaaguacugugguauagggcaccagaaggugugguuaacaugacaucaauugucauucugcugggugacaaugaaauauguauaggaauguauacuaauauucagauaaaugcagauacugcgagcagcuaugcuaagugcuuuacaggcacauaucacuuaaucauuaacaugaauaccauagguaucccuauuuuauagaagaggaagcugaagcacagggcaguaaagggacaaggucacucagucgggaauuaguggggcaacaguuuaaauucagguuucucucaugccaaagggucuuaaccacugugugauaaaucaaauaguuuucaguugucugaaauuuucaguuuucauuuacuuugguuguguaggcacaaacacaagaagaucuacagauaauguauauuuuuuaacuuccuuuaaauuaaugcauguuggauugcucucuaccauuugccccaucuaagucuuuguaguuggaauccaucguucucugcaaauuugacauuugaucauaaauugcucaucucgagaugaauuacaacaccucacauuaaagaggcacuuagggagacauuucuauuccauuucaagagacuuauauaagaacccuuuuugaucuuuccuaaaauuaaaaugaaaagccacauuuuggcaacauuauggaauaauacaaauguucaauucuguggaaaaagguagagacaugacugaucauuugauauuuaaggcaaagaaauagugguuuuauuugauuuuucauuuugaacucugucagacugugauccuuuuuucuaucuucauaguuuuuaaaaaauaaucaucagaaacaagaaacaaagagaaagcaguaaaacacauuuucuuugccuccaggauugaagacauuuuccccuuggcauguaccuacuaaguaggaaaaccuagaaugaaaguuacuguguugcuucaguaacuucuaagaaaucaauauaauuuugguuuucugcuauaacucucaaagcauauuugauguaucucuuagucauugacaacuuucuuuauacucugaagcaaaguuaucccagccaaguguauguggcugcggaugauaaaguauggcuauuugaaguuugcuucuucuuaaagagaaaugcaaaguucccagaaagacgcuagauacaacgguucacauacacuucacaaggcacuugccuaacuucuuggaccaaauuacauuaaaucuuugagccaagaaaauuaacucaccacucauugaaaaacaguauuucagccaugucauaucuuugguuaaggcagacuuaacgggaaaaucucuuuccaauaugauaugugauuccuuuacaaguacacaguuuguuaaguuuuauacuuuuuuaagaaguagagguuuuuuguuuuuguuuuuuuaaccaaugguacucucucuguguguguguguguguguguguguguauccuaccaaauuccuuaguuaauaagcaagacaaauuuauucacagaacucauuuuguauuauguaaauuuuccaagaaaaaaaagaaaaucuuaauuuguguuucaaagccucucuaguuuaagcacaaugacuuugaagaaacaaccaaaaaaaagauaaaauguggaugcagaaugauguuuauuuuacauguauaugguacacauuggguaccaaaagaaagucaugguuaauuacaauaaucacucuaguuuggccaaauaacauggaacuaacgacaugaauuucaacuauggauaguaauauuaaguggguugaaguaaucucuacacaauuaauuuuuucuagugccuuggccucugaaaacuuaucuuuggucuauauggaucuaugugcaucuaauuaaagguucauauuugcaaugcaggguuuuaguuaagggagguuaaacaugagauuuccuuagagcgccucaguguucaugggccucuauauucucauaucucugcaccagcaguaggaggaugugagagcccagggagcccucgaacuucaaaauuagaucugugggagaaaacauguaaaucucagccagaagaaucuaugccuccuuuuucucccaugcugccuuacucauagcacugauagcaugcaugaucuguuagccuucacuauccuugcagaggaacuggauucggugguauggaaaagacauauacuauuccaugaauauccaugugcucugcuccauuuccuguucccuugcagauaagugagcauacucugaccaguucuggccaagggacucugaaugaaaaugcuaccuuaaaggccaaaguauuuaagagccagcacaugacucuccagcucucucuuauucugucucagugauacagaggcugcaggcccaggugucagaauuauacaauacagaaaauagaucucuuauaagggaguuuguaagaaaauuggcccuagagagccaccagucccuuaaaagaguuuauaugacagccugggcaacauagggagaccccauaucuacaaaaauaaaaaaaaaauuagcucgugccuauagucccaguuacuugggaggcugagguuggaggguggcuugagcucaggagguugaggcuguagugagccaugaucacaccacugcacuccagccugggugacagagacccugucucaaaaacaaagcaaaacaaaacaaccccccccucaaaaguuuacauuaguggcaaauaaacuuuguuaugcugggaagauauuaccaagaauagcuuaguuuacugugacaauuuaaaucaacugcuaagauaaccaaaguaaucagaagcuauaacaggacauaaaugcugaguacaaauauuuauuuuuguaccuccucuauuggagaaaaucuagaaaauaaauucaauauauauuccaaaggaaaaaggaggaaagucuaggaaguuuuucauuugggauaaaagccaggaauaaauauaugacuuucauuggaacauuuucaggcacucagagauucagagauauccuuaaugcuaaguagauguauaauuagcucccuguuuagggacuccaaaaugugccaugucaaaacugucuccugaaaauguugcuuugcgauuccaaaagcaaucagagguuguugaaaaaucuuugggauuuugcagugugcaguuuuccccaacaggccuaacauuaaucauuauaggaaaaacauucaaacucccccauucuuucauagucuagucuaaacauucaaugcaauaucauaauucugcagacauaaauucccucauuaucugugggccaggucaaccacagcacagccagccaccuagcagacccaugagcagggccuuuugcaaagguguagcacuggcccucaaaaagacuuacaguuaagcacuccaggaggcugcaauugugcacagcagccaaccugucuaauugggucauuuuuucacugggugauuuauauagaauguggacucaaggcugacugcucuucgaacaguaugacugcuuuugucugacuguaccaaugaagcaggaugggguugcugguauuuaagaccaggcauucuggucccaaagaaacauugcuuugggcuguaguucuguguuauugcaagaagcauaguauccgauguuaccagugugggcucaguuacuucaucuguaaaaugggaggcuauaaccccaccuaccucuuaggguucucgugaagaugugcuugagaagagcugaaacagugugccugacacagagaaagcauucaaugaaugugaaccauuuaugcuauacagcauuauuacugauaugaaguauuagugauacauuauugauauaauuaucaucaacauuaucugugaugcuggugauaugaugaugaugaugaugaugaugacaguaauaaucauuuucugagugcuugccaugugcuugccagucuacuaagugccuaauguggauuacuuagugaauccucagggcaacuauugagacuauuaucuccuuuugaugaaugaagacacugagucuuagaaagguuaagaagcuugaucaaagaaguaauaaagcugaaauagaagccaagcaguuugacuuccgagccugugcccuuaguuacuacccucuaccccagcauugacacaaacacaaccacagcuuuuauuaguuguccuuauaaugacuuagccucaugcgauaagacugucugucccagauagagccacaaguuacuuaacauaucucagugucagcagccacaaccugcuagguaacuacaacuccaaagugcccugccuccugaaugagauggaaaaucaguggaauagggaauggggguucugcuuggaaauaaccuguaaccagaccaguuaagguggaaagggguggcugugaaaaaugaaaacaauaaaacaaaacaaaaugccaaaaagcagggugauauagagaggguuuaaaggguauugcuccccuuucacuccuagccugggauucaauuuguggccaaaagcugaugguaaguguguguguauugcagccauagucagcagagcaaauggggacucucaacuacugguccuacuuccccuaaggagcuggguaguuaacauguuaucccugcaccugaguaaauuaacccauuacuccuuacccagugauccacuugcccccccaugaugugcacuguagggaguucaugcuguuuagcucagaaauucuaaguucacauggaguccaguuuuccuggauuguaccuuaagugguugauuguuggagccacuucauaucuauauuuaaguuagacuauugaguacugucccucaguuucaggagccaugggagcaaaucgaggggcaaaaguuacuucuggaucuucccaaucauuucucaaccauugagucacagccugugacaccagacgucuuuaacuuaacuccaaccucauugugcuagguucuguuuucuccucaauuauuuuuuuuucuugcucuaagaaaaggauaauacaccccuaccuuaucuguaacauccagccacauugucuggcuugguuaugugacuuucuuugcccaaaggacuauaagcagauaagaaauauccaugucuacauagaaucuuuaaaugagguugcaaggcuuaacuuucugcauuuuuguccucugcauugugaauagcauggccccgaugagggcuucucugcuucagccuaggucuuggaauaagagaugcacagaauagagccaagaagaagugcugccaaccacagacucauaaaugagaaauaaauauuuguuuauuuggggguuguuuguuacugcagccgaggcuaauacacaaauuuuucaauaagaacucagccucagcuuacaucaugugcgcaagugaaucuggggaugcuaggggcuaucuucccuaucauugagugaaagacuauuuauguauuaagccaacaggcaaggacagaaucaagaaauguuguaaaaguaagagcuccgaguccuuugagccccugaauccagcugugccugaagacuuaaugcuacauguuaugauuaugugagccaagacauuucuuuuacuuuagcuaguuuggauuagguuucuaaucugguuuaaaugaauacugacuuauaucaggucuccucacucuuuugcaaugauaucugagcacaagcauauaugacauauuaaguaauaguaaucacauggggguaaguuacacugggguauaaaucauuguaauugaauaagccugucauggguugaacuggguuccuucuccacccccagcuucaaauggauauguugaaguccuaaucacuacuaccucaauaugugacauuauuuggaaauggcauugaggaugcaauuaguucagaugaggccauacugaaauagggugggcuccuaaacuuauauaauugaugugcuuauaagaagacagccacaugaaguuugagauacacauaaugucuugugaccaugaagacagagauuggagugaugcagcuacaagccaaggaacaucaaagaucgcuggcaaacuaccagaagcuauaaaccaaaggcaaggaaggauuccucuacaggcuacagagagagcaugacccuaccaacaccacaacuucagacuucuagucuccagaacuaugaaacaauaaauuucuaauuuuuuaagacaccuaguuuguaauauuuuguuaugguggcccuaggaaacuaauacaaagcccaucaggugaauuuuuaccaacagaucccauggaaaacuucugauggaaaucacuauuauacucaugaaggucauugacaggguuuggcucuguguccccacccaaucucaucucgaauuguaaucuccacauguugagggagagaccuggugggaggugauuggaucagggggacaguuuccuccaugcuguucuugugauagugaguucucaagagaucugauggcuuaaguguauggcacuucccacuuugugcucucucuccugccaccuugugaagaaggugccugcaucuccuuugccuuccaccaugacuauaaguuuccugaggccuccccagccaugaggaauggugaguccacuaaaccucuuuacuuauaaacuauuccagucucacauaauucuuuauagcagugugaaaaugaacuaauacagcuauauugccauaucuauguccacacaauauccagagacacagaaaggaaaaaggaggcagcacaaugcaauggucaugcacauuggcugaaagaucaggaagaccugaauucaaguccuaguuuguucauuuacuuuaggugauuucugacuccaguguucuccuguacaucacagaaaaauccauuguuucauucaugauguuuuaugagaguuaaacgagguaguggaugggaggugcuuuacacugugccuggcagaguauauuuguuaaacaauagauagauagauuagcuaaauagacagacagacagauagguaacuuagacauauagauagaugauagagagagagagacagagagacagacagacacuuugggcgacuaucaaaauauuauaaacugguuggcuuauaaaaaacaaacauuuacuucucacacuucuggaggcuagaaauccaagaucagagugcuaguauggucaguuccuggugagaacccucuuccagguuguagauugucaacuuuuuacuguauccucacgugguggaaaaagaggaaguuagcucucugacaucuucuuauaagggcacuaaucccauuccugaggggcccuauccucauggcuuaaucacuuaucaaaggucccaccuucaaacaccaucacaauggagauuauauuucaacauaugaauuuugaaggacacaaacauucagucuauaacagauagacagauauacacacauaaaaauauaucaaugcauaagucuauagauaugaaggucuguaucuuuccugccuauauaaaauuuaaucaaaucauuagcaguuaaauagugaauuuucaacacauucccaaauaguuuuaacuuacuuaauauguuguguuggugguaauuuucuuguuguuguuuuuuaaacugaacuugauugaccugauuuuauguagauaugcaaagauaccacuuacucaugcagaccuuguuguguaaauaacccaaucuucugucuuugcaaagacaaucuuucccuaagaguuauaaucuccucucaacacaucgauuauauggaucaaaggcccucugacuuauaucagccugggccaaaauagucauuaccaaagauuuuccacuuucccucuuuaauagacuaagcuuuagaauuuggguaaugguuuggaugucaaacaaaaccugagaacuuguuuagguucagaagaaagugagagugauaauauuccuuucuucaucaauggagcuuucuacccuuucccgccuauuaugucuaauguuauugugcaccaaaaaugaagcucuccuaaucuucauuuaccuucauaauaaagagagucuuugugcgaaccauuucuacuauacugcaaagacacaaagaagaaggccuuuaugcugaagcuacaauuuguugacauuuuuauggauaugaaccugaauugucaugagugagcuuguucuaggaguagauguguccgaguuuucacacaugaaagacuggguccugaccuaccaagaggcaguaaauggaauacucugaggauuaaagacauuacucucaauaugucuuccccauaagccuaagauuccaauuuagugcuacgagaaucaccccucuguauuacaauaugcauugagaagacucucuuugagguguguuagaaagaaauaccaacacacuugaagaccacuagcucauuaaguugauuaguuccuugccagccuauaaugaaauucuaagaucuggagggaauugaauacuggaugauuaaguuuuggccaagcgguacauuacuaaagaaauagggaggagaaaagggggagcccuagucgcuuaagaguaaaucaaggggacacaaauaaucuaggaggggaugguucccaaauggccccaggaaguccuguugggaugggcacccagauuuuuaaccauuuucccucacuccccauaguaccuuaaaucaagaauauccaugaauguuacuaaaugcagcaugcccaagauggaguccuccccaugaguuuacaaagaagacucaagucaagaagacuugauggacuaggagguacuacuuaaaugggaaggaaaaaguuucuugcuagaugcugcaggagacuagaagaugaguagauauucugugauccucucaaaauuucacagguugagcuccuuugcacgauuccauacuguuaggcugggcauucuuauccuuugugacugcugcacaaggaagaaaaugagccacacuaucccuucaaacgcugagagcugguuugacacauuugugcugguuuggauaacuaaguaggagacccaggacauaaguggcagcuggcuggcaaggaugucagaugcagaaguacccagaaaaccuacucaggguguuuucuuccuuuccugguccccuccuguuacaggaaggcugaccucugcacaugccauaugagcuuggcccugcgguuugccuucugccaaagaagucccugauauaaaauggaacuucagaaccuugccuuuuuaggagugucauuagaaaucaaaucaguaugggcugaacaggcucaaggacugcugcuuuaguguggcagcugaaguccaaauuuuugagaguaauugggcccaggcuguuaacaggugcagccacuuccuacuagggagaaagaaugccugccauguguguuacacauggccucagaaggaagccaccugucaagagaaaugcagacacugggcuggaggggcccgaacagugaugcaagucugagugaugacuaaaugaggccccugcaaaggcagaauggcccaggauuguaauuaagacacuuucuuaccuucgcaugguaagauuugacuuguuauagugcuauuucuaguccuaaacucacuauacgucuaugcuaucauuucuaaauuauauuccauucaacacuaguauuuggagaaacacaguuaauuuucugugagaaaaaaaagaguucaguuuuuuggauuugcuuaggagacacuucuuuguacaggcuccaucuggcaauucucagaacacauuauucuauuaucuaaaaauggcugaguaguccuggaguauagaagccugauuaauuuuaagucaccuuucccugaaccaauacagucaucccuugguaucuaugggaaauugguuccaggaccucccucagaugccaaaaugcacggauguucaggucgcugauauaaaaugucauaguauuugcauauaaccuaugcacaucuucacauaucguucaaaucauuucuagauuauguauaauaccuaauacaauauaaaugcuacguaaauaguuauacuuuauuguuuagggaauaaugacaaggaaagaaaagccugcacuuguucaguacaaacacaauuccccccaccccccaaauauuuccaauccuccauugauugaacccauggauauggagggccaacuguaaacauuuucauuagaucuuuuauaaaaaugucccauggaauccuauuugagaaauucaggauuacacaaguaaacaaaaguugagagaacugguuuucucuaucaaauugggcaaaggucuucucugcccuugucauuauguggauacguuuuucuaugaggagcacuauagcacaguggugaagggaauggguuuggacuuggacugcuuggguuggaauacugccuccagcauccauuaccuauaggacucugggcaaguuacaaaaccucucugcacuguuuucugcaauguaaaaugguggugguguggggggguggugugggaauaauaguaauaucugccccagaagguuguggacagaugaagucagacagccuuuguaaagagccuagaacagugccuaguacccuguaagccuggggcaaauguuagcugcagucauugccaccaucaccaucaucuugccaucaucucccauccucucucucagaaucagauuccagaagucauuuugucuccauuuuccucacugcucuccacagucauucacucucgcugucccacuccugcuuuugaaaagccuccaccccucuagccuucauaacuagcacaggccuuccucgcuccaggcugaaauauuacagcuuuccccuagcuagguucccugaccccagucccacucucuacccaaacaaccugcccucaaugcccagacaaaccugccugaaacccugcuguguucuuggccccauucugcuacaauguuucugccuucauugucuagauggcagaguucaagguuaccuuggguugcaacccucucacaaacuaauucaaaccuguuuuccaaaccacauuuauucccucacccccagcuacuguuccugcuguucuucccacuuggaaugucguuccuagccucugcauagacucaaauuccaaguagauuccagaacccaucucagcuugugucuucuucccaaggccuuccugaucccuccaucucuuacucuggcaugggacacuagcaucugcucuacuguggaguggcagguuuagagggcuuagguuuagagaccugggcucauaugccagcuccaaaaugagcaagcggugagaguuuugauccaguuguguaaccccucugugucucagguuccuuaucugagacuggagauugauaaugcucucucuccaaagggauagcaugaaacucaagcaaaaguacuuguacacauucagauuuuuuuccagucuuccuguguguuuuuugaggagcccuagauuuggcaaaggugccuuugaaggcggaaguaggaaacugaagcgggcuagguugucagaccuccagccccugccucuacacuucaaccagagcugcgcuaccuugaucaauuauauuuauauauuugggaucugggugaccuuuacuuaggaaaaaaaagagaucuauuccacaaaagaaagaauaagaaaaccaucucaucucccagcugggcgcgguagcucauguccccaaucccagcauuuugggaggccgaggcagguggaucacuugaggucaggaauuugagaccagccuggccaacauggugaaaccccaucucuacuaaaaaugcaaaaaaauagcagggcguggugguacaugccuguaaucccaccuacucaggaggcugagacaggaaaaucgcuugaacccgggaugcagagguugcagugagcugagaucaugccauugcacuccaacaugggcaacagagcgagacuucauuuucaaaaaaaaaaaaacaaaaagaaaagaaaaaagaaaaccaccucuuaucauuaguaccauacaggcuuuccauaauuauuucacuauuucacaacaguacagcuggucuccccagauacauuguaaccuccuugggagaaaggacugagucaucuuuaaguauguauuuucccuaguuaaauauguuguacccgguaaguacuuaaauacuuguugaugaagcagcucugccuuacugcccaccgguuccuccagagaucacacuuuuauaagguuaagcccaucaagaaguuccuuuuccacuucccugagcaggcagccauggcuucuuuaucuccuuucacucucuucugggaagaucuacuucaaucccagugccauuaucucucucuaccaaacacugcucagagaauagccucugagaccuguuuccuuaccaggauucagaggaucacagauacuagagaugaaggagaaaaaaaauaaaucuaucagggcaucauguccucuccuugugcaaaacgguuaaguccugaacauuuucuaaauauuugucaggccugguauuaaaggcuugaagugacaaggucccucaagggagaaguuggcauuaaaccucacucuuaaagaugacuucuuuuacugacuuuucaguuucauguuucaccacugaaucucacuucucacuuuuaguuaaaucccuucuaaguagccaggcuacagugagugggggcuacagaaaagccacaggaggagucagaagaggguagagcugucacucugugggcuauguuucccucugacuacagguaaucaaaaaggaugggcaaggugaaaucuugacaucucacuugaacagaaguacucccccauucuugcagauuccccaucauucccauucagagagccaaaaugcaacuguguaauuauaagauaaugucuuauuuuuguggccccacugagguuaccaacucagacaccuauaggggcccuuugauaaggauggcaaacccacuuccuucagcauauugccagcucacaggaaggugcaucaugucaccagauuaucccccuuuaaaaaaaaaaaaaaaagaaagaaaccaucuaucaaaauuucaaugaggaaucucuucauuuuugaauguuggcaaugaauucaaauuaucuuuaacccauuguaaaggcacagcugacaccagucccuucuguaggagauuucuucuccuucugaaauccaucgccaauucauaagcaagcacgcaggaauggacaaugcuguauguuuauuacauuuauaauuuuguguguagaagccuugccucaauccucaaaaugcagacaccuaugcugcagucuuuugcgugguuacaucacucaacguccccaguacauauguucagaaaaauggucagguccucagggaauaguuaaaacugugcaggacuagacuacuuagguuuauaucccugccucagugcuugacagcucugggaccuugggcaccucaguuuucucaucuauauaauggugaugauaauaacagcccugggcucauaggguuguugugagguuuaaaugacauagcaggguguacaucauuuagcaaauacacuaggagcuuaauaaaugucauuuggaagcugcuucacauuuccacauucuauuaaaacacccaggaaccaauggugcccucacuucaucucuagauuuugcuaaagaguugguuuaauuuucgccaugucuucggguuucauuuuuaccucugaaggucaaguuggcuugcuacauucuuggcagaguccauagccccuuugaugguagaaaaugauauaaaugaaaaggucagaugaucuugccuggguuaccugucauucuggaagaucacagcuguaugcuaaacuagaucuagguaugugugugggguggggcugaagucuacacccauauugugguaggcacagauauguaccacccagguugcccuucaaggagggacuuggccucccaacuguaagguggauagugauuagcaagcacuguucagccauuagcuacuugagaaugggccucagcuccagugagcugcuucccuaaagaccauacauuucuugggcagcuuucauuuccuacagagugaggcaggugugacaagaugcugcuguuuccauucaucacggaacaauccagauaggcaauaaugaacccagggcuccccacuggcuugggugaagcuuuggagggccuaccucaaaguccagcuucuaccuugcccacuccuguuucugccccuuccuuucacagguguugaugccuaauaaacaucuuguacuccagaguccaucucagcacugcagcccaagaacccaacccaugacacacggguguacugaugcacacacacacuccugaaacccagacaauccuuuaaaacuaucuuuuuaauaaacagaaaccagccaaguuugauuauaaagaaaaccaaucgugcauugagaccuaugggauuagcagggucagggguaucuauagaguugggaaggauuaccacugauauuuucuuccaauuucuuuuauugugguagaauacacauaaucuaaaauuuacuaucuuggcuauuuuuagguguacaguccagugacaauaaguacauuuacauugugggcuacaauugccaccaaccaugugcagaacucuuuuucgucuuguaaaacugaaauucuauacccauuaaauaacaacuccccauucucccuccccccagcuucuggcaacuaccauucuacuuucuguccaugaggguugacaaaucuagauaacucauguaaguggaaucauacaguauuugucuuuuagugacuggcuuauugcacuuagcacaauguccuccagauucauccauaucauagcacuuaucaggauuuccccuuuuucaagguugaauaauauuuuauugcauguauauaacacauuugauuuauucaaucauguuucaauggauacugaguugcuucuacuucuuggcuauuaugaauaauggugcuaugaaugugggugaacaugggcguacaaacaucuguuccaguuccugcuuucaauuauuucagguguaugcccagaagugggauugcuggaucauaugguaauccuguuuuuaauuuugugagaaacugccacacuguuuuccacagcagcuguaccauuuuacacucccaccaacagugcacaugaguuccaauuucuccauaucuuugccaacacuucacucuuuuuugauagcagccaacuuaauggguaugcagugauaucucauuguaauuucauuugcauuucucuagugauuagugaugcugagcaucuuuucaacuguuuauuggacacuuguacaucuucucuggagaagugucuauucuaguccuuugcgcauuuuugaaucagugauuuuuguuguuguugcugaguuuuaggaauuaucuauauauuaugaauauuaaucuauuaucagauauaugauuugcaaauauuuuuucucacucuguggguugccuuuuuacuauacugauggugucuuuugauguacaaaaauguuuuucauuuaaguccaauucaucuauuuuuccuuuugaugcccgugucucuggugucauauccgauaaauaauugccaaauaaaauaucaugaggcuuuugcucuaaauuuuauucuaagaguuuuauaguuuuaguucuuaaaguuaggucggagacucauuuuaaauuuuuauaugguguaagguaaggaauguaccuaacauuaauuguauucuuuugcacuuggauacagaguuuuccuagcggcauuuauuggaaagacugucuuuuccuccauuuaaucaucuuggcacucuugucaaaaaucauuugaccacauaugugaagguuuacuuuuggacuccucuauccucuauucuauuccauugauguauaaaucuaucuuuaugccaauaccacauugcuuugacuccuacaguuuacaguaaguuuuguaaucauaaaguaugaguccuccagguuuguucuuuuccaggauuucuuuggccaucuaggguccuuucaauuacauaugaauuucaggauggcuuuuuguaugucagcaaaaaaagcaucguuggaauugucacagggauuguguuaagucuauagaucgcuuuguauaguauugaaaacaauauuaaaucuucuaauccauaaacauaagauguguuuucauugauugauaccuucuuucagaaauguuuuacaguuuucacuguacaaguuuuucacuucuuugguuaagcuaauuccuaaguauuuuauucuuuuuaauucucaauuuucuuuucagauuguuguuaguggauaaaaaugcaauguauuuuuguuuguugacuuugugucuuauugcuuuguugaauucauuuauuacuccuuacagauuuuuuuuuuugguggaaucuuuaggguuuucuacauguaaguucauaucaucuguaauacaguuuguauguuguccccuucaaaucugauguugaaaugcaauccccaauguuggagaugaguccuagugggaggugacugggucauggaagcagaacucuaauggcuuggugcuguccucaugauaaugaguguguucucaugagaucuguuuguuuaaaaguguguggaaccucccacacccuccuucucuuuugcuuccgcucuggccaugugacaugccugcucaugcuucacugucugccaugaguaaaagcucucugacaccuccccagaagccaaacagauauuggcaccaugcuugugugacuuucagaacugugaaccaauuaaaccucauuucuuuauaaauuacucugucucagguauucuuuuauagcaauggaagaauagccuaauacaaucugcaaacagauauaauuuaauuucuucauuuucaauuuggaugccuuuauuuuucugguugaauuuuucuggcuaggacuuuaaguacuauguugaauacaaguggugaaaaugggcauacuuuccuuguucuugaucauagaggcaaaucuuucagucuuucgucacugaacaugauguucaauguggguuuuuuauauguggcucuuaucauguugggguaguuucuuacuuuuccuaguuuguugagugugugugucugugugugucuguguguguguguuuaaaccacaaagggcuugaaauguggcagaugcucuuucugcaucaacugagaugauaauguguuucuuccucuucuugcucugcugugauguauuguauugguugauuuuuguguauagaaccauccauacacuccaagaauaaaucucgcuuggucaugauguauaauucuuuuaauauaccggugaguuugguuugcuaguauuucguugaagauuuuuguagcaauguuuauaagggauauuggucuguaguuuuuuugcaaugucuuuguaucaagguaaugcuggcuucauagaaugaggaaguguucccuuuuauuuaauuuuuuugaaaaguuugaaaaagaucgguuuaguuguuuaaauuuuugguacuauucaccagcaaagucauaaggucuggggcuucccuuugcuaggagauuacugaucacugauuuaaucuccuuacuaguuuuaggucuauucaguguucaugacuuagucucauagguuuuguguuucuaggaauuuguccauuucaccugaacuauccaaugugcuggcaugcaauuguuuauauuacuugcuuauaauccauuuuauuucuguagacuugauagcaauguccucacuuucauuucugauuuuauuaauuuuagacuucugguuuuuuuucuuagucuagcuaaaauuuugucaauuuuguugauaauuucaaaaaucacuuuuuccccugauuuucuaguuuuuccuugauuucuauuauuuuucuguucuccaucucauuuaucuuugcucuaaucuuuauucuuuccuucuguuagcuuugggguuagugcguuauuuuucuaguuucuaaguuguaagcuuagacauuugucuuauuuuuaaauauaaguauuuguagcuauaaaauuuccccuuaguacuguuuucauuacuuccauauguuuggauauguuguguuuuuguuuucauuugucuuuuaaguauuaucuaauuccccuuguguuuucuuauuuaauccaguuguugcuuaagauuguguuauucaauuuucacaaauuuuugaauuuuucaguuuuccuucuguuacugauuucuaaugccauccuauugugaucagagaagacacucuguacaaugucugucuuuuaaaauuuacugagacuucauuuguggccuugcauauggucuauccuggaaaaugucucacguguacuugagaagaauguguaugcuguuguuagguagaguguuuggcauguaucuguuagauccagcugguuuacuguuuuguucaaguccucuguuuucuuacuuaacuucugucuuuugucucuuugcuagcauuuuuuauuuaaagucuauuuuuucugauauuaguauagccaacucugcucuguuuugguuuacuauuuacauggaauauccuuuucuguccuuuuacuuuuaaccuauuugcaucacugguucuaaaguaagucugugaagacaguauauaguuggauuaugauuuuuuaaaaccauuuugucaaccucugucuauugacuaggcuguuuaauccauuuacauuuaaaguaauuacuguuaaggagagguuugauucugucauuuugugacuuguuuucuauaugccuuauagguuuauuuugucccucauuuccuguauuccugucuucuuuuguguuugguugauuucuuguuuugauaaugaaaugauuaaauuccuuuucgauuuuuucuguauauucuuuagcuguugucuuugugguuaccauggaaauuauauuuaacauccugaaguuauuacacuguaauuugaauuuaugccagcuuaacuucuauaacauauaaaaacugugcuacuuuaacaacauuauacccuccccuuucuguuguugaugucauaaaauuacaucuauauaucuugacuuccucaaaacaucaacuaauaauuuuuauccauuagucucuuaaauuauauagaaaacaaaacauggaguuauaaaccaaaguuauaauaauauugauuuuuagaccaauauauuuuaaaaauccguuauucucuuaauucauauagaaacaaaaaguggaauuacauaccauguuaaaauaacacuagcuuuucuacuuacaaauauauuuaccaauacaaagaccuuuauuucuuuauauagcuucaaguuacugucuagcaucaccucauuuuaaccuucuggacucccuuuagcauuucuugaagggcagaucuaguucuaauaaauuuucucagguuuuaucugggaaugccuuaauuucuucuucacuccuuuacuucuuuugcaguacaguuuuguuggauacgugauuauuggcugacaguuuuuuuucuuuuaccacuuugaauaucugagccuucuggccuguaaagcuucuaaugaaaaaaucugcugauaaucuuagugaggaucccuagugcaugacaaaucucuucucuucugcugcuuucaaaauucucucuuugucucugacuuucaauaguaguauuuauaauguguuuuggugugagucuuucaggcucacccuauuuguauuuuggugagcuuuuugauguucauauucaugucauucaacaaauuugggaaguuuuuauucauuauuucuucaaauaaucucucugccccuuucugucucccucuuuuccuucuggggcucucacaaugcauacguugguucacuugaugguguaccacaggucccuuaggcucuguucaucuuucuucaacuuuuuuuuucucucuguuccucagacuuaauuuucauugaccuaucuuuaaauucauuaauucuuucuucugccugucaaaaucugccuuugaguucuagugaauuucucaugucagucauuauauuuuucagcuuuacaauuuauuuuugguuucuuugcaucacucucucuuuauugauguugcccuuuugaucagacauuauuuucuugacuuuccccaauuauuccuuuaguuuuuuugaucaucucuaugauagguaguuuaaguaucuggcuaauggauccaucauuaggucuuuucagcucaguguccauugguuuauuuauuuauuuucccuuuaaugcuuaauacguuccuguugcucuauaugccuuguaauuuuauuuuuguugaaaacuggacauaugaaucgaauaauaugauaauucuugaaaucagauucucccccuuugcuaggguugcugguauuuguuuucauguuuuugauuguuguaggccaacucuauagcaaggaucacucugagguauaaacuuaaagucuuuucugagccagugccuugccuggaacaugcacaguagcuaucuaaagucucccacauauguaguugcuuuugaauguccuaguuuucaauaucugggucccaaaaagggaaagaagaaaaauuaagggaagcgaaaaaaggcaucagcccuuuaaauucccuaggagucacuucagcuagagaggaagguacaacaauaauggcuaccaccucuuuuuuguaccucugugauugaaaacggcaaucaguaaucagaauacagaucccaauauuugcaggauagaguccuuuuugcccaccguggcucccacaagccaugugcaaaccaggaguacaugcacagcugccugccauggggcugaaagauggggaauggguaguuauuacugugcuaagaacugaaauugauugaaauuaaucacaauuugugccccuuucccuggaauauucaggccuucaguggacuccagaguuccaaaauagcuacaacagacagauucugccaaugcaauuguuaucuauguggaaauacagauuucucaagcuucauacucuauaaucuucccaucaauuauauuuuaauauaccuauguuuauagggaaagaaugccaaaaagauuuaaaaaaaucacagaccuuuaauagcucuuuggggauuuuugagcaauuucaguaaucuucuaaaauaauauuuagaauaucuucuaaaauaauagagaucuuagaaauuauaaagacaaaaaagauuauuuguguugacauucaauacuuuuucuucugaaauucccaaaguacuuacauuuaggauauauuagauaaauuagguaacgcaaugggaagguaagcuauucuaaguuuuccagccuuguuauuauccaguaauaaugccauucaacuugcuggcacuuagauugucugaggaaccuuuccaaauauggugucauauaaaugccauuguaaagcucuaccagaauagcauuaucagauucuuccuucaaugcccaguaacaauaaaacacuuggggaaaaagaucucauuucagagucccugucucucauccuucacucuugaguauucagcugcaucugucauucuuuguuuuuauauuucuguuuauucaaauaucacaugauccuaaaacagaauaaauccugucaucaugcaaauuccauuuaggacaguacucucauauaugaggucagguucauaucccuuuauaggcaaucaagcuaauguauauaguuguuuguuaagaaauaagauucucggccaggcucaguggcucaugccuguaaucucagcacuuugggaggccaaggcaggcagaucacuugaggccaggaguuugagaccagccuggccaacauggugaaagcccauggcuccauuaaaaauacaaaaauuagacagguguuguggugcacgucuguaaucccagcuacucaggaggcugaggcaugagaaucacuugagccuggcagguggagguugcagugagcugagaucaugcuacugcgcuccagccugggugacagaaugagacucugucacagaaaaaaaaaagaugagauucucccauuauuaaaugcauaugaaaaagaucaaauaaugcaugcgauaugaguuguguccaaaccacaaucucauggaggcaaaauuaucaagacuucaauccgauugguggcuugcaaacuacccuaggccuccaacccacaaauauauacagccuccaacccacaaauauaaacagacacagaugaaaucuggaugcuaggaauucguuuccuaaacuuuccaacagcacguaccugagggacuguauggaagagaugaaacaagagacauguuuaggaggaaggagcuaguuguuuaccaauuaaugacgaacuaucuaaaacuucuuugcucucuaaaaguaagacuuguaauguuuucagaaauaaauauggguuauucuuaaucagguauauuauaagaguagcuuauagaaggagauaugcauuguuucugcagugaaggaaaaagcauaauuuaauuuuugacaaaaucagaaauauuauaagguauauguucagcugcagaagcuauaauaccuuugacuuuaguucuuuaaaauaaauuauagauacacaacuauaugcacuaacagccuaaaaguaagucaugcuggguuuuuuuccauacaauuuuaauuagguauauuuuuuccaauguguuuugaaaugaucugcuaggaccaaaugcuaacaugaaauucccugcaugcugguaguuaauuuaauaaaaauuagaaaggugaagcccuguucccuagagggagaaggucuuaacacaaaacauucauuauuuccacauaaauugcaaaaaguaaagaugcuggauuuaaaaucuaagcaggaagaaacugucaacuuucauuaucaguggacaaauguuuuaauuugcaauauucccuagcaacuuuuugaacagacaacuuuaccucuuuaccaacaucuacuuuaauuccuaauuugcagcugcauaaguacuauguugggcccaaagcuuuggguauaucucuuagagguaauggaauccuuguuguuuucuggcacugccucauuaaaaugaaacucagacucaggguaacccugaaaaaccuaagcccuccaauaaaaaaugugguauaucccugcacuuaaauuacgcaggagaagugaaggcugguacaucacacacagaagagaagcuaaaggucaagcuauuagaguuaaugagccgauacaagcucaggcucucuaaccagagagguuagggacagaauacauggccaccccaaggaacuuuauuuaagauaucaauuaaaaaugagucaccucucuucucagcuccugcacucaacacugacacugggaacaaugacugaaggacucacacaugucugagaaaaggcaccuugugggugugacuugccacaaaagcaagagucuuucugcauuuguaaauguguugguaaggcaacaaaaagaauacuacugugcaaggggagguagagguggugauccuggcaaccuaaaagccugauuguauguucuaauccauucugaugucaccaaagcuccccuucgagggaauaaccuggauuauggccaauacuuucuacuucuaauagucuuccaguuucauuguucacaagggguugguaaacaaaaaucaaugaaaagagcagggucuucucuauuuuggauuuggacacugaugaugaagcugugauauucugauccaggacucaauggcuccuccuggaucuucuaacaaggucaaucuggcugaguuccagacagucagcugauggucucauaugaggaaucuaaaguugaugaagauggugguaguagagugguguaauccucauagcucaaaaacgaucagagcucauuaauuauuaacuaacuagaacuuuuauggcucauuagcuacugguuaaaugucagguaaaauguaauauuuaauagaaaauguuaagauuagaaauaugcagagcauuucuuaugugccagaccuaugcuaaguauuucauauccauuauuguacuugauccuuacaacucccaugcaagggaccuauguuuaucucaauuuaacagagaagaaggcaaagugugaaaaacuaaguaacuugucuuaaguuaaacagcuaauggagugguagacuugagcuucaaacccagguuuagccaacuccaagcccauucaauuaucacuugauacacacccaaccuauguaauacuuagcuuuguucuuagucauuguugcaaagcucauuucaccccucagucaggcuuauuacauucauucguguucucaagagacaagagggucuugcccaaaacuacagaauaucacuaucacaaguugccauucccacuagaauuuaccuugauccccagugaugcuacaugcauuauuauguuaguuucuucuuggagguguuauuuuuaaacugcaagauuaaagcuccuacaagcuucugacaacaugaaaaucagacacgacuuugcagucuuuuuaaaacaaacuaguaagaaggucccaauuaagagaaaaagaguagucacacauaccuguagaacugauuguaauuuacccuuucaucuugcucuaaaacacauuccuugagucucaguuuaguagagauaagauucacccagucgggggauauuaguucuuccuggauauuuuaauuaaacuguuacauugaguaguucugaaaaucacauauaaucauucaagguaugguggaguucuguucuccagcauauggcucuccacccagccacauuccaucuccuuagguaaacuagcuggaggccuucaguguaagcucuuuaauuuuuaaacucuuggguggugcuuuguucuucggguagagaguagagcaagagaacgaauuaccaaacaguaauauuacccccaucgacaagcgggugguguuuauaucacacauacuauauaccaagaaaugcgccacaccuuuuacaugaauacucauuuuaaaacaguaaagacuuuauauuuagagaaguuuuagguuuacagcaaaacugauaguaagguacggagauagcccacauauccccugccccacauauguugccucccauauuaacuuccccccaccagacugguacauuuguuacaauuugugaaccuacaaggacauaucacccaaaguccauaguuuacaagaggauucagucuugguguuguacauucuauggguuuggguaaauguauaauggcauguauccaccauuacaguaucauauagaguaguuucauuguccuaaaagauccucugugauccgccuauucaucccucccucccuccuaauccuuggcaaccacugaucuuuuuauuaucuccauaauuuugccuuuuccagaauuccauauagucagaaucauggagcaugcagccucuuuagguaggcuucuuucacuuaguaauauacauuuaaguuuccgccaugucucuucauggauugauagcuaauuuguuuuuggcacugaaucagaaacccuuguugggauguaccacaguguauuuauccauucacccacugaagaauuucuugguggcuuccauguuuuggcaauuaaggauaagacugcuaugaacauucauguguagauuuuuguguggcuauguuuucaacuccuuugaguaaauaucaaggaauacaacugcuggaucauguuguaagagcauguaguuuuguaagaaaucgccaaacuguauuccaaagaggcuguaauauguugcauucccaacagaaaugaaugagaguuccuguugcuucacauccucucuagcauuuggcauugucaguguucugauuugggcucuucuaauaaguguguggugguaucucacuguuugaacacucauuuuugaaauauccacauaggcuauuaugaucuucauuuuacaguucaagaagcugaaacucaaagaauguagauauuucaaacuggccauuguaagcuagagccaagauucaaacucaaguuuggugaauuucauagccuauacuuucuaucauugagguacaucuuguuuucucaguuguauuaugugauuugcaaguccuaugaauaauauauuuaaauuauaccaacaugaaaacuaaguguaaucuucagucaauaaaauauccacuaaauacuucaaaauaugaaacuggaagcuuaucuaaaugaacuaauucuuuaauaucaccaugaaaggaugauguuuuaaauuaagaagugaagaauuuauaguuuccagauugagaauaauuuccacaaauuuuuauuuucaucauauucuauugugggugugcaugugugugugugacagacacauaugcagacacagagauauggggacacacacauagacacuuuccaucucaugccauguuggaacuucccagagacaguuaaaauuagcuagcuaauuuccauaaacuaucaaaauaaaauuauacuuauugagagucuagaguuccugucaugaagacuuagcaguuaaaaagcauggaagucauggaaucucagugcuccuucguugcaauccacacuccugcuacaauuagaaucccaccaauagauaaagucaucaggagcuaauuaguccacguguaaaaaauaaaaauaagacaaagaacagacuucuaaaaaaaacaaaaacaaacaaaaaacaacaacaaaucauuugaaccauuggguacuucgaguacaugaaaauugugaaguaaauuaauuagcuuugcauugauugguaucaaaagucguuagcccugcacugcaaggaaauccccagaagccuaaggugcaugaaagaaaaaggcugggaaggaaaucaaucucugcucuucaacgcugaugcuuuaaagggucccugcuguauaacucgcccggaagcauuccagggggaagaacccacagauuuauaucugccacacgugucacugaacacaaauacgucugauaaauaauugaagcucgguauugugcuuacgucgcaugugcaaaaaaacagggacaggaaggcaaagaggucaaguuucccaucugacuuuccaaugagcaucccaaucaucacuuaggucauuauucuaccucgugaagugucagaacucauugucuuagggaauccaggugcuggcaucacauauuuagcaaaucucauuucccucucucucacaccgcagagcacucucuaguccaagcacagugcagggcagaauccagagcuuauuuuauuuaauccucacaauuuugugauuuuuacagaugaaaaaacugaggucuggggaauagaauuguuuuucacaggcacaaagcugguaauugguagaucugggauuugaaccgagguccaggaaacucuagagcccauauuauugccauacuaggcucccucucuaaauaacuuucucauuaagugagcagagagagaggagccagacugcccugaggccuuugguauuaauaggaggcuaagaagcucaugcagcuaagucucuuuauccaacggcacaucccuggaaggagaaaaugggcucuguuggaauccuuccacugacaggaagcucucuaccucacauaacuacagaccugauuacuaaaaagacuuugguuugccuuuccaaaacucauauccagugaucacaauuguggccucugaagcaguuugauucaauacuaauugcacucaguacuuggaucuaucauaacuguaacauuaaacaauguuuuccccucgcaggguucuuuugaggauacagugaguauuaaaaugggcugguacauaguaagaauuugcccaauguuaauuauaaaaauuuuccugauauuacuugguaaguuauucuguuaaauggaauaaacacccaugaaugccacauauaaaccaacagcuuugacccucauaaugacccccaucuauccauguuguccucccccauuuaucuucuugucuccaaggucauuauguuccugagugccagguucaucuuucuucuuacaggguuuuauugcauguauaauugguccuaacaugcuuuauaaucuaagcuguuuuaaauuuuauaaaaaggauuccauccuuauuuaaucuuaugcuauccucacaaacuuauuuucccccacuugauauuuuacuaugaagaaauuaaaaguuaccuacaacugaauaauaaugaaaugcuacauauuaaaaucuguacuuauaauagaagauagccucaauguuaauaaggugucaaucuuaaguauacaaaaacugaacaaaauaaguucauauuuagcaaaagaaaaaccacaauaaauaugagcacaaauugaugaaauagaaaaauauuuucuagaaaagaucaaaaaagucaaaaguagauucuuugauaaaauaauuaauagauaaaccuuuuuuuguuuuuuuuuuuugagacggagucuugcccugucgcucagucuggagugcaguggcacuaacuuggcucacugcaagcucugccucccggguucaugccauuuuccugccucagccucccaaguagcugggacuacaggcgcccgccaccacgcccggcuaauuuuuuuguauuuuuaguagagacgugguuucacuguguuagccaagauggucuugaucuccugacuucgugauccacccgccucggccucccaaagugcugggauuacaggugugagccaccacgcccagccaauagauaaaccuuugacaauaucgauuaaaagaggaagauguuuugaaugaaaaagugaauauuuauuacaacuaaaauaauaaauggcuauugucaacaacuaucugucaaaauuuuuaaaaauuuagaugaaauguauaaaugccuaaaaauuuauaacuaaccauaauggacccaagaaauaacaaaaaguuuauauagcccuauggcuauuaaauaaauuaagguaauuguuaaaauuuuuuuugcaaagaaaacaucacaccaggugauuuuacacgcaaauuuuucccaauguucaaggaagacaucauuccaauuuuaugcaaacucuuccauaugauagaaaaaaagagauuauuccccauagauucuguaaaucaguauaacccuguuacuaggaccaggcauaaaaaucacaagggaggaaaauuacagccuucucucacaaaggaauauagaugcagaccauucuucuuaguaguauacucaauuguaaggcauaacaaauuuuauuuccaauauacaaguagcaguguaacauuacagaaagauuucauuagcuuuggaauguaccauuuuucuagcuguauaauguagcaauguuaucuaauuucucuaagacucaguuuccuucuuugcaaaauggcuuuuuauaauaucuaucuaauucugugggaauuaaggaaguaaacaauauaaagcccuuagcucagagucuggaaguaacaguaagcaauaauaaguuacagcuucuauuuaucaaguacuuagcuccccggcugaguauuuuuuuuuuuuuuaacucuccuuuaauccccacaaccacccugaaugguggagauuaugcucaauuagugaauaaagaaacugagucaaguggaauuucaacaacucacccaaagucacauaaguugcaaaaagucacgcuaauguaacaaucgcagucucugaauacugaugccugggguccuuucaaauguggagcugauauuaccagcugcuaucggggacacagcacuuccucugaggggcacuggaguuccuuccacaaggcauggaauguguucaccuuuucaggggaagcaguuuucaaguugggguuugauuugugacaugugagauuaaauugcagcauuucuaauggaaaggcuucagagggcaggaaugagcgauacacugucauuucuccaucucugcgugaggaaccuuaagcacuaaugagaucagauaugucaccgcaacucucuccacucugccacagauuccaggucagaauauuuuuuuuuuuaaacauucuggccacuucacugccuaccugcaacucucuaccacguuccugacauauaagauuuaugauaauuuaccuuaggcagggcuuggaguuuuauuccaccagguuaucaaaaauguugccaauaaucucuuucauauuuucauaggacaagauuauacaaauaauauuccacccuauucuuucccuagagaaacuuacauaucgauuagacagggaggccuaacaaagauucaagagucaguuuguccuaugagcguggaaaacaccacuccuguuaaagauuacagagugacgucacuuaugacuaugcugugcaaagugcuggguuuuuuuuuuuuuuuuuguauccuaaggggcuuuaugcuugucuuuguacuauuggugccuugggaaggaaaacaagaaugcauuucucaacauuuaugucugcagcgauacugggaacugugaaugcuaacauauuuuuaaagagcucugauagagagaaaccagguggugaaagaagguagugaacaagccuggauacagaaagguuuagaguagaacuuacgggcgccaccugcugguccccugacaccacugcccagagcuuccaguuccccuaauuggagucucagcuuuauggccaguuggcucagcugaauauuauuaaaugauuucugucuucaacuaugcuuagacacagccuuggagacaaguaaguaaugcagagagaguaaaagggagugaguagaugucaaagaaugguuugcccauucaacauaugugugacugcugugaaagguguaugggaguuucccacaucaucuaucagcaaaaagacauaaauggugaucuuccuuccuuuucccaccuucuuuuuuuuuuuuuuuuuuuuuuuuugagauggagugcuggagugcaguggagcgaucucggcucacuccaaccuccaccuccuggguuccagugauucucuugccucagccucccaaguagcugggauuacaggcgcccgccacuacgccuggcuaauuuuuuguauuuuuaguauagacgggguuucaccauguuggccacgauggucucaaacuccugaccuugugauucaccugccucggccucccaaagugcugggauuacaggugugagccaucgugcccagccuuuucccuuucuuucuuggagagaaaugauagcaucugaggaggcaggagcgaggggugucuuguggagguggguagugauggcagccugcucuguaacugaacaugcagggcaacguggggagaggggugcugcauggaugggggcagugguguuucuagugugugaggaagcagagcagaggaugagauguacgcagguggugggcagugaaggcuaauauugaacaaaugaguauauauauuaaggauaaugggaaccaaguuucugucagagaagguauuuauaaauguggaagggggaaaagacuuagauuugaauugaagauacugauaugaauucauguggcuuauguguaaacauauacacauacccagauauggaaauaauaauaaguguguguuuguguggacuuauauguacauauuuccuagcucuguguugacugggucucaaagcauugacaucacaggaacaauaagcaugcuaagcacccagaucuugauuucuaaaaucauucuacacggacaggaaccagagcugcuuggagaaguggcugauuccaaggcuggacagggacaguauaagaugauccuggagcaucuuuuuuguaccagaauauaaagaaaugcucaaagaaugauggggagaucuggcaaguaccaacuggaccaggugaucaaguggggauacggucagugugguugccuucugaugugauaugcugagaagagcucagcagcguuuuuguggaauuccugccaagauggcauggaagaauacaugacuugagucuaauaaugaagaaacaguggaagcuccagagaaagagucauccuacaggaaaaaaagaccuauacucuuuaaggcaggaaaacacgagacagggaaagaauaaaaauccauuccaggcugggugcuguggcucacgccuguaaucccagcacuuugggaggcugaggcggguggaucaccugagguuaggaguucaagcccagccuggccaacauggugaaacuccgucucuacuaaaaauacaaaaaauuagccaggcauggaggugugugccuguaaucccagcuacuccagaggcugaggcaggagaauugcuuagaagcugggaggcggagguugcagugagcugaagaucgcgucacugcacuccagccugggcgacagagggagacucugacucucaacaaacaaacaaacaaacaaaaccauuccagauuggaggaaacugaugaaaaauaauaauuaaaugcaguguauguuucuguauagcauccuggaccaaaaaagaaaaugucaucacugagacaguuggcaaaaugugaauggggccuguggacugaaugguagugcuguaucaguguugauuccugauuggaaguguuuuuauaauaguaaugagaagagugcucuuguuuugggaagguaaucaaacaccugaagagugauggagcaucauaucugaaagggaauaucuauauauugaucucucugaaugaaagagaauuaaaauguugcaagguggauaaucagggugaaaggauaccgcaguucuugcuacccuucugucgguuugaaacagcuucagaauuaaaaaaaauacuaaaagugcugagcucugagaagaagaaaauagcauaaguuuaaugggaaaauuauguuauacaugauuagaauccuucuuuguuuucugagaagacccuuuguugggaagaauugaugaucaggaaugcaaaugagaauggccaaaggacagcuagcugacuuacaaaaagaaaaagaagauucgguauaaagaaggagagaagggugaccagguaugcaaggagaaaaacugauugcuagauauugagagagaguacuugcaaacaagcaaacaguugccauagggaauggaacuuguagggaaaagaaggauguuggagaaaaguugaauaaauuuugaaguguuagguguaauauaauucuucuguuauuccaaaucaccacccauaacauccacacccuucaucaacacccuuaagacacagguauuuauuuguuuaccuuguuuguuugauuuaaugaaaaguaugagacugacuggagaacaggugcuuggugagcacagggcagucaguguguaucaguauguuuguguuuauuaugaaaagugagauaaaacaucuacauaaauaguucuaauacaggguagaacagaauaaaaaggagccaccagagagugucagauaaggugugaggaaacuucagaaaauagaaggaaaaagaauauuuacauuccccaagcuccuucucugaaccagaaggugggaauuauacauugaaauagcacgguaugaaaauccaguaaugauccaugaucccccagcuaguaaauggcagagcccagguccauagaacccgaaagaucucuuuuuuuccuacuauagugggcugccuugugccugggucugaagagaagaggaagaaagaggggagucugauggacaaagcucuguggaggacguggcacugagcagaaacuugaaacagagcuugacuggcuggcaggaugagaagaauggacucuuggcugaaggggaagcaagcacaagcacauagagaugaggaagcauggguggugguauauaggguaagugcaaucuauuucaaagacagcuaaaacacaagaugacccauuccauggcaaacauggacaccaacaccauguacaaagaugaugagggugaggaagauugagacgucaguuauacugauugggaggcuguggaauaggcagcacuggcaauacuucugugcccuaaugucauucucugaagcucaaggccaaacccacuggggccaaacucacacagaaacauuuauuuucagacaucauuuaaggaaggcaacaccugaaagauggaagggcucagugcaaacuuccagggugcuauuuuugaaaaugcagaaacucccaguuuggaaauauuuucuuaaaaauuuccccaucauuauuagcacuucugccaaauaaucacuaacuaaaaauauucccuccuugauaaugcacagauaaggucucugcacugaggaggaacaauaaaggaaggugaugaauugcaaaucaaucauaauuuaugcagauacucuacugaaaaucacauucaucaccuuuuccaaauagcgccacaugaauuuccugaaguacaagaagucuauuuucauaaauuagaccuuaauuucuuucucucaucaauauauuuuuaugccaaaaaguuaaauaguaaacaauacagcugaggaagaaauuaugaacuagaagaacaugaaacaugguauucagaaggaaaaaaaaauagucaaauauauuuucuauggccuuugcuuuguguuaaaguguguguuuuuuccccaaaggauuaugugauguaauugguacuaguuggaugaugaauauaaacaaaaaaugccaaauuaucacaagaugccuuugggaaaaaaaaaaaccuguaacugaugcuacaguguacccugccaguauuuuugaaagcaaaacuguacuaguucauuuuuacacugcuaugaagaaauacccauagcuggguaauuuauaaagaaaaagagguuuaauggacucacagccccacauggugggggagaccucacaaucauggugaaaggcaaaggagaagcaaaggcacaucuuacaugguggcaggcaagaggccaugcgcaggggagcugcccuuuauaaaaccaucagaucuugugagacuuacucacuaucacaagaacagcacgggaaaaacccgcucccaugauucccaccaggucccucccacgacacauggggauuaugggagcuacaauuugagaugagauuugggugggaacacagccaaaccauaucaacaaucauaacagcaaucagccagcuaagaccaaugaccauccagcaagacucacuugcuauuucucuguguuaucuaugucaaauggcaccuuuuuucuuagcaucccguuuguagaagagcagacacagagaauguuucacagguccccauucuggggauuauuggcuggguauuuaaauauacuuuucuuaggcuggguuccucuaaagcaaacccugaagacaagacuuugaaggcaaguaguugauuuagaagguaauugcagaaaucaccacuaguggagugaggaaguaagaucgggagggaagaaaauguguguuauuaaacaugugauugcugugggcaagagggacuccguuucacugggaaacacuauagauacguuucccaguuauuccuccacaagagcaaaggagccuggguacuuacucaccaacuuccaugagucauucugauaacugcuaccaaggggugacgggguaggaugugggcugggagauuaaauuccuagcacuuucaggcuaguuugcacugcacaaacacgaaguagacaccagugacuagaaaaagacaacagccagaauguaauaguauuuaaagauggaagccaggggacaauguguagaggaauaguccuauccgaggaauaguccuauccaaggaauacgggcaguacacugcaacagggcccuuuuaaggugagauauuuagaaaccugggucaaugcuugucuccaugccaaugcaguuacccacucccucucagccccagccacucuacgauaaagucuuaaugaacaucagagggacguuucagggccugcuuugugacgcacaucaccccuuagacuacuccagugcucacugaugucccaaauaacaaguccucuaaauuauuggugguuuggucuaauuaucugcugaaagcauucaaaaccauuggguaucccugaaggagaaagucacaaugcugcauaagaagaaacaacgccugcaacggauaacuuauuugcugucauaugauccuauagcauccuacagaucuccuuccauuagcauccaucacaucuguaauuauuuccuuuucauuaucugucuucccugagugaccauaaacccaaugaagccagagaccaugcaugauuauucauucacagcucuacucccugugucuagcucauaguagggagucacucaauacuucugaauaugaaaacaagugaaugaauuaagauuauuaccgucauccagcaggcaaaauggauuacauagcuaagggucuguucuucugaaguaccuucuuauaaaggauaaaaaaaggugcuccuucuuccaggcagaugaagcucugagccagagcucauugcuuaaccaaagcauugcagcucaaauucagcuccugcucacccauuggcaaggugccugcgguaguuuuaagagccaucaacaaauauuucuagcuugucuucuuccugcugaaugaaaaguuugcccuucccugcucccuugaaauuagauguggccauguggcuugccauggccaaugaaggaaaacagauaugaucccauucuagguggaagccuuuaugaguucgugcacaauuuaccauauuuguuucuuucugccaugacaaccagcaagaucgcagauggcagacagugaucggccuauauucuuaaaaggaagagacauauacacaguaccuagcuaacccacaaaaggcauaugauauguuuuggcuguguccccacccaaaucucaacuugaauuguaucuaccagaauucccacaugcugugggagagacccagugggagguaauugaaucaugggggcuggucuggcccacgcuauucuuucgauagugaagaagucucacaaaaucucauggguuuaucaggggcuucugcuuuugguucuuccugauuuucucuugcugccaccauguaagaagugccuuuugccuuccaccaugauucugaggacuccccagccauguggaacuguaaguccaauuaaaccucuuuuucuucccagucuuggguauguuuuuaucagcagcaugaaaacagauuaauauagcauguuagaaauauacuuguauuguuuaaauauuggcgcucuucauuccugcagcauaucuagcccacucuggcugaucuaguauacaacccgcagcccuauauccuguggcccugggcagguuaacacgacuugcaguuucuuuguucucaugaacugguguucaugucauacccucaugcaugcauuacccucucucugcacacaacgugggccucuaagaagcaaugcuuuucuguggaagaaggaagagggggcauucagacuuaacccuuucugccuaaaaggcccuucugaaauuauaugaaagagagagagaaaaaaaaaaaaacauuuugcaugcuguucauuuagaagggaggccuaauucuuucaccuuccuauaaucuccagagcaguuccuauaccaucaaggcugccucuccugagggggccagagcuucaggcucauaauuaguuguauuacuacuacugucacugcuaauuaaugauccacauucagccuaaauugaaacugcccauuucugacuccuccacucuaggucaaauagaugguuccuuauuuucaaauuauguacuucaucuuaauuguauaauuucaauuucauuuaaaaaaagaaaaaaauuaaaccaaggaagaaaugacauuuucuaaacuggugaguuggguuaucaaacuuaaaagcauaaaaaauuaauacugugggauuagcauuauuauagaaauacauuaaaucuuauauuuaaauaccagucuuuuaaaccauggcugucacagugaaaauguuaauaguauuuaaacauaaauccuucuccccaugaagaaucauucaucgugcaagcacguuagcuauucuauucacuuuagagaugcugccuagcagagcauuuuaacguaagccuugucaguguuaauccuaaugucugaugcugagauguguguuauauuacuuuauguagcugaaaaaugggaagccuuuaugucagauuacaggcugaaauaacgaccuccccuuggagccagggccugggauauaacgaggugccaaaugggauucuaggucagagccucugcaggacauaaaagggaacagaucuuuuguuaagacccauucacucacuaacagaaugcuuuuacccuuugcaaucuacuuuauggcuccucugcaaagaagaguaaccaagagagaaagucuugauucacaguggggcuuaccagccaagcuuuggauucaggcaggcgaugguggaaauguacccagccacuccuucaccuccacaaccaacagucuagggcuacgguguucaaauugcauucaucaaauucagaguggggagugagagccugagguucggcagaggcaggaacggggagagagagcaucaaaguggauccagugccuucuccauccucacugcauccagagcaguucccucuacaucuguuuuauauaccacaguuuuaugaaagauggcacaugaaauaugguucuccuguuaaaguaacucauuaauucaacaaauauuuaccagccacagacaauaaaccccugaauaaaugagcacauuucagagagugauagacgauacagagaccagcaagcaugaugaugagauagagaguaccuggaguaagggccacuugcagagaggacagggaaagccuggcugggguuugguggggaaucugagcugagucaugaauaagcagaaacagcaagccaugugagauccaggaagaaccauuccacgcagaggaaguggccaguacagacagccuaaggcagaaacaagcuuaacguguccaagaauagaaaaagggcaauguaacugcuauugggugaauaaagagaggcauggaaaagaugaggaaggcagaucauucggggcauuccagacucaaacaaggaguuugggugucauuguguagugguuggaagccaauggaagguugacaacgggggcaugacaaaaucuguuuugcggaguucuuccacacagagaguagauuccaggcacaagaacauaggcuggaggaucaacaagaagacuguuaccuuccaggaccuggaagagaguugcagugaagauggugcaaauuaucuggaucugggauaugucuaaaaguaaaucugaugggacuaaaggauuacuugaaaucacuaaccagaauuugagaaggggaggguggaacacgugguauguggggagggaggagauagugcuuagaaagaauagaauaauugccacuucuguagauagcuucuggccaacugacuuagcaaagagcagcacaauauccuugggcugagaccagcggguuugccacugucucucaccggcaaucgcauucuugcuuccaaauccggcugauaauuuaggaagguuuuaugucaccgcugcucggcuucuuuuugugcuuugauuaccuauucucauacaacacuuaaagguggucacagaauaaucucuaauguuuugcuuucuaugauaaauaagggguucgugaaguucauuaacagggauugcaucacccuccacccucuuuuacaaccacaccauaaaaguagccucuaauuaguuaaaagacuacaaauuauaccaucaacgugagguauggcaaaaucugauggcucuaauuaucuuaauaaucagcagaaccacucucaaccuaauaagagaaugagucauuagugguaguuuaugaagaucaccgacauucucuuuguuauggaguuuguccuuccuguguuaaaauuuggacacacuuucuacuugaaucuaaaaaggaugauuucuaagaaguuacugaagcaaugcaagaucaaaacauaauaaccacauucauucuuaaucagcauuacagugaaaguaauuuaccaaagaacacauaauuaagucauaaaugaaaucucaagacagaaauugcuccccuuuuaagauuucucauuguccauacacucagaaaugagaagagggauuuucucauucugauccuaaaucuaucacugaaaugaugacuucacuugcauuuaugcauuuugcuuuauuuugugauuacuuuaucucacuauccuccccuuuuucugcuugugugauugccuuaauccuuuuaucuagaaccagggggaguuccauuagcuucagcuuuuugguaugccuuagccacagaaaacuauuuugugauucaaaacugcucuaaaauucaggaccaaauaucacauauuauguacucccuagacuuuugagaguuucacucuagauuauagaggacaaaaucaucuccccaccuccaccuuaggguauguacuccccaucucaagucauaagauaaaccuauuguggucagaaggcagaguacucuaauaaccuuguuauaguugaagagacugaguccaugaaaaaguuacggaccaagguuauacacagagcuggugacagucuugaggcuaaaacccaacguuuuacucuuagcuaauguucuuuugggcuuaaugaaugaacuacugcuguggaaauguuuuuuuuuuuuuaaaaaaaaaaaaaaaaaaaccuuucauuguguuuugccagaauaaagacugaacauggcccuagcggaagagcuaaauucauuaucuuuaaaaaaugaaauuuucucaaaucauaaaugcagucaccaaguguaccuucuuucucugcauugcaguacaccaaaaugccaguccucucuacaaacacauuuuauggaucccaaagcagagagauugacguuguuccauuuccuguucacaguauaaucaggacaaaggaauaagauuaguauugugccauuuccacgcggaaaaaaaaaauuguuuucuccaugugacugucaguguaugucaaaaugauaauggggaauguguaauacaagauauugcuacuuaucaauggacucugaaaagaaaauuagcucaagcaucccuugauauaaaaagcaaauaugaggucuugaaucacaccauccugcuaucaacauguuuuguuacaagucaguuuauguuccuugaguaccacgugguuuacagugcauuucucugacagcaauacagaaccucaaacaaauauuacccuugccuccaauaccaaccaacauuaaauacaaguucuauuccugaacucaguggcauucagaaauucaaaaugcuuagaugcccucuccaucgauuugcuucucuggguauugggcugacuuccuguucaucagggggugguggugguggcuggaggaggaaguagaugguuuuaaccauuuguaggucuaauuacucaagcucagugagcccacauugaagaaggagaaggagaagaagaaaaauucucuuuccuauuguucauauauaaaaucccagggaaagauucuaaucaacucuguuuggaucacaugcuuacuccuugggccaaucgcuguggccaagggacaguguagcuuaauuaggcaagccugguuacauucccauccuguuggcuuggaaagggggauacuaugaccaguaaaccaccccaaaucauaugaaauguaggagaacgguuauuuagugaaaaugaagcacuauuaucagaaagaguuggaaguuauacuagcagacagaaacaacaacacuccacugccuuucaaauaaguuuauuaugaaaugaaacuacggcuccucuuuucuaacagaccgauuuugugauuagaaguaauagguuuuucucaaccaacaagcucaacuaguuuagcucuuucuaccagaugagccaagaauaaaggacacauaagggucucaaagauuaugcuuucuauccugcccaaauucuguaaccauuaccuuuucaguaggugauacauuucccaauuuagacuucacauuauagaaaaaaaccauccuucacugaguuguauuugauaccgaaugccugcauuuucauguacuagucauuauuccaucuuuccuuaaagaacauccuuuuuuuuuuuuuuuuagacagagucucgcucugucgcccaggcuggagugcaguggagcgaucucggcauacuguaagcucugccucccggguucacgccauucuccugccucagccucccuaguagcugggacuacaggugcccgccaccacgcccagcuaauuuuuuuuuuuuuuguauuuuuaguagagacaggguuucaucauguuagccaggaugggcuccuccugaccucaugaucugcccaccucggccucccaaagugcugggauuacaggugugagccaccacaaccggcgaaggauacccauuuuuaaaauaccauuuaauuuaaaguuaccagaugaaagcugcccacuguaauuccagggaaauuuuacucuuaguuuucuucuuuauggucacccaaaucuagauuauuugaauucuucuucugcaguaaaauuaauuauaaucauagcuuccaauuuuuagcugcuacuuauugagugcugacuauucuuggcaucagcuauauuaucauuaauccucauaccagcaauuauuaucaucuccauuguauagcuggggaaacugagauagaguucaaagaauuuacucaaggucauacagcugagaagugacacaucuuggaaucaaacccaccucuauuucacuaccaaaugccuucuccuaacuauauacucuaccccugcaucgcgagcaucaggcaccgagucucuccaaggcucugugauaaauacuacucuugugugaccucaugucacccucacuuuucacucggaauauaaggauucccauucccaugucacaggugaggaaacugaagcuuaaagaaauucaucaacagaccuaguuugcccuguauauagaaaagcucagguagucucauauuuuaaucucuuuuuagccuccuuuuguuuuguuucacucaguucagucuuaacgagucuuaauagucaagaaaauaaaaucauaguaaagaaaacaacaaagguaucucauaaggacaagaacuaauccaucccacuccuacugggcuggcuccuuuuggcaguggugauugcuuucucagaugucuuaauagaagagagaauuugugaaagcagagagccccauuaauaaggaaggaagaaccugcaaggugcaaauaacuaaucucuuguugcuuuccuguuaagguaccaugcaugugucaaaaaucaaaaccagggagcccagccucuaauaugagaagauuccagauuucaaaagcacuagguacuauuugauaaaccaaacauuuucccuguuauugcuagaagcagacacacauaggcacauuugcauccucuauauugauacuucucaaaucauccauaguaaagggcgugugugugugugugugcguguguguguguguguguauuuaaccucuauuuacggcagucugauucaugacccuacuguaaaugacuacuacauaguucauaccacaugugacuugccacacaagucugaucacauuggaacuggucuucuccuuguucaauaggauaaggccaccaauuauauacuuggaugucauggugacuucaaauugcuauaaaguuucuuauccaagacugacaacuugcauuucuucaggacuggcacugauccuccagcgacauuuugaauggccuacuccauaauuuuuugauacaggguagcaaauacuaugccuauaguggcaaggaaguguguacucugcugaggaagucaccucugcagccaccagaaugacauuucugaagccagugagagcaauaucagagagcaucaauauuguaaauacguuuugaucuuauagauaaccugaauuuugcugugugcgcuauuaauaacuaauauuuguaagaaucucaacaauuuucaaaaugcucucuuauauguuaacaaauguagcccuacuacaauccuguaacauaguauccuuacccacccccccacacacgcacacauacaaagaccaccaccuccaccccauuuuucagaugaggauaauggggcuuagaguauuugggugacaaggcuaagcucacauaauaaguuuuacaggcuagcaggaauaacaccaaaguuucauuuuauuugcccacuccaaagaacugauaaugacagccagccaggaagcuacuuggaggcugugucuggguucaguggguaaagagucuuugagagauuagcaaugucugccggguaagaccagauacacuggauacccuuggauagauuccaauccagguagccuaauuuccuuuuccacauccuuuagcacuccacauagaguuguuucucacaaguauccacauuuaaaagagguaaccucccagaacagaaacuagcugacauuuuggaggcaaagucuguuucucuugcgcacugaagacaagaagagucaauuugugauacguguuacagagauaauacacaucuaaacagcggugauaaaugcaugggaauuacaggcaaaaccaaggugauacaaaguuuccaaagauuagauguaucucagauuaaacucuccagauuauacuaaucaauuacagaaauggggcugagugggaguagucacugaagccaccguugauguacuuucccuaaccauuuuaugcaggcauuccuucaugggggucuccucaagucacuggaguccucagcaggggaaaggaaaacagcaauagagaaggagguuaggaucuugggcuucauuuugggagucacaguacuaaaacaucaccucaugauuagcagauaaaaggugcugcccugggcucaggcaauuacaggaagaaacaacccuaaagcagaauucacaacauacugaguucaugaggagggcgaugaggcugauguggggacuggcuuuucuucuuggugacucaaagacaaagccagcaguacuuauuuaaaacaugccacgugcucauguuuaugugaggaguagaagacaacggcuuugguaaaggagaaaauucacugcauaauugaaucuuugaaauuccagagggaauggccuuuucugagaacaaugucuguuauuaacagaagaauuucgaggccaaaugcagaguuuuccaccagguugcauagugagagucauauuuugaauggauauauaguuuuuuaaaaaaagaacucugaagaguuauggauguuucucaauaucuuucucaagaaggcaacagauuuuggacucagcagauaacccuuuauccuauagcuguagugaugaugacaugauaagcuguguagccugagcuuagaugcagaagugaauucugggcaagggucccacuaaccugucuucccugggcuccagacccacaucccuagcuccuuguugggggcuccaacuuguacagccagcacaucaggcucaguagguacaaaguugacauaucaauuuucccaugaaaagagaucuuguuuugacaacacuagucuuucaguuaccuagacucaaaaucuagaagcagcccugcucaccuucaucuccuucacagccugaacugagucaagggucaaaucacauagcuggguuagagauauuuuugacacaauuccuuccuuccuuuccacccacuuugaguuggcacuugcuuaaacacucccuguuuuaccucuggauaguuacagugccccucacuuguuuccucaucuccaguaauuauccauuccaacccauccuuuaaacccaugccaaaaucacuuucauaaagcuuaccuccacauucaaaucucaguacucuaccaggcacaugguggcuauucagguaauauuuucuggauggauggauggguagauggacaauguauuuacucaucauuuacuauaugccugacauugugcuggguauuaaagacagcaggaaacaaaccaacuucuaacaaaacacuucccugcucaugagccuugaauggccaauuaacauaaaugguucauuccagcauucaagcccuucugcagcacagccccauucuaauuguuucacuggucaccuacucucccaucuguccucuagccaaggguuucugaccuuagcacuauugacauuuugagccagacaauucuuuauugcagcugcugucuucuguauuacagcauguugagcagcaucccuggccucuaccuacuugaugcuaguggcacacagccccacucaaguugggacaagcacacaugccuccagacaaugccaaaugugccccgggggagaagagucgaaaagaacccaacugagaaccacuggucuaggguggcgcccaauuuacacccacuguccuagggaaauuauuaauaguacuccccuuucacuuucacauguguuccaguuuagaagacaaacuagauugguucccugcuuaaaucucccgagacagcaaccuugcucuguucucaugcagauugaagaggaaagcaacaaauuaguaugaagccuucagcuuccaagcaacacuuuuuuuuuucuggugaaccggucuccucuuuaaagauucaacuucucucuucuucuuucagcacaugcaguacugggaaguaaaacuggcccaaaugcucugcagggaaaugugaggaucauaagcuauccucgccucucaaaaaagaaucacaaaaauauuuacagcuuuucucaaaaaguuucauguuccaaagauccccuucuacgucauucuaaccccaaaugccucaaaaagaaguucaaagcucucaaguccaucgauccaacuucuucucuggccaaaaaacaauuucgugccauguguuaaugcaaagggcucaugcuguauucacgaaaugccaagacaccugguuaaaaaguucaaaaaaguuaaaaauugauccauaauuucgacuagcaugguaguucucaagcuuuacuguuucagaauucccuggagugcuugcugaauuggagguuacugagccccagucagcagaguugcagauuuaguaggucuagggugaggcacaauaauuugcauuuccaaguucccaggugaugcugaugcugcugguccagggaucuagaagaugcccgcugcucccugcuuauucccucacagacugaaacguacgauauuacgggguuaggacagugggcuugggaaagaagggagggaggucaggagacuucauccggcugcuugcuuagguuuuguguuuuucauuuuuuuuuuuugccaguuagucagaagaaaacgauuuuacccuggccugugcugggcaccaugcuaggcacuagggaugcagcaagaaccagacagaccuugccuccugcuguuuuccccuuuagagccacaagcucuucuaugggcuccaauuccauuccuucuagcacucccuuucaguucaucagcugcuaaucagcaccuucaaucacucuccaaauccccacaagacagcuuccauuuuucaaaagcaaagccaaagggaaaaucaagaguuuuuagaagcaucuccuauuucggcaagugcuucccuuuuugacucugauccauuucaucaaaaacccuuauuagagugguccuucccagguguaucuuuuuaguuaccucuggagauaggaggugcauccaguuuauucuuucugcuuuguuuccuguccagaggagaagagugcuuugauccaacacugacaaccacgucugcaggggccucagacuugcuuccagggaacaaucacucagccuaugauuuugaaugcuucuuuugucacugucaccaaagccugagggaaagcaaucuacacgcugguugaccucugaggcgacugccagaggugccagcuguuuccccuaaacuacuacucacuguugaaugucuagguuuccaucucccagggaagacauugccccagcuuaccucuucaucaucauuugggaaggccagagaagugugggcgaagccauccugccuggcguccucaagacucuugucugauaccagggcucucucugggucuauaaucuuuguucagggaauagggaaaauguccugugauuuguuaaucccuccugugcagugagggggaaguuuuagaguaacuauuuauauuuuugugauaucaggagcaucuagauaucuuugcuuacaaguuuuuuuuuauaauuuuagcaaaggaaaauuuuauaguuuuuagcaaaggaaauuuuaccuuucaucauaauaaaaaauguauucuagaggccauuauucauggguuaauauuaucagggagcuaacgauggcuuaacaagagaugggaagccauuuuggaaguguucuauuauggaaagagggagggccugugacauggauucauauaucauauucauauggauucauaugccagccaugcgucagccaugaguaacaucauuucuuaagaugucagaguuuuucccaagcacauaugcccucaggaugagaaacaacucgucuguuugauaaaaaaagaaaaaaaaaagaaaaaaaaaagauuuuaguucaagaauuuuauagauuacaaauuucagagauucuuuauuccaguauagagacacagaaaucaaaaagaaucaucacucaaauauacauaggucuauuagguggggacaccugguagauguaauuauaguuucauaugccuguauuuaaugccacugaacuguacucuugaaaaugguuaaaauaguaaauuuuauguuauguguaucuuaccacaaauauauauauguauauaugcagaaaaaacauauauaaauauauauucauuaauuagguaucugaauagggagcuaugaucuuaaaaaagauuauuuuuuccuaaauggcaaugugaauuucauguggcuuaaaaucuucuaguauggauuuuugguguuugauaagcuacauuauuuaaacuagaauaaucuggaauuauagagaaguauuuggcuucuggggccacugggacaggggcagggagggagugugggagcagcaccccuccccagccccugcugcugugggaguugggauggggauggcacuucccucaaaggagaccaauguuccauugucagucaacuuagggcacaaaacagucuucaagagagaagagguggaggggacucauaccuuuggugggagauaagccccugcuacaggguaacacaggugaaggucaaaaugacuaguagagaacaccuccugccacuaagggguaagaguaguaacauguaaaauccagcuuuaagcuuuacuuuccuguguuaguaucagacacugcugguugucuaccuacuuucuguucccccuucuuaccucacuaacguaacuccaauuuugagaggaagcuacccuuuuucauuuguucaacuucuucuugggaagcuaaucuuacccuugacccaacuggccuaagccacugauaggaauaggaagaugauacaauuccggucauucacaugcucagcuagcugaggagacaucugugaaacaguuccuuguccaucaaaagagacacauaagaagaaaugagaaucauucuuuuccaacuguuaaugggucuagauaggauggcuauacuacuguaguuauugugugaccaugaagugugcuaaccuugagccagaagccaaugcagggaaauugaagaguagaaagaagggaagauguuauauucuugaguaugacauuuaugcaacugauguaaccauucauuaucucaaagguggaacuauccuacccuuaaacuccuuacuauuggaacuuuuugaaucaugauuucuauaaugugcugccaaaaucauucuacuuaacugguucagaauuguaauucuuucagguuuuuccuaaagccauugaaaaaugguuugucauaaaugacuguguagaguugacagggccuuuggaaaacugagugggugcugaugaccauacagggauaaaguggucauggaacaaccucugcgacaugaagauauggcugcaagcagcaagagauaacaagcaggaaggcccagagcagugauccauagcauaaagugacaagugacaggagggacaggcuugugggacauguaaacaagcccuaugguucuucagaaauacgaguggagaggaggucauuuaagacauugaccauguucagacaugcagaguagaggcuugggcuaugaucaucagauaccaaaagaaaaaguaaaaagaugaagauuuuagagggauucagauaauacuggcuauaaggaauaucacaggaucuccugccaagaaaaugagauuccuauaugauuucuuauaucucuccauauguuuccuauaagaauacuagccaucaaaaugacaaauucaaauugguauauucagacaaauagaaagaaaguauuucccuaucccucaaaugaguuggauaaccaugaauggugagucagaugagaaagaaaaugcaacagcucucacucagaccuggacaaaauguuaaaagauuuaguaggauggucaaaaacauaguuuucaccuuaacugcuuacuuucaacucuucauuggaauaaaugcauauaggccaaauuaauaaggaauaaguaguuauauuuuagguuaauaguuguaccauuauuagaaaaaaucugccucauauaaaugcagccaugagcacuuccuccccuuuaaaaacuaguauaauaaaaggaaugacugauuguacuuggcauauuuccccucucugugguugcauuucacugcaguuaugaaaacauaauauaauuuuucccaaggccaugguuaccugacagaagcauuuaaaaaccaacuacacuuuggacuuccaggcacgugugugugugagucauaagacaguucagaagagaaauucauauuugacauccagagcuccaucuucccgccucaagugucuguguggauguacuuacuccagucuuaccugaguuucaauaauauggguuugucacagguuguuaugggcucuaacuaacagcuguccacugcacugagaacuauuauuuucagaggcaggucagaagcccauuucugacucucacgcauuguaaagaaaugcugaccccaaagugggauucuuucucaaauacacucacccuguaagcaccagguagagccaggagcuuucaaaagugcucugaguuuaaacauuucacagcaugaggaacacagccgaagagaaagugcaagaaaaacaauauaaagacauuauuaacugugugaucacacaagagugaggccuccagaugggccaccucauaguuauugacgagcguuuagagaagaacauucauuacucgauauugacgcuaacgagaaaggguuugagagcaaguuuaaaauguagaaggaggaaacacccaaaccccauccccauggcagcuaauucacuguucccaacaauucugcaugcuauuuuuuuuacuccccuuguucauaucuuauacugugauuaaacccaagcauucugacuguaaacccuuuuuuucugucuauuucgcauaggcuugguguguuaaucaaacugucagcaaaggaaaaaaaaaagaagaagaagaaagggcacauucuauccaaaugaagaaaaaucugagcuuucuacaacaaacacauuuuccaguggaugagcuucucacacaguaauuauuucacuucucccagagauuacugauuacaucacacagaaaaacuaaaugagggcuguuuuaucuuucucaucucucugugguucuugugcaaacuuauacuuguuaucaugaaaaaugacaaauuugccaucugaucaaaauguuaacaagguaacugucagugagauggaucucugacugucacugcaagccagaacaugaggauacauugauauuucucaauacagccccugcuuccccaacguucacuaacuacauuuccacaguaagguaauaaaucacucagaaauaacgagcuauauaggaucucugggguaugauagauguguccuaacagcacuaucugcaagauagaaaacaauugauaaugaucuaaagaaaacccuaaucaacugccauuuuccauaaugggguagaugaagcaaagauaugaaaucuuaacuaugugaugcauguuaugacaaaaccggacugcuccaaaaaaaacccacacagccccaaacaaaacacaaaugaccuaacauuacguagggucgaauaaaugaaaaauaaaguuaauaacacagucuggauacaaacauuauauuggacacuggcaaugaugggauaaucacagcaauugcuggguccacaaacagcuaaauaguggaggguuccucauauaacaugaaugaagacucuggcucaguuauugguuuaaugaacucuccuccaauacuuuuauguucuuuaagacucuuugggccacauuauuucugagccuuuaauucaaugguuuaaccaaucauuucccccacccccccccccccgccccuuagcaacguggccaagugccacauccaaaggaaccaagagagaagaggagaaguccauauggaaauaggagguaaucaaagacagaacacaagauagaaaacuucugcaagaagaucauggcuucagaucacagggacaaagaagcauggcaucaaacugccaagaagcugccucauaacgacaucccuuuagguuuuaagguuaagaagucucacauagccacaguuggucuccugccuguccccucugcucguuugucuuuggccauuccugcuucugcuguuuguagaauacuccaagcgccuucccuccccaagaccuugugccugcucuucucucucucucagggaucucucuccucccuggcuccuucccuucauccagcuuaaaucuuccccaaggaaccugccuugcccuucgguuucaaaguagccucuacuaccaccccuuuggucucuaucagcuucaucgauagcagaaagaaccaugucugucuggaccacuguaauuuccaggcuucuagcacuuucucuucucuaguagggauuaagcacagucccaauccugggcucugggauacaggacugacuagccuugaaucuagugccacaacuaaguaccugugucccacugugcaagcacucaauuucuaugugccucaggucccucauuuguaaaacagagagaauagcaaugccuauaaaugacagcguuuugaagacuaaaucacuuuaucaauguaaagagccugagauaguaucaggcauacaggaauccaucaaucagcugcuguuuuuauaagagcaagaacagagguaauucagacauaaagugaauuaauucaugauuauagacguuagaucaaugagucaccuucaucauuccagguuuuuauuuuaccauuagccaaaacaguauugugcuccuucuaauuccauauucucagacuacauggaaugaauggguauuggucuuuaagccucuuugagcaaugccaauaaauacagucacuuccaauuugagggcacuuggaauagcagugcuauuguuccuuugacaucucaacagcacuugaaagugaaagaaaaaaaaauagauuaauggauguauucccuaaagcaacaaacauguuugauguauaaacauauguuaugggcaaugacgcuguaccuuuggugccacgucucaacaauucucuuuucaucuauccccuaaucaugcaacugaaugcuuccaguaggccacacaguagggacaaaaugauaguaagaccaccuggcuauagauaccugcuucuagagaggccagguuccaacccauuacaagcugauaaccauauguaugauuuuugcuacacuggccaaguauuuggaucuuuuuuaaacauauuugauuauuuacccuuugauuagaauuugugaauaaaaaugucuuuuaagagacacaaaggaaggggguacgggcaauagcucauuacuaaaaaucauuuuaguguggaaagugggcuucacuauuccuauaaggcagucauuuucaaacuucagagcaucacaagcccccuguuagauucuaauagaacccugaggaaaaugcacauacacauaaauguucacauauaauuucuacagguugaaggaccucccaaaacaaaacaaaucuaucaaccacaaacuccaguguaaaaaacuggcucuaugaagacuucaaaucacccucacuuccuuugcauauaaccauuuuuuucuucagacaaauaaaaaauacaauuaaguuuaauacaagaagaggcuaaaaacauuaggauagaauauuagaguuuaaagaucuuugccugguuauggucuaaagauauuugcuuugauuaauauaugguguaacucauuaauuaaaugcaaauugaaauaagauaaaccuguccccauaucauuucugguagacaauaaugugccaguuuucucuccaauaaauuagaugaggcaagcuuucuguuacuaaauaauagcaauaugggacaggagaaaaaaauuuaccaugaggugcuuuggaauuauucacaugaagaacuuuuuauuucuuacuuucuuuuucacuaaaauaguacuuuuucucauuuucaaccaauuuuuaaauaugagguguuuacauugcuuacuguucaaauuagcauugcauacuuucaggcacagacaugcucaaaauaggagucuuuugaaaugccugcauucaguauaaaacacacugcugguaggaaaugcaaaauguaaaagucuuaaaauacauuuagauauggaaaacaaaacauuuaaaacauauucacacuuuaacauguuuggaaguauaaaguuaauaucguuuaugaaacaaauuucaggaaucauacuauugaaacacccucacaucuucaauuagcuggauuaaggaaaaaaaauauuaacaauauuuaaaugcagaaaacagauuaucaggaagagagaucguuauagcaccuuguuuucacuaacaagcagagcagacuguaauugaguuuuagaaaucccugaggugguaacucgguagagaaauccagacuuggcaaggaaaucaaguuucccuuuaauuacauuaucucaaucaaagagauaacuuucacaucccuacaaagcaaauguuuuaaggagaagucuggcaaggaaaguagguggagguacagagggguuaagaguuucaaauaacuucauauugguaggaggaacauguagaaaacugaaguacacugugaggaagaagacagaugcccuggcaaauggugcugcucccaaaaacauaugacaccuaacaccuugguccauugguccugcuuuccuauaucagccuugguuuugccuuugucacugaagaaacauggcauguuccuuaguguugaacacauaagccuaaagcugaucuacaguuucuuaagcugauaaaaggcaaagcuaaaaugacuuuggccaugacuaugcuguucggaggaggaaaaugagaauguucaguggaaauuauuuucuuggcaguguccuuacuaggucagcaaaccuccauucuuuccaaauuuuccgggucuccugcuuauuucaggacccauauaaggaggauauaagcagugaugugugagagcugguuuguaccagaucacaagagcuguuuguauaauuuucagaaauuuuguaagcugguagcuuaaaaagccauuaaaaauuaaauuguguaauuugaaaguaauaaauauuaaaaacaaagggaagaaaauauuaaaaacucuguaauuccucauaaugucacuacauuuuacuauugucuaugcucuuagguuauauacaucuguauuagucuguuuucaugcugcugauaaagacacaccugagacuggguacuuuaaaaagaaaaagagauuuaauggacuuacaguuccauguggcuguggaggccucacaaucaugguagaaggugaaaggcauguuuuaugugguggcaggcaagagagaaugagaacgaagugcaaggguuuuccccuuauaaaaccaucagauuucaggagacuuauucacuacgacgagaaugguaugggggaaacugcccccaugauucaauuaucucuuacaggguccgucucacaacacaugagaaucaugggagcuacuauucaacaugagauuuggguggggacacagccaaaccauaucaacgucuauuguaucuugugguggaaauacucucaguagugugcuaccgcacgucucuuuccaagucugugcagugacaucagguuuguagcuucaauucagccauaugaacuggaaacuggaaacacuacagauuaacuguuuucuuggcuaucuagauuuaagaaagugaugggggaaaauaaugauuauggagacaaagcuuaaaagcauauugugucaauagcuguuacauggugaauaguacaaaaaauuaagaaaauacccuuuaguguucuauaucuauuaucugauuuggcaaaaaugucacucauaugauugacaaaugaguaaaguuuugacauauauucuuaggcuucacuuuugucuuguuuauguaaacaaaaaugucaaccaauauucaugucugaagcacaccuguuuugucagugacaugagcaacuuugcuuaauuggguaguaaccaagcauuuauuccuuaucugaauuuucaaaucauggcugaaucacaaucauaaguugacugugauuacaggaauucaacaaacauuaacaaaagcauucugugagaaucaaauuggcuauauagaaucuaugauaaagauugguguauauuuuaugauuacucacaaauuguguggugcacauuuuauaucaguaaaauuuauaauaagcagucagauguaugaggguauguggauauauguuuuuauauauacacacauacauacacacacaugcauacacaaaaaccaguuguuaauauuuaccagcacaccacuggauaucaacacaauaaagauauacuuuauuguguaucucagcaaaaacugaccacucaacuuuucuagggacaacuuuauuaugguuggaaacuagaggcuaagacauuuauugugucauuguugaaguuccguaaaaccauuuccuaucucuaaaguuauuuauuuggcuauaaugccaagcuacaccagcuacuuccccaaaagcaaggcuaccagauggugacagauuugaaagcucuuucucauauuuugaggguagguaggggagucacgcuaugggacaguaggaaaauccacuuuuagcaggcaggauagaaugggagaagucaacaccuugucaguugccaaugagcugcugagaaguaguuacaggguauauagcaggauaguauuaaacugaaaggucauuaaugugagauccuugggacaauaugcacucuguaugucucaauaauguuaaaagauucuguacaauauuugauuguauccaaauaguuuauaacuguaacauuuaauuucaaggacaaaaaugaacuuaagucaacuauuccugugguuuuacauuucagagagcaguaagaaaaauucaccaaaacaaaauaaagcaaaacaaaaauggagugccaaaacagauuugcuaauuuuuaaaaauguguucaaauaaagauauuuucaaauccuuccuuuuauuaucacccuuauggcgcaaaagaaagcucaucaguuugcuauuaggaucauuugguagcacacaaaguccauuuucuauauauguucagaagaggaaacaggaugagcauugggcucagccacuggagaucacagcuucaucaugguucaaccucaucuucagacacugaaaauauugcugaagaaacaggaagcagcauugagcacggggggcugccauguguccucuccacugaagauagucugaaggauacagugaccgcaggaacaaaaaugcccucagaaacagcccuaaagggcuucuagaaaguacaugcuaccugaugcuuuuuuuuuuuuuuuuuaacgauugaugucucugauuugauuugguccaagcuauucugagaauucaugauggaaugagaacaucagcaacugcagccuauuggauuucgguuuaguagaguacagugcucuguuugaucauccacuuuucaagagccagcuucacauccuaacugcaucauccuugcaaagcucugcuacuuugaaugcugcuuuuuuucagucccugaaauacaugugccuggggugucaccaacagguggguuuuuuccucugacuucuuuccauguaagccucaaggcauguauaaaggacaugagcgcugcuuucauuuuccaaaagaaaucagcuuuauacugggaauugcaagcacgugccagguuucccauagugacuuauaugaacucgcacauacucagggugaguaaaacuagcaggcaggcaggccucaaccaagagcacauuugcuaguuuuucuugaaauguucagaacucuggcccuaagagaagcuaaugccaggcaaucccuugcaaggauaggaggguuaugggaucaaggcaaaagacacauuuggggaacaccauuccauugggcaagcucugauaugcagaaucuaaggcagcuuucuggaccucugaauaucauagcaucgcaguggcuuccuguggcucugugguuacagaacaauuucuaccaaaugaagagaaugacagaagcaaggaccuccacauuccuaucauaugugacagucuggaaaaaggcaguguucauucuuaccucuccuaacuucacucgcucauucccaggugagccugaggccacauuucaccugagcaucccagcuccuacagucagaggaaagaacaaacuucacucccacugaauuaggaccaacuauuuacuagacacugugcagguauuauguuacugucucagucuguuuaguugucaccauaaagaaauaccugaggcuggguaauucaagaagagaagaagguuuaucuggcuuauaguucugcaggcuguacgagaagccugguauuggccuuggcuucuggugagggccucuggcugcuuccacucauggcaagggugaaggggggcugugugugcagagaucacauggggagcgaggaagcaagagagaagggaagaggcaccacacucuuuuuaacaaccagcuuucaugggaacuaacagaguagggaguaacucaccaacagagaggucauuaaucuauucaugauggaucuacccucaucacccaaacacuucccaugaggccccacuuccaauauuggggaugaaauuucaacaugagguuaggagggcacaaacauccaaaccacagcaauuacuagucaauuauuuccgcaguccagugagacaguuuucugauacuuguuuacaggacaagaaauuaagucuuuuuugucuauuagacauucauuuauugagaaccaacuauuugucagaaauggugcugcagggcuaccagagaaccagacaaauguggccccugaccucauggaauuugcauuccuguggcacucaaagaagugaguaccuaagcagucaguaaauaacuuuggcuggcugguuggcuaaguguguauggagcagggaggcuuggaagggggaaaguaacaacauggaaagaaaagcaauugugcagggauuccuagauaauaagccaaagacccagaauuugaacuucagccuaauucacuuuugacuuuaucaagugacauagccucgcagaucccccaucucuuccuaucucauauuaaaaacgaaccagagcaagaacaguagcaguggaaucuuucccauggcccaucucuguucgcuggagucugagcaccaucuuugggccaaaagccuggggaagaacaggaucuaaauuccacauuuguggugaggacuagaaaguuucagaacauugcccuuuuaaacucaucuuuauuaauauucuuuaagcgcacagguaaugagaaagugcaaauacagcccccucuggcugcagcagucagagagccaagaaaaaacugcaugucaugccauccuauuauaauaacagauuaaaagggcacaaacaggguacuaauuagcagucauaaaaacuugaagcuccagauugcucaucuucauaucugggcaguaaaaguaccacgugugcagauaacauagaaguaaaauaccagggugcaauugcccagagcucagccagcaucagcugagagaagcaguugcauccagcagcacauccuacacuuucucaagaauccaaaggcauucaggugacugcccaagaauuaaaaaucagccagcccagagagaggcaagugccuccuaacucagcaagggacagcgggagaccuugccaacuucugauugaucgucuucaauucccuuucuccaagauguauuccuguccauggucucucccuggauuuuaugcagaaagcuacuucugagaaaugagaggguuuuauuagcaugcaggggccaaaguuuagccugaaggagagauaccuucaucaauaaaaucuuuuuugauuaaauucagucuuuuuucuugggucugcucagagcuuggaaaauaagacggguguacuuucuaacuuuuauccccaauuuguucccugaggauuucaaggauucuguugccaucggggcacucugaaagaagaaaggaaggaguaugcuuucuuuaacaaguugucucuuaacaaauucauacccaauaauucaggcuuggacauucacuguacucaccuagcuuggccaaguggcucuguauucuauguuaacugugaucuauaauuuuaaaaguagucaugcauagcuuauauagagaaccaucuuuuaaaaaauacucuaaauuuuguucuaauaaggagaaaaguguaucuacauugcaugugauacugaaacuagacaaauuccuuguagccuuuuaucugacaacagcuaaaaggcccaaauugaaggcaaagcaaugaugcaagugaacuauacaauaagcacaauuguauucauuuuauuuccaacauuauaauaaggaccauauauuauucacugguauauauucucuucacuguacagugaaauauaugggaaaaaaucaagacccuucucuuuuaaacauuagcucuauaucagaaaggaaauggucuauauuuauugauuuucuuugagggaucuagguaaauaucacagggcuaugacuggguccuagucuccauaccaccagugauauggcuuguccaacaugaccuuuagaaagacucagaguuuggcuuuguguuucucaucugucuuagucugcuuuugcugcuuuaacagaauaccugagacuggaagauuuauaauaaacagaaauuuauuuggcucaugguucuggaggcugggaagucccagaucaaggggcaagcugcauccagugagggccuucuugcuaugucauaacauggugaaaggcaucacauagccagaagagagggugagaagggcugagcuaguguuuacaagaaaccuacucccaugauaacaacaucaauucauucaugacagcagggcccucauaaccuaaucaccucuucaaguucccaucugucaauacuguuguucuggggauuacguuucuaacacauaaacuuuggaaacacauucaaaccagagcaccauccuauucucaguaauacccuuugucuuaauuuuucccuacuaaccugggaugauauucaaagauauucaacaaugcuugggcacugaccaauaaaaaugggacuagacaccaggcaucaagaggcaguccagccuuucuaauucauacugucugacauccauccagucccaauuguuucaaagguucuggugauaauaggggccaccucucccaaauuugccuucuuaacuggauuccuaaaaggacaagucaugaaucucuaaucauaauucuagcacacguaccacaggccauuaggaaaacuauccucagauaaaugaagccuccccauacccucaaauuacaucaugaaggugagacccuuagcauggucucugacucacuaggcaaccauggccaagugauuugcauucuugagaaaaacuuacccuccuuauaacagagaggaggaucccucaaagagauccugaaagcucaaguaggagaagacacuacaacgugguuggaaugcuucaaaagauaauacuuucuaauccuaagacauaauugcuaauaaaugguuucuuuuuuacguaaggucaaagaauuuuuaauaaauacagucuuuggugcucauuaagaagacacuaauucuucauggguucauaagcacacacauaagaaaaaucugcagcaacaguacaguaauaaauguaaaauccuaaugagagaacauacauuggcuggaaaaggguauuguucuuuucuuccuucuuuucuuuugcgaaugauauuguaaugaauuuucuucagaggacuuauuagugucuguuuaauauuaucucucucuuucaugugaaaacuuuccuuagaaucuuaggcaaagcuuuaggccuucaaugaagacgucauuaaaaaauaauaucuaagcagugcucaaaauaucacauuacaacaaguuaacagcacugucauaggauauagagaugggaugauauuaacuaucagagauuccagccugaucuaucaguaauuucauuauuuccaaguacgaaauuaacuucuuugagaggauaaagccugcagggcucuggaggccucuuuugaucuaagcagauuauugcccuguggggacuccauggugggaauuagaucugcguucuuggugguguccauagcugguucuccauuuucuacauuccucauguuagaauggccauaaauacggacugagcaucaaucugggacucuuuuucagauugccuagagggccaaacacuggaaaagaaaagggcugcccgugaaacuucugguuccugccuuacugagggcuucaaggaaaggcuggguuuaggguuccugaacacucugugcugccucgguucauuuccuguuggggaaguucugaaguucaucuguuacauucccaaugcuuauguuaauucauaugcaaaaugggaacccgcuuaacuauugccuuuuauuacucugaaaucagccaaaccagcuuaugcaucuuagcagucuuaaaucagcguuucccaaguaugaucuuugaaacacuauuaccaaaaagcugcucaaaagagagagagaaauuauaauaaaaauaucauaguucaaaguacuuuggaaaugcugcuuauuaucucucuuccguuaguuucacguacaaugcuaaggucaaagaaguucuucaauaaagaacaguauuuaauuuugcuuagcugagcauuuuucaauguuacuugccauagaauuuccuucauuucucccccccaacacuggcucucauaaucuguuaucauucugaagaacaaagagcacacacuuugagaagagauggcccuaaguuaaucagcacacugcauuagguggcugcuaucaauuuugauuuaauuacacaagcaugcacucagcauuuaugcaacguaaggucagaauaaggguuauguacuccucaaggguagguucccaaauuggugggauauguuccagccccuccaaggacuuacacacuuuccuaagaccugaaaagcuaugguuuaaaaauaguugaucaauccuuccaguuguccagcuggggucaguugccaacucuggcgggcaaaauaucaggaaccaaggacacaaaauaugaggaaggcguggccucuucccucaaggaggcuaccauggacaacuaaccacaaaccaggaaaagcaugauauggaaaagggagugguuuauucugcaugaagggaaaaggaagauugguaaagacacaggcugcuaagcggggcuccagugagaagaauucccauugcuggguagaagaggacagauggguaagcaaccugagaaggacugaggcugcaaaugugcagggcauggccguucuaagccagucauccccccgacaucacagaugaaccaacaggacaaaaauuuaagaguuccaugauagaggaggcaaaccuuagccaauuucuucacaccaggaagccacugugccuauauucugaaccuugcugacgguaggucuggagugggccuuugugucucccagcagcaggcauacauaggagucaucucuucgaugggcauucacauagggcuaggugugcccuugcuuuauaaaacauauggguucuuaaaaauuggauauuccuggaugucuuguaaguaaaaucauuuuacaugaccaugaggagugauccauuuaaaggauccuugcagggaagacucuggggaacaaggaauccacaugcacucugagauuucuguuuagauuuuuccugaagagcugccucuuaggggacuucugaauuuaaagagacguuagaaagcagacaugaugaaacugcguugucuccaaacuaaaaacaaaaagaugaaaguaaacuuaaaagcuacagaugccauucgacaaugauuugauguaaaauaauaguccaucuauaacucaauuuagccaaguccauaccuucugagauccuugacuuaccuaaaggcucugucuaaauagugacccuauaucauacaaguugaacaacaacaaaaggagaaacuagcagauuuuuacaucaucgggagggacauagcuggucaaacaggcaguaaaguuugagcacaacaaagcgagcuuugaaccuccuaagcaaacugacaaauugcgcucaggaguccaguucccagcaucagcaccacuuugccacaauggcuugucuccuaucucuccugccuaauggcuuuccaugccaaggagggcagucagugugaugaaaauaaccaucaacaaagcauuuggugauuagucgucugcuuuuuuaaauauaaugccugccagccaagauugauaaauuauuuuggucauuaacaaucuauuuaacaacuguaaauuuaaagugaucacuuuccugaggcuuaguguuauagagguuaggggguagaaucuauuuagccagaguuaagagcuggaaaauuaagccagaacacgagaaacaagauuacaaaguaguauuccucagugagugcugugaagcuauauggaaucaggcuauuaccaauggugggggauauguuuaaucaccucuuaaaggaaaaacaaucuuaauuaauguuguaugucauaaaaauauaauuuagauggggaugggaaauugcuaaagacgaaacccagagcaaagugaagacuugguucaaaaugaaccacccacccaucaauuauaaaaauauugcccaacagcaaaucaaagaacaugcucuuuggucauauuugggcagccugaaaacacugauccuugaaaagcguuuucauacuuuauacaaaaaagauaggaaauauuuaaacuuacuuuaaauuagaauuuuaagugccauauuuaaaaagcugaauuacucauagacacagucaaaguuaacacacuauauuuuaaaacuauaucuaaaaaacucauaaauauguagucaguuguguuggucagugaacaauauuauuaucuuuaugcugcaacauuuggaccgaacauuucaccugacuaaaguuuggcauugguccacuuguuuuauuugaugcuuauaggacauccaaagggaaacauagcaaauuguuucuguagccuauucauuaguagcacagagaaccaaucccagcuucaaggugucaacugguguugcaucccaggccccaucuaccaguaguucaauaaggagcaagauggcaggaauaagagggaaaugcaucucccuucagcuuucagguuuuagacuacuguacauggcucuuuccaaacaagaagaaaagaauauaacaugaacugauuggugcaguaaacuaaacuggauuuauaugcucuaauauggaaaaaagaucccuagaacugauccucaaaagcaucucccauuaauggagaaauaggagaauguccccaagggugaaagucugggaccagcaauauggcaacauuauaagugcgcugaacagcauuuuuguaggaaguguguucuaacugccuuuguaaaaggaaaaaggaaaauaaaacaaagcagcuggacaauaccauuuccacugauuaaaguucaggggagccugaaaaguuacuuaugagauauaguucaaccauuuucccccuugcuuucagauuuacgugauauuaacuccuaugcguccacagcagccccaugauccgccucagaggaauucagugccuaauacuugacuaggaagaaacauuagguauugaugggcaaagaguuuucaucucaaaugccucucugaucaacuagcaguagcucuuguugaggaguccgaggccauauuuaaacucaguggaaaacagcagcaugggaaauuagcaguuuggcauagagauuaagaacauggauuccagcagggagcaguggcucaugccuguaaaauaccagcacuuugggcggccaaggcaggcagaucacuuuagaccagccugggcaacauggcgaaacccugccucuacaaaaaauagccuggugugguggugcacgccuguaguccuaauuauuugggaggcugugguaagaggaucaccucagcccaguaacgucaaggcugcagugagccaugaucauaccacuguacuccagccugggcaacaaagugagacccuuucucaaaaaacaaacaaacaaaaugaucauagauucuaaauacauauggauguuugaauccuggcccuauuccuuaccagcauaacaacauaaccuuaugagguuauuaugaacauuaaauaaauuaaggcaacuuucacaaugucuagcacauaauuuacacuucauaaacauuagcaucauaaccaggaggacuaauugccauuguugcuaauuggcauugcagaguagaguuguggcuugucuuuugcccaucaggcuaucuguguuucagaaucugcuccucaacucaaguguaaaacuuacaagcagugguggagugggacaagucaaaucuacacaguucuuuauaugauugaaucagugaacuggauagacucuaccaccaagaugugauguguugcgauggugguucuguaguauguuuggaccgugaaagaucaaaaagucuuucaaugauucauauuuucagggcauugcaaagugaucaauuugguacauucuugacuuaaaacaaucacuuggacuucuccaaacuucccagacugcuaauaacaugcaauccuacuucuaaccaaagugaauaaagcaucaaaaggaaaccuugguuucaucccaagugcuaccagcugcuuucacauauugaaaguuuggcucuaccacuaacaggaaaggaaacacuuucaaaccuggcaggugaugagaacagacuucagaacuuggcuacacugucaucagacaucaggggcuggaauuagggcagggguucucaacuggugacaauuuugucccacaggggacauuugacaaugucuggagacauuuuugguugucacaacugggugggagguguuucuggcaucuaguggguagaagccugaaugcuacaaaacaucucacuaugcauacucucacuccccaaacucugaaucuucggguacaaaaugucaguagugccaagacugagaaauccuggauuagcacggaacacagagcaguguggacucauugcuaaauguuuuccucacuauacuggaggcuccagguaaguaggaaucauuguaucuucagugccuagcacaguucccaguacuuagcaggggcuauauuaauuuuuguggagugaaugcacuauaauagcagauauuaaugcaggucagcuaccauuuuucuucacagcagagcaaauauuucuucaauauuaaagucagaaagcaaggugaacagagaagacauaucagaacaugacuuugcuuauuugggcaucuagcacaucagacacuuccaauaaaucugucccacuuccuucauucccuaucuucccuagagaaguaacugaugccacauccagaaccuaacaauaaguuacgucaacuugaccagcaccaacauauuucuagaauccacuugcuucucuccuuccaugaagccuaagccaccaucaucaacaucucuaaugagucacuuugcuuuugcucuugaccucuaacuuccauucuccacagagcaauaaccauauguccuguuaaaggcguuaaucagauuacaucccucuuguguuuaaaacuugcuaacauccucacgggggcuuaaaacaucuuacaaagucuggcaccugcucaacucugcacuacaaucauagcggucaucuuccuauuuaaccaaauuguccaauuccuuugcuucucagagccucugcacuggccugggaaugcucuucaucuagauccuuacauggcuggcacuuucacauaauucaggaagugguuuaaagucaacucgucagagaaauuuuuugacugcacagaaucuucaccuguguagucagacaaguuuucuugucuuuagauuaugaggcacaaucugagagcuuuauuugcucauuuacgcuuguacacuggcaucccucccagacuggagugucagcuucaugaaaacagagaaccugacuguuuuguucucugcugugucccaagcaagcacagugccuggcacaauguaagaagucaauacacaucuguugaaugaauagauaacugaggaauaaaucgaugaaauaaacaguucauauacaugaacuagucagagaaaaaagaacucaucuaaaagaaaauauguguuaacugucacuuacaaaagaguugccuagaauuuucaaauuaaacuccaaauagcauccuuuauuuaacugcgaucaauucaacauaagacugaaaaucagaauaauagaggguaguuaguguucaucuagcaccaagaguaacucagaaauuaaauuaacaguuuguuaguauaaaucucccucguucucuuuaugaguacuaaauuaaaguucauccuauauuuuuaaaucuguuacaagcaaagagacaaugaaauaaugaaaguauaaugaaauaauuuuacuaauucuuaauacauaaccauagcaaugauuuuguaaguuuccaaauaugguucagcaguguggaccagcauggcaugaaaauaaauuuaaguguguuuuccuuuuauaauuuuuauuacugugaaagaaaauaauuaagguauuuaauauucacaagcaguaucagaggcaagaauacgaguaugacauuacugacgaaaucuggaacauaacgcaaguguaauguugcuuuuuuuggaccacgugauauaucugaaugcaacaaggaaagaagccagaaacauguuagcaacgauugggagggugaguugaugguagcauguagagucaagcaaagucagaggcugugacaaaccaugcugaauuagcacaugcaguuccucuuggucugccucccacccaccuuuccaacugcaguucuuaucacuccaacaacauccccaaaacuugcaggguucuaaaguuuauauagucuugggguaucuguguccuuauuuacaccacagcugagucuaaaagaacuuucugcaaugauggaaaugaucuaauucugcacugucuauugcuucuguaucgagaaacugaauuuugcaaagcauuuaauguuaauuaacuuaaauuuagccacaggcugccaaauugcacagcacagcucuagacacccucccuauagucugcaaacuccugcucguccuucaagacccaauucaaaugucucuuccuccagaauccccuuccucuuccuguucccuaaauagcagguuucauggcuuuaaugauaaccauuuaucacauucuauuacaaucauuuuaugguauguugguccuuccaacuacaucaagaaucucucaaggggacagacucugccugacucaucucuaaauacucaguuccgugcuuggcacaugagaauuauuugauaaauacuuguuggaugcucaagugaaauaaugaagccaucuuuagacaugaacaaauauaagcacagcuuaccagaaaaguucuucccaggggaagguuuacuccauuuauauaagaagcugcaaaccagauauagcuugagcaucccuaaucugaaaaucugaaaugcuccaaaugcuccaaaaucugaaacuuuuuuuuucuuuuuuuuuuuugagagggaaucucacccuguugcccaggcuggagugcaguggcgcgaucucggcucacugcaagcuccgccucccggguucacgccauucuccugccucagccucccgaguagcugggacuacaggcacccgccaccacgccuggcuaauuuuuuguauuuuuuaguagagacgggguuucgccguguuagccaggauggucucgaucuccugaacuugugaucugcccgccuuggccucccaaagugcugggauuacaggcaucagccacggugcccagcccaaaaucugaaacuuuuugagcaccgacaugaugccacaacuggaaaauuccacauguaguguuaugaugggucacaguaaaaaugcaguuaaaacucuguuucauggacaaaguuauuuaaaauauuacauacaauuaucuucaggcuauuuguacgagguccauauaagacauaaacaaauuuuguguuuagacuugggucccauucccaagauaucucacuauguauacgcaaauauuucccaauccaaaaaaaaucugacaacugaaccacuucuaggcccaagcauuucagauaaggggcagucaauauguaugaccuucagauuugauaguauuucaccauauuuguauauaugugugcguguguauguuuguguguguguguguguguguguguguguguguauuugguagacacugcuuaccaauguuaaaaacagauuuccaacauuucuugaaacaaauauuagaucuggcaauuuuagucccauauuugggcuuggcaacaaugaacuagaauguaacaagcagcugcaucauuuagauaauaaauauccucuacagaaucuuuuuuuuucuucuuuuuuugguacuuuuaguccacuguugucauuuauggucucugucuuucuccugcagccaugugaccuuacaacaccagacaaugaaugaagagacagaaauuucaaguucagacauugauuucucaccgacauuaguaaaauaacaacagugacaauaauagcugcaaaaacaacaauaauaauggcugguaguauuuauugaacaugacaugccagguauuauacuaggcaauuaauagacauugucagauagaauccuccuccaugaccuagaaaacagccuuagcuucauuuuaucaaugaggauagugagaugcuaaggggcaagcugaaaacaaacagaaaggucuuccccuagucugcccaccaucagaguccucacugccaucucuucauuacaaggcgacaucccucuucacuccuccauguuccucccagccuggauuuagacccagagcacaagacaaagugggaccuugggcaacugacauaaccuuucugcauuuugcuccuccacucacaauggacuucagaaauaagagcugacauuaccuccagggucacaugcgggcacaugagaugauguaggucaaacacugaacuucucagacacuuuucacaaauggaaaaugaucucaucugagcaggcagagaauggcuggacaaaggcugacacaucuggaguagggaggcauggaaaggacugaacucucuuaagguaaauaauggccuuguggcuuuugcuagcacccacccucaaggagcccucaucuagggagagcaugucuuuguggaacuaauacaaauuuggcuccaugaggcuugccuagcuucgugccaguuaggugauauugaaaggaugcaagucaauggaagguuuaagaaucagcuauuguaggccaggcgcaguggcucacaccuauaauccuagcaguuugggaggccgaggcggacggauugccugagcucaggaguucgagaccagccugggcaauauggcgaaaccccgucuguacuaaaauacaaaaaaacaaaaaaaaaauuagcuggguauggcagcauacgccuguagucccagcuacucaggaggcugaggcaggagaacugcuugaacccgggaggcggagguugcagugagccaugauggugccacugcacuccagccugggugagaaagcaagucuccuucucaaaaaacaaaaacaaaaaaaagaaucagcuauugcaggccuagcacucugccaggccaggaguuggcaaacguuuucuauaaagguccagauacuaaauauuuuaggcuuugccggccauagguaaacaaaugaguauggccauguuccaguaaaacuuuacuuacaaaacuaggccagggcccacagguaucguuugcccacaaccccugugcuaggcaccauggaggcagagcagaggcucuucacagucauccggcacaaucaccaggggcaaagcaugaagcagccuguuggauuccccacucugguagccacaguccucugagguaaaggccuggacagcaagaaugacuuaagcaacagacuuucuugguggcuccagccccagacucaccccacagggcaugaggagagugagccucucuuucccaugaaugguuccucccagcaguugugcaggccuguccgcagaacaggugaggcuacauggccuucaaccacgugauguauuggcuccucugacuaaaucaaaguccacagaugauaggccuacaauauccaagaaguugccaaacaaagaugcuuaaauugauacagacaaaacuaaauaccucuccuucccuugugccugcuuugacuccccuagaugccaucccuggugccacuucacacugagcuaucuccuugcacuugaaucccccaugucucauuaccauguguauaucccaagacgggguggcuccuguuguaggccacauauguuugguuguuguuuguuuuuuuugagauggaguuucacucuguugcccaggcuggagugcaguggugcgaucucagcucacugcaagcuccgccucccagguugaagcaauucuccuacgucagccuccugaguaacugugauuacaggcacccaccaccaugcuuggcuacuuuuuguauuuuugguauagacgggguuucaccauguuggccaagcuggucucgaacuccugaccucaaaggacccaccugccucagccucccaaaguucugggauuacagacgugagccacugcgcccggccaggccacacuguuuaaaaucuaugcaguccuucuuugauaugauaaccuugggguuguuuauauuucuuccaaguguaugaccaacaggaugcagagaagcaaaaguuuucuuacuguuuugucuguuaacguaaccucccauugucuuuaugcuuuuguuucuguucucauuuaauccuguuuuccuucacaggauuaagucugcucauuucuaaacuauugucugaacuuuaauauucuaacaugucuuagugucauguuuacucuucacuguuugacuuucugagugaaauagugaagaauaugagaguggaaaagguauuuggaaagauucuagguuuuaaaauuucagcuuuaguugauccuuccuaccugugggaccuuggguaaaugagugaauaaucugaacuugaauugcuucaccugcaagacaaagguaaguaugccaaucucgggagagguaucaugaggauuacgaguuaaacauggaaaauuccucuuccaacucaauaauaaaaacacaaaaaauccaacuuauaugggcacagaaucugaauagacauuccuccaaagaagcuauacaaaugaccaaggggcaugugggaagaugcucaauauuagcuaucagggaugccucacccaaacaaaaggacaaugagauaccacuucaugcuuauugcuuauucggaugacuauaauaaaaaguuacaaaauaacaaguacuagugaagguaugaagaaacuagaaucuucuuacacuauugguaagaauguaaaauggcaacgcugcuuugaaaauggucuggaaguaccuucaaaaauuaaacauaggguuaccuuaugacccagaaauucuauuccuaguuauauacccuagagaaaugaaaacauauauccacacaaacacuuguaauauuaacagcagcauucacagaacgauuauucauaagaagcaaaaaguagaaacaacucaacugucuaucaaaugaugaacagauaaguaaaauauggccuagccauacaauggaauauuauuuagcaauaaaaagaaguuugugaagagcaaagaaaacaagcaacauagugaagagacaauuuacaaaaugggagagcauauuuggaaaccauauaucagacaggggauuaaauuccaaaauacauaagaaacccauucaacucaauaguacccuccccuguaaaauaacccaauuaaaaaaugagcaacggacccgcauggauauuuuuccgaaggggacauacaaauagccaacagguuuauaaaaaaugugaaauaucacuaaucuucagggaaauggaaauaaaaaccacagugagguaucaucucacacguguuaggauggccauuaucaaaaagucaaaagauaacaaguauugcugaggguguguagaaaagggaacccuucuugguagaaauguaaacuuguacagccauuauggaaaagaguacagaguuuccucaaaaauuaaaaauagaauaccauaugaucuaguaaucccacuccuggauauagaaccaaaggaacugaaaucccccauccaaaagagauaucuccacucacauguucaucguagcauuauucaaaaccaccaagacauggcaucaaccuaaguauccacugacagauaaauacagacaugcgauguauauaucaauaauggaauacgauuuacucuuuaaaaagaaggaaagaaaauccugccauucgcaaaaacaugauaaaacuagaagacauuaugccaaguggaauaagccagacacagaaagaaaacuacugcaugaucuuacuuagauguguaaccuaaaauauucaaacuguuagaaacagagcauggaauaguaguuaccaagggccaggcaugggggaaaugggaauaaucuggucaaggguacaaacuuucaguuauaagauaaguaagugcuggcacucuaaugucuggcauggugacuaaggcuaaugauaauauauuguauacuugaaauuugcugagagaguagaucuuuacugcucucaccaugcacacacacaaaagguaacuacgugagguaaaggauauguuaauuagcuugguugugguaaccauaucacaauguauacguauguuaaaucaucacacaguauaucuuaaauauauauaauuuuugugaaucauaccuuaaucaagcuguaaaaaaagaaaugaagugcggauacaugccaaaagaugggugacccuugaaaacuuuaugguaaauggaaaagacaguggcacacaccaccacauaauguaugaugccauuuauaugaaauguccauaacaggcaaauagagacagaaaguagauuaguaguuuccaggguuauggaaggggaggaauggggagugacagcuaauaggcacaggguuucuuuugggggugaugaaauuauucuggaauuagauuguagugacaguuacacaacucugaauauaccugaaaucacugaauuguacauuuuaaaugggugaacuguaugguauuuuaauuguaucuaaauaaagcuguuacuauauggaaaguucuuagcuucaugucugagacaaaggaagaaauaaaaauggucacuacgguuaucauucauucaccugcauuuuaaaaaugcagucgguuuuucuagagacuuuucaccccuguuauucugagaauuaaaauacucaaacauauguguggugaggucuagaagaggaggauuauuguagccuggaguaguuagaaaagcccucgagaaguuuaaacagaauaaaggaggaggcaaaggagaaaucaccaaaggcagcaaucugaaagugaaaaggugggaauaauuugguucccugugagagccauaaggaggcaauucgauuaagcaaauggcucaugaaugcaagggauaaguugaagagaaggcaaaguuagauuuccaagggucuuggaagcauaggccaagauguuugggcuuccuccagcuuuggaaugucaggaacugaauuuaaggaaagccauccugccaguuuaugugguacaaaagggacuggcugaaaucagaacccaggaaguaugaguuaguuagggccugaagaaagauaauaagaauggaaauaggaaagaaauagcacaaaauaguggcuacuucuuuuuuuuucucccccacacccccccgcccccggacagccaguuguucuaaaggggcuauuucuuuaugauaaaggugacagaauacagaagaaaaaaaaucucccuuccuccuucaucaacaccuaacaaaaggaacaauaauaaccauaaaaucaugguuaaaaaaaaaaaagggaaauuuaccaguaagcucuaaauaaggaauuaagcacaaacuugugccauaaaauucaaaagaggaaacuaauuaaaaaaaaaaaaaggaaggcaggaaggagcgagggaaggugaaaaagcaaauaggagaugauuuucaugcaauuugaaguugcaucaaaaucuuccaccucaacugucagaaacagauuggagaaaguauuugaguugacaaaauuaugggauuucccuucaauauuccccacaaucaggagacaaguagacugaagucaugauuuugauguaggauuuuucuucucagucacuuugcaagcugggaaccccuggccagugaugcccguaccaggccuugcuuggccaugcuggugugcuccagcuucuuguguuauagcuuguacccguguuuggugguucccugagcucuuguaccaugcccaagaagaaugaggauacacuggacauugaagggugaggagggcagggaagaauuuuacugagugacgaaaacaguuuuuagcgaagaggggauauggauuuggucucccuaccugaaggugagaaaguuccccuguguggcugggccuggggccuuuuccagacuuagaaugggaagugccugcugauuuguuugugagucugcaaauaagucuaaagcaaagacaccacucaaaggugggcacaacaguguagaaaaccaauuaggaaagcgcagguauauguaaaacaggugaaggguggggaccaaucagaggagagcuuaccaaacagaaagggaaauucucaauccagucugaggauuuaacuuguagcuuggcuuucaggcuuuaaacucucuuccacuugaggugggguuucacuggggacccaccccuaucugccuaggcauuugccugccuccuguugcuaucaauuuggaaaccuuggugaagccccagaaaacccuggggaguacaaucccagaacuucagcccagccaagaauagcaauaauuaugacaggggcuuggcaggaaaaaagaauugauagaacuagagaaugacagcauacagaggacgaacuucaagaauaaacuggagaugacccaaaguuucuagccuggauuuuucagaaugggggugauaccaguaagaccaggggucagaauaggggaacauuuuaugguagaagggcaugcacucuguuaucagauaaauuaaguuugagcaacucaucccuugaauucguaugucuguauaaaccuaaccuagugccucucacguaguaagccuuuuauaggugugugcaggagggaugaggcauauaaaauuuaauuaaauaugaacaaaugaugguaacaauaaacucagauuuuaaaaaaugguuuuguuucaaccacuguggagucaauagacucuaugagacuuaaaaauuuuuuaauuuuaagcugucucuuagauauuauaaagccacagugagucaucuugcacuuaaaauccagaaaagccuauaaaagaauagaaaacccgaauacguaacuuccuccugugacagaagaacaaaaacgucaacguucacagcuuaaagacauuuagcaccucaaaaagauguaucauagguaaguuucuauacuugaaugauauuauauaaucauaaugcauuggaaauuaagucaauuuacaaaaaaaaccccucagaaaugcaaauaacagugcuuuguaaaacuguauggccuguuuucuggaagguacugugugauucugggacuggacuuuucauuaaaaagauaagagauucaggcaucagacauguucaauuauuggcucccuaaugaaguucacuauccugucuaauggaucuuuccuuuucaaaagaccccuuccuccuuguguauucuggcauugcgugucucuggcauuugcucuaugagaauaacuggacaguacaaugcucuugaauacagagagcuggagcuugaauggacaccauagccccaaggacaugaaaacuauuuuuugauuguguguguguuuauaaaacuucuugcauaaaaucagucuuuguaauuuccuagacuucaagggcauucuuuucaaguuggggcuucuuaauguggcccuuaaaaauccuaaaauuaaaugcauuuuuaagcuaucuguguaaauauauuaaaaauuucccucauuaggaaguugccaguuuauggcaaagcuuucagaggagucuguaacacaaaguggauccagaaccacagcauguagaccccuaaaaauuaaaaacauugaaaccuauuuagcaaaucugcaugaaaugagccaaauucauacugcuucuguggaguugguuccuggaaaucuaggcauuuagugguggaguuacagauggaucucaauggccugcgugauuuucccagccuauuguuuucguaucugauuaauuauucucuuaaaauuuccauccauaaaaaauuuccaaagauauuaggaucucucuucacauagucuuuccuucuuuugaaugaugcuauuguugucacuuugaaaacuguaaauagcauucaagaugauauuuaaguuugugccaacauuuaguggaaaugucuaaguuuugaaauaguagggagcucacauuccaucugguguguuuucauuuuaucuccuauucucagugaauuuuaaaagucagcugcagugucaauacccuuucugcuaugcuaaugugaccuccacguggaaaucaaaggaaaggaguucucagggcaagugauucuuucucaauugaacuauuuagugucauagaaucacaaaguaucagagcugaaagcaggcuuacaggugaccaugaugaauaccucucaguuugaagggaaacugagccucaggcagagggaacugcccauagucucauuagccacagggacaggaguugaaccucgauaggaagccuuucugauggccccauaucagguggucacuuccuuccccacacuuccauggcccuuuaucagagaccaccaucccauguuacuuagcgguuucaacuuuguagcacaguuacugucacuaauuucuuacccauguguagcaggcuaauauuucaaaguaaucacuggugugccauuuccuuccugaccaucucuuggcuaaagggaagugcaucuauugcuuagcaguagucuccuucacucaccagcuuagccuuuaauucaaaaggcgcugccccagugugagagagaaaugauucaugcagggauaaggacacagaagaguucuaacugcccacccccagaguuuaaaauagaguuucaagcuggauaauggacagagucaagagagauaaagcaagaaagagugcauguguacaugagugggcacgugcaugcaugugugugcaugugugcacuggggcagggugugcucuacccuugccuuuuccccaacccccaggcugaauccugagguuggguaauauaugaguuuucuauuugcuacuauaacaaauuuccacaaacucaguggcuuaaaacaacacaaauguauuaucuuacagcacuggaggucagauguccaaaauggguguaauggguuaaaauucagguguuggccagucugcauuccuuuuuggaggcucuuugccuuuuccagcuucuagaggcugccugaauucccuggcuuauggcucaauuccaucuuuaaggccauugauggccaguugaaucuuucucauauugcaucacucugacacuacuuauuuugccucucucuuccaccucugugauuauauugaguccacuuggauaauccaaggucaucuccuuaucuuaaaguuggcugacuagccucuaauugaaucuucuacuuuaauucucuuuuaccaucuaacauauuuacagguucugaaagauugguacauaggcaccauuugggaggcuauuauuuggucuuccacagcugacucacugcaagccaucccuuugaauuugagacucuaagaguagauugaaugugcauucagcuuuuuccauccagaauucugguaguacacagcuuugcaaagagaauaaugaaggacuauagcagcaacaugaaugucugcuggaggcaccuaauuuccugcaggucuuagcaaaguauguaagaacagacaaguuuuuuuugagcccaugagaagaacucugacaagcuggcaaaggccaaagaguaaguguccuucaugugcuugugacaagagacuaugucaggaccauggacaccucuaggaauguaggaggccaaaggucaccauccugcaaagaaugauggcauuccuuacggguaucagaauggaccaaagaugcacacaaggaccaggcaaaguggauuacuuggacaccagaggccaaggaaacaacagccaaggacaacagaaucccugccuaccccacacgacauguugcucauuaaggccccagaauacagaaucugaauugagagauuauaagccagaauaugacugaaugaauuacaggccugaacugacagaaacggcacugaacuugcugagcaaaaccuggcccagggcugaugagaugguuugcuuucacagccagaaauucaacugaacuuugggagucaagaacauuucauuuuuuaauaguccaacuggugacugugaaaguaaucauuguuauacuuggcacucaaaugaaccucagacacagcaagaguugacuuggugauugagaagaaacuggagacaagacaaaacaaaugggaauauaaaacuguagacuaucacaucagcacaacuggcuaguuuauuuuuauuuauuuauauuccuuuuuauuuuuuugagacagagucucgcucugucacccaggauggaaugcaguggcacagucucggcucagugcaaacuccaccugccguguucaaacaauucuccugccucagccuccugaguagcuggcacuauaggcacgcaccaucgacccagcuaauuuuuuguauuuuuaguagagaugaggcuucaccaugcuggccaggcugaucuggaacuccugaucucaugauccgccugccuuggccucccaaagggcugggauuacucgcaugagccacugcgcccggcccuacuuuuuauuuuuuuagguggagucuggcucugucacccaggcuagaaugcaguggcaugaucucagcucacugcaaccuccuccucugggguucaagugauucuccugccucagccuccuguguacaugcgauuaugggcacgcaccaccacaccuggcuaauuuuuguauuuuuaguagagacgggguuucaccacguuggccaggcuggucucaaacuccugaccucaagugauccguccgccucuaucccagggaguaucuuuauuuuuuuuucuaacaagucaaagaguagaaauaccaaaaaagucaccucuuuggguguuucagcuacuuagcuagcucacacacacauguauuucccaugagguuuugaucaaaacuaaagucaauuuuuuucacuagguucaccaaacaacugccaguaaauauuggcuucugccaaugaaugaaaaagaacacaggaugucugcucuuaaaaagugaccccugauguuuccuucacauuaucaaauuauugcauacucauuauauuauguuugggaaaugcaagagaauaugaagaaaggaacaggaguguaacauucuauuugaagcuacaaucucucuuaauuucaagguacaugugcuuccauuccauucuccauuuauaugccacucuuuccauucaauauuauaucccaauguauuuuuucccagugaauuuagaaagcuuauuuugccaaggcugaggaggugcaccugugacacagccucaggagguucugaggacaugugcccaaggugaucagagcacaguuugguuuuauacauuuuagggagacaugaggcaucaaucaacauacauaagaugagcaaugguucauucuggaaagaugggacaacuugaagcaaaggcaagaagacucuaaguggggagggagcuuccagggcauagguagauaggagacacaugguugcauucuucugaguuucugacuagccucuccaaaggaggcaaucagauaugcauuuaucucagugagcagaggggugacuuuuaauagaaugggaggcagguugccccuaagcagcucccagcuugacuuuucccuguagcuuagugauuugggggccccaagauuuccuuucacauuucccccccuucucuuugaaaaaaucuuuuggaggaagcauuuuagaagaaaaugagucucuggucucagguuuugucucaucucucauggcuaggauggcuuauuccuagauggguaggucuugaguuauuagguauguucauuuuuagcagguuguaagucucauguucuauaaagaaaaaauagggggaggaaggaaaaaacaacaacaacaaacaaaagaacaagccuguaaaauccauauaggccauauuacucugaaguccauacaucaguaggcagguaugaaaguggcuuauguauguaaauagguugcuguuaucuuuuucugaaguuuccguugucuagcuucaguucacuuggcuuuacgaaagcacagcuuaguuuuuggugacuccaaauuaggaaagaugggaaaaaaaagaaggaaaaaaaauugaaaacauuguuuugcagacuuguagcccagaaaaauuagaauucauuccaaaccacagaaaauaauaaaaacaggcaagacuagaaucuaacaacagguauacuacaguuuuugaaauauaacuuuucucucuccaguuucccauuuuuacuaaugauaaaucaugguaggacuaauuugcuuuauuauucuuggucugauuauuuguguacaguguuauaucauuaauauuauucauaaaaacucauuugauggcuacauagaugaauauauaguauuaaauauauuccucuauuauuuggcauuuaaauuguuucccagguuuagauuuuucaaauuaauuagaucaguuguccaaguuuuauagacacacacucacacacacucugauguaaacuggaaccauaaugcagguaagagcauuuugaacguagaggggaugacacagaaaugccugguauucucuggguuggguguagacacaguuccauacaugaagguguguguugaccagccuauuuuggauugucuaucuuggagaguacuggugggccuuuuaggggagcaauuuaucaagcuaauuuucagggagauuccagaaacggguacaggggacagagcuggccuuggugauuugauucuggaguuacccacaaaguuccacugugccucuagacuaagccucauauuccagcuuuaaaaucccauucuuuucucagcaggcuuuguugguuugaaaaaauaccuuggcaucucaggaaggacaacaauuugaacuacuauuguaauaacugagguaaaaguucuuucucagggggagguuuugacaggaggcaggcagugcccaagaaguggggagacuugcagcugauaaaggaaagccacggaccugaggauucggagaaccaggcuuugaaugcagggggcuggggaagugccagguucagcucaacagucauuucuugacaaccuacucuauuaugaagugguauuuuuugggugccgggaggcagagacgaugaagaugaguaagaugccucugguaguucauaaaggcagcagagagaaaagaacccagacucuggagccagacagccuaaguaugaaucucaggucuguuucuuacucucucuguguccucagaaaaguuuucaagucugccuaugccuccguuucuacacaugauggagauaaauguaccuuaaugcccaaaugagcacuucauuguaucuacuaacucaucaguaugcuaaugucauuaucauaucacagucucccuccacauuugagguaucuccaacuaaugaaaauuuuguuuccagccucuuucaaggaguccaauucagccuuaucccagaucaccaauagaugaaacuagcccaaugccccagggaaagaagguaaaugguagacaccgcauguggauggaaaauaauuuaggaaaacaagugcaguuguuuauuccaggucacgaaaaggaaauucagccucagucuucaauaucaacugauagggucaagauuaccagagaagccagcugaaauuucauauauagauuugaccuaaaugugcaauguccuuucaauaacucugaagagcuuacuaagagaaacaauuuuuuagagucgcuaaaaggaaauucagccucagucuucauaucaacugauagggccaagauuaacagagaagccagugaaauuucauauauagauuugaccuaacugugcaauguucuuucaauaacucugaagagcuuacuagaagaaacaauuuuuuagagggaaaauauauguuggagcaagguuacauuuccgugcaaagggaauauucuaugaguuccuuaguuaccacuaauguaagaaggauuuccagcagguacuggugcaacuggccuacaagauauuuaugguccauuaagaguuguaagcaagacuguuucuuuuucagaaaaaaagcaauuuucucuuaaauauuuuaguguguuaugacaugaauacacuauagggcaagcaaaaguauuuaagugguucagcacacaaaaccagcuccaaaaggaugaccuugggaauuuuagaagcuuggcuagagcauguugaugacuuccuuguguuuaacaaaaacuauaaaaaggaguuauaauaaaguaccuagauggggacuacugggccauauccuaaaagcagagaaaauuccugacuuuguaaaaugucauuucuuucacuguaagucuaaauuacugguagugugucuaggacuuauaaauuuauuggaaauccaguguguguguugugugucguguguggguguguguguaaaugucucuaagguugaacagggauaugaaaaccauuugggauuuaguacuggaagucccagugucuaagaaaaucgcuuuucucccuauacauggguuuuccauaaaauugaaggauaauauuuuccuuaggcuaaagcaaagggugauagaaacagggacggcuuuguagucaaacagacuuugauauaaacaagcuuugccaugagcugguuaugagguuuugacauagauauuuacucucugcaaauuuaguuucaauucaaugguaugaaugauaugcuuggcaccuagcagacaguccagcccaauguguauucucauugacaguaauaauuugauuauuauucucaaauauuacauuuauuuaaaauagauguauuacuagucucaguguauucucaaugacaauaauaauuguauuauauuauuauuuuucauuagugcucucccuaggagcaaagacugcgaacuauaguuguuuaugaccacuaaccuuacacuagaagcccaguaugauuggguauuuuucccccauuuuaaauaugggaaacauaagauacugagauuuaaauagcaaguuaaacauuaaacaguuugcaauaaaccacuauguugacucaagguggagagaauuuagagcuacacagguauaccagcuauuucuugauuuccuugauuagaaagaaaaucuggcaucauucaaauuccuauucuaaaucuggggaaggucauaacagucuccacaaacagcugcuugccaguaagcugaagcaguuugaaagcauucuagagcaaaaccauccagaagaaaucuaaugcaugauacauauguuauuaaaaguguuugguagcaacaccaaaacaaguacaaagaaacaggugaaauuaauuuuagugauauaauuuuuaacucaacauuaccaaaauauuauuucaacauguaacuauuauaaaacauuauuaaugagauauuuacuuuuuuuuugguagaaggcuuugaaauccaaacuggauuuuacauuuacaacgcaucucaauucagacuggucacagguggcuagcugcuaccaaauugaacauuaaugguagacgucaccccgcagugacaaaaauauaaccacauuugaacacucaagccgggauucuaaacaucaggcuauguuuccaggacucuaugucuccaaaagcaggcaacuuggaggccuuaggauuccuuccugcuggcauguggcacaugaaugaaccuugcuccaagcuaagagguuacgggauuuauuuauacagguuguuugaauuacguguaucauucuuuugucuaaagaaugacaggugauaauuuaaaaauaaaaacauuuacaaaugcuuugggacuuuaaaauuguauuaauuuuuaucuucuguuucccccuaauucuugcuuauuuugauuuucuucauuaaaagagagauaaaguuaaauguuugggggcuuuucacuuuggggccauuauaauuuauauugagggaaucgugucaaugcuuaauucauaucuguuuuaucuuuaccuaguuuauccauuucugaucauaauuuauuuuuccaauagucuuuuuuuuuuucuauccuuaaucccuauacucucauuucucuaaguaaaauagauuuggaaaaacuacugaggucuugguaguuugcuuuagcagguuaacuccaaacuuaucaaaacuuuuuggacaauuuuaagugacuguuuauuaauagcuaugucaagaaccuugaauguaaaccuaagauuuuuuuaaacacugaaacagcccauuauucaagcacuguaguuaaacuuagguuucauugcagcagccacugugagacugagagcagaacugugagaagcagguaggaagacagauggacuccagcaacaaggacaccucggaggaggcauuuuccuccuucaccggcaagcaccuuagagcuuucugauggaauguaucugguuggagcgagaauucacuguggagggcagauaggacucugcacaagaaagccugauucgugaaauaaugagagaggaccacauggagugguuugauagaguggauuuacuauggaugcuauggauagagugacacgugauuaaauuuuucuuauuucucacuaacaugcgauugaacguauucaaacaacauaggagagcaauuuugggaaacuaaucuaggguggcuuaccucaaagcaaacucuaggaaaaagccauggcauccuuugccuugaagcucaaccuguagauaccugcauccuccucaucaagcacucuucagccuucuuucauuacuuuuccucuuuaguguccaaugacuucaugaucuuccuuggaggcuccagcucaccaucacuaccauuauagcccuccaugcuucucaacauuccucauuugcucagcucuagccugggcugggcacaguggcucaugccuauaaucccaguacuuugggaggccaagccaggaggauugcuugaggcuaggaguuugagaccagccuggacaacauugcgagaccugucucuacaaaagcauuagccagguguggugguaugugccuguaguccuagccacucaggaggcugaggcaggaggaucacuugagacccgggguuugaggcuguagugagcuaugauugggccacugcuggccagccugggcaacaaagugagacccugucucuuagggaaaaaaaaaaaaaagaguuaauaaaaugacuaaccugaaucauauauugugacaguuaauauugagugucaacuugauuggacugaaggaugcaaaguauuguuacugggugugucuaugaggauauugccaaaggagauuaacauuugagucaguggacugggagaggcagacccacccucaaucuuggugggcaccaucuaaucagccgucagcauggcuagaauaaagcaggcagaaaguggaaagagcugacuugcugaguuuuccggccuucaucuuuccccugugcuggauucuuccugcccucgaacaucggacuccaaguuuuucagcuuauggucucuuggacuuauaccagugguuugccaggggcucucgggccuucagcaacagacugaaggcugcaccgucagcuucccuacuuuugagauuuugggacucggacuggcuuccuugcuccuccgcuugcagauggccuauuguggggcuucaccuugugaucauguaagucaauacuccuuaauaaacucuccuucauauauacaucuauccuacuaguucuguccugcuagagaacacuaauacauauauuaucugaauauuuguuucugugagaaaaaugggcacaaauaacuuuuaaccagauaaaugcuuuucugcuaauuuugugucucucuuuugaggaacauagagauuuagcucaguaauaaucugacauaggauaggguaaaccagaugcuuacccagcuuucucauuacuaaaauagguagucaaagagcauucauagauacagagggagcauuugaggucauaggucauuaaauuagcauuacuauaugcuuauuuguuaguuuuaucacaucugguucuuugaauaaaaagucuccauuaauuuagaagaacauaucaaguuguuaucuuauucugagugagagacaccaaaguuuucauuccaaaauucugaaauacccagaaacuuaccacucagugggaggacaucaguaaacccagaagacaaaaagcuaauuaacugucucacugaaacauuccuuccuuuuugaaaagucaacuagggacccauggacucugagcccauugucaaaugccgugugaaagagauccaaguucaacaacaaauaucaucagcaauauaaugguucucuccagcccucagggccaaauggccugcauuuuagcaaguugauuuugcucaugaauuguguuaagccaagcaauuguuucccaugacaugcuugaacccacaguugcuuugucuaugaaauucaugguugaauuuguccaauugcugauugcuauucccacuugcuuuaguaauagucacuuccuucaucaguaauggguuuuauauacagugcacagucacaaccauucaaugucacccauaagcauuugaugaauuguccaauacaguuaugagaguugguuauuugggauacagcuaggguaagucuuacugaguuaaugaaaugauaugacauuaggccauggguguuuccucccccacauuggcuauacacacucuuuuaucuaaggacgcauuugggucauuaccauaaucuucaucaacuugucaagauaaugaagggcccauugaguucagggaaggcuuggcauaauucaugaaaauuuaaagaacauagauguagaaagaguuugggagcuacagauaaauaagaucugcauagacaaccacaaaggaagagcuucagcagacaaucugcuuuggaagggggagaguuugagcucaguuuugagacagaagagaggcucauacucugaaaugucuaagacauacugcuggaggaacagaaggugaaaacaaacuuagagaugauaaucaagauuggaaagaaaggaagaguagcucucgagccugcuuucagcaaauccuacaucuguauuuguuauagccaccacacaaaucuagguuuggugggagggggcaaguuaguuaucaacuucgacaugugccuaucagacuugcuuagcaaucagacaagguuuauaauugcuuccgcuaaccuuuccagaguaccacaauuuguagccuucugcacacugauuucugaccaaaggauucuguuccaucaaugccccauuaaauucaccucagauggcugauggcaccaugucgaagucucacccaguguggcuaugaguuagugaauugaccgucugaagagcaauauauagucuccuuuuaaauuauguuagaacuagcagagaauuucagguucuucuaguucaacaccuuguuuuuuuuuaaauguguucauucauuuucaaauauucacugaagguccacccuaggccagauuagaucccugcccuaaagacuguaacacauaauugggggaugcagguauugaauaauaaaguaauaaauuaugucaagugugggagguguuaagaaggaaauagguauggcgauauaguagaguuacucuagaggggacagaggauuaacuauuacagaugaaaucagagaacagugaaaaggacccuuugaggagguucugcacauguaucccagaacuugaaguuaaaaaacaaaaaaaacucaccuggggccagagcacuguaaaugaauaggcagggagauuaaacagauguuucaguuaaacagcaugcccaguauaccagacagaagauccuggggaauaguaaucuuugaguagcagagagaagaggagcagcccaugaaauaggcaaggaucuuaaacuccaaugccuucaggagcuaugcaugcaccauuagccagugaagcaagccuagguagaaggcagucguggcaacuguauaggccuagagaaugagcaauaugccuaacagcauucaaacucauuaaaaaauacuuuacagucacaauaaagcaaaucaccaaaaauacuuugcaggcaaaaauaaaacacaugugaagaggcaagcaaagcccaaggaccaucaauaugcaaugcugagcugcaggaaaagcaggaaguaggcugggaaugagaaaaaaauaaauacagugugguuuccucuaaguuaaaaagaaaagguuuuaccuuuuauuuccaugaacuuaacaaugaaaacaauauguuucacuaggcagucacccaaacauugcaauacugaucacaaaaaaccccccacuauuuguuacagaacuuguaaaaccugaaaauggcgguaaugaucaaaugggucaaauguguaaagagaggcaccacaaauccaaguggcccaugcacugaccaaauguagauauccucuugaagaauuguggccaugugcucugugcuugagugaauccagggaugggaagcucacccccuuggaaggcacucuuuaaguguucauuuuuuuucacuuugacccguuauuauggagagcuaaugauaucugccacuuuguaguccgauacucacagaucugcccucuggagccacauagaauguauuuaauaucuuuccaccugccagcccuucagauauuuggaaacagugacucuguuacuaucuucccucuacaagucuuccuuuuuccaggcaaaacauucccaccaucaauuagucuccaaaucuguuuucagacccaaccaccuuucuuaugaaccuucuuauuugucacuaaccaucuuaaaacagugccuagaaagaacacaauguuccuagccaauuuauacucuggggcuucuuuaggcauaauuuucuaugucugcagcaguagaaauacaauuacauuuuauggagcucagucuccugcuguuccuguuuccuaccucccacccuccaaggcagucuguuuguugaauguccugaacagaugcauaaucuagagcaagugcucccaucaauauaaagaaugccaucccucaucacuccaucgcuucugauuaagaucauuuggucuaauguacauuaaguucuauuccaauaaugccugugcgguacugcaugcuuuucaugccucuuucuggacacuguguuauuagauacucagccuggagaaacauuuccauacaaagaggaagauaaaacugagaaugaaugguuaaaggcaaagagaaaauugggaaucucacccuuggaaagaaugguagaugggaacauccaaugaccuggcuuugaaucugguucucuauuuacuaaccauugcuacuuaaagaaaaauaguaauaauaacaguaagaacagaaacuacuaucuauuaacaaauucuugguaaguaccaagcccugaaauaagccuuucaggcuacaauaucauaugguuaguagaugccacugggauuugaacuuacuucugccuguuucuagacuucaaucucuacauagucuuguaccacaauuucccuuaguggauacugucuauacuacauaugacuuauaccacugauuuuuaaaaaaagaaaaacucucacaguaauuacuucuccugagaugauccuccaaaaugugggaaguagaaacauguguuuucuuuucuguggggccaucagagcaugcagacaagggcaaaggaauaagacaggagagagaggccauacaccaaccacagcacuguacauugugucuugaacugggcugaaaaguaaccaugcagcuucauuuuaagcacaguuggaacaucgacaagauuucaaggugacuguucagccuaaggaaacaguguuuucaagcacuuuuaugcuacuuuagcaguauuuacuaguauauaauucacgugcuaauuuauucauuaaaacagucguauuuggcaacauuaaccuuaguuuacauuagugagauugguauuuguauuuuaauuacaucucuuuauaauuacucuauaauucugauuuucuuccaaugugaacuaagcccuuaucaauccccaaacugcauuccacauccaacgaaaaugaguucaaauuauaguuuuacagaaaauggcuuuguaaaacccagagagccuauucccaaagguagucaugcaucagagucuccuggggauuuccuuauacaaugacugauuccugagugcugugcaaucuacuugaucagaaucuccagcgacgggaccuccugggaauugagaccugcagcaacugguccacaaaucagcacuuagggacuggugacuagacuauuuccacucuacacacauccaguacagcucuuggaaaacauacaaagcaaaagauaguaaggguuauccuaaaggcagaauaaccagccaccucacggaauccaauguguuccagaaacauuaauuauacguuucauuauuaacugcugaccuauuguucuuuauuuucaggguuugaguugcuguuuuaauuucaucacugcaaagaagcccuauagacacacacacacaaaaagaugcauagauuuuaacuggucccuggaaacaagguagagauaaucaugugguuuauuugauagagccacaugauaaacaaucgagauaaacaauguguuuuaaaaagcauucucaaagaguuagaacaggaaugucaaaaagacggcaaauaugauaccuaccuccuauccaaugcccuuggcaggcguugcuaaucaaucacagcauuuuuccuugcauccacaaacagccucaaaguccauuuaaccaaucacuccagggcacuagugcuaucuaaucugcucuaccgugugggggacauacuuucuccucuuuggcuacaauaaacagguaaauugaaaucaccuuauaacagccugauccaugacaggcuguaugcuccacaagguggaaaugggcaucugaaaguucucauguagacagggcuuuaggcgcagaucaccuggcucuugcugguucauguuuguagugguuucacacuuguaucuuugaaugggaguacuuagaaauaaauuaacugcuuuaauauuuaugauaugugaguuacacuuacucaaaccaaccuaguuuuugcucaugauaauuuacaguuucacuuugaauaaaugcuguugggaaagacaagcugaguuccaaaguguuuuaaaaauuaaguguagcauuugacuaaaagaaucauauaucaaucugcuugauuuccagugguagcacuguagguuuucuucuauggagauucugggccauaucuccaugcaaauauuuacuguccugguaaaugacaggauagaaaucacaaggacacuugguuucugcugguuuucauuugaaaaagaaaaucauuauaauuaauuagucauggguucccacgauggccauucuugacuccuuggccucuauugccacuuuccaagucuggcuaaauagaauuccauuucagaccauaucuaggguaauacuugauucauuagguugaugucaucccaccgacaguccccgugaucaaacaauaagaucagagagaacagacccaccuccucauagaugcugucauuccugugaaagucuccagccuuccugggaagaacauggacgugaacgugcugaaaauguacaagaaagaaaaaaaaugugauuaucuccccauguauuuuuagacuugacagugaugcucucaugaagcccaauuacuccacgaugguuccugcuggguuauuuuucagaggaaguugauauccaccuucgguaacuauaccugaaaucugccgagaagagagugcacuaagcaagagagaacaacuugggguauauaugagaguuggugcgaaaugcuagaguguuucagagucucuguggaauuauucaugguugucagucuugguuguaguuagccagugcuuugaaaugacagugcaucuucaaaggugaccaucaugacucugaaacugacaagaaauaagaauuggcuaacagagaacugcauaaguaaagagcgagugaaugagguagcaaguaguaugggcagaauuacagacuuggggcuucgaaaaauaaucauauaauaguaauacaaacaguucucauuuaguaagcauuuauuuccuaugauaaggaaagcucuguguuuggcauucuucauuuaguacucuuaaaaauccuaugagguggccgggcacgguggcucaugccuguaaucccagcacuuugggaggccgaggugggcggaucacgaggucaggagaucgagaucauccuggccaacacggugaaacuccgucucuacuaaaacuacaaaaacaaaaacuuaggaggcugaggugggagaauggccugaaaccaggaggcggagcuugcagugagcugagaucgcgccacugcacuccagccugggcgacagagcgagacuccucaaaaaaaaaaaaaaaaaaaaaaaaaaaaaaaucccgugaggcaaggucuacuaugaucuccacuuuacagaagaagauaucaauguucggugaggacagggcgccacaggaaguaaaagucagcaccggaaaugagguugccuggcuuuggcuccuguguuucauuagcacaugcacugauucugcgaacuuaaucuuuuaaauagcccauuucucuagucuacuaaagcacccagguaauauacauagcaaugcuauuaugcaaugauggugaaucagggcucagagcauaucuaauucaauauauucuucaaagcuaaacugcuauuugaaaguuuuacuuuccaaauagccucuauuguaccucggcugaaguuaaaccucauuucugcccuugagcuauguuccacuuuuauuacaaaccguggggaggaaugcgaaaaugaagagcuuaaauagagagaggcagacagagggucaaaccucaucccugaucacccaccccuuccugauuacugcgaucggguuccgaggcuccaaaaggccucaagagaacguaagauuuaagugucccuguggcuucgcuguacaaggagggggaaagugacacgcuauuaaagccgaggcagggugcaacgugguccaaggugaaugaagcagagaggagcuucaaagcagccccugagcacaguucccaaagagugacacgcuuuugccagaauauucgccagucaaugauaaagccagucacggaucucucagcaauugggccaagugugcacuucagucacaaagauuacgugagcauggagagagaaagugaaagaacaaacaaggaaaaaauaaaucacaaacuacccaugaaaccaaauucuuaggagaaagccaggcaggugggccugggcugaaaucuacugaaaucuccagaugggcugacuuaaaagcaaaaccaggaaaauaacguagaacaaggauacagacaacccuuagaaggagccuucacucacucuuuaauuccagaaucuccugccauccuuucuucuucuccucuuuuuguccuuucuucuuucugucccccuccuccuuucuuccccucuuccucccucccauccauccaucuuucaucaucucccuuauacauucuaggaaguuccagaccagugucuuccagucaaacuuccuaacacaaauccuggaccuaccacaaacuaacugugugaccuugucucacaaagucuaugugucaguaucuuaucuauauggggauuauaaugguugcuaccucacaggguuguuaagaggauuaagucugcuaaccaugugcugagcauucagcuuugcauguaguuaguacucauuaccuagaacuguacaagaauuaguuuuauuauuuaaaaaaacaaauuuaaaccugaagaucaaguagacaucacauucagggauugauuucugcaccagcaaaaaaauaaaauaaagauauuaagaagcuccuugaaugagggcauuguucaagcaucucuuuugugaaagcugauuucuguugcuuugacuagccauucucaaucuuccaccuguacuuggggcuuauuaaaaugcagacugcagggcccuaaaagucugcauuucuaacaagcucccagcugaugcuggucuaaugccacacuuugagaaccacuggcuuacaauauccaccugguuucuuaccuugcuucugccagugugggcacggaggucacuugcuguuuugccugcccuacugcauuauguguagacucuuugucucuuuucuuguuuuuuccucuuuuuuuuccuucuuuccuucuaucuuuucucuuuuuucuuuuccuucuucuuucccuccuuccuauuuuuuucccuuccuuuccuucuuuucucucuccccacagaaucucacucugucacccagguuggaguacagugauacaaucauagcucacugcagccuucaacucccaggcucaagagauccuccugccucagccucccaaauggcugggacuacaggugcaugcuaccacaucaagcuaacuuuuuuucauauuuuuagcaauggaguucucacuauguugcccagucuggucucaaacuccuggccucaagcaauccccucuccucagccucccaaguagcugagauuauaggugugagcuacuauguccaguauguggagacaucuuucugaaugcuucucuggcuuucugcacucugaccacucuccuugcgugguccucaggaauaugccuguuaguauccacuacuaacauaugggggguugcgaaccugcacuugggaaccuccaggguccaggucuauccccugccuacuauucuuuacccucgucuucucgauuuaguucagggcuaucucuauaggcuguguuaccacuaaguucuagaaaagccacucuugaucacugguaaccacuugaaauucgccgugacacacugaaaccguaaauagcucacuguacaggugguuuuuucccgagggcauagaucucaacccacccugauaucgugacauaaauucuuaagugacaggcugaucacacgaugcugacaacccacucagcuucucagaacagggaaaucacgauagagccagcucaaagccucauugcugugaaaaaauaccaucacuauggacuucuaauagaaugacauucugauaaaaacgcuaugaauagcagagaugaggauaauuugauauaaucuguucuuacugcuuucauauuaagcuguggugaucacaacuuacuuuucuaagugccaacaaaacaucuauuuaauaaaagccuuccacaaauuugcuagggguugcaguugagcugcuugagcuagaagaguaucuuuuuaaagucccaugacacauuccacaccaaaaauguuuucauggucaaauaacauuucacaaugcucauuagcacauuaaaguaugagaauuuccacacaaaagaugcuuguuuaacuucaucuaauccagcauuccagaaacuuauuugauuguggaguccugauuuuccuguuucauucauguaacacuucuguacacuuuucuaaaguauacauugauucacucaaaaauaucuauuucuaggugcuauucuaggagccagggauacgguaauggacaagacaaagccucuguccccauagagcuuauauuccaaugggugaugcagaagauaaguaaggaaaugacuauacauucuaauuuuggauagaaauaaguguccugaagaaaaacauaacgguauaagguaaauacugagcacugggccacucuaacguuugaaguuugggaagagaagcaggacucaauuuaaggcuguaguaaggaaaggggcaaaaucaagagaggguaaguuccaacagcccagagaacaaauuucaaagaguguaucacuaacggugugaaauguuuuugaaagcuugaauuguuucaguaaggcuaggagaacaaaauuuaaaaccccaugaaaagaugcuccacauuauuagucauuagggaaaugcaaaucaaaaccacacugagcuacuacuucauacccacuagaaaggcaauaaucaaaagacacacaauaacaagcguuggccagaguguggagagcuggaacccuccuacacuacuggggauguaaaaucacacaguuacuuuggaaaacaguuuggcaguuccucaaaaaguugaacauggaguuaccuugugacucagaauucugauccuaauacauacccaagacaacugaagacauauguccacacaaaaacuuguacgcaaauguuuacagcaacauuauucacaaucaccaaaaaguauaaaaaacucaaaugacuaucaacugaucaaugguaaacaaagugcaguauaugaagacaauaggauaugauuuggccauaaaaaggagugaugugcgcugagugaaagcaucaugcucagggaaauaagccagacaaaaacggccacauauuguaccaugccauuuacaugaaaaagccaaaugaggcugauucauagagaaagaaagauuugcgguugugaagagggaugcaggguaacugcuaaugggcacaggguuucuuuuggguuaauggauauguucuggaauuauauagcagugaugguugcacaacuuugugacaauacuaaaagaaugaacuguauauuuuaauaggguuucuuuuauauuaugugaauuauaucucaauaaagcuauuacuuaaaaaaaaaaaaaaaaacugaaggccgggugcugugguucacgccuguaaucccagcacuuugggaggccgaggcgggcggaucacgaggucaggaguucgagaccagucugaccaacauugugaaaccccgucucuacuaaaaauacacaaaaaguuagccaggcgugguggcacaugccuguaaucccagguacucgggaggcugauguaggagaaucgcuugaacccgggaggcggagguugccgugagccgagaucgugccacugcacuccagccugggugacagagcaagacucugucucaaaacaacaacaacaacaacaaaaacccaaaacuuaacugcaguggguuucagagcaagcaggaggugaaauagagacagcaugcaaugccaucauuuuuagaggcucugccucuucugcgcugucucugcuccuuccaccaucucuuugaacacaucucuucugcccauacucaccugaggauugccagugugguuguaucgauauccuuuuuccuugucagaauauauuguaauucaauucuaagggauagaaacauggcucauggcgggggaaagagcaaggaaggcugaagagcuacccugcuccacagcugguguccugcaaccuccaccaguuggcccugugugaauccuucucccucacaugugccaaugagcaacugcagaaggcaggucugauucuaaagaacaacagacgauacugugguaaaacgauaauggccaccuucaaaguuauccaugaccuaaucccugaccugugauuauguuaaguuacaaaagauaaauuauggcugcaaaugaauuaagguuauuaagcagcugaccuuaagauuggcagagguaucauagauuuuccagguugccccaaugucaucaggaguccuuaaaacuggaagagggugaacaucaucaaaauuguaaacuuucuacuucaaaggccacaagcaagaaugugaaaagccaagccagagacuggcagaaaggauuugcaaaucaccuaucugauaagggaaguauaucuaaaauacauaaagaacuacuuacaacuaaguaauaaaaagacaaaaauccuaaguaaaaugggcaaaggauaugaauagacauuucuccaaagaggauggauaaaugaauacaugaaaagaugcucaacauccuuagcccaaaaccacaaagacaauaccacuuaacacauacuagggcaacuguaauaaaaaggacagauaggccgggugcggcggcucacgccuguaaucccagcacuuugggaggccaaggcggguggaucacaaggucaggaguucgagaccagccuggccaauauagugaaaccccgucucuacuaaaaauacaaaaauuagccaggcaugguggcacacaccuguaaucccagcuacucaggaggcugagguaggagaaucucuuaaaccugggagguggaaguugcagugagccgagauugcaccacugcacuccagccugggcgacagagugagacuucaucucaaaaaaaaaaaaaaaaaaaaaaaaaaggacagauaauaacaaaugcuggcaaggaaguggagaaauuggaacccuuguacaagcuggugcagauguaaaaugguacggcugcuuuagaaaaguuucugcaguuccccaaaagguuaacaauaauguuaccauaugacccaugcacuguuuccagcaauuuguuauagcaacaaguagagaaugaauacagaugccuugauauuuuuaaugcauaguuuacacauuuuucuuaucucuacaacaccuguaugaaguauuauucuaccaauuuuauagguaaggaagagacaaaauuuucccucagcaagacucagaaaucuucacguauuguuuuuuugguuuuuuuuuuuuuuuuuuuuuuuuugagacagggucucacucugucacccaggcuggagugcaguggcacgaucucggcucacugcaaccucugccucccaaguucaagcgauucuccugacucagccuccugaguagcugggacuacaggagcacgccacuaugcccggcuaauuuuuuuuugcauuuuuaguacagacgggguuccaccauguuggccaggcuggucucaaacucccaaccucaggugaucaugcccagcaucuauuguucuauguuuguauaaucaccaacagcucucaacuuggaauaaccaaauguaauguaacaauaagauuguuuccauuugcugaauaucaacaucaaaaacuuacagcauagaaaaucuggaagagacagaaaaacacauaggagaaaauuuagaucaccaguuaaucucacuaccaagcaauaacaauccuuuucuucauguagagugauacaaauaugauacacgcuuuuuuuuuuuuuuuagucucaauugccccagacaaaaacccugaagcaaggaugagagugcaaguaguuuauuugguggaugaucccuggaaacacgaguaagggaaggaaacaagaaaggaaaggaggccaauauaggaugugugaucaagugaguuauuauuucaugugacuggagcuuauaaaaccugcuagagaacucugagaaccagugaagaauaugcaucccagaguuaucccagccaaggugugagggaacuagcguauucauacaccaacuuuuguccucacugguugagaacugcuccuggggagacaucaauacuccagcacuucugccuucucccaccuggagagugagaaaagccagguuuccagggccagucagaugcaagucaggcuagguaggaugcauugcagccaugguggguggggguaacacaaugugggcagagcacagaccccacuuguagcaaugcuuugcacagugcugucucauuucugacaccuggagucucauaauuugcugcugaaccgaaaguucaaguauuuagucuccuuuucaugggugagauaccagacagauaaagaucugguuagagguucuuaaacugcaaaucccaaagcccuagagcuuccagaacaagccugguauggccaaggagcagcucaugauggaaguaagaauggggcaccagaaagggcggcaggcuucaguucccccuccgugauucaaacagagcagcucuguuuuaucuguuucuauguugggaucccaugcacgauuucauuugcaaaaagaauuuauuacuaaaacaaacaaacagaaaaucuuugaaaacuacuaggauuagaauuaggaaacguuggggggugguaagagugauuaauuucuucauuucacagaagaggagaguggcuuuuagaagaccaauaacaaagcaauggcagggcugggacuggaaccuugagaaccccgaaacccugacuuguguuccagugcuuucuaccucaucuugcccaaccuaccuuucccagaucucagaaagguagaagccccuacaauuaagcaguuugguguucagucacuggagauggguggccaagguucagauccuaccuauucuuuugacugagucaauuccuuaacuucuuucauauucccucauuuaucaagugggcauaaaaccaguaucccaacgcauaagacuuuuauaccgauuaugugaaauacauagguaaagugcuuaagcuaaugcugcacauucugaauauucagucaauuccagcagugacuauauuacaggacauuaguuuuaaaaauaauuuugacaaccugcuucuguucuaaaccagaaggcuuaauucuacggugagccuugcugaauguauucuacuucauccagaccaucaccaaccccaaagcuguguguucuacauggcuggauuucgccuuucuugauuuggggaggccucaucuucugcaacuaagucgagucaagggucagcaugaaauuacugacagccacuuaguucuaaaauaaaugucacuggaaguaaugccacuuacaggacuuugaggauaccucagcaugaucaacucaagaaucaaauuaguggccugucaaaaugcacaggcacacugaugguuucugaugcuacugucaaugagcuccuucacuuagaauauuagcaaugcucaggcaguugguaugccuuucaggaaacagaggaaacauagugcuuuucauguguucaaagugucccaaucaaguugggaaacuucgaggaaaaaaauaaaauaaaaaaaaauucaguuuaaacaaaaaaaauaaacagaaaacaccuccuagaauuuguggagacucuguugaguuucguggcuuaacaauuguguuuuuaagccauacaucacugguggugcuccaauugugaguuauaauaauauaucauaagagggauggugaucuccugauauaugggugccauacaucaucuaagcaccauggcuuugaugauguauugcuccaagccacaaugagaguuuaaaggagcuuuuagcagccagacagcuuuaaauuucaaauuuucaaaaauuaagaucuuuucaaguaaaaaaaaagcaagauaauggaaugugaugcuauauaaagugucacugaacucugagagccuggguauaugccuuuuccuuuuggcuuugagcucacaagguggaaaucauuggcaaguucuucuucaauuccuccuccaugagcacagaggugagcaagugucaaugcauccauuuugccaaucaauuucccccaucuuccacacugcaagccugaguagcucaucaucaucccaaagacuggaucacauaaaaugcugugauaggcacuggauaaacccaggagaaguuauuuuuuauuuuuuauuuuuugguuuguuuuaaagagcucuuccacugagauucagaacaaaaagaacagauaaaaaguagauagacuuccuuccucauugcucucaaacucaaaacagggcauguaggaagaaaacaugccuugucuagcauuugucuuuguaaagcaaaggaagcauugauugcagaugaggagaaagaggggaauggcauaugggcuucucauccagacuaggaaagggagcuguugucauaguucugucaccuuuccuauuuuaacgauggguuuauaagacgguaauguggcuuaagagaauguacccacuucguuuaaaagccacucacuuuugggggcaaaguaaucacaaucaauuaagaaaacagguguugagagaacuccucccuuuuuuuuuaaauccuacugcaauaaacagaacaaaaugagaaaucuuccuacuguuucuguaauagaccuaaacaggaacagugagagacgauuacacuucaaguggcuucuuccauuuuccuuuacuaagugaauuaaaggaaagaauaagaguaguuacugccauguggagggaaacaucugggcauaaggaauuaacagucuucccucccauucuccuaucucuaauuuuuugcuccuugggcuuccuccaguagauucuaagucccaaauuacuguagauauuuugcacccggcucccuccuugaccacuuccaaagggcaaaaacaucuuauuuccaccaaagaaaaccaauggcugucucaaaaagaagucccaggcuucuuuucuccuguaguaguaaguuaacuauauaaucuggguaacaaagacauggaaauaaaugcaucacccacuauucugaggcugucaguugaaagaugugaaugaggcaggcuuugcaucuagagaaauguggguucuuucacgggcugguaaauaaaucccccaaauucaguccucuucuucucuauaaagagaauacugacacaacacuuaauuauuucuuucacauaagccaaaaagcuuuacuuacguauuuauaguaauagcacaccauucauccacccaccauuuuuaagucauuaucaguuauaaaacuugcugccauuuacauaagaauauuauauguuggaaugguacuuaguacuguauauuaucacauccucaccaaaacacuaaaaaauagaaacuguugucuccuuuuuuuucaguaagcacacugaugcuuacuggaauuaaauaaauugugcaagcucaccaagcuggcaaaaguggccgaguuaagauucuaagucagguugauaggaugucaagcguaaucuguauuuugcuaugcuccuuccugaguaaauaacuaaugucugggugaccauaugccccagucuguuuggaaccauccagcuuuaggccugcagguaugaacaggccaguguaauaacaaacagcaucuucuuucacucuccuaaguucugcuguggacaauaaauuauauggucucccuaacuaguaguauaguucaugccaggaaauuuuauuucugcucauucuaacuauucucaucugcagauagcaggggaaaaacaaagaagaaaggaaagaaagaaggcucugugaaaguuuuuaaagaaugggcuacuaacucuuaucuaucaauaccuuucaugaaaccuccaacauguucagaguagagcucugggagggaaaagaaauacuuuagacuaaaacagggccccucaagcucuaaagaaaaaaccucaagcaugcuagaaaccucuccaguugagcauucuuuacuuauuaucaucacaagaggcaacgguaauagcuguugcuauuuauuaagcucuuacuauaugccaggcaccauaugccaggaacugagcuaagcacuuucuuuguaagaucucaauuauuuaucauaaaacugcaugauagauauaauccaaauuauuaucaucauuaauuuauagaugaagaaacuaaggccgaggaacguggaaugaggaggucugcccgauuccaacauccaagugugauacuacuaucaacacucugguacaguugaacacagccuaguaaaaguucuaagcccacugccccugcacccccugcuauucaaccuuaugacaguaagcucuucugcaagaggggcccauuagagagaauggacuucuaacaaauugagaucaaucuuguacaaauauucuguauuaucuuuuggcuucugauugguuuucagugacauaacagcuuuaaauucuuaaagcuauuuaaugagaagagaguagauguauuagucuguucucacacugcuaauaaagacauaccugagacugggugauuuauaaaggaaagagguuuaauugacucacaguuccaccuggcuagggaggccucaggaaacuuacaaucauggcagaaggggaagcaaacauauccuucuucacaugggggcagcaaggagaagaaugagugcccagugaaggggaauccccuuauaaaacuaucagaucucaugagaacuaacucaguaucaugagaacacgaugggggaaacugcccccaugauucaauuuucuccaccuggucccacccaugacacauggggauuaugggaacuacaauucaagaugagauuugggugcggaugcagccaaaccaugucaguagaauuuauaaucacugccucuagagaaguugacaaaccuaaccaacagcuauaaaaccaggauaacuccagauguagggcucucagaugaggucaucucuacugccuuggguuauggacagguagaacccugggaagaccauuccaagauagagucuuccuguucaguuagacaugcaggagcucagagguucuuguaaaauugguucugcuugcugcugggugggaagggacagugccuuaguaaugucuccaucugaaaacguaugaaaguuucaaaaugacuuuuaggagauacagaggauguuucaagauuugucacccuugugcuucucagcuguuguuguagucauggaguuuauaguacaugugcuugguagaaaaaauuauaaguguucuuccuuccauguggaguuccuuucucuuuccuuuucuuccucugaguuuuaaagagcaugcucaaaugccaccuccuuuguguacucuucagacucuuucaggcuuuucugauucauuauacauauguccaugacagcuuuuuaccacaaaguauaaguaauuacagguuuucucuuccacuagucuggaacucugggcuauuuauuacuuauuuuuccccugauuauuucuuuucccuaacccuagguuccuagguuagaagacauauuuucuaaauguugaauggauggaugaauggauggaugggugggguggaugggugauggaugggugaauggauggguggauggaugaauagauggaugaguggguggguggauggguggguagcuagguacaugagugggaauguggacagauaggugcauggauggaugaauggaugguuaaaaaauagacaacuacacugcucuuaauuucuuagcuugcuuaaaagaagaaauauaugcacugauuuucuucgccauucuugucauuuucuuuugcuugaaaguucuugugcauacaaagauauggucuaugaagagccauuaugaucacauuguacacaccuuucuuccccacugaaaaguaucuuuuuaccaaaauguaaguuugaaguucuuguguuucuagccucacauaaaucccuuuuaaaaaacuccucagauaugcucaagugucuggagaaauagcuuauccuaaaaacagucagcauugcaaggguugccaaggggauauauuuguucuucaguauuaacuucauuaagagcuacugugguucucucucaggagagaagaagaaaccuaaccuuucuuuggauaucuucugaucuuuacaaauuauuuccagggugcugucuuuguuagacaaaauaugaagaauaucuauuuuuuuauuuauacaucauaucagaacauuaauuuguagagugauucccucugggugccuuucuguuggguacacaaaaaaggauuuggaugcaaaugaaacaaugauagcauuuuuccuugucuuacucauuuugugacaaaugcacauugcuuuacuguuugcuauacacauaauuacaguucuuuaauuuauguuucaauaaaauguauaauaauaaacauuuacugcuccaugaauaaacauucgagugaagccucuaauggagguuacauguuucgaggcagcucuguggcuuuuucagaaaucugccuucuacuuaaugagcaucauuuccauaaucugugcauuauugcuuaagccucccuuuaaaacauuucaaaaugcaaaaauuugugaaauaugaucaguccaaaggggaaaaaauguuaagggaauuagcaacuuguccuguuaaagggacaggacaagcuuucaugucccuccagagacaguaacauaguaauuauggagacagcacuuccuaauuaucucacuagcugagcgcaauacuacugugguuuuugccucuaagaucugguuuaaauaaaagugauaagaaaccuggagaggucagccaugaaggacaagcuugugcuaauucucuuuccagugcuaacaaagaaaccagaaaguagaaccagaaauuuggggaaggucaagauaccugugguauggacauuccuggauguagagacagacaaaugguuugauuaaaacggucaccccaaaguaacugaauucagacaaaagccuaugcugagcuuuaugucgauggugucacacauuauuuucaguguguuauuucuuaggaaaauuacuuacauaauuuuaugucauuaucacuuuaaaagguuaaucuauuucagauaaucuuugcaaauuguguucuaaaaagcaggugcuuuuaaaaauaacuaaaacaugaugacauauuucuuuuuucuuuguccaacagccauggcuggguuguuuaacuagagagaaaaaaagaugccaggagaaaugaaggaacaaaggacccuucacagugugauaagauacagauagucagccucugcagagcggugaugaaauguguuaaaagugauggcugucacuucaugacaugucagcgugcuuuauugguggguuggcacaauuuauuuaaacaucgucaggagggacucauuuugguguaguuagaaguuguguuucuuuagugugaauaaauaucucugggcccacgugcaacauuuuaaaacugugcuguuguuuacugugggaauuggagcaaggagcuaagaguuccaaagugaagcucuccuucucccaccauuuuaugauuugcuauaaguaauuugcuccuugcuuugaccguuacuacaaaaucuuucaaaggaacauuauucuccuuaacaggggcuaaauuuaagauuuuucaucauucaauauugcuauuuucacaugugacuucaacaaaauaaaacauucggcauaaauagaauuuaguguaauccaaauccugcuuuucucuugguacauaugcuuuguugcuucuugacauuccugaauuacaaaguauuaagcagaaucaucuuuuuaaggguuacauuuuccuucuaacucaagugagcagguauuuacgucaaagucacacauuuaaaaaugacauccucuuccagcauggggcaaaucucaaccuacagggcugccaaguggagcugcaacuuuuugcaaggguucuacccagaugugcuacaaguccauauuaccuuugaaaucaccaucuuguaaagauaucugcacccucauguccacugcagcauuaucuauaguagugaagauauacaaacaauguaaauguccaucaaaggacaaacagauuaaaaaaugguauauaauaaauacaaugaauauuauucggccuuaaaaauuaagagauucugucauuugcaccaacaaggaugaaccuggaagacauacacuaagugaaauaaaccagacacagaaagaaaaauaucacaugaucuuacuuaaauguggaaucuuaaaguaaaauauauagagauagagaauaaaacagugguuaucagacugcgguggagguugggagggcagaauggggagauacaggucagagaauaguaagcagcagauuuguaggaagaaccagucuagagaucuaacauacaacaugaagacugcagguaaaacuguacuguauuugggauuccugccaaaugaguauacuuuaguugcccuugucacaaaaacaaacacccaaaaaagugaguaacuaugugagaugaugaauaugugaauuugcuucauuauaguaacuauuuuacuauuuuguauauaugucuuaacaccauguuguauaccucaaauacacacaauaaaauuuauuuaaaaaccaacgaaaaagcacauucccuucauaaaugagauucuuuucaaaauaaguuugaaaauauacauuguaaaauauacuagaaaaaccacccccuaacuaacuccccacaacccaggagcucugauuugauagcuuaagacaggauaaaugacuccgauuaggacaaugagccccaguuuuauggggaccuccuaaaucauaucucgguuugggucuagaaugauggugcugggagcacccagagagcugcauaucaucucagccuggcuuccacacagggagccagagagauuuauggggcccugucugguggcuuugaggcacaaacgaugaauacugcuaaagcaauaacaauaaaagaggcaacagacagugggggaagccccagcaccaacccucauuuuucucauaauauacucuguuguacaaugagacagagugauuccauagguaccagccagaaauuacaugaaaaauugaucauguuucuuuuucugggugauaucagugauugaggcccuugauuuaugcuggccaaacuuuuucagugcagaauggaacccuuccuaacuucagucuccguggcucacacagacuggccauuaacagaagacacacugcaucauaccauuuagucaggacccuacacuaacagagggaacugcagcagagucuuaauagcaacuccaauuugccaggaaucucaccacagaucagaaauuuacaguggcggagaccuuuuaggaacuuucagcauggaugcucccucaaggugugggucagaauuugcggcgcaggaggugaggugaggugaauaguuuauaaugauuuuucuaugccuuuuaaccuuuggaauuaacauuuggucaagaaagccaauugaaggcuaaguguguacuugacaugugaaaaaaugaaugugucuucuaggcguuggcuuaggacacugcugagcccuggcuacagccaacucaggcuuaacucauuaaggugauuagccaacaaucaauucuuuaaaauuaguaacauaaaacaggccauaccaggcucauggauauaaaauuuggguaucaaguuuugcuccagagaaaugucacacccucaccggcaaaaagucuauagagguagggagugucacagguaagguugaguuaaugagacauccucuagcuggcaugaauguguaaagugcgcuccauggucauacauccagcaagucaggauuucacagcaagcauagcuuucacuuuaagcuaagugacauggaagguucagguccuuaaccuuaggucacgggaugacaauauacagaaucugcagcuugacagccugggcuuaauuccuaguccugccacuuuccagcugugggaccugagauagucaacaccucagagcuucagauuucuuguuuguaaaaugaacccaucucagaggguugcugugaggaucaaauugguuaguacugcaaaauacccagacuaguacuuggaacuuaguaagcauagauguaagguguuugcagcuaucauugcugcugccgcugccacgauuauuaguacuacaacuacuuaaccacaaaaucugugcuacuugaccacaacaucuuucaguuaaaaaaaauucacaauuuauuuuuuuaauuuaacuuucucuuaaggacuuuaccauuguuuuaaaaauuacucuacugaagucuaauuuacuaaaugggaacagguagaagaaccauucuccuaaaaacuaauguggagucaauauacuuauccugggcaugaagaaacccuggagcuuccaaagaacacagugugaaaaacuuugcuuggggagggagauggaaggcagagaacgaggguuucucccacugggguacaaauccuuaggaaguggagcuuggugauuaagagcaucgagcucuaaagucagaugagcugggaugaaauccccaccccaacuuucauuuccugugugaccugugaaggcagucgaauaucuuaauucuuuggguucuauauuuauaaaaugcagauaauaaagucuauucuucaaagggcuucugagaggauuaaaugaaauaauacaugaaaaccucuuagcaccgccccuggcaccauuagaaaaugccuuauaaauguaagcugcucuucuaguuacuuuuacccagaucucugcucaaguguuacuuccauagagaggacuuccccaauuucuauauuacauauaaacaguuccgguccuaucucaaauuaaaaucugcauuuauucacuuuuucauuuuuuguucccauacucacggccaugaucccagcaucugugacuaugacuagcacuuaguaggcacccaauagguauguguuaaaugaaugaguuaaaaaggagagacaggaaguaucucuaacucaauguuaagagacugcaaaaacucuauuaggcugaaaacuaggaaguauaauucuucaaaguaauaacagaaauaaaacuugaagacauguucuuuuguguaugcaauaguguaugcugauuguucucaagcugccaacuacccuuaacagugcucugcugugaagacacaaaaggggcaggaggguggaucagacagacuucauaugagccacaaugcagguccagccaaaguagcaaggauacaguuggaauauaaaugccuuuacccaccucucacuguuuucuucuccugaaaauugcucuacauuaugaucucucucucuuucucuaucucuugucucauacuuggcuuuccucuguccaugcaaagggccuccuugugauaucccacauucucuuuuauccugacacauugcauagacuccuguuguggguacuguguaguuauauaaccagaguugggauguuuuacugccuugaugcuugcguugugggucuguguaaucuuugcauucaaagugugauaacagacacuggacauagcgcauaacacucagagcugcacuccagguacuaagaugucaugaggcccacgagagagaugcacauuucugcaagggcgucaagggacccaggagaggaagguaaaagccacuacgagguccucugagggcaaacgcucccugcucucuccugacaaugauccccaaugcaugaaguaggauauaguguguuaaggugauaagggcugaggaugaaguggguuggcucaacuggcaaagcacugugaacuggaaauguguuaguguguggaaaagcaauguuaccuuggaugagagcucacuccucucgugaacuagacuuuucccucaagugccuucccccauaauacagucaguaaaaucuucuaaagcccugagaacuggaaucaucucacgaucuauaguaacccaaaguggccuagcaacuagggguggacccuguuaacuauucacaucgccacccugacaaaagucuuccugcucccauuucaaggcucucuccacacuugguuucucugaccuuucugaaccuuucaccguaucuugcucucuggacugcagccccuggcugugaauacauauuuagucucucagccugcccuuccuauagacauauuauuugaugcuuaugcaaagaucacccuuagccuucaucuuuccaugccuuugccauacacuaccuuccuccuccccacacuccuguagucagaugugaugcuucaaacucagcuugagcgcaggucucauuuucacccuccucauacgccuguggacaaguuugucagaccauugguuaaauauucgaccaagagugagguugguaaaaggaaggcauauuuacgagacagaacaaaggcuuugcauuaaacaaaacaaaauggcaguuuuccuucuugcugaaacccucacuuggauauuccuccagaaucagagcuuuccaagacuccacaugauucauccccucucccauacuuagcugucuggauuacagcccuuaguucuuuuuuuauuuuuuagagacacggucuugcucuguugcccaggcuggagugcaguggugcaaucauagcucucugcagccucuaccucccaggcucaagugauccucccaccucaggcucccaaaaagcuuggacuacaggcaugcaccacauuggcuaauauuuuuuuaaauuauuuguacagacagagucucacuauguuguccaggcugcucucaaacuccugggcucaagcaauccucccaccucggccucccaaagugcugggauuacaagcaugacccacugugccuggcuuccuaguucucuauaggagucucuagguuguucugccugagagauucugauaguucagcuaguuucaaccagaaugcugaacccauuauuuugagcaugaaucugcucuccuguuauauuacuaagaagaaaaacaagguauuccauuaaaucugugggcacauccucaaaagcacauaguuuugccgagaucuuacaccugacaauggaagugcuugcacgaugcagguaguaaaacggaaaauaggaaucaggaagcugaucaggaaccagcucagggcuuugaaaaggagaaggccagugagcgcccaccauuugcagguugacagagucaauuuuuuuuuuaaaccugggcucaaagagagauuaggcagcuggauggggagcagacuaaaaaauauguucaccuuuaaauaaaucagcaacgaaauuggaggaggauuauaccucagggacaaaagaggaagaagaacaugaauaccugcuuuacuugaaaugccucccuucucccagccuuuccugcauggaguaugacaagagaggcccuugguaaccuucacuuuaauuagaaucauuaacugcaaauggaaguaagaacaacucaacucuccuugucuaauuacaggggcuaccuuacuccugucuguaaaaggcaccaauauuguccuaugaggcccuggcaugaagacuuugcuacucucucaaguaccaagaacagccuuggaguggaagaaagaacauauuugacucuaccauggaaauucuucuauaccucaacaucauuccuucaucauacucacauccuggcuugacagaacuuauguaucccugaaagccaaaggcagcuuaagggacaggauaguggagaaaaaugcagcccuggaacuagacuccuugugcaugcauccucaucacaccacugacugcuaccuggagcaaauuacuucauaucuccagauuccaguuuccucauccguaagaaaggcacaacaccacugucuacaucucaucauaguuuuucccugacaauuaauaauacauuacauaaaauaaaucuuuaauaaaguccuaggacucaguacuagguacugucuaaauacuagcuaugauuuaacauuuuuauugguaaaguuuuagaaacacuugcuuugagauuauggauucaaaggaagguacaaaauaguacagagagaucccugguaguguacucuucaucuaguuucucaaaguacuaugcugacauaguuuauaaaauauaacauaccuauaguacaauaucaaacccaggacacugacauugguacaaugcguguguauaguuaguucaaugccauuuuaucucauguggagauugguauaacuaccauugcgcucaagauacagaaugaauccauuaccacccaaaucaccauuguaauccuuuggggaggcacuccuguuccuucuccuccauccauuacaagacuggcaaccccacaaccacuaaucuguucuccaccuccacacuuucguuuauuuuucuugaauggugcaauaauaugcugcccuuuauuaaacauuuuuuucuuuuuuuuuuauuuaaacuuuuauuuuagguucaagaguuuaagcgcaaguuuguuauauagggaaauuguaagucacagggguuucguauaaauauuuuuucaucacccagguaacaggcauaguacccaauggguaauucuuugauccgcucccuucacccaccuucuacacucaaauauguccuggugucuauuguuucuuucucuguauccaaguguacuaaaugauuagcucccacuuauaagugggaauaugcaguauuugguuuucuguuccuauguuaauuugcuuaggauacuagccuucagcuccauaaauguugcugcagaggacaugaucucauucuuuuuuguggcugcauaguacuccauggugcauauuuaguacauuuucuuuguccagucuaccuuggaugggcuuuuagguugauuauaugccuuugcuauuaugaaaacuacugcaaugaauaugucuauguaugugucuuuaugguaggaugauuuauuuuccuuuguguauauacucagcacugggauugcugggcugaauaguaguucuguauuaaguugagaaauugccaaacaaccuuccacaauggcugagcuaguuuacauucccacaagcaguguauaagcaguccccuuccuccacaaccucaccacuaccugcuauuuuuugacuuguuaguaauagccauucugaaugguaugagaugguaucuuauuguguuuuugauuugcauuucucuaaugauuagugauguugagcauuuuuucaucugcuuguuggccucauguaugucuucuuuugagaaguaucuguucauguccuuugccaacuuuuaaauaggguuguuuuugcuuguuaauuuauuuaaauuccuuauagagucugaaucuuauacuuuugucagaugcauaguuugcaaauauuuucucccauucucuagguugucuguuuacucuguugauaguuucuuuugcuaugcauaagcucuuuagcuuaauuagguuccauuugucuuuuuuuuuuuuuggucacaauugcuuuuggcaucuuugucaugaaauauuuuccagagaccguguacagaaugguauuuccuaaguuaucuuccagaguuuuuacauuuaagucuucaguaguuuuagguuuuacauuuaagucuuuaauccaucuugaguuuauuuuugcauacauuaaaaggaagggguccaguuucagucuucugcauauggcuagucaguuauucaagcaccauuuauugaaaaaggaguccuuuccccuuuuggucagcuuuguugaagaucagaugguuguagguuugcagcuuuauuucugggcucucuauucuguuccauuggucugugagucugguuuuguaccaguaccaugcuguuuuggcuacuguagccuuguaguacaguuugaagucagauaaugugaugccuccagcuucacuuuuugcuuaggacugcuuuggcuauucuggcucuuuuuagauuccauaugaauuuuagaauaaauuuuucuaauucugugagaagucacguugguaguuugauaggaacaggacagaaucuauaaauugcuuugggcaguguggccauuuuaacaguauugauucuuccuauccacgagcauggaauguuucuccauuuguguugucucugauuucuuucaggaguguuuuauaauucucaauguaaagaucuuucaccuccaugguuagauguauuagguauuuuuuuguguguguuugacuauugugaaugggacugcauucuugauuuggcucucaccuugaauacuguugguguauagaaaaagcuacuaauuuuuuacauugauuuuguaugcugaaaccuugcugaaguuguuuaucaaauuaaagagcuuuuggacagagacuacaggguuucccaggcauaaaaucauaucauuuccaacagaugguuuaacuucccgucuugcuauuuauaugccuuuuauuucuuucucuugacugauugcucuggcuaggacuuccaguacuauguugaaaaggaguggugagagugggcauccuuguuuuauuacaguucucaaggggaaugcuuccagcuuuuguucauuugguaugauguuggcuauggauuugucauuauuauuuugagguaaguucauucuuccaaugccuaguuuguugaggauuuuuaacaagaaggaugucuaauuuuaucaaaaggcuuuucuacaucuauugagauaaucaugugguuuuuguuuuuaguucuguuuuugugaugaaucacauuuauugauuuguauauauugagucaaccuugcaugccagggauaaagccuacuugaucauaguggauuagcuuuuugaugcgcugcuggauucaguuugcuaguauuugguugcggauuuuuauaucuauguucaucaaagauacuggccugaacuuuucuauuuuuauugugucucugccagauuuugguaucagaaaaaugcuggccucacagaaggaguuagggagaagguccuccuccuacauuuuucagaauaguuucagugggaauaguaccagcuccucuuuauaugucuaguagaauuuggcugugaaucugucugguccguggcuuuuucuaguuguugggcaauuuauuacugauucaauuuuggaaauguuauuggucuguccaggguuuccguuucuucccgguucaaucuuaacagguugcauauuuccagaaauuuauccacuucuuguacguuuucuaauuugugugcauagaaguaguaguaauagucucuggggaguuuuuugguauuucugggggguuggugguaauguccccuuugucauuucuaacuuuguuuauuugaaucuucuuuuuuccuuauuagucuagcuaguggucuaucaaucugauuaauuuuuucaaagacccaauuuaugguuuuguugaucuuuuguaugguuuuccaugucuuaauuucauucaguuuagcuccgauuuuauuugaugcucugaggguuugauuaugguauaagagguucaguugaugagcuucauuucuggaagauuucagggggccacggcuuagcucagcacuccugggggaguaugcugcaacccugggggggcugguaccagucccccagcuuuguucucugccccucaagguuaagaaccugcugugcuggaggggcauagguguuccccaucuucuggaaacaacacucugacagaggaugcuggccaaagcacuucacuggggcaguggcagcaggauccaugcuuacuagcaugugcuggcaacaguggcagaaugguggguguaugccaauuuuguuuuuuugaaaaucuauauaaaagacuccuauauuaucugaccuuuuaaagugggcuuuugucauuuaacauuaaugcccuugagauccauacaagcuguuuuguguauuaauaguuuguuccuuuuuauugcuggguaauauucuaugguauagauguaccacuguuuguuuaaccauucaccugcugaagaaccuuuugacuguguccaguuuucagcuacuauaaacuaccugugaacauucauucauguacagauuuuuguguacacauagguuucccuuucucugggauaaaugcccuugggugcaauuguuggguccuaugauaaguauacguuugguuuuuaagaaaucacucggccaggcgcaguagaucacacauguaaucccagcacuuugggaggccaacguggguagaucauaaggucaggacaucgagaccauccuggccaacauagugaaaccccgucuccacuaaaaauacaaaaaaaaaaaaaaaaaaauuagccgggcauaguggcaugugccuauagucccagcuacuugggaggcugagucaggagaauugcuugaauuugggagguggagguugcagugagcugagaucaugccacugcacuccagccugggcaacagagcgagauucugucuaaaaaaaauaaaaauaaaaaaaaauaaauaaauaaaaaauaaauaaaucacuauuuuccagaguaguaguugucuucuauauuuccaucagagagauuugguuucuguuacccucaccagcaucuggugcugucauuuuaaaaauuguccuaauguaugcagugauaacucaucauggccuuaauuugcauuucccuaugggcuggugacguugaguaucuuuucaugugcuacgugccacccuuuauuaucuucaaugaaaugucuauuuaugucuuuuguccacucuacuuguauuguucauuuuuucuaucauaaaguuuuuuuuuuccccacaguuccaugaauacuauagacuuuuuuuccuuuuucaacuuuuauuuuagacuugggggaacaugugcagguuuguuaccugaguaaagguaacuacugugugaagcugagguuugggggaugaaugauccuguuacccaggcagugagcauaggacccaauaguugguuuuucaacccuuaccuccucuuccucucccucuacucaaguaauccauagucuauauuguuaccaucuuuauguccaugaguaccugauguuuagcucccuuuugugagaacacacauauaccagaguuuugagaauucauuauaucuucuagauaugaguccuucaucaguaacuuuuuaaguuucagagauccucucucauucccuucaacuacgagugaucucuucuuucccuaacuucuuuacaaauuuucacauaggaccuuuuauccugucuaucuugagucugccauagauggcccucccuaacugccucacucaucuaugaacaggcucuauuucugauuugucaucacucagugucuugcuaacauuugggcaccuaucuggcauuccacuaauguccaccaagugacugaaucaacuauaccuggauuuucauucaguuacuauaagacuucagccuaaagcaaaagccacgguuaccauggauacgcaggcuugggauagauauguauccuaagcauuuaauacuuuggaaaggauaacuaauuacaaaaagaaauacacacacucagauguguuagugauuaauuucuucucagcuaccacacuucuagcuaacgcugugacacacuaacguuuauugaggaguuucuauuuacgccaaccuggggcucacauuuggcuaauuaagaacacauacauuucagaacuugugaucugugggcuguguuuacauaugaacaucauauucaauacacaggcaauuguuuagcaccucuaaccuauuucuagccuuauauuuaauuagugagaauugcugauggggaacgcaggguaugacuuugcauuaaacaaacagcuauccuccuuacaaaucacaacaacaaugcauaauuaaacaaugagcuaccugagcuuuauucagucuuucuuccaaaggaauuaaaucucuaaugaggaccaggccucaggaggaacugcagaaggaauagagguaaggagacauaggggucaauucuagcccugcuuccuggccuuucugggucuuaauguccuuauugugagaugaggaaaugaauacuccucccuggcuccccauccuucucuucuucucucugguaugcauguucuaaagaucacaugcaauaacagaggcaaaucucuuugcuaaaguaaagcauaauauaaaauauaagaauugucacugcugugaguuaagaggauuucauuauuuuuacacuggagaagaaaaacaauugccauuaaacagguucuccaugaccuguccccaucucuucccugcccucaucaccuguccuuccucucccuguucacauguaccagccaccugaccuugcuuugcuccuucccaucauaucaggcacaugccagccuugggcaaaucccccuccucaucaaagccuuuccaugaccgauccuccaauugaaacuaucacucacuccccucuuauaucacuucuuuuaauacagucagaguacuugccacugucuaaaaaaacuguuuguuuacuuguuuucuuuucuuuucuuuucugcuuuuccuacuauucucuccugcuuuuccuacuacucuccaccagaaucaggagcaguaaacucaauggcucugucuuacuuccaugcuacaaacucaggugaguucacuguagccuccaggagggaaauguacauuauguucucugggacaaagcucccaggcaacaggcaaaaauguuccuuuuauucuacacaacuuuggaaaacaccucugaauccaacguugagagccaucauccuuaugcugaguacucaagagcucccaggauucuacagcccauaaaugagacaauuugacaagagucacuaguggugaccacaguaauaguauuaggaugaaccacaugaaaucacugagauucacuguuuuggcccuaaccacuuucauaugguuuggcauaguaacaacaauggcagcaggagcccuugcuacaugccaggcuuuguauuaaggcuuuaauagauacuaguucauucacuucccaccacaaucuuauaaccuaaguauuaauuaccuauguguuaugcauggaaacagcaaggcuuaggaagguuaagggauuuuuccagaggagaggugguagcaucaggucacaaacuuaaccccguauuauccuggaagagcuaauguguguucccuuccuagggaccaccaugaacccaccuggguucugugcauggaaauaacacagaaauggaaguugcuguuuuuugcuuuauugccuccacgacuuuguagccauugcuguugacugggaaucucuaaauuacaccaacacucagggucaucugaguugacaacuuucauggccacggccacuacgcccaagaaaaaaauaaguuggagguaaaaugggguauaaaacuaucuucuagcacuuucugcuaauugucuuuuacccagacaaggaacucugaaggacucugacaucaguuugcgaugccucagcuaccucuguccuuuggccaucucugacccuucagccaacuugggacccucaguccugguaagagaucaucaggccuugugccccccaccccaccaucuuggugagcugacucuuucuugcucacaccauaccuaaguuccaaauagaacuuuagggcaucugagaucccacacaggccuccccacugcugggaucaaugauaaccaucucauggaaagccucuucauugagauguccccaguuacaucaccccaccagcccagcauucuccuggcucaccucucuccagccacagaauuugcaucucacagcugagaaaugggauuggucuucuccucucuccaugucucugaaaacaucacucaaccaccuuggcucaauagucuccugcuucaaccagugccacugagcaugccaaucucuuuuugucauguugacaucauguguggccuugauuugccucccccaaauuccuccuaggauggcccuucucacagccuugaucucauccugggcaccuaaagggguacugagaauggucccucccacagcuuugacugaaaguucuuggauuccuucuauauccagucaauuucacuaccuucuacuuuagcuacuuagucuugcggauguuugaauuuuuuggacacuggauuuuuuucaucguauaaaugauuucacaucccaaaucugacauuauguaacaccucuuuccugaacaaccugccgaguuugucuauaagaccacccacacugugcauuaaguucaccagguauaaaacauagguggccauugcaccaccaaagccaguaucccagacacaguggguuggagacccucgggacaugcagacaucuccccacucccagucagccaucugacucuguggagucuccucccucucuuguuaccauuccucaguugugccaaugugacacgccacuuccagacucucaccuccccugaccaaagcuagaggcauggccuuucaaugaucucggcuuguggucucaccauagagucuauaugccacauuccugcucaacaucuagaggugucacuucaagcuacccucccauuauaggguauuaagcucugaaguuagccaguaagggggaaaacaugguuaaaccacucuggaaagaucccuuaaacugaccaaccuucaacaaaucugaaaagucuaauuucuuuuucuuggaaccaagcgcugguucugcauuugaacacaaguuggaguccugguuaggauuuggagggcuagagggugcaaaaacguccuuauccauuagggucacacucaucacagcaagaugcuccccuuguggacagcugugugggacggcagccagugaagaggagacuagccacucugaagccuacguuccuugaguagaaugguccacaaucuaaaucuagggguucacuccuucucucccucugcauuugucucucuuuccaugucugcuugugucugucucuccaccccccgaagugugugucuggguguuucucucugaaucucgguccccuagcguauguugugucugucuuuauguacguaucuguguguaccuggcucugugucucucucagcauguuacuguguuuccauguguguaaggguaaaucuccccugucucuaucucuucuugucuuucucugcaucugucccugucucuacguguguaccucuuucuugguuucucuguggcugucucucuguuucucucucggucuugaugucucucugugugagugucucucucuccuuaugacugucuucaugcgugcauuggguccuugugugcauguccuccuccuccagugagugucucccuaugcacacauuucuugagguguagggcucugcaaaacacuuagaguugacccauuucaaauauguuagccgcacaugauucccggccagguaugccagcgcugcccucuucugcauugccacgcagacgccuaccuuggucgaaacacuugcagacauaucuuuagcaagguaucuuuccucguuuuuccccaacaaaacucaugcuguaggaaucuccaacauauacaaugaaagaguauugagcugccauagauaaauuaaguacugugcucggccucccacucagcaccaagaggccaaacagaaucuaaaaccacugcugacaccuagcacaccaaaccuuuccagccucugcaacuggcauucucugcaugucaaaaaccucugaaucauucugggucaagcacacaugccuccuuucacaaagguucugcaaacagguagcauccuguaccccgagugugugccugguaccuacugguguacccccuucucauugagagguccugaugccuguggugugagucaguuugaguguguuaauggaguguucugcuuucaaggccaaacugcauaagcagagcccauccuuuucccuucuuuugugcccagaugggaggaauuugugaaacuuguauuccaguguuaaugcugaaguugggaaauggcucaaucaagcaauggcaguuuaacuugaagagugcaaaggagaagagcagggagaaaaccaacacuggaagcaaaucagaaggccagaaaccuucaugggcacuugcacuauuguuuacagccacaauaaucauguaagggaacccagcauuuuucagaaguuauuuuguucuguuuuuuuuucuuuuuuuuccaaauguguguuuguauugcuuuguuuaaauauaggccugauucauucaggcuugggucugaagaucccaggcuuucagaacucaacaaagcuuucaucauuugcaaauaauucaacucaacaaauaucauuugagaaaagcucugugcuagugcuucuuguagagacacaaugaagaaaaaaucacggucccugcucuuuggagacaaauaacuuaggggaaaacacacacaccucucaacucucaccuaaggagugcugugcaaagugcugaaggagauggagacuccucuccugggaaaaucugcaauucgaaacucaaaagaagaugaggcuaagggcccuccagguggaggaacagccugaguaaaugccuagaaaggaauggcacauaguaggcacuugcaaucaaagcuuugcuaaaugaaugcauguugaacauguuccagaaaacucaagaccagaguagcacugagaaguagagguguuucagggcuuccuuuuagaaauuucuuauacugaagguuucagaaugcuaggagggaccagggagaugguuuauuccaacugguuucuuuugaaaacgaagaaaccaaaaacccaagcuuacaugcuagggccagaaaugagaugagaacucagaacuguuccagaagguaaucacuuugaauuuaaaugccuacucuucugaucucaauuuaaggaacuaaaacaaaaucagcaguacuguuugcuaguuuucugugaaucauucagacccuggagaagccagcuucacuuuugaaagcugagcugauccacuuacaacuguguggcuagguucccauuacugagucucagucuucacaacuguaauauaggaaaaacaacaguagcuaucguacagcguaguuguaaagauucagugagaucauguacaaaaacagcucuuaacaaggucaucagugaccuucacuuugccaaacucaauggacauuuuuuguccccaucucacuagaccucugggcaguggcaucuggcacaaaggggcugcuccuuccccaaaacaccccggcaccggcuccugggauagccuucuuuccugcuauucuuucuuucuggauguuccucggucuccauugccaaguccucuucuauccaauuucuaaauguuggcaaacugcaagagcucaauucuauauccucuuaucuuccccagcgacacacuuuucucauugaacccauucagccccuccgcuuuacacaccauccaaauguugcuggcacacacuuuuauaucccuagcucccacuucuccgcugguugucagacucaaauaucaaacuaccugcuugagaucuccauguggaagucauagaagagucucaacccaauaugucaaaaacugaacucuccauugccccauucccaaacuuaguuuuuccucaccugcuuaaaugguauugauacucaaccaugacuuaagccagaaaucuaagagucauucacagcaccuccucucccccucucccaacaucugccaucagguccuaaauuucauuugugauauauauguuaaccguauacguuuuucuuuauuucuaccaccagcacugucucucaucugaaugacggcaaucaccuccuaacuccacuccuguaucuccacagucaguucucugcccagcaaccgccaugguguguaacaaaugaaacugaucccaguacucuguguuccauccaucaguggcuuccucuuguucauagaauaaaggaugaaaccugaaauacuucuucaaacuucuccaggaucuacucacaaaaauccucuggcacagcucucuucuucuaucauuuggcugcauuucuacuugccuauuuuucauacucggaacaaucaugcuuuuuguagagccagggcccucacauguguugcucaggucuuuagucagcaaacucuucuuccuuaaucuagugguuaaaagccccagcucuggagucaaacugacaggggcugggugacuaaagacagucuucuggccaggcaugguggcucacaucuguaaucccagcacacagccucccaggaggaucaccugagcccaggaguuugagaccagucugggcaacgaagcaagaccuauuugccaaaaaagaaaaagaaaaaaggccgggcaugguggcucacgccuauaaucucagcacuuugggaggccgaggcgggcagaucuugaggucaagagaucgagaccauccuggccaacauggugaaaccucaucucuacuaaaaauacaaacauuagcugggcuugguggugugcaucuauagucccagcuacuugggaggcugaaccaggagaauugcuugaacccgggagggagagguuaccgugagccaagaucgcgccacugcacuccagccuggugacagaacaagacugucuccaaaaauaaaaaaaagacaaucuccuuaguaaaacuauguaccuuacuuuaaucaucuguaaaauggggauaagaacaguagccaccucacauaguggugaauauucaauaaaacaaaaugugugaagcacugaaacuacuaccuggcagaagaaaaacacucaguaaacauuauugucaaaaaucccuaucauccuuuaguucucaucuuaaauguuucugcuuaaagcacucuccauuacucuaacccucaguuuuaauccauuuuauuuccuaguacuaaucuaaauuggucaucaaauauugauuuugagacuuauuguccauuucugccucucaaauuacacucuacagaacagggacuuugucuguguuuccuucaguccuggaaaccuggcagaggagcugaggaacugagcuuuacaggcugaguucugugacccugugauuauuauguugaagcccucauccccaguaccucucaaugugacuuuaauuggaggcaggggcuuuaaagaggaaaguaaguuaaagugagaccaucaaguuaaaauuaugcccuaauucagucugucugguguauguauaagaagagagggaauuuggauacacaaagagaaaccaggggugugcauucgagagaaaagauugugugaagauagagcaagaagguggcuagcuggaugcucacaagaggggccucaggggaaaucaacucugcugacaccuuggucuuuggcuuccagccuccagaacggugagaaaauaaaugucuuuuguuuacaccaccuaaucuguagcauuuuuguuauaucuaccauaaaaacuaaugcagucaguaaagacugaugagugaauggaugaaugugucaacccagugcucagcacaagguaaguaugcacaaagguugacuccuauuccugaaauaaugaugaugaauguaauaacaucucaggagcaaaucuaaccaaugcacauugaccaagucacugagaaaaauaugucucaguggcacuuacagugcuuuucaccuguaauacugaagugaaaugugauuagcuaugaagaucugagaccuuccuuuaggagccagcacauacuacucuaugacuucuguuuacuuaauuuguacauguuggaacuugacuguuuuaugguagacucuuggcuauacaacauggaacacuagacauuuccauacucaguaaacaaauauuucucagacaugacagcaaaacuagaaaugagaauauuagauuaauacuuccaaaauaacagccucaucguuuuaaucaacauguccuugaacacguuugaauguguguguaacugugugggaaugugagcuacauguguauuuuuccacugaaggugaccauaccauaugcaagagcaggaucucaaauuagauauucagcauagguagccauauuauccacaucuaccaacugucuucaaauuaaagcccuucucuagcuggaacauguaucugucacuggaaaguaggcaguguugaaaaucaugacaaaauuggcacauaucuugauaguugcaucaucuuuucuguggcaguccccaguaauagagcuucaucuaauucagcaaacuauuagcucauaauaagaaacagcauguguauugauucuuuuaauagaucuuggaauuaauacacaugauuccuauaaaaggacuguauaaaaaaaaucaccaaguugauuauugcacaaugaggucucacucaaauggcauaggcuacggcagaaagguaggcaauuccucuuuugaaaaaaacucuccaucuuacagacugauucucuccugaggaagaaaaaauauaaugaagugcuauaauuagguaucucacauguaagggaagauaacaaaaucaggaacagcaaauagguuuuuacugagugucaacuccauucaauuagcugcagcuaccuagaggguuguauuaagaagcccaaggucgacaguaaacaaugccuuggugaaauaaugauguuggcuaggguugcaaaaugaugaguagauggccgcuauguaauuucuacucugaaacagaugucacuaaagucucuuccggggccaaccuucuaugacucucuccuuuuuucuccucuucccucacucuugcucuuggaguugggaugaauaaguuagcaucuccugagaaucccaacuuucuccucuuauauaaaguggucaggcucaguuuucaguaucaggauucaaagcagcaaccucugucauuacaaucaugugucgcuuugguauaggcauugaaaagcuguaccagggugcugacugucacuuaaguaauuagacuaaacuauaauaaacaagaagagaucacugcuggagacccacauuuguuaaugaccuccaggguccucuccccuggcaagagauagacagaugagguaccaggagugcaggccuccuugcacguauaaugacaacagccagacaacaaugcaacaaaaauggucccauguccuguucuguguguauagggagagugaugacaaucaucauuaccaccagaacuaccaaauuuccucuccaguucuuugaugcuucucaaucauugucggagcuacccuuuaaagaugucucaccaugaacaguuacuaugacaagauacuaagaagagaguguuucauuuaaccccuuccaucacuaccccuaugagacaugauugccuuuacuugacaggaaaaugagguucagggagguuaaauguauguagaagauuuuagcaagaauauucugacuugaaaucuauguucuuaaugauuuaggauaccagcucacaacucaaagcaugaagcauguggcaauacuauaggagguaagagaucucaugacaggaaacucggguuauucauucauucauccaucuagucauucauccaugcauauauccaucucuccacucagucacugugucaacagauauuuaccauguaacuaucucuguacuugguacuggggcagaggugagcaaaacagauaaagccccuggccucacaguguucacagucuaaugaaagcacaaacaucaaucagugacauuacugugcaaucacaaauugagauaauacuugaaaggaaaguaaugggagccuaugacaaagaucuggauuugggguagggucagauuuaagaaaaugagaccugagagcugaacugauaggcaaguugacauuaauuagguggaaggcaggugaaagaauggggcuagagaacuaauaaggagauaauaacauauguagagguucauggaggaagggaauauaaaguauucaaggagcuaugagccagagcacaucgagcaggucaaugagggaaagagugguaugagaaaaaccuggaaaggcagagaggagguggaccauauuaaggugcauaggguggcaguggaaaccacugaaaaauuugagagagaggaagacaguggguggaagaaaggggacaacugugauuguucagacuucagugaccacaaacaauacagggagcauggugagaucagaauggagaugcagcaaccuguaacaggucacuuaguucagaucagagacacuugguagcuuugauuaggugauggugguagagaugagcagaaauggauggauuuaagaaauauugugggguaaaaucuaaagcacuuacugauaaauuggauuugggaagaugaggaagcaggaggcaaggauaaucccuagauuucugaccugaccagauagauguugcuacucacuggcuggcaacuucacaagguggccuuguugacuuuggaauaccuuuugggcauccuaguggaguggccuaaaagggaguuagguuuuacauguuaggaguucagaaaagaggucugggguggagacauuaucuugacagucaguuuuauagcuagaaaugguugaggcuuugggauagauagagaagggguacuuuggaaaacaauguucauggaaagcaauaaacauucucgucaaucacuauauucuucuaauacacuucuuccuuuuguuaugagcaucugcaucuuucuuccucuugcguuucaauaaaagcuucuauuuuuaauuacacuucccuugguucuaauuuuuaaaaguauuuugcauaucuguuuuauacuauguaucccuauaaccacuccaacuuuuguagaaugaggagagaggaccaauuacuaguuuucagaagauccacaugagacuccaaauggucaaauuauccugacagcgaacccagcaaggaauagauuaaauuugaauagugcacucaaaaggacuaucuuugagacucuaagacgauucuugauucauucauuucgugaaagccaaaauguccgaaagugguuugcggaugaggggacugaaucgugaauuugaggccuaaagaauuucccaauguucagccuuaugguggauuaaauuuaccaugacuaauuggaggauucaaagcuguuaggaacacuagcuauuagggccauuuuucucaucuucgaucuuacugcuugacugauucauagcuggaacugcuaggccguuauggaaauggaaaugcagagaugaagcaguucccaaugucaaaaacuuccagggacauguaaauacaauacacguaccaaguaaugaguuuaauuacuuaauuauuagauacugagcacuaaaauuuaacuaacaccugguuccauaaggaaaaaaauacuucauuucgcuguacuuauagcucuuuauuaugccuuuugaauuaucugaaauccacugauguacggguaaaaaacuccugcagcuagcucagugucuguccaaauggccacccaguuuugugcuugaaauccaggaccccacugguguaggcaucuguggggaaucuccuggucuguggguugugaagaccaugggaaaagcgugguaucugggcuggagcgcaccauuccucaaggcacggucccacauggcuucccuuggcuaggggagggaguucccugaccccuugugcuucccaagugaggcgacaccccacccugcuuccccucgcccccugugggcugcacccacugucuaaccagucccagugagaugagccagguaccucaguuggaaaugcagaaagcaccugccuucugcauugaucucgcuggaagcuguagcccagagcuguuccuauucggccaucuugacagccaccaccccauuuuucaauuuuuuuuaugacaggcuaacugugggcuuuccuaagagacaugagaguaguauccuuccccuacaauccucaggccuagcauggugucuggcauauaacaaauaaaucaaugcagccucucaaggaauccucaaaauacagcagaaucauucuagaaaacaauucauuucgauuaaagaaaugaacaccauagagauguuccauuggaagacuuuugaaccaaaacauuuaauucgccaguccugaccauaucuauaacaaaaggaacuaugucuuuaacguauuuuucuugaaagccaguucauaugguugagagagcuuauaaggaauacuaaaauagggaauauaaucagccuucuguuuuugagcaaaagugcugucaacuagagauggggcucuuggaaaauacuuuauacugccuguucucaguuuuuuucuucuuaagagcuacuucauuucauuguucaaaguuuagugagagccaaaagaaaauacaaucuauuuacaauaaaccuauacuuuccagaaucaccuuaaauuauuucugcuaacucuaagcauaaaucaaaaguucugaaaagcagaauggccuaaagaggaaauaugucauuuguguaguuuugggaggggagggagucuguuaggaaagauaaauuauuauuguccuaagcaaaaggacagcuaaugaauuccuaaaugacaggguuuaauccucaggcuuguugacuacaagguuauagagcuuucuuccuuuccauuguuaaggagauauuuaaauguaaacaucuuuucuaaccuuggaaggaaacugauggaaaacagugaguauuuucuuggugcaauuuaaauauuaaauucaaacuuaaagcaauuguucacacaugcauuugcuagcucaagaacacaaacauaaucugugggaauaagaaucacaauaaaugaaauaauaauagaacaacugaauccaucaauuuuucuagcauauauacacuaagcaaauaguuugcacuuugcauaggauucagcauugccaauauuuuauuucuaauaagccagguauaauaagaaaagcaaaauguauuggccaggugcaguggcccaugccuguaaucccagcacuuugggaggccaaagcgggcagaucacgaggucaggagauacagaccauccuggcuaacacggugaaaccccaucucuaccaaaaauacacacacauaaaaaaaaauuugcugggcaugguggcaggcaccuguaguccccagcuacuugggaggcugaggcagcagaauggcgugaacccaggagguggaguucgcaaugagccgagaucacaccacugcacuccagccugggugacagagcgagacuccaucucaaaaaauaauaauaauaauaauaauaaaagaaaagaaaaauguauuguuagucuuaaauauuuucugguuuuaaauugagucgaaaacucauggcucaaguucauuuaaaguccaagucugaauucuaaagguuaaaugcuaguaccguuaguuccucaaauuauucacuuguuuuuuauuuuuguuacaugagagagagaaggaggaggagagagagagagagacagaaagagauaucacagaauuagaacuugaaucucauucaguggauagggaugagaagaaaaaugaacauucacagagcgccuaacauguuucacguauccaaguaucacaucaggaacuuucauacuuaugauuucauuuauuccuaaaaauuaaguaacuaaguuucagaaaaauagagugacuugcuaaagauaauucagugacugagugguggaaucccaguuuugaagauagagcucuuugacuccaagaagaauucucaauccauaaagcuuuacuacaaauuagggaaaauggcuuaucuuuaaaauagcgugugaauaaauaaaugaguaaaguuuccauggggacauaggcagcaaauuaacagaacacaauuuaaaauguuggauguaaacuaauaaacagaugcaugucacuaaaacgucacauuuuucaucguaacaguguauuaucuguuggcaaagaccucaguaaagcuguuuuuauacaacagaagcacagcuggcuaaaaacagaacaaauguggucaaccaacuaaaauuuucaauucguucaaugccaagaaucugcauggaaugacguuuuaaauaaaacaaccugaaaguaagcugacccauaacaauuugguuuuuaucuuuaauaacuuuaaauuuuugguuaaugucucuauaaacagccuacauauuauucaggguaaaggcucaaauauauuauacuaaaauugcuuuuagacccagaaaauuccuuugcauggagguaugaaaaaggaacauuugaaauuagcuugaaauuuggguguauuucagauaugacaugccauucacauucauguguuuccauuccccaugaacaaugggcugcgugggccaguaucaaucaucuauuaauccagaacuuuccauacuaccuauuaguuaauaaaguacauugacauccauuaccccaugugaugggauauuuaacacacuuccagaacauagaauaaaaauaaagggguuuauacuuuaccuagaaggcuagugacuuaagaauuuuggugggaaguuucauccacuagaggaaaagucuuaugauuauguggaaauuauuuaucacaugcccccaacaaaccccacaacaucacaauagacaaauaguggugcucaaauagugaacauuauggaaauaagggagaacauacaucucuacccauucccaauaguuuugaacuuagguauuuauaaaauuaauuucaugaugcugcacauaaaucuuaauucuaaugugcauaaacagaaaaaagcaaguuguauaauuauucuguguuauuauuuuuaaaagcccuauauaucaaaccaaaacaaaucaauauaaugccaccaaugugaauaucauuaggcucagcaucuuaaacucagcaugauauccaucgggccauaaauuugaaggaaaauauucaauaccaguuucauaaaucauauuaacauuaggagaaaaucuauuauagcacaaagucuuauucaagggaaaaucauguucauaggaauuaaacaaacaaaaaaacacuuguggcccucugcucuauuauccuuaaauuuuaggaaauaacuaauuauaggagaguuuucagucauguaaaucagagaguuagcaaaacaaugguuauauuaugacagcaaucaauaauagcaugcauuuuuauuaaaacauuacuuucuaaauuuguagggcuuuaaauugucuagcagaacacagcuugaaguaugauauauggauggagguucauagaaaauauaguguaugggaaauacagacuccacucaggagauauaucugauuuaaacacaugcauauauaugugacaauauauaucuaauuauauacuaaaucucacagaacuacauaaauaucuucuugcuugcuuucuacaguuucuuuaagaaaauauuauuuaagaggugacaaguuucuuguuguuguugagcaacuugaauuacuuaguuucuugcagaacugugucuucuuccagcuagaguguaaaaucacuuggaaucauaacauauucaaagaguuuugucuuaacaaauccaugagugaucaacuuccuuccauccucaacaaagcugagagguagaccuugccaguucuaaccuagcacuggaguuuagguuuauuagauuuagccagaaccuucaagugauucuugaaaugaacuuuuuaaagagaauuaauuaagcccaauuucuagccuacaugauucccaugacuauacauuuauauuagaauugauauucaaaacuaacuauaaauauuuaaaauccuuuuaucaacaaaugaaacuagaucagcacagagaaaguugaacucaacuucuaauuuccuccucuuggcucuaucaaacaagagcaaaucaaacuggcugcuaagagaacugaugaccaagacagacugggaaaugagacuucuagggaguaugucaccgucuuaaaggccuuucuagacuggaugaauagaaauaacuggcagauaaaacugauaaacugauuugaaaacaucuaaguaaacauggccacaugcaaagguauccagagaaagauaauucuagaauuugcagauaaaacugcugaauugcuuuuuggagccugugaagaauuacagcagagguauucuaacaaagcagagguauucaaacaaauaagacucuuaguauucaaccucccauugggcaaaaacuagaagcuggcacccaagagagaaagcaccucuuucuugucccccaagcauguggcuuggacuggauuuuaccccaagucccacuguagccagaaacuuucauguagggcauaaccugugcaacucacauaugguuguccuggaucuaaauacuguauaagaauaaauaucucuuuaucaaaagaacuaacuacagcuagccauguguuacuuaacaauggggauacaugcugagaaguauacuaguauauuucacccuugugcaaacaucauagaguguacucauacaaaccuagaugguacagcucucugcacagcuaggcuauaugcuauacccuucagcuccuagguuacaaagguauagagcauguuacucacuuaauacuguaguuaaugguaacauaaugauaaguauucauguaucuaaauaaauauagaaaagauacaguaaaacuaugguauaaaagauaagaaauaugguauuccuauauagggcacuuaccaugaauggagcuuguuggauuggaaguugcuuugggugagucagugaguaaggggugacugaauuugaaggccuggggcauuacuguacauuucuauagacuuucuguacacuguauacuuaggcuauacuaaaugaaucuucuaaauuuauguaauaaauuaaucagcuuacuggaacuuuuuaacuuuaucaacuuuaauuuucuuaacuuuuugacuuuuguaauaacauguagcuuaaaacacaaauacacuguacagguauacaaaaauauuuucuuucuuuauucuauuuuuaaaaccuuuuauuuuuuacuuuuuacacuuuuguguuaaaaaccaacacacacacacacauuagucuaggucuacacaaggucaggaucaucaguaucacucucuucuauguccacaucuugucccacugaaaggccuucaggggcacucaccauggagccgucuucuccuaugauaacaaugcauucuucugcaauagucccugaaggaccugcuugaagcgguuuuaaaguuaucuuuuuaaaaaaauaauaaauacacucuaaaauaacaauaaaaaaguauaguauaguaaggguacaaacuaguaacauagucguuuauuaucaaguauuauguacugaacauaacuguacgugugauacuuuuauacgacuggcagcauagcuuuguuuacaccagcacugcuaugaacaagggaauaaugcaauggacuacaacguaaagacagcuacgacauugcaaggcaguaggaaauuuucagcuccauuauaaucuuauagggccaccuucauacaugcggucugugguugacugaaauuuuaugcagugcaugacuacuauaaccuuacaagcuugauaaaaggcagguaaaauucuaaaaugcacuguuucagaaggguugguggaagcuuggcaaagguguucacgaagagccagcauggcucccaaaggcaccucaguuucuauguuuguuggauaagcccaguagauccaaagaaugcuacaaaauacaacauauaguauauaaagcuaccauaauucugcuuuaggggaggauggagaagaaaagauuagaugaacaaaggaagaaaagagugaagaaaaugaagaaaaggagaaggaagaagaaagucuaagaaacauaaaagaaaaaagaauggagaaaagauaucuuagaaaauggaaaaugaaggaauuaagaagaaucaggauaucugcaaguuauaugacauacucucucacaauaccuuugcgaagcaugucauuuucaucuaacacagcagggcucaagcaagaguaauauaguaauauucaaaaagaccagggguagguagucaguuuuccaccuuuaccaauauggaggaacacugauguaaagaaaacuaucaccuaucuuuuuagggaggcauuuuuaguguauaaucaggacuuuagaaggcaaacuuucuuuaggcuguacccaccauugaccuuaacugagaacaccucuaccaaggucagggggccaagacucuccacuccaggugaugaaaucauacaguuucgauaugauuucacaauaugaacuguagauuuuugauaaaguaaaggccuggccagaaaaagggcagaaaccuauaugaacuuuaagguggucagaaagcucagcucuacuuaagaaacacuuuuagacucacuuuaguaggcuaucaaaacaaaaacaaaaacaaaaacaaaaaaagacacaaaaaggaaaaaaaaaauaguuguaccuucaagauaucucuugcaggaagccuaguccaucaagaaauaaaccuucaucucccgauuccaaaaaucagauaccagcaguucucacaaugccucuagugguaauucugugguuuuauaucaaguucucuauccuccccagagacucacagaaauggcaucucagcacuuuuaauccauuacuccccauuaaguccauuaguuacauaagccuagaagauaccaguauaggucagcaugugccaaaguguguuuccacaagcacucaacgcugcuagaugcuaaaacacgcucugugaacaaaagcgcuugcugucaaaugcuuuugagagaugcuagaguuaaacaaagcuaaaguuguuuauuugcugccagauuucugggagccuuucagaugccaaugcagccuguggcagugcaggaaagagaccaagaaugcaacauuucccacacauucuucacuagggucucuucaucuucgaauuuugcugagcaucaucacagucaacugcucuaaugaacauauuuugggaaauauacaaagaagaggucagcuaggucaugugagaaauccauguuucguucauugcucacacauuaaauuuucugcacaaacacauuauucucugugaaauuauccuucacucguagggaaaacaacaauagaaguccucugcaucuaaauccaaagggaucugagcuguucuacgcauauuuacuguguugcuuaagaaugucucaugguucuuuccuauggcaaucuccauuccauuauucaaaaauacaaauuaaucacauucuaagcaauuguucaguuuccuucauuuguaugugguugcagucuguaagugaaauuccuuaauuucuuuucucaaagaaagcuucuauccauacaaaacaguccccaaacccccaaauuuugggcucuaauaugaguuaaguagaaagguaaaugcuaauguuucauuaauccuaacgcuugaauuucaccccaaccucugcaguguucugcucucucugaagugcuuguuugcuuuucaguuccccaaauuuggcucugguaaaaacaaaacaaaacaaacaaacaaacacuaaugggaacaguaacuguguuuuguauaauuuggggccauuaccagcuacuuuaugcuucauuugcguacuugcguguauuagauacauuuuguuaaguucaccuaaggauauuucccucaaugggcacaaauucauggugccuauaaggugacuuuaguacagcuucaucaucuacacuaauauuuccagcagccccucaaaagcgagauauuuucuugaaaguaaaauaacaaaacuuacuguaugucugauacugcagaggccacuuaaauugucuauaauaaguccaaggaaaggaucguugaaguuaacuggccuugggaauuucaaguacaccucccuuugaaauaaaaccauuuccaaagaacgucaugucaaaugcacaucucccuccagaaaauuguguuuucuuuucaccccacccagaacauaacugaauaucauuuugcuggguagggaaccucccuaaccugccuuaagucucaucuauuuccauuuaaccauaguucccagcuaacacuaccucuuucccaaguuuaccucuggcaagacaaaaaggauggucuuuaugaacagauggucuuuucaagguaaaguaguuacauuuaaauacagauaaauguacuguaaaaaacggcuuuaaaagaauuuaggucuuuaagggggaaaauaugagagcacaagacacuauucuuuaauuacaugagauuucuuuuuucuucccuugaagacaaaaccaauuccuaaugaagcauaaugaaucguaaagaggcaccaaugcucaucccaacagauguuuauugauugguguugacugaacacaaacacaaggguguugcuuacuauugucaguaaguggugggaagcagcaccaguucccccugguuauuuuaccuuucaaagacaagcugacaaauuuauuuugucacgagcagcuguguucuuauuuuuauaaggguuggcuuacaacuaagaaagcaagcggagggaacagccuuuugguguccaauguguuaucuggcaaggacagauuguuuuagggugcaauggaaaagauuuuuaaugaaacuacauuucaaacgagcagcauaugcuugauuuucccuucugcuacucauccugccauuuguuaauuuuuguuauuguuguucuccgggacuccuaaauuuucauacaagcugucucguccggcacuaacacagcuuggggcgaauuaaugcuugggaugcaaaaaccugcacgucccacuccagccauuuuuuuuuuuuucauuucuaaaauuucuacauucaaucaggguuuaaccggugaacuaguugacggaacaagcagggauuaaaaaaaaaaaauuccuccucuuugugaguccuuggagccccagagccagaaaaugugacuucagaauauguguggacuugucagcagcucagcugcacacaauuauggggucagagcccagauuggaggucuggagaaacucugaaauugggaauuaggacaaaauuuuuuucuuuuuaacaccguaaugccacauauuaauuuaaaugauucucucagaaugauucuguggcccaguuaaaugaaguucaaggaaaugaauuucagccuuugacacucugaguccuauuugaaaguagucggcuuuacaagauuaaaaacaaauuacagggaauacgaaaucuuugauuagcaggugcuuugauagcugcaagaauauuuuuucucaaaaaugugaacacacaugggagaggcaccacuauuauuaucuuuguguggaaggccuuauaaugaggauuccauuguguccagagacugaggacaugaauugcuaugucugaaggguccugguucaagaggugauuucaguaagacacagcugauagauagaaccuaagguuucauggguucauaaacucucuuuuuuugcuaaccucccauaaucaauugaagaauuuaagggacucaccccuuucuguaggauucccuucauaacuaaugggaggcagaacuuuucaacagagaaagagaaugcucgacauuuuucaauaccaugugcaucaaccaaugggagaaaagggucuuggaaguuuagacagagucuuuggucagcucugagcucaggaagacugaaguccauguccagguugccccauucacucauuguaugaccuugggcaagauacgucaauucuaaggaguucaguuuucucgucuauacugugggcauuucaagggucacugugcagaugaaacgaguuaccacaggguguggcauacaguaaaaacaaguuaaauggcaacaaaauauaaucagaaauugcaccaacgucagugccuuauuccaucucauuucucccauucaguuaguuuccaaguuauaaggguucaaccccuucaugcuaggcccugugcagacaugccuugcuccaucacauguucagccuugaauggauaggaauguccacugcuuggucacuguuacagaacuacacauaugagaugcuccaucauuauguaacucauggaccagcuagcaagauggcacuaguguccuagugaggauggguacucagaaccaagauauuagagacagaaugugcccuguuaaguucagaacauauaaaguaaauacucuagaguuucagacuaacuugauggaauauucaagaggcuugauaagcccugaauggggccuugugagacauagggccacuuaaccuuggacaguaagaauauuauugccagcaacucaagugugucucucaugaagaacuggggcuaccugugaagcuugguucacuagccauccccagacuauuccuuggcauguuuggcugggaagguauccuuggcgcucacuguaguaucauacauuucaguagcucuaugggucaggguugauauucucaccaagccuccagccuaaaccucugagggugccuauucuucauuccuccagugucaccugucucacacggggccagucagcuuuuuccugcagguuccauccugccccagauucugaaccaaucaaacucccugacaaguggaauccaaguccuaugaguucacagcuuaaagucuucacagcaagucagaccaaugccugacccugcucugcuccugcaaguggcuuauacccuaguuuagcucacugaguuucucuugucuuauucaguacaggucucaguaguacuccuguucauuugggauugguuuucuaccuugucuccucgagguucucuggaaaacagaagcaaaccaguauuugcuggccccuaccuagugcuuucaucaaauugaucuacauguugcucuucagucacaggcucccucacuuccguauuuuugcuccugacuuaucucuuccucaaccccauucucaaucucagcuccucuacugauaaaaucccucccaguugaauaccaacucuuccaugaaccucagcuagacagggugugucucccuccucuaacucuuaaaguacuugguuucucaauucuggugcuucucacugcuucccaugauggcaauuacugacaugucuucucuuucugguuaaacucuugacugucuuccaaaugcaucuugccuuauccacucgcauuuccucuaaucugucuuccauccuaaccguauagugacgcucuugaaacacaauucugauucccucuguuucuggccuucagucauuuccuaccauauuaaaaauagagacuuggaucccaaacgaagccuagaaggcuuuaguuggccccauuaucuuuacugccuuaucuugcauuuuuggucuucucuugccuugugcucccaccacaccaaccucucucuucugccacaggcccucugcacaugcuguaucccuccccaaccucugucucugccuucacugacaccuauucaucccuuacaacccaauucaaucauguuuuaaagaagaucucuuguggucuuuccaacuaggccaguuuucccuaagauauccuaccacaaacaugucuucuuuauagcauaaagauguaauuuuaaguuuuuuauuaauuuccugcuaucccacuagauuguaaccucccugauggcaagaaccauguuagauuuuguucaacauuucauccccauaaguucugagaauauuuauauaauaguugcucaauuaaauauuugcugauugaaguuauuuugggccaaagaccagguuucauuuuucuucucagcccacugauuucuggcacaaaggagagguuccauaacuaacuguucaccaccaaugaaaauacagguauaauguuuaaaagcuuccuauuucuucuugugguacuauuaaguaggaccagagcagcaguacuucacagggguaguguggcaucuucaaguacaaugauuuguaggggauaaagaaaagaaaaaaaaaacccacaaaacuaguuugugccacauauaaggaagaauaugguucucuugggcaaaaauggcauuguuuucaacaacugauauggacugccucauaauugcuauagccuuagcaaucuauacuggccauaaaggcaagccaaagggaacuguuaugacuccagagaguuaccauugccugucuauuaggccaaguuguaccccaaccccaaaaugacagaugauuugcuacacagugcccaagagaaggaagaauaauaaaagaaaagccguguucucauucugugcauaguuuugccucacuucguacaguaaguccaggagucuuauuuuccaaaguaaaaauggugaaauuugucuuuaaacacugcuucuaaauguguugguuagaugcuucauuucuacaauuaaacaccuaccuacuggcuucagcaccagguauuuaggccauccuggccuaguuccacugacuauuccagugucuauaaaacaccuucaccaagcaugagaaacaaacacagacuuuauuuucuaccucaucugucuugcauuuccuugugcuuaauacugugacauuuaaguggcagugacacaaucagcaaaccuagugaaggaugagucuauguaaaggcaaccauguuugcgggcagagaauaucaacuuuauacguaccuaaaugacugcugugugcacagcagccaagcccaauaaauguuaaaucacaaaacucacacuauaagcugaaagugccuuuaggugugugaauuccaguuucauguugcaaagcuaccuaauauucuaagguugucgggggagauauggaaauugagucuauaguagagagaaaaguucuacaccaacuccagaccuuaucaguggucaauauaccaacccaacaaaagcagguugcauucuaccacggcuauucauuacaaauaauuuuacuuauauucagugccaaugcccagccuucucuagucccuguucuagcuuuacuuuucuucauugcacuaaucgccacuuaacaugugcauauuuuacuuauuuuuuugugggcccucauuccccucaaccaaaaugcaaacuaagaagacagagauuuuuaucaguuuuauucauuacuguaucccaagaagcuaggauacaggggauucucucugagauuauuugcuggcaaaugaaugagauucuuggcauuugcuaggcacuguuccuuucgcuuuccaugaauuagaagaaggcaacauaaaugaauagccaaaagcuugggccucagagugagauaaccuaagucccaaaccuuaugaaguguuuaucuugggcaagucucuuaaacucucugugucccaaguggcuaccucuaaaagggagaugauaaaaaggacacuacauaaaagggcuacuaugaaauguaaugagauuauaaauauacuguaagaugcuuugcauaguuccuggccacacaguaacuaaacaacaaauguuagccauuauuuuuauuuucuuucuauuauuuuuauaauuauuaacuauuaaaauaaagguaggaacuauuaucauucucuuucuacaauugacgguacaaagaaugcuucugcuugaaguugcaaaauguuacaaaugguuaaaaaaacauuagagaaagagagcaggagagaaggaagaguaagaagcguuacaggaagaaucaagagauacuagccuagaaauaaaaagacucauccuggagaacuugguuaagguggguucugugagcaugugggagccugguagguccagaauagacacuucuuauagcagaucuagaacuggcaacgaacuguaguaagccaaagagugagguaggaccuaacagauuggacuaggaauccaaccuacaugaccuagauuucugauuaucuggcuccacuuccuuuaccgucacagagaguaaggucuccaguuccuccccuguacuagaaugcucccagacaaccuaggugauuagugagaguuuaaguucucuacucugaaggacuuggguucagacacaacucaaucacuuauaagcuuagugaccuuggacugacccuuaauuucuucauuugcaaaaugaggaaacuaacugcaucuuaucccauaggguugccaugaagauaaaaugagauggcucccaacaaguacuggaugcugucugggggguaaaggaagcuuucaauaaucacauaaacagaaguagcauucaaccuggcugagcaaaugcuuuagauaaaaucgaaguucuuucucuucccugcccugacuccccagaagagaauaauauaugguauaagcaaauccaaaaauacccgcuaaaggaaguuaacaaucagcaacuaucauucuuaaugucuugggcaaaucagcauacuuuucaaauacaaaaaacacaaacaaacaaacaaacaaauaacaccucaaauaauuaaguacuuuaugaaaauaagucaaaguuucuuuagaaacuuugucuuaagaaucagacaaaggccagcccaccaccuaugucauggaggggucauaaggaaagagaaugaagaaagagaaaaagaaaaaggggugaaauucuaauauuuaacaucuccaggcacacgccccagccucucacgcagcccuaccuaccacaaccaaccaccacauuugaugcuugaaaucuaccuaaaucaaaucgauauuugccuuagcacuuuccaaauaucuaggcuuccccuagaaauacuuacaagggagaugauauucaguuuagacucaaaggccaguuguuucaaaugucaagugaaauaauaucuccuccuccuucaucgugcucauaaacuuauacaacaaagacauccugacccucagaggucagagaacucaagcaagagaacgagaaugcaagauaucuccaagguuauuuuggaacuaggcauggcuugaagacacaucuaauggugaagggcuuuuaauugagaugcugcacaccaccugguugggguuggggucucuggguggguggaucaggcagugggggacagugaaaacuggugaaauuaucuuggaaugugcuuuuauccauagagcuuggauauacccuuccuuagcugaucagagagggcccgggaaccaaaagacauuaagaucuuagaaugcauuuucuacucucucauuuuauagauagcacaacugagucccagauaaaauaaaaguguuuuucccaauaucauacaucugcugaugguccugacuuagccacuaggcaagucccccagacuccagccugcgguugcuuccaucuaucaaggccucuuuucaagcuacuuggaaggcucuccuagcaaagaugacuacaauuuaugcucccuucacaacauuuugauugauuuuugguggaaaaguaggcaucccugaagcauuucuuuaaaauaaauccagccugccaaaccagcacugauguacaacccuaguagaagaauccaccauuggccacaauaauagcaaaaaggguaaugagaaauaaacguauuuaaguuuacaagccucgaagagguuaucacacacaaugacaggaaucuuugugucaggacugaacaaguaacccugauuuaacuuuacauuuugauagagucagccgcguugcagucauuguuucgucuaacaauuaaaagcggaauuugaaacuauuccuguccauaguuccccuuaaaaaaucuaaagcaaagagauucucucaugccaggauugaaugaauuuauaauuaucuaucuguagcuccaggacaaaagacuuaaacacaaaaaagccaaauaaaccaaggacaaauuucugauaguucuaguuacccugccuauuaaaugauagacacauuaaaagaaagagagugauauuuggaauauucagaaguuggugguccauuucucaugcuuuguuuuaguaucacucuuucuuagacgaaagacagucaugaaguuguuugugaagacucucaucagacaagaguacaguguuaauaaaugcauuuagcaagcauuuacuaugugccaaacacuaugcuauguaugggcugucauguacaaucucaguucauccucauaauaaaccuguggguaaguauuauugcuaauuucaguuuaaagaaauuagcaauaauacuugaggaaacugaggccuaaaacaggcaaaguaacuuacuccaguugcauggcuaauaacuugcaauuuggacucaaauuccaaagccuguauguuuuuacucgcuaaaguuuguggucuuggccagcaaauuucaagaaggccugucauaaagccgugcugagagggccaccuuacaugccaauuacaaccuuauuuaaaauuuaaaguacguuauuucuuccugaaauggaaaauaaaccauuagauaucuacaauauuacuaugcuuuagagucccaaaaucacucauguauaauuaguuauacccaugauguaaauauuuuaaauauuauuaaaugccuuacuauaaauauuagaggcuggaauaguuaaacagccaauuaacuagcuaguggccaucucuuuaccucucagcauuucuacucuguuaucugaaacaacccauacaaguaucuaaguagaaguuuagaaacaacggggcuuuggggagcugcugaggagggacacuuugcaaccuccaaaauuacugcaaaacuaugugcauaugccuauccaauaguuuuucaguaauuuuggagguuucaaagugucccuccugcccagcuccccaaagcccauacagaaaccuauuugagaagcuuucgaucuaagaaaugggaucugggaccuuaaaaaaaggcuaaaacucaauggucuggauauuugugagacuauauuccaaccaguacaccagguuacugcuucccagacucuguucuucaaaagacaaugugucaaguuuccaaauuauggggggcaaggguagugaaaagugagugugaaccuaacagacaacuaacugaauacuucccucugcaucuggaggcuuaggaauucagcagacagacauaagcaaaccauucugugaaauuguuagggugcuauucuuucugacauuguguugguuuccuauugaacaucugaagacuguuuuaacaugugugccuaaaaaugucacacugaggcugagagagcacagagccaggggccacccagacuuucaaaucagcucucagaagcagccagggaaauuccaaccuuggucuugugguccucaagaacuacagaagcauggcagaauuuuagauucacagguuguuuguacaguuagugcauuuauaccuaacuccucaaagccagagauauuuuuuauaacucagcauugcccucauugcuuucuuaucacauauuuugcauguguuuccaucuccaagauucagggaaaacaagauacuuaguugggaaugucuagaguggagaccuuauaaaaauuacuugacagacuugggagaggaaagcauuuugcaaaacaccagcuaugagaauaaacaauuuuagagaaucccuuggggacauuuuuuuuccuauggaucccaaaaucuuuuuuaaauagaaacaucucaggcagggguaagaaauuauugguuaagcccauuuagaacguguacgcugucauggaacauuccuaucaauggggcacauugaaacucuacacuaagauaugguggggcuguggugcuuuacuggauaaauaagaagggguuuggucgcuauacucccacccugcccauaaaugaguaagcccgugugacaagaguacauguuuucgaaaagaaagaaacugugaaacugagcgucaccauccugccacauaaaaagcaacagaaaugagaauuaaauucagcacuuucuuaaugggagacugaggaaaucugggagaugaaacaguagcucuucuccaguccuucccagcauaauaaggucagcugacaacacuguucgacagagaagacuuaaugugucugacagauggcaaauacaccauauugacuuuucuuccuaauuuaacaaauuugaaucuuuugucaauuuucuuuccccagugaaaagauauucuaaaacaccacuuaagcuuacauugcucuuuucccccucucccucuuacacauuaaguuugacacuaucuaaagaaacugaagcuaacucacuaaauuaacucaccuuuccagcucuucaugaucaucacaaauuugggcauuggcaugaauguuaauuccucaucucugccaacuguaaggcagauacucacuucaggccagaggaagguggcugaauggacaacaaggauuccuugaacucuuaaaaauaacacacaaaagugugcaucuauauucuucauacuucaaaacuauguaucuauguucuucaagaguccccaguuuugcccaguuccugaagguauaaugccucuggcuuuagcuauagguuguuauaauuagcccucauucuacaguuucuaaccggacuuuggaauuuuaugggguuugucuauauaagauggaugggaugauagcagagaagagcuucaaacuaguggagcuccuggaucacaaagcuguguaagucaucccaagugugacucaaguucagccuggagaagccauggccaggccaaggauagcuugucccacaaggaggcaaggggccguuucccaccacugccucaucccuuccaccaugugaggacacagggagaagauagcaucuaugaaccagaaagugggcauucaccagacaacaaagcugccagugucuugaucuugaacuucccagccucaagaaugugagaaaaaaauguuggucguuuauaagccacccaguuugugguauuaccuuagagcaucccaaaugaacuaaacuacuguuuucauaauuuacaauguguccuaaaauuaauuauaauccuaacuaugaacaugaaauucugccaaugugaaaauaacauuaguuucucuugacaaccuuuguaguuauguuacccaaaaguaucuauagacaaagcaucugaagauuuuagugguuauucacuauuauaaacaacaaccacaaaaaacccaccaccaacaaaaaaaacacuggguccauggagaaauaaguuugaaaaauauuucauuaugcaaaguaaaauggauuuauuacaaaaaccuucuuagagcaucucauggaaauggaguuuagaagaauacuaugcuuuagauuauuccugaauccagacacauuuuuuuuaaauuuuaacucaaaggauuaaaauuuccacacuuggaaugccccuguaugaggaagaacugaacgcuguccugucuugucuaaguuucagaguaaucccuauguuucuagcugauuagcugguuucauaaggcaaagggccuucugaaaaugggccauugcuucugugacaaauucaauauccaaauucuauugcugcccuugaacugugcucucugauuuccugcugcaaaaauguaggccaucaguggggacgugaaaaauuuguucauuacacacagauucccacaguggcagugccuggccacauuaccgaaccuauagauaacaucacagcaccugacauccagcccacauuuccucagccucagaguaaagaacauaccacggugcccgcacauuaacgcagagagaugcccuugauaauuaacaguucuuauggagucucucgaaugcuaaauggucaaauagagaaguuaaacacacauaaaacauuuaaugugaaaugaggcaaauaugccaaauuaaccugaaaugcacacaaaagccuuucagcucuggaaucgauauuaaucauuuucuggaauucaagaaaaagucugaugugguuaauuuaaaauuguauuuuaugauagagaacaaaaauaucccacaggauucaagguaucaguuuacacuacugccacuccuuuuugcugccagggucagcaaaaagaaaaaaaaaauuauugaucugguauuaaaaaucaguugacuucacuucuuucugaacagguauucuuugaccacuaagcacuggcuagucuuaccucucucuagugacaacaugaagagauaaauagacuauucaaacagagcucuucgcguuacauuagcugaauaaauagugauguauggucucuuuucucaagcacugccuuagcuugugaagaugagagugaggaagauggggcuuaugaauccuauuugaauauuuaaauaaacacaaaauaacaucccugaagaugguuguuuaaguggaaaaagaagguaugaaaaucugucuuuuaauuguagcuuuuggggcaacaaaaaaucccccaagaaacuuuugagauuccagugucaagugaaaucacagaagaaaaaaaaaauuaauuugugguuuuauaagcaguauccagaggaaaugggaugccagucccacaggguuuucaaaggcugcaaagcuagcacaaaccaauucaccuaaagugaaguauauuaucaauaacuaacugugaucacuuuuuggccuuccagcuaagaucaaguguaauaacuaacuuuacuuugggaauauuucacaaugaauuuuugcccucuuuaaucugcuuuaagauuucugugcucaauuuccgguauaugccguacuugcagaaagggaugaaguucugagcuagguuaagugcuuguggcuaacuacaaauguguuaacacaauguaauuaggucaucaaacagcaucauguuuauuagguaccaauagauaaaaaaagggagcaggccuagaccagcacaucagccccagucccuacugucuuggaacugggauucugagacaucuccguggcuucuacacauuacuggcauaauuacuaaauccaaaguuuucuauuuguaaauuagagauucuagcaaggaaaagaugaaguccuaugcaucgugcauuagccaggauucuuuuuuugauuuuuuuuuucauucuguugcccaggcuggagcacaaugccacuaucucagcucacugcaacccccaccucccuggcucaagcgauccucccaccucagucuuccaaguagcugggacuagaggcaugugccaccaugcccagcuaauauuuguauuuuuuguagacaugggguuuggcuacguugcccaggcuggccucaaacuccugagcucaagcagucggcccaccucagucucccaaagugcuaggauuagagguaugugccaccacucccagcaggucaggacucuuuuggaacaaaaagaagggguauauuuauugguucacauaaacacauccucaggaauguuaaggcagaaccaguacaguccuaccuuccuauuggcaguuuuacuuucuaugguuucaaguugccuacaaucaacuauggccugaaaauaagugacuagaguacaauauucugagagcaagaaaaagaccacaauuauuaacuuuguacuacaauauauugguauaguuguacuauuuuauuaguaguaauugaucucuuacugugucuaauuuauaaauuaaacuucaucguaacuauguacauauaggaaaaaacaguacaaacagaauuugguaccaucugcaguuuuaggcauccgcuggggucuuagaauguauucccuuuagauaaggcggacuaauguauaguccuuucccucuccaguguuggcuucauucucucagaauaaagaugacaaccuggcuguggaagguggccucaggaagcucccaaccuaguaaucagagaagaaugagaggauugccccauuaguaccagaaaaucccuauauuagcaaagacagggaccugauuuggucaagucuccauuccuguauuaccccuguggccaaaggggauugaguaacuauaauuaauccagucaugagggaggaagaguugcugcauagaccaaaaacaagagccucuacguacugaagugauagggcaaagaacauauauuuacgaauuauaaccaagucuaaauuguauucgaauuccuagaagaucaauguuacuuaacuuuccugugaauaauacucuugccucuuacuaaguagcacacuaucccuaauauuccaaggugaaacucagucacugagaauugggcaugcugcaccagacuguuuucccaguaguagcaggagauaugcugaaccucauauucuuucucuuuacugcuuuauuaucauuaaugccuuagacugaauuucuccagaacugaucaugagacaggaaucugaguacaaauggauuauuugagagaugggcccaggaagcaccauuaggggagaaguggaaguaagacaggggaaaaaagaaaucuacuacaagaaacauuuauaagaauauuagugcuucaagcaauuggggcucaaauccacuggggggggcucuggaagacagcguggaacaugcuacccucugaguuuucgcacuuacgacauaggaagcuggggaauuuauccucaaauucccacugguauuggcuaaacauuguuccuaaagucaauaauuccugacacuuuaggccuacacucuacaccagcaagagaaagccccagagugcagaguaaaaggcaugugaaauagaauaaccuuagcacauaugagaagggugagucccagagaauggaaccaaggcacacagccuuggcuaauaccaguaacacacacuuaugaaaaugugccuucauuuauucaaauacuuaccaagcuccuauuaaguuugaguuuucuucuagaugaugggcauacacugagggacaaaacaaagauuauugucuuauuuaauacccagcacaacugggcggggcaggggcagauuccaggggcuacaugucauaauccucuucacaacagcaacuucaaauguggucccuaaucuuaagaguagcagcagggucagcaguauugggcuucaccauuacuaagccagguguguugaggucuaugauccaguaaugaaccugaaucagaaauggaaucucagauagguauuggaaaagugggagaguucccaucguaggacagugaguuacauuuuguuuaggaaacucuucagggacaucuucucugugguggcuuguguccagaggcacugcagaguugccugcucuaacucuugacaguugaguggggcaugcagcuucuggacauggaaaggacuaaaguuaauuugcccaucuggggauugaacuggcaucagugacuucaaaugugcccugcagagcccaaaugaucuccauuacaaacacagaaugcuccgccuuccaaaugccacagaauuccauuuuaucugcacuggcaggguaaggcagaguauuugccaaaacuccagacauaggggguuauuuguaaaaccuuagaguauuaucagguguugcuuucaauaaaccauuacacuuguauagaaaguaacaaacuacguggucuaaggaccaguuaucccuauuccaaaaaauaaaguguaaguaaguaaagcaauuuuacauugaaucuugaacaucuauguacauaauuuagaauuugcuaaaagguaauuuuaucugugcugauuaucuuuaccauuuggcauuucccaucucagggcaaugaguacaacuucacaaguccagcuccgcuuagcugugaguacucaauuucacuaaagacuuaaacagaaaauuaaaaaucugugagaauugggaugaguccugucugucuuaaagcagggugagcaaauauauguggcacaugcccuuaagagacauuauuaauugaucaccucucacuuucacacugagccuaggcugaaccuuagaauccgucacagcgcagguguccacucagucaugacuggccuuccagaacuggguacuggaaaugaaaccuacuugacacuuaggauacauuuauagagccugguccccucaguacuauacuccccucucacaaacagagagagagaaaaaaaagaggaagaggagagcagagaaaggaugggggaaggaaugagaggaagaaaaaaaacucugaaccaaguaucacuuccuuugcggucugcacaugucaaggaauacuccauuuuaagcauauuauaacggcaaaaagaaaaaagcacuaucaauagcgguucacacuuuauggcugcucacccugaaacuguagcagcuaacuuucuugggaaaacucagacagacucauucuuuccaaaaacaaggaaagaagaaaaagaauuucccacauccuuaagauaacugagaagcucucaguaggaguaaacuguccaaauaaaauucaacggcacccccuuuggaaggauaguuaagaaacaccacauguacaaagaaggauuaagauuccaaauacugucuuuucuccaacucgauuuuuccuucuugugcccuuacuucucaaacaguuauucccuuugcuauaucacccagaagucugugauuggaucucccuuggacuccaaagggcucuggguaugagaaaguaguccaaaauauauauauauauauauauauauauauauauauauauauauacacacacacacacacacacacacacacauauauacacacacacacacacacacacauauauauguguacauauaugucuaggauuuacuauagaaaauuuuuaaaauauuuuuauguauuuauauuuauaauauauuuacauauuuaguuuuauauauauuuauauaaauauauacauauauuuauauaaauauauacauauauuuauauauauauaaauauauuuauauaaauauauaaauauauauauauaaauauauuuuguauuauauauuaaaauauauacguauauauguguauauauguauaggauuuacuauagaaaaauauuucauauuuuuauauauucauauauuuuauauuauauauuaaaaauauauguacguauguauaggauuuauauacauauauguauauauguauaggauuuacuauagaaaaauauuuuauauuuuauauauauuaaaaaauaaaaaaauaaaaauauaaaauauauaaaauauauaaaaauauaaaauauaucuauauauaucuauauuauauauagauaugaagauauaaaaaaucuauauauuuuauauagauauaaaauauauaauuauauaaauaauauagacauaaaaauauauauuuauauauuuuuucuauaggaaauccuauauauauuuauuuauuuauuuaggacugcuuuuccugaaacucuguaaaaguuuucaucauacuagcuauuucuugugaugagccagaucaucauucaccugguauaaaugagcuuggcugugaacacgguuagaaauuagagccaaggaugaucuauuaguucaucgugugugucucaugggacaaaagcaaauguguuucucuaaagaguuuucuugaaugguuucccaaguccaacuugaaaucacauucacaaucuugucauuuuccucuuucuugcagcacaccaguaauuagauguuuuaacacgucauggcaaugauaucuaacaugaaggcaaacuguauuaagacacagcaucacccaguuuuauacuguaagcucauuuccaaacauuauuuguuuuuauaaauuugagcgaggcugacucuuuccucucugccuuuaauuaauaaggaaagcuuaauaugcacuuuuuuuucaucaaucuggcacuaaaaauccugaauuccuuuuguaguaauuugaaagaagaguuuggggcuauuaggagaaauucacauuaggcauuucccuacauggccuacuuauguuuuucaaagugaagggauauuucaaggaaagaaagacuugggguacuagagaugucugccccaucuaaagucuuauuuuucuauuuccuauaucaagaagccuuagguacauuuuaguaacauagcuugaaauauauuuugaaaaggggaacaagacguaaccugacccacuacagaaaaaugccucauguagauccuugaaugaauuuaugacuguaaaagucccucucuuuuguuuccuggguaauuauuucacacauuugggagguuuauagggaaugcguaucagcuuuucaaguaaaaagugugagucucugacucuuccuggaaaucuggaagcaacagagaaugagaaauucucaggcagccuccaaaauugagcaagagauacugcaggucaccuucagugcugaauauuccaaaguuaacuucguuaaaaaugcacaaacaaccugauaaaauaucugauuuuaccuuuuaaaaguaggauuaaaaauuuaggaagcuucgugacuuacucucgcaucucucuuugauauuucuuuguuugguauuucucucaccucuuaugcccugguggagucuauuguugguuuauguguaacaugaucgaauaaagcaaaauuguaaacauuuucuuuuuaaauaaauagacuuuuaccugaacauuauaaucacaguaucucauucauccauucacucauucauucauccaucuauucauucauucacccauucauuuauucacucagguauuuucugaguucuuucuguguaucuggcgcuccucuaagcaguggggauacacauguccccuguucucaugagcuuacagucuccuggugaaggauuuuaaucaaaucaucacacuugugccuaaggguuucaaacugagauaaggaucucaaaauaaaggagcaaacacccgaaggaucaaggacgacuucccuguggggguggucccugagccaagggcuucagcagaagcagagguuaaguaaguaggaaguaggacaagcccuccaagauaggggaaugcaguuagggccucgagcaggaggaaacaggggcaaagcucugaaaguaaaggacagguaguauuugcugagcuacucuaagacagauucucccaccuaugcugacagcaugcacaauuucagcucaaugaauacaaaugaaugcucuaaguauuuuuuagauucucuagauuaugcacauugaggagcaguuugggguagggaugauggaggucuggccauuagacucaggcuuuaaagagguucugggaaggggagccaaucugaaguaccuggaaauuggaaaaaauagaugaacagugauuuuaucuggcuuccaauggcagauaaauuuccuuucgggaaaggcagauauucucauuucaagccaggcuccucugcccucacuuuagcauaugaggaaacugagcucuugaguuccuggaaaccuuugagaauauggagacagccuuuucacuaggucaguuuagcuucagagggaaugagauggcugacuucccccacacauuaggacuuucauuccaacccucggccagcaccuagggaacaaagcaaggccccagcuuuaguucuacuuaaagugagacacugcuugcucuuucacacucagguuaacauucacuccaacaaugaguucagaagugaccaugggaagacaagaggcuuuccaaauaacuaccucaccauggcacagggucucugagggcugggcauguuagagucugagauauaaaacacaguauaaagaacguucuauuuugcaaaacaaucacauucuacaaucuauaccuaaguaacaggaagagagcagaucucauuaugucccuucuacaagaagaacaucugcauugaguugggugucuucauagggagucauucucagggaacgugaagcuuccuccccaucacccugaccucccuuccccuguaaauuuccacauugauugauuguaaacaaauuguguucaucugcccagauuccauuauaucaaaaagacauacuccucuccacaaauaucggagauagacagacagauaaagaggauuacuuuccaguagcagggguuccuccccacucuuccuccacagagaacuuuauuucuaguacauaguagaagaaagagucaagagacggaugagaagacaaacucagcaaagccuuauuuuuaugcugcuguuguuuuuaaccuuuagugggaaguaauaggagaccucauacuuuaugaagccuuuuuguaucuggugguaguuuuuaaaaagaccaucagcuaaaauauaaauauaaauuuaaccauggaugauuguaauuuccugcauuauauuuuuauguauuuucgaaaaguaucuguaaugagcgaguaucaucucuguaaucagaaaagaaacuaugaaaauauccccagugagaucuguguuugcucacagggcacuauuuggcaugaugagagugaggggaaugaucugaauguuuucagugccaagcaccauguuggccucaaucgguagcaauucuaauucuuuuuccuguggauuuguaucaguugcugguucauuuaaaucagcuauuaaaggaauaaacaugaaucuuaaaaauacauuuagagaaaguauauuguucuaaauuaagcaagcaguuggcauuucaaaucauauggaagcagaugaggggaacccgcucucaccagaucucaauccacuuugcaaacugcuuacuccuuaacuuggcucccuaauuagggcauuuuaucuuugugagcauuuaccauuacugcaucaugauaacucuuggcuaguauucugugaagaaauaauuaauaauaauccacaccagccaaaaguagauagagcaacaugagcaaagaacuagguuggugugauguggcucaauaaccacuuggggaaaaacaaugagaggguuuuuauugaccaaagugguuuaacaaaugacacuuaagugaucuacuggcauuuuagaacagaggcaagacugcucacucauuaagucauuuuaaaaauagucauuauagagcuuuugccauaaaucaagaacaaaagauuccaggaaauaauuuuuuauaauucauaaacacauaguaauguggaaagaaggacucuauagaguugaacaggguuaucaauuacauuuuccaguugucuauccuagagacaacauuccuuccgugaguucaaaccuuaaacauccagaugagguauuguggguaaacuugaggauugacacacuucagcagacuaccagcuccaugagaucaagggccacaucuguuuuauuuagcgagaagcagaauuaggccaugugugacaguggguguuacucagcaggugcucagugaauaaugaauggauuaaugacauuguauaguagugucugacuuugcaaacagaaaaucacagccuuugugaauguaaauuuacacaguaaacccaauaccauauagacuuuuagugauauuuugguauuuagaaaaaagacuaagaucuucuccagguagaaagguauuuugucaaguauuugcuguguguguuugacuuguuuuggccugcaauguaaaugauccugauagacaucuaguucuacuggguuccacagcacuucuuuagccaguggggucuuguauucaacuuguauuuaucacguccuucuaauuucacuugucucacccuggcuguuauuauaaucccaaacagacagauacauuaguaccccaggcuuaagucucauccuauucauugcuaucggguuauucucuaggaagcaucuuucuuuucaucuuagucccuucuuccuuccuuccaucaguccugaaugcuuucugagucaaauuccgagagcagacccuggcuccugaaucuuuuuaugcucagacccugcaacugcucaacagucguugucucccugauccucuucacacagccauaugucggccaagaugcucaacucacuacugccaccuuuauaccuaggcucaugccagucccuuugcagagaaagagaaacacagagggagagagaaacacagagucuugagucccuggaucaagccauaccugaagucagaaacuucccuugaacucuuuaauuaugugacccaauaaaucauccauuuacuguagccaguuuggguuuucugacacuugcaacugaaagagucuuuaacguaugcagggaagaggagaugaggaagagaggaacauaaaaaugaaguaaaacgaaacagaggaagaaaacaaugaaagauuuguccaaggcuguagaacuaaacaguauuggauaagaauauagaacaugaagcccagagcccaagacucuuuccccuacuacuucccuucagaaauuaguacuauuacucauugccacacauuguuacuuuaaaccuaaccaaaugagaagugaccugccaucaagcucccgcagguuuaagacauauauuuguccugaguaacuuauauuguuuuccuggcguaguacauuuaagaauuacuuuuacaauuaagcugcccaaggggucuauagaugcccguuuuaauuuaaauaaauacuaaugcuaaaaucaauuuguaggauauuucaauuggaccgauaaguacagucuucacuaaauccaaaguauuucccuauuagcgcaucuuuagaagcguauaccaacaacacaucaggauuuucagaaaccugcuacaaauacauuacucccagagacuggaucaaacagcugaugaucaaaacauaaggcaaaaacuaguauuucaucuuugaauucggaguaccugauuucuacuaaauauugauuagaguuuuucccauaagagauccugcuuugugccuccuuaauuuucuugguuucaauagugcuuugugcagagaacagcagaaguaaggcagaggauacagcugucaucugugccacagacauugacaugcagcuuagucacagaacagagagaacacgugaaagucaccaucacacccucgcaacagugucaguguaaagacucagguuccagauaugaagacaggacugaaaaugcuucuggcuacaaugaaaugaaucuaccacacacuugccaacuuuauucaaacugaugauauuuuucuuuaaacaauggauuuaguuauucuacccguaagaaguccaggucguuaaugaaaugauaauuuucuacaaacuaaaaacaaacauaucucauccuacuaaugguuccugccucuccaauauuucacuuaggccaucucccuuuucucuucugguagaacaacuucaauagguaagaaaguuuucuuacauccgggaaauuucuuuaaccaccaaaauccaugguguuugcuuuucaucuucaacucacuccuuggucguuacgacauguugccuccuauuucugguuaucuauguuaguuuccugcucuuccuacagaauugcaaccccggaaagagagguacugagucucacacaccuucuucaccuggagcuuguaacaacauccuacaaagcaaguaaucaacauguguuuuacagagaaaacugguuaucccuggacuguauuaaaacagugguauggguacucuaaaauaacaccaaugugaguguagaaugcauuucucauuuaagagagguguucauucagccugaggaugggagaauuuacgaaaccucaaaccccaauuggcaaacagccucucuaccuucccaguuuacaaaacccuaccugagagaaggugucuucucucaaaugaagacuuccagauccuguucuccacagacaauuaaaugugguuuaaaaguugcugcugggagcugagguuauuacccacuuucugaugaggccggcgccaccaaaaccagccugugggagcugauuucacuaggacucccccaacauuuucuugauguuggagguguaacggggucucaguuccuguucaacucugccucugacuggauucuaggucuugagcaagucacugcuucccucugaaccucaguuaaccucaucuuuaacauggggauaaaauuccuggcaccauagcuaccucacucaaugcuggggaaaauuaauaauauugauaguguuaauaauuaaauaauagcuaacaugcacugaguuauaccauauucuaggcacugugauaagucccauaccucccuuaacucuuacuauucucauaacuacucuaugacaccaagcaccaucauuaugucucuuuuacagaugaggaaagugaagcucagagauguuaaauaacuuguccaggaucacagagcuaggaagaagcagagcaauauuugaacacuggcauuguggguuacaaagcauuacucccagaauacugccuuacaaaaauaagauaagccaugugacacaaaaaucuucacaaacugcaaaauauuaagccacuguaaaguacuguuaccaucaaugcaaauagaugcucauuacauuuauuguaaaaagcagguaaccaccaacccguuuagggaaggugcauaaaccucugucagcaauacucaauccaucugcagagaaacaauuagaacugcauuagcacauaaucacagaagaaguucucuugacaccauuucugccaaagaacucauucuucccuggaauuugaaaaggcaaaaagaaaaaaaucccaugccgcaucugacaauaggaacaaacucuucuugcagcucugguaaugcaacacuucugaaagaacaaguuaaggaacguacuuccacugcccucauuagcugacaaccucuguggggacugcaaaccagccacacauucaaaacaaaucccagggaagaaaucacaccacaaagccuguuucuauuugcaaguaaaaugacggccccaagugucuuuccauaaagcugugugguaccaaauccaaagcccaaacugguuacaaagggucgccauugauaagacauggcauuucagguccacccaccaugggccaaggagguauaaagcucagaacgugacaugcaauuuuuaagcccuccuuucaccuugucuaugcacuaaguuacuuugacgccacaccuguuucuauucugccuggaagcccugucugcacaacagauggcagaguguuugccuaacaaauguucuugugggucaguauaagaagguggugguggggauuguuguggguacgaaaggagagaggcucugcuagagcagcaaagaaccaucgaucuccaacuuagcuagggaaacuucccacccaaugagggucuggguaugucugagcucugaauguucucaccucuguucaucccuucugacaaucuuguccaggauaguacaaaucugcugcugcaaccggaaauuacaaagaaaaucugauguaggcauuuagaaaaaaaaaacaacagaacaaaaccuuaucaaauuuaaaaguuaacuucaaauucaauucuaacucuaucuccaacuuagcucucuugaaucuaacugaagauucaacuuucuuaacucuaaacuuaacccuugaaucccaacuccuagcuuucaccucucaagugucuuaacucuaacuuaaagucaaacuuagucucuugaggagguaauuaaacuucaacaacuaauuggaaugaguucuugugaacugagagcuuggcuuaucaacacaucuggucuucagagguuaagaaaaaacucacuuucuguuauuguaaacuuaacaccagaguaauguuuuauuucagcuaugaugguaauauuuuuuaaauuaugcuauuauccacuuaaaaaauccaugauguaagguauaaaguaacauaaugcuccuugauggugaaagcacaucuuaggcaccaugcuuuggagaaaaacuguggaucuggagggaaucuccuccucccacccuaaaccacacauaccuaaaccacacacagcaccggguauaccucagucuucaacauaaagaaccaacucggcacguuccauuucauuugacucacuugcuuagauagcuuaggaaaccaaucugcucaacauuaguaagucugggcccauuaaaaggggacugacacuaaacugaaauccauuucaucucuucuccaggguuuuccucggacucucugaucagccuuuccuucacacaggggugaggccaaaacuacuauagaugaagaagaagagagugagaugauguucuuuuugagggccaggaugacacuggcuuuguccaguguuuucaucacagaaauugaagugggcauguaguagguucucaaaaaaacaaaacaaaacuggugaauaaagacgaugugugcuaagcacuaagcagagaccuccccauucgugcucuuauuuaauacucacaaaauccuaacagcaggggguauuauuauuccaauuuugcaaccaaggaaacacaugcaaauagcuaacaguggacagcaucagauuuaaauacuuaaagcaugcauuucccaugagugagagagacauuuugcaaacauggguagaauguggcuuugugacuugccucaagauucaccccaucaauuuaggcaaaaaauacaaucuucccugacuauuuaguuggaagauaacaagucagggaaauucagucuagcaguccauggguaagccucaggggaauaggaggccccugaaauuaaaugcgacauuuuguguguaugugaauuuuuccauggaaaaagucugcagcuuucgaauacuugaaagauucuaugguccucccagcccacaaaauuuaaugacuuagcugcuuuuaauuaaaguuaugcuucuaauucucauccccaaagaguccaaagggcuccagacacccuuuguaugccuacugaaagaaaaaugauuagcaugaaagccugguggguauuagacaugagaauagucaaacaccuuagguauggaaagcacccacauagaucauuacuuaacgaagaaaaguaauugagaauguauuccauugcuagcauuuguccacaaugagauugagaagccauucuauugcugaccagaugguccugaggauagugaaaugacagaaccccuguaucacucaucagauucacugcucuucaaaauaugaaaaagaaccaacaaaauccucauuaugacagugccuacaaacaagauccuucugaccauuucacauucugcaaacuucaucugcaauaagaauguccagaccugaggcucuauacuuggugaaaccaugcucauguucaaaaagcauuuauugagagccuacuauauucuaaguaccgcaauaaauacuuguuccuauaccaucuggaugcccucaugugauucuaggcaacacguuuaaaagagaacagucaccaaauagagaacccugagaugggaggaaccaguuugggaaagggauaaaaaucaugccauguacacagccaaaggcauugaugauucuuuaaagggaaaguaauacauuuucuuucaacuucuacaaaguuucuagguagaagaagaaauagagaaucaauccaaauugccagagaagucugaaagaggaccacaagguaaauauuucagagaagcaaaguguugguucacaauaauaaaaagaaagaaaggaaaugaaaaagcaaacuauuauagcugggguuauucaacaauggaauaagacagcugguaaaauguuagucguugcuggaggaauuugaaaugcauuuauauguuaaaagcacuaaagcuaaaacuauaaaaccaaaagauggguuaguacaagaugauuguccuaaaauacaaagaaacacacauugucaguaugugaaccuuaaaaacuaauguugguuauucuguuuaaagagaagaaugugauguucacaaaucaacuuaucacaaauuacaugcuuacucuaguaauguaaugaccuugggagcugacucauagucuuccuugaccuaaugagcaugcugaguauaaucaauuagguuugcaauuaaaauugcaauuuaucuaacaccccccucuacccccaccuuuuuauaaggcucaggagacaguggggugauaaauauaagcccuucugcuguggcuaucuuuuauuuuuuaagcauuucuauuacguauaauuuauuaaaccuuaaauuucuucccuauuuguaaguuucagcaaaauuuagucagguuucaacacaggguaucaagggauaauuaggacaguuagcaguaauuuaucauuucucagcuggguuuucaugcuuucgcugacugcccguagaaaucuguuagccacuucuacacagaucacuaugaaaucugcuuuaucuuugugcaaauugcuuuucuauuuuccuaaagugagcugaaagaugagccaaucgacuccugaaaaucuagccaccggugugcuugucaucagagugcagcugaggccagggccgcagaugaagggcuacaguggcuaauggaugaugcaaugccaugagaggcuuuuuuccagccugcugcggguuagaaauuuaaaccaggcagcccgacuucagguuagaucuucacaaaauaugcccaggaaucuaugaacaugccaauacacauuuuauggagcaaauauugccuaguaagccaccagagaggaaaagccuagaaaaggcagagacacuaguacuauaccacuuccacugaaaagagggauuuuaugaagccugaaccaaaaagggaggaccucguguucuuuagagagauucauuuacuagauggugaaaaaugaaugcuucggguaauuucauuuugaauugauuuauuucuaaauggggggaaacugacacuuggugaagaaaguaacaagugguucucuggaaagagccagccagucucagguauaauccaauuauuccaacacaggaaauaaggacacagagggaaggguggaaggucaccugagaaagucauuccuugcaaugaauaccuuccuguccccuucccuacagacucucagagaaguauaaacugacccauauuuccaguuuauuucugacaccuaaaccuaaucaaaguccacuauuuagaaauccaauaguuauucgcaauuagacugcacggcaaauuaaaucauaaauuucucuaucucagcccugguugucacauuccuaaaacacaacuugccucccuccggcacuuuauuuaaaucucugaggccgggcuccaaagcaaguuauggauuugauaauuugcuaauguggccacaguaauuguuuugagccauauuuaugauuuuauuggaucuuacaacaaucaauaauaauccauugaugucccugacucggguuuucucgcagucgacaaauggggcagcagauucauuuuuaauguacucacuuagcacucccucccugggagagagagcccugcauauuuuaaaaaagggcaagaaaugaauggcacugguacacauacuuuacugugaaaaacuagcugcaggauaagauuuaaugcuaaaaagaaaggagagaauagacuaacagggcccauuuugugcagcaccaccaucguuaaaguuaauggaauuaccguguggucacgcacuagagggaaccuauuggaaguuaagcucuucuagggccauugauucacagacuuucauucaaagauucccacuagcaugugaugaguauugcagauaugcagaggcacuuuagaaacuguuuacucaaacugccaguuaagcauauuaagaaacaacaauaacugaauauuuuagaguggaugaucuaguggaacgugucuucuguuagacauaguaaaaacuucaacuccgacuggcuuaaacaauagaggacuuuauuggucaccuaauuuuuuucaggcuggagugcaguggugcaauuucagcucgcugcacccucugccgccucccagguucaagugauucuugugccucagccucccaaguagcugggauuacaggggugugccaccacaccuggcuaauuuuuguaguuuuaguagagacaggguuucaccauguuggacaggcuggucuucaacuccugaccucagguaauccgcccaccucagcuucccaaagugcugggauuacaggugugagccacuguuccuggccagaucaccuaauuuaaaugucuggaaguaaugcaggcuucaagucugguuaauucaacaauccaauaaugucaccuaguguccagcuucuuucugucucugccaugucagccucagcaucuguuuugcucugaggcauguugcccuagaaaauauaagauggcugcuagaagcugucaguuaccugcuuucuuguucauaagcaguaguggagaaaacagcccauccacaacuaaugcaucuaaguccuccaugaugaugggacuccgauccuuuagaguguaggauuccuaaagucaagggaauccuacacucuaaauagcuuaggaaaggauuaaugaaagucauuacuguggcagagacaacugacuuagacugggaugggcaaauuauggcccucaggccaaauuuggcccaccaucugcuuuuacaaauaaaguuuuauuggaauacggccaugcuuauuugugacaauucauuuucauauauucuauggcuucuuuugugcuguaaagucagauacauaauuaugacaaagaccaucuggcccucacagccuaaaauguuuacuaucuggccuuuuacaaaagaagucugccaaccccugguguguaccaaacaaggucugcaccuggagcuaaagaugaguucaaacccauccuaauuuuguggcuacuaaaucaagagggaggguaggaagaaugcuagagggacaaccacagugccuaagauagacaugagagaaaauccuucaagucuagaaaaaugggcuuagaaacuaaaaaaaaaaacaauuuaggaaaccuaucauaagcacaugugaaauacccucugcccugaaauacacucugaguaucaucaaaacaucaaauauauuuaaaauugaauuacaauuccuuaccacagcauaagucccaguguaacggcuccccgcccacucuucccacuucucuccugcugccacucucccuacacuaaauuucugccaccuggucuucaauuauuuccuagaaugugccaagcucauucccacugccauuuccucuucccagaauggucuuucuucuccagcucuucgcuggcuaggcgccugucguucccuguucuggguuuauggguuaucucuucagugaccaccccaucuaaaguagccauaccaccccauuccccuuccaccaugucauuccauuucauaacaccuuguuuuagucuuucuaguauuaacccaaaucugcaauauuuuauuuguucccuuucacauaaggggaagaagacaauacacugagaguuuuuccuaggcugucuugccuuccacuuuaacccagugccugggagcacauggcacauaguaggcacucaauaaacacuuauuggaguaauauguuaauauuaacuauagaauuucuacaacuuuuucagccuuccugcauuaugguguucauuucaaagucuguacuugaaaacaaggacuacgucucauucuucuuagguucucagagccugugacgauaucuggcacauaguaggugauagaagaauaaauuaaugaaugaaugccagauagaaaaacaugaguaggcaggauacucauuuccuggaagggaggaacagacuacuuugguagugaggaaaucgagaucagagcgauucagaacuggaagcagcuaccucacagugcuuugaguuuccagguauagaggaagaugaaagacagacuuaaaugcuacaggggugauuaacugucaaguaguggaugaugcuaaugacuuuuaaggucacuugcuccucugggauuuucuugaauuaucccgugcucugaguuucuuccuuaaagagugagauucaucgauggucaucugauaguggagcagagcuuggagucacauuuauuccuuccuuggccaaacaguuucaucaaaauuauacugcuagaaccugauuacgucugggaauuuauaccauuuacaaccaacagacgaauuuaaacgcaaauaaaagccccuggugagcuguuugucagggcaccaggauggaaagcaugauaagaaaauauuuugugggggaacacgaacugauauauggaccccagagugggagacuugaaugugaacguuaggauaaaugaauuccaccacaaaguaaaagaauauuugguguguucacuuuguuaacucaauguuguuuauucuucucaaccacccuaggcagggucaacaucuuaaagaauuccaucuucauuuuucauguaacgucaggaaccaggaagacuuguuuaaaagaauaaacuaccagggaaagaaauggaaguuuucauuacuggaauccaauaauauuaucuuuauguugaauaagccuagaauuucaaaccacuguuuguguguguuuuuuuguuuguuguuguuuguuuguuuguuuguugcccuucccuccugagguuuuggauuaaucugauggagaaggcuuccgaagauauaugucucaacuucccugauuuuggugaacaagaggcuucuuuggagaacggaucuauuagacaauaagguaggauggaugccucaugacaugggaaguuaaaauuucaaaaugacccuuucccagcacuaacauaauugacuuagaaggagggaaaggauuccucaccauguuuggccugagggccauuauagagucucaccaucccaacauuuuucacucaaauguccucaggaaggucauuauucuaauucuuccacaucuguggcucugcagguugccuugucuauuauucauuaagcugguuuccaucugacccuggcucagccaugaaaucuuuaccuuuuccagcugcuuuuugugucuugagacuuacuuuauuaaugacuuuggcauaaaggguaaagagaagcgccugaggggacugaauaauuugagaugaguaucaagaaagaaucaaguccaggucaucuagaccaagaaucaaaauauauuuauaaaaauaaacaaaugaaauugcaguugauauucuggguaaccaucagaaucaacuguggaccuuucaagaagcuacuucaugggccccacccucagagauuggaaaauaggaggcaugagaacuagcuauaugcuaaagauaauaaagcaaagagaaugaauuauaauagucauuucuuaauggaaagugcuucaaauggggcccuugguuuuucuuuuaaaaugcacuuuaaauaauagaaucaacaaccauguacacauuacccaauuuaaaaauaaaacacuguaaagccgaaacccucagguacaauucacaucccacauugcacugcuuccccucacuaucuccacccagaggcaguaagaauguuaucuguguccuuccuucuaagccauauauagaucuacauguuuauaaauuauauggcagccuauaagcaaccuguucuuuuauuuuauuauuuccugcuguuaauaacuacuagucaaaaguuuguagcauuuggaucuguuucagcuaaaaggcccaauuucaaucaaggcacacauuauuguauggucuuucauuccccauucuguauuuaaggaugugguguagucuaaaacaaaugguuccagagcacuuuaagaggccaaggcaggaggaucacuugaugucaggaguuugagaccagccuggccaacaugaugaaaccucaucucuauuaaaaauacaaauaauagcuaggcaugguggcucgggccuguaguccuaguuacucaggagggugaggugggaggauuauuugaacccgggaggcagagguuuuaauaagccgagaucacaccacugcacuucagccugggcaacaaagcgagacucugucucaaaaaaauaaaaauaaaacaaauggcucaucuacugagguugaauuggccacuaauauuuaaucaaaaguacugaaucuuucucacaugauuaauugggcugcauuuauuuuacuuuuuuuuuuuuuuuuaacagaauugacaguuuggccagccaaguauuuggauaucacagguuuaaaauuuugaaauuagaaugagcugauuacauggaguuagagauuuuuauauuugauuuccuaggcuugaaacacccauagcaaaauggugaggcagaguagugcuccuucaaugauuaguuauugagcacuaguauccuauagcaaaaugacaacagugaguaaccggccuuacuacaucaacaaagguaagacucugacugaauaauaacgccuuacauuuaggugguauuuuagggucuacaaaacacuugccuuucacaggagguuugacuucacagugauuaaguagaaauuacaggcucugagccucagguguaaaagacaguuuacugaauccuauaaaacacugaaugucccuacuauaugugccacgugucggcauuacaaauagcaaaauaaauuaaacagccaaauauccacuuugcuauaugucagggccucuaauuacugaggggauuuguuugguaguacuaaugaaaaauuaaacacuaaaagcauauaauucugccauaaauugacauacagcaauaaagcagcauuuagguuaagcuucaccuguguaauaaacagggauuguccucuggauauuuuuagauggaaaccaacauuauuccaagcagagcaaaauaauacagauuaauaugugguaagggugacaaaauauuuacaaaaccugugcuugaguuucuucuacugugauuacaggauacaacauauuucuuuaggaacagccuggucauaugauauaaugaagaguugaaauuuuggauaggcuuggguuugaaucccaauuccacuaucugucaacugugcuuuuccaguaugugauuuuuuuucuuuaaaccucaguuucccuaaguguaaaauauuaaugccuacuuuugcagguuguugugaggacugaaguaagaauuauaaaacuaauggugaacauguauugagacuuuacuaugugccaggcacuauuuuacagggauuuacaugcauuaauccauuugguccucacaacacucccaagagacaggauacucuuaagaccuccauuuucuaaguuuaugaaugaaugugggggagcucagaaagguuaacucgcccaggguucaugcaccugguaggcgacagcucuggguuugaaaccaaguagucuggccccagaguccucccucuucaucaguaugcuuuaacuucccugcauuuucuucucacccucaucccugcuucaggaucucucucaucucuuucaccuuagcugccuuugaguuugaaugaacagggaaaaaguaaauaagaacgugaaaauacuagggagcuugguuaauuuuucuuucagugcuuugauccaaaugguaucaugcaaaucaaaguuaacaaacuagaaacggaaaaacucaaugauuuguaucuacuuaggaaagggccugaggguuuaguaggagagaggaaguuucccaaaggagacaggcaggcccccagccccuucugccuggagagcuggggacuggggguuuugccucaaaucaccaggagcgggagagggaggggaagucagagauauuuacaugccagaggaaaagggcuuggaaccucaacacuucucuaaggcguccacucccacauguacacccaaacccaucccccugagcacugcaguugucuuugguuuaccaacccagucaaacuggauucauucugagggcagagaugcaaauuuuaaggcaauuauacaagauaaaagcuacagcauccugaagauaccaauucuucaugcaggaaauacaugcauuagguauuaacauagucagggcacuguucaccauggcuguaaugaaaggauaaaaguccuauggcaaaucacaucucucuuggagugucuuuccaaaugaaaauaauaaguaacgguaaaagaaaaucauuuucauccucaagauaaggcuuucucucuuucuguacacaucaaaucuuuccuagaaauugguuuggguugagagcagcagcccccuacaagugcuucuuaucacuccuuuaggaaagcagcuucagaaaagugaagugugcaucagaaucacuuguggugucuguuaggacagaguccuaggccccacaucagaacuaccgagucagcaaagcauggggcaggcaggcuucuguccuauggcuaccuucuucagguaacugugaaguacucuaucgauuuguaaccgcgacuuacucgugaucaucugugcauacaccagaggcuaaaaauguucggacagagagggccaguauuauuuuccccaauuaagaaggcagauuucugaauuuucaaagugucauuuuuauaaguucagauaagauauuuaaauagcacaagucauauaaucagaguaaaguuuucucaagaauuuaaccaaaaggcagucauucguagcgagagaauucaguguauaauaauuaagggaauuuggcagcaccacaaaccaucucaaugcuaguuacaaccccuuaaagccuagccacaaucuauuuuauagaugagaaacugagauugagauuaacguuaagaaacauguacgagguccaagggccaugauguggcagggccgggauuugaacugggguggacuggucagauucuauauccauguccaaauccuagccaaucucugcuacauauaccauguacugaacaucaauacgucaguuuuucuccacuaucauucaauauaauagauaggguuuccgcauucaaaaaaaaaaaacaaggaaauugauguucagagaggcuaaaaggcugauccaaaggugcacaguuaggaaguuaauauggcuaauauuccuaacggaaccucugaugccaaaguauguuaacuacuagacuuaauuaagagauaaaauguccucauuuucaugaaucugaaagauuaccaaauuuucagguggaaaauuuguucuagaaccacagaaacuucucagugaacagaagagcuuccuuuuuaucucauuuaauuuuugaauuauacuucuacaaauaauuaucuucuucuucuagagcaaucuaaaaaguaauuucuaauaucuuaaaaguuauuaacagcuacuucccacugcguuaauacuauaaaauuaaauuucuaaguagaagauucaaguaccauaaacauagaagaguguaagcaagcauaaucuauaaacaguucuuacaagauuccagauuaccugccuggaauaaaucuguccuuaauauaccuaaaaccgccucccacccaaagaugaacauaccaauuguucuaaaagauagcucacauuuaacuuauuaagcagcaucgcuucuaaagaaaugaauauugccuuaaugguuagauuagauggaauuacauuuuggaacaugauuugagaacuugauucguggaaauuuuagucuucguuaguaacaccuggaauauagaagacuuuugauagagauuccaggaauauugcugacugcaugcuggaauacacauacauaucgucuucuacuucauguuaacuaaaguuagaaacuuaugagauucguuccaacaagcaacaagcaaaguuccauuaucaucaucauucucuuccccacacaaaagaggcauagaaaauaaaccggagaaaaagcugugucauuuccuuacccauugcccgguucauggcucagaccccuguaacacaauacagauuaacgagaggaaagccuaacgaauauauuuaauauaaauuuuaugugccaugggagccuuuagaaauaaagaccuaaagacaacuguguauuuuuacggacagucaugcagaaguaugauuggaugauaaaagaguaugacuugaugguaauaaauuggggaaaacuuagcaaggccuguguguucagauucuucuuggcaugugaguagagggcagaacuccucuggaaugaaggucuuaugaccuacuugcauggguguuaggucagagaauucuuuuauggcacacuugaggguagacaaauggaaaaaggucagagagugauguuccugcuucuguaguuuucucaguuuccuucaccuuaaaauacucaguaugcagagcuagcauauuuuggggguagcguguccugagaccuaucauaaacaaugacaaaauccagguccucacaaagcuuaccuucucaaagaacuagagaaaagacagagguacaggugcauagccaaacaaacaaaagacaaugaagaaugccucgagagaaaucaaaucaugcaccaggacagagaguaggggcuuuaggagagcuacuucagaugaagggucagggaggcuguuuggaucuguaugguugaagaugaaagaaaaagauuauuucucaagccugcaggacaucaaacugcugcaauaaucaccuuguggauggcaggguucuacuccuuuuaaacccaaaaaggagaguuaauaaucaauugugaaauaagaggucacuuuuuuacuuugauauuucccuuuccugacuacaagugccuuacugaguaagcaaggccacgcuuguucuuugcaaagcagaauuuaaagccccugaaacaaaaaaacccuacagugguaucauguucaagaggcuaacucaguggugcaccuucauuaacgauaacaacaggugcuccaggggaaaagaccauuacugggcuuauugcuauuaccacucagcaugagacaaaaaugguuuagaacccagggaucaggcagaaucucaagaaugagacacagaggcaaagaugaagagaacagucacugugcuuuccauggcagguugucaaaugcugccuuaaaaugugcaacugugugaauuccaaaauaugaaaugcucagaggcuugaauuguaguauucacaacuggacagcugaauauuaaagaugcugcuuuguccccuagaggggcuggcuacugcaagacuggcuuccaggggucauaauuauguggccauugccacucaauauuuuaucaucauacaauacugaggcuggcaaauaucuaucacgggaugugcuuguuaauaaugaagauucccaagccccagucacaguauucuaaauaaguagauuuggaauaagaacugagaaucaacuuuuuguuguuguuaacugauaccaaaguuaauuuucaugcaggugauacaaagaucgcauuuugaaaagcagauucaacaacuuuagauauggauacuuugucuaaaaggacagcuuuggaaccuucauuguucucugggauuuuauguguguguguguguguguguguguguguguguguguguguguguguguguguguguguguguguauggugguuuucuuauaaccaccauauucuacaaacgagucaagauauccccauuauuucauaucaggaaacuucugugaucagguuggaaacaacugaaagaugugcaaaacagcauaaccugcugauuuaaaaaacagaaucguuuuaaaaaguucaacuuaagcuaaauaaucagggugaugauaacaauaaccacauucaacaauucauauauaaguacuauauguuaagaauuaguccaucaucaucaccaucaaagguaacaaaaacauuacacauuuuggccagauaauugggacaucaaaaaguaauuacuauuggaguuacacaaucuguagccauaguuaucagcccagcuaggcucacugcuuauuuguuuuguguguguguguuuauuauuuuuagucaagagauaauucaaauaugauaaaauucaccauuuuaaaacguacaauucaguggcuuuauuauauucacaauguugcacaaccaucaccacuaaguccacaacguuuucauuacccuaaaagaaccuguauccauuaggaaucauuccccauuccuuccuugucccagucccuggcaaccacuaaucuacuuucuaucucuauucagagccuguugcauagcaaauauuuucuaucccgcuuuagaauggcuaaaugaaauuuugagaucauauaaccuaucuauucauauaaguuuuagcuaugcuuacuaugcaccuauuaucauucugugcaucccacuuaauacaguuugugcauucccccaugucacuagcuaugccucuacaguaucgcuuucaauggcugaaggaauuccaucaaauagauauugcauagugcaucuaacuaauccgguauaguuggaauuuacauuugaauacugaguuuuaaaaaaucuuggaaccaaguuuaaacauuuguguuuugcauuucaagaagugauuucaaaaagaagccacagguauuaaauccuuucuuugcauccguauauuuagagccucacauggaggugagacagugggacagaggaaagcugaaagccucugugucuaucaccauacccuguguguagagcaauuaggaggcuagcccuuuuuuaugauaaggaauuugguagcccauaugguggcagucccuacauaaacuuucacugcuuagaaguauuucccagagauuguauuuuaaaagucccagaauagcuguguuaaagacaaaaguaaaguaagaucaaaagggaacuuacguuuauuuggcauuguuugugugggcagcaccuuauccacucacagcuagucuucgaagcauuaaacuuuauuucaacaaaguguaacauuaacaucccagccugacuugcuucugacuucuagcaccaaaaauagagccuuuucuaugacuuaggugcagaaucuacccguauaggaauuagcauuuguaugaaaagagcugaaacccagcuucugaaucagccaggauuuuauuauuuuauuuuuacuacagaagcagagacuauccuaauaaauccuccuuucuucuccuagcacacuuaaaaacccaucuuugagcuccacugacuccauuagguuugaacuuugguauuaaguacacagggaggaaaagaguaggugugggggugacgagaaggagaacagagagaagcacaggagaacagaaaggaagggaggcagcuugaugcuacugcugcgguuauugcuucacucaaaaacaaugaagcaaaagcagacuaugucaagaagcaaaggugugucaaagacaccccaggcuuaacauggggcugcacaaacccacaggaagcucacaugcuauuuccuagacacucucucacaugaaccacuuugacuuauguuuccggacuccuugauuuaguuucuguuuuagcguuugcacaauaauaauuuuacuacuaaaaguaaaugucuuguaaaccaaugggaaacauauuguuuggcagaguuuauaaugucaggauuuacggcucuaacacugagggucucucugaccucgaagauaacauaaugaaacagcaaugugcugcauaugacucguugugauuuuuuauuaguucucauaaucgccucuuauuaauuuguaugcacauaauaagcacucaccuucacagucuguccggcuucggggccauccuagaaguaggaaaaaaccaacagaggugagaauagauagaugguaucuccugcuuauucagaaauaucacccauuaauaauuuagaugcaauuucauuguguguuaauuuauaguauucucauggggaccauuggcuucaaaugugcgggauuagacaguucuccauuuccgccugagaguaagugcgaaguuauguauaaaaaugauauaaauuauccagcaagccaacuccuugcuacuuuucaugcucuuugcucuaggcuaugguuuuaauugcauuaaaggaaggcugaaaauguuuggggaggugaaguaucacaccuucugguuauguuuagaggugguuuaauuaaugucugauuacuuuaagcuucuacucaggaaaucugcuauaaacauaagccauuaaggaagaauaugggguauuucauaugggaagaguccucuggcuauucugaccuugugggagacaaaugguaguguucauuguagcuggacccuuuucccaaacugguucccuuucucuguuucugaagcuuaguuggaaaugggcaaacucaccaagucaccagccauaauauaaagcaaaagcagauacucagcugguugagauggccaaacaaagcaauggcuccacaaucagaaauuccaaaauagaauuucaccucugcaacuuuagccagguuugucuaccucuaugagccugacuaacggggugagaacucccgccguaaggauuaagcauaacuguguauaucagggauuuucaaacuuagagucacaauccauuagugggucaugaagucaacuuaauggguugcaaucagcauuacaaacaauguaaaucagguguuuuuuuuguuguuuuuuuuuuuuuuuuuuuugagaaagggucuuacucaguuguccaggccagaguaugguggcaugauggcggcucacugcacccuugaccuccuggacucaagugauucuccugccucagccuccugaguaacugggacuacaggcaugcaccaucaugccuggcuaauuuuuguauuuuucuuagggacaggguuuugccauguugcccaagcugaucucaaacuccugagcucaagagagcugccggucuuagccucccaaagugcugggauuacaggugugagccaccacacccagccagaaaucagaucuuaauagaauaaaaacuauuagacugcacagaaugaguaaacauuguuuugugaaacucugguuuccuuuaucaauauaggcauaugcauauauuucauauaugugugucaggggagacaggcaugauuuugaaauaaauauguaucuuacuguagguuacaguaaaaaauaguuugaccacauugcauauacgaaaguacucuaggugcuaacacaagucagcucuuacauuuauggaauuaacuuucuagugaaaaauguuccauaaccagcaauggccauuuccuauaaaugugauuuuuauucuuguaucucacuaaacauuaacagagguuuucauucacugccuucauuuagucucuccagaaacacgguuugcaacauaagcuugauaaacccacucugaacugaacuaccugccugaaggggacucaaaugguuugacauacaacacauacacacaaagcauuugggggaaguuuagcuacucuuaacacagacauggcagcaaaaaaagaaagaaaaaaaucuguuugagaagaagaugagcacuuuuagucagagccuucauaaccugaaaacacuggcuuucuuuaucuggucucuuugaagcucuaugguaaagagcuaaggaggggaggaagaauggcaaacauucaguuuaacuaacaggcugaguacagaguccucacauuuugaaaguguguccuucuaaagggcaauuacagagucauccaauuucagagccaugaaggacuuuauacauugauaccccagcccuuuccauagagggccugaaggagcucaugguauguuacuacggauuuacucaauucccuacugaugacucaccauggacauccuucucccaaccugacaacuguuggcucaaccucugccuaaaaaucuucagugacuggggaucugauuucuucacuggucagugggccacacccaaccagugaaucuagcuucuaacuaaucugugaucaaucucugcaucuugaauuaaagacagacaaaagguaaggcccaaccuaagcugcauaucacugccacccuggaauuagagcagggcuuagucuaugcagugcucaaaaauuaguuaccauggaaugaaaaugauuuuuccagucccaguuccaguaagcaauuuggaaugucugaauguccauuaaaucacuuauccauuacucccaccugcuugguaaacaagccucagacaucaccuuagacacuaucccacgguccaucuuggggccaauggacaguaggguugcccugcauuagaaaucucuuuuuuuggcugcuaccuaaaauacaaacaaucacaucugcccuccugguaagauaucaggaggagcaagcccaaugccgggauaugaaagggaagaaaaaucauuucugagaaaucuguacacucaccugcauggaaaaggugagagaggucccauggaaauguuuuuccaccacugucccgacucucugggucgucugaaacaaaucggccacuucaucaggacgcaggucauggaagcgcuccacuggccgcagcgggcacacaaggacaucuguagcaaggucuguuaaggcccaugcugcuggcuuuggguaguguucuuaccaagcaguucauacccacaggauugaauccucucggaccagggccugaacucucaaagacuaaggaaugaagaaacagauauuuaccauccacugaacuccagagaguugaaagagagcucccauacauggauaauuacacuuugaaggagaagcugugguaugcagaagaauuucuugcaaaagaaagggacauucguguacagacagacucaaguguauggugagauaauuaugcgaggaggcaagaucuauucuagaucauucucucuugaccccuauucuaaagcuguguccgcuucagcagccaaaggcacuagguugaaaaagcaacuggaauaucuacuugguuucucuagguagaacauggggauaaauuuuuaauuuaaauuaucucuuuagagaaauaagaaaauuaugcaaugaacauacaaaaguagauguuuauuuuauuuuuaaaagaguauagacauucugaaaauguacagugaacuuuauccauaacuaagagaggugccaugugguuaagcaauuuaugacaagaguuccucagacuaauuuuuuuuuuagaauccaaaagaagacauuugaagguaaaucaugaacgaaagguugucuguuuauucaaauaaagcauucuuaaugcauucuacaaguuagacaaggcaacguauuuacacuauuggucucagcaacauauaagaucugagaaaaaaggauagaaauuugauuacuucuugauaggaaauuaauauucacuguuacaccaucaauaacauuucagucacuauacacacauguaugcacacauguguauauacacacacuauauauauaaauauuuguuuaguuuuuagauacuaacaagagaaacaaacucuuguacguuuuucuguuucuuuuuucuuguuguuuuaagacagcaugcuccugccuggagcuaagcagcugaggggcauaauaaaaccauaauucugcaauugcuagucucacuagaauaucaaccccauuccgcuauugguagaacucagagcccaaggggaaacacaacugagcucagcuggucaggccugauuuccauaagagagaggggaagagaaagaagaaacugauuaauuuugcucauaaucaggaaauucaugucaaugguaaacuaggaaaagaagcauuuuuaaaaucagaguucauuuuucaagagaggagaagggaggcguucacccacagggcaucugauacuuaaaaagauaauuauccaucuuuggcaggcccgcuuuauuaucaugggucaaugaaccauuuagaaaugaagaauuuccuuucauuuccuuugagcagauugccagccuccacucccacgaagcugcuuuuucuguguuaaaagggacccuuccccauauuccuccucccugauuugaauuacacccucacuuaggccugacuucaccaaaccacagcaagggugacaaccaugcaagcuuccaacgaaguccauaagugcuauguuaggcuauguucacacacagcaacucggugggggaggaagacauuucacuucaacaauggcuuacugugaaaacugguggaauaaaucagacaaccuauguaucuaauguaaauuuaguaauaucaaugacauccaaaaauguuuuuuuucaacaccauaaaaaaacuuauuguuugucaauuuugcuuguuugcauguugcuccuagaaaaacaacucagggaaagcaaauuaauuagaagaacagcagauagcuuuuguaauucuaaugccacuuuuuauaugccaauuguuuuaaaauaauaucacagaugcaauauaauuuaauuuggagccucuuaggccuuguuaauggguaaauuccauauuauacauaggcuaugaagacacauuuacuucuggauccuguuugcuugggauuaucuccucugucaagauuucuuagccaacauguaggauaaccuuuaaagaauuaaaguuacuauauugaauugaauaaauguuuuauccaguacauaucaugugugaaaacuuguggaacugguuaccacuucucccuauaaucuagaguauagaguuuuuuuagcaauaauauuuuuuaaaggaagcgaaggucaauaguuauaauuuagguuguauagcugacaaggagauuucucacaguagaugaaaaccaaaggcgacuucuuagagcagaugagauuuaaacuggacuuuaaaaauuggggagugauuuaaccaguggauugggcuggcaaccuacucacucauccaucccaacacugcagucuccucucaguccagggucuaugcuggaacuuaggaugcuaagaugaccaggacagaguagcugaccuugaagaguucacauucuaauguccgcaacugucaugcaguguaaacagaucauuacaacacagagagaugaaugcuauugguagaaaucaguauagaaagcugugggagcacaggggaggucagaucuaauucugccucaggguguuagauaaacuuuuccaucucauuuuacauuucaccuuuuaaaguagaacaauuucuccacaccuagaccaaaaucuguccuuaaaaaugguccagaaacuuaagguuagcuucaaagaaaguuguuaagcguuccuccuuuggcccaaaucaccauuucacuuuuguacguacucuuacuuacucaaucuuuccaacaaacccauaaacuauuaauacuauuauaauucccauguugaagaugaauuauaagcaauaauuucuuauagaaaauuagaaacuugccacaccagcacacucaaaaugagauuaaaacuagaauucaacccgucuguccgauucuaaaguucauguuauuaaugacagugcugugaugucaugcuuguuagagcuuucaugacuccauuuuugccuagccucuuauuaaaacugugcccugcauucccuagucacucuguucauagaagggaaccacuguuuucauuaaauagaaggcuaugaugcaaacaugcugaacgcuuaagaaacaccuaaccuuggaaaaagaaagcagacgagaccuacaaucccacaaugaaaggaggccucagcacugggcagugaguaugccuucauccuaacagagaaucguaagaucaaaaaggggggagaguaccagcuugccugaacuggaggaaguaaagagggauacaaagcuggcauuuugccccuucucauccugacuuuggguugcuucaaggugacuugggcuccaucaugggccagacuccugagaaaguuuagauacugcagccucuaucacugggucagguugucagacacacugaauccauugcuuguuggacagucuaauuacugagaauuauggaccuucucacaacacaugauucauaucacaagagacuaccagaaacuuggcaauccuuucuuuuuguuuucccuuuucgucuccuccucuucaugcucaccaccagcccagaacugacuaucucucuuuuugaacaugaacacuuuagguguuuuugcugcauuaaaguggugugaccacaugccaagcccuaugcugaacucuugcugacacacugccaacucagaauacacacaaugaaagaaagacauauucgcauuagucaggugccuagagcuggugugguuugcuauuugcaaaugugaccacaagaaucccucccauccuacacaugcuguuuugcucucuggcuuucccccacuuuccaucaagaguugcagucuauuuccccuccccuugagugucuaucuuacuuuguguuuguguuguuauaaaagaacaccugaagcugggucguuuacaaagaaaagagguuuaucuggcucacaguucugaaggcuguccaagaagcacgaugcuggcuucugaauuugguggaggccucaagaugcuuccauucauggcagaaguggaagggaaaacaguuugcagagaucauauggugagaaaggaggcaagagagacaggagggaggugccagacccuuuucaacaaccagcucuucugggaacuaauagagcaguagagagcucacugguuaccacaaagaugacaucaagugauucaugaaggaucugcccccaaacacuucccauuagacccuaccgccaacaucagggaucaaauuucaacaugagguuuggagggucaaauauccaaucuauagcaguguugcugugugacuuuccaagguuaggccuuaagugaccuugaaaccucugauuauugcucucuuggaagccugagaccaacaugcuauaaaaaaucccagcuagccuguuaaguggcaacaugaagaaagaacuaaggcaccucagcugauagucagcaauaacugucagagaucaucucagaccuucuagagucaggagagccacugacuuccaguuucuauaucacuuaucuacugcugcauaauaaacuaccccaaaucauagagccuuaaaacaacauugaucggccgggcgcaguggcucacgccuguaaucccagcacuuugggaggccaaagcgcgcgaaucaccugaggucagcaguucaagaccagccuggccaacguggugaaaccccaucucuacuaaaaauacaaaaaaaacagcugggcaugguggcgggcaucuguaaucccagcuacucaggaggcagagacagaagaaucccuugaauccgggagguggagguugcagugagccaaggucacgccauugcacuccagccugggcuacaagagcaaaacucugucucaaaacaacaacaacaacaacaaaccaacauugauagguuuuacuaccauaagucuguggaugguuuuugcugagggucucaccuggacucacucaugcaacugcuuucagauggaagguaggcuggagucugggcucagcugcauccacuaggcccuucacucuacaugcucuuccaucccaauagaugcagaaucucugaauuugcuuaaggcuuacauugucccacauucuaucggucaaagaaaaucacaagccaacccagauucaagguagagauauucugucuucuaaaaggaggaguggaaagaugacagucaaaagggauauggacacuaggaaguuccagggauguuuaaaaauuaacaggggcccaagguaucuuggcuguccuagugaguaaauacaggauggcauuuuagaguugagaugcuccuuuuuuuuuuuuuuuuuccugagauggaguuucgcucucguugcccaggcuggagagcaauggcacaaucucagcucagugcaaccucugcuuccuggguucaagugauucuccugccucagccucccaaguagcugggaauacaggcaugcaccaccaugcccagcuaauuuuguauuuuuaguagagaugggguuucuccacguuggucaggcuggucguaaacucccgaccuuaggugauccaccugccuucaccucccaaagugcugggguuacaggcaugagccgccgugcccagccgagauggaucuuaaacaucaacuacuccaauaccuucacugucagauuuuaaaaauagggagagaaagguuacuuaacuuguucaaagucacacaguuaggagcacaguugggauuggagcucaacuggugagcuuccccaaccaaagcucuuucuguuacacugagauggcaaaacauugcacaucugccacuauuuuccaaugguaaacuuauggcagaauaaucgaccacagaauucucuccuuuaaccaaaguguccccaaauacuugccaauauaaccucugagcagucaacaccagugagaaugggcacgcgacaugagaugcaugugccauuucuguggccucccacacugccucaugaaacacagaaccaacugcaaaggacugguggagucagaacaaagggggaugcugcaaaagggagaaucuucccaacuacauaaaauuuccauuauguugccacauuuuuauucaaaauaaauuugauaaguucaaaauuugcucaucaaggauaauaauugauuaaaaauauuuuuaggaggauuuccaugacaaauacgaaauauuuaaacauggagcacugacagauaaauggaaauguacugauucagaugauuaauuaaagaugacagcagaauauuaugaucggaguugcucagacucgcccccauuuaguuuucuauaucugaucuauucuagggauucagaauauagaagucaccaaaauaaagcaaaucaucaaaauaucacugauuuugauuaggcugauuagccuguguauauauuaauaugaaguaaggcaguaucagauaauacaacacagaauuaaucauucuucugaacuaauaaaaaagagucuguauucaucucgacugcagaucuguguguaguuuagugauaagcaaggaacauuccagcuugcaaugcagaccucagcagacccuguauaauucauuauuugcucuaacaaacacuccuaggccuuguaaauguuuaaaauaauucuuaaugucacuucacaaaacaauagcaggauggacugucagcuacuuuucaagaaaauauucaauuuauuugauuuaaauagcacaauuacagagcuuugagucaaaguaggcggcaucucaaaaaguaaucuauucacaacguaagcacuuugauggauuuucauaucagaaaggcagaaauaucacccuuaaauauuaauaaauacaauucugaagaagcaucuugcuuuguuugggccacaccuuuuuucaguggggauuaacauacucauuucaguaacucaauaaaggguucaugggauauucaucaaccauaaccauaaaugacacagauguaauuuuaagcaaaugugauuuccagaauaugauaaauuccagagcagugugauuaagauaaugauaacacucugcucagagcugguucucaaggcaagcaucucacaaauauccacuaucucauguuuugcccugggauaugcuuugggucagagauaugaugagaccuuguucaucuggaggaagagaacccagguauccuugucuaggcaacaugcccugagcugcccucaaaacuccgguaccgaucuggaugcucaaaaguaagaaucacuuucaucgagagaagcaaacaguugccuuucaaagaaaguaaauugacaggggaguccgcagcccgauagcauucugguacagauucuuugguugaauuucacauauuuuucugugaacuuuucaaugcaaaguaaucuuauacugauugagggaagagcaucauaucuggaaaaaaauaugcucauauaaacuaaguaugugggaaagaaguaaaugauaucauuaaaggaaagaaacaauauauaacauuuguuugcugccuaguauggucuagugauaaucaauaacccuuugaguuaggauaauaucaccucccaauguccagauucagaaguugaggccaaaaaaguuuaacugcauaaccaaggucacguagcuauuaagugaaaaucccagccaggggcaugugcuacaacacuguuacaauguccaugcuguuucaaugccucucaagguuauaaaaaccuccauguauaauaccuacugcaguguuuacuagagugggauagcagagcccugcuuccacgggaugcuguuauacauuauacagaaaaaaaacugugcggucaaagaagauugagaaacacugcaugaaaugaaguaaaauagcucucuuuaccgcaguauucaucagcauauuuacuguacuacuaugcauucuggcuucucaaaaauaagaaauaguaugcagcacugcucaaauuugcuuaucuacaaaauaauaaugauuauuaauuauuaguaauauuguagaacacuacacaggacacauguuucagaggauguucuuuggaaaccuugagcaucauuucccaaaacacagagaggccugaguaauuuuucuguuuuuucaaacaaaaaguugaguacauguccuauuaaucacaugggcaaagaaagagagcauucugugaaaugaaauaugcugagaaguugagcauuaaaauacaucaaaugggauauggcagucauuagugcuguuugccaaacaguucagguuacugccaugucugggcauaugguaggccuucuggacccuugcaguugggugaagcucaaggaauacaggucaaagaguugugagcgaaaaugauauacgucacuucugggcuaaagcccuuaacuucuaguaugugaccgacagcuuuauuuccuucaccaagacaggcagcaaugcuuugcaaugguagcugcucuggcagugagaccccgaauuauaggucagcaggggccucugagcaucguggucacagugacuagggcaaguuuguucuuaaauagguuuuaccucuuuugcuaaccccaaccaacuuguaguagcuauuuacagcagcauguugaagaggauucugaagcucugauaaggagcaggaggaaagaacugaggaauuuauuaguuuuggcugccaccagggaggaaaaaaauauuagcguguauaccaaguaccugccauucuucaauuagacggcaauaaaaauguuuuuucaagaauucucucucccccauucuuaaugauauagaagucauuucugggacuugcaaugucucucaguaaccguuaugaaaaucuauuauuauuguuauuguccuagagauauacagaagugucuagaauuuagauaauucugguuaggagaguacugaaaaggaaaauuaacugucacucgaaagagucuguccacaauguguaaacaugagaaugggaacacaccaauaugaaaaugagcauguuguaaaaaugcucuuaggaguuaagacuugaaggaguauggcaauagaagaaauaaauugcacucagcagcugaagaaauauuuaaagauaacuccaaugagagauuauuuuaaacuucagauacacuuugcuaugagaaucauuucaaaaacucuguaaaaagcuuuuuagugaaguagagaugagaaaguaauacuaaaaaucugcaauucauugcagaucuagaaaaccacaugcaacauaaauaauuuaauagcacccucaccauauacacaguuucauuucaccaguaugugaaugaggggagugcccugagcacauaccuccauaggguggcuagagugaaaccuggggcccaaacucccacauagacaggauucuuccagugcaagcucuaucagguuuugaaauuauggauuccaaauuuagguuugcuuaugucauuuaagagacuaaaaauuccaguuucccucagaucuuccauauagcuggccaagccaauggagcaaccagacaacacaguucagaugccaucugaaggcaaaaaguagccaaacuauaaauaugaaaggaaagaaauaggaaaugagagaaagggagagaggagauuaaagguaggggugguauuuagcagaugaagccuccuuagaagagaggaaauacuccuuuauagauaggcucaacuaggauuccuggugcuacacacagagcuuaacauagcauuggccuuuaauaaauacuuggugaaaaaauaaaugucauguaggcuuauucauuguuuaaucugggaaacaauucuuucuaaugaauaauuucuucaaaaugcuccccaaacuguggguucuuaaaagaccagugaaccaguccagacucaacuuacuuaaauguaaaccauuaagaaaaauauacuucaugguaaaaaaaaaaagaauuaugaauuccuaauacaaauguaacauacccagcuaaagggauagaaaaauaaauacaaacuggucuuuccuucacacaucaaaaguagugcauguguuuuaaauggaaaacuucagaacuauuaacucagugaagcuuggaaaaguucaaagauaacaguguucuaugcuuuuuaauaacaaugaggaacccucuucuaugacagauacuaauguuaauagaaacauccuuuauuucaaauaaaugaaagagagucacacuuaacacuaauuuggcauucucacagaauaugaaucaacgucuuucucucuuaaaaucaguccuccaugagcuagcaaccuaaaauaaaugugaagauuucguagugagagguauucaucauguguucagugaaugaacuucugaaugaauuagugaaagaucacaaaguugaauauuagagaaaaggauaaagccaaaagacuuucaagaacucuguauuuuuuuguauauucauucaguaaauauuugugaauuaagagccgacuaccuggcaaguacuauauaagacacugaggauacagcacaaccagguacagucauccucucccuuccaaagaugugaaaucuagagggugagcagacaaaggcaacugacauaguaacuacugugaaaauauaaggggugagaugagaaagaaaaggugcaagaaugcaagggcaagaccguaacaagccaaaccagcuaagguggcugugaacuaggcccaguucacuuggucuaacuggaucuucaggaaagagugcaggcccuugauagccuuggucagcagucuguauuuauucgccaugcauggagaagccacugaagcauuucggagaguggagauguaugacagauucuggguucucuuugcaaagcugaaggccacugggaauaucuuuauugcagacuagguaaaagauucaaagcaggccuggccuguggugguggcaguagagaugcagagaauuugagauguauguuugagguaggagcaacaagacuuaacuaaugggggcaaaaaggaagagaaggaucaaagaggauuccaagguucuggcuuggguaguaggugaagagugauguaauuuugagauacggugggugggacagugucauguagcucaccauuuggagacuuuucuuucuugaauuuauagaauucuccagaaauaacuagagcagaguuuccuaaccugggucuacagauaggcuccagggcuucuaugaaucuccugaaauuguuugcaaaauggugcauaugugcacgcacacacauuguuuuccucugguauaaaauucuuaaauagucuccugaccccaacuaagauaagaaaucuagauuuaaaucagaagaauucuuugaagauuaguccccaagagaaugauuagaaacaggcucagacuuuugcucacuuuggcuuagaaucuaauauacccaguacuaaagaguaagaaaagaaguucacucugucugagcaaugugccauaauucacaagcaugaagccuccauaaaagacaaacaaaagauuuuuuaaugccauaacaccgaagucauuuuaaucugauucagcagugaacaauuuaagacaugucuccuccaacaaaggcagcuggacacauaaagaugauugugugauccauucaaaauuaaagaauaagcuaaaucauuuacaacaauaaaaaugcagaaaauucuaccagaaaaaaaaaaaaaaagagagagugaaaacuuucagcagcaagugauuuccaaauguuuccaaaacaggaagcaaaagacauuuuaaugucacuguggcagcuuccagaauagaguaaguuaaucaggcagccucuaaaaacaaagcagcaauucauuaaaaacaacaacugcuacucagcaaugaacuguacugccagagugucaagaaagcaaacuuuuucaagauagugauuuguaugcaaauauagcucagcauuuaucacuaaaccuccaaggccuguaaagggggggaaagaaaaguucuuuccaucugcuuacaccugucuccuaauaaaaucaacugccaaucacaggggaggcuggggcauuuuaaaaacagucaaagaaauacauucacaaauccaggguuucaaacaaaaaacuccugucuacucuuucuucuucaaaucuccuagccuacuguccucuuccuaaauuggaguuaauaucuguaccuacuucauugggauguuaaaaguguuuuuucaaaauaauagcauauuucacaccaacaaauaaaagcugaacgaaugguugguuuagaaaaaaaaaaaauagucaauggaaaugaaauccuucaaagcuucccucaauccagcaaugguaaugcgguuaugugauugaaacagugucucacuagcaccaguguuaucguuuggaacccagaucuucauucaucucauguuuaaaaugucuguacuuuucuacauuccacucacccacccaucuccauuuucucauuugaucucuguuuuuuauuucccccucauaauguaagcaucacugguagcagagucuaggaauuaaucaucuuauaaucauuuagucuuccucuccaguucuaacuuacgacuuuuucaaaauaugguugcuaacaauaaaaaaaaucucaaaaugugaaaacaaacaauggaaaaauauuguaaauauuuaaacgcauuuagaauuugcaaguuuuuuucacucuaaugucauuuuucaagcuauguuuagacagcacagaacacuauaugguuuaccuaauguuuaaauuaguagaucuggccaggugugguggcucacgccuguaaucccagcacuuugggaggccaaggugggugggucacuugagaucaggaguuugagagcagucuagccaacauggugcaauccugucucuacuaaaaauacaaaaaucagcuaggcaugguggcacacaccuguaaucccagcuacucggaaagcugaggcaggagaauuucuugaacccaggaagcagagcuugcagugagccaagauaacgccacugcacucuagccugggugacagagugaguaagacuguuucacacacagacacacacacacacacacacacacacacacacacacacacaaaauuaguaaacccaauaauccacaaagaucuauaaaaauaugaacuuacaagauuucuauauauuugaauuucauuuuguauauaacugaaaaaaaauauuuaagcaugccuaaggaaaaagaaaacuguggaaacaaaacaaauguucuggcaauucugcaacaguuucacauuuguauauuguuauuccuccugaagaauccuaaaauucacucucauuuucuuuauaugcuuagauauuaaaaacaugucuuugacaaccaacagucuucugucauggggaaucagacaucggccccauaaucucucauuaccaacaucaccauugucacugucuuuaccaucaucacuuaaaagaaaauagaaacugcuuaaauaaccacagcuaaaauaagugucacaaguuucuuacugauuaaaugcuccuccgcgagacugcaaccucgaauacuacgccauagaguucagauuccaacaccuuuaauguuucuauaaggaaaaaaaaccacaagcguucucccugaaaacguacucuuaacucagaaucucuucugguuccauuuaguuuauaaaaaaaaaaaaaagaauaauucagauugaaggauaguauuuuggauuuucaguguuauugauauuccucgauccaucauaauuuagcuaacauagaucacugccuauagagcagugcugucuaguggaacuuucuauauccuauacuguucaauauaguagccacuagccauauguggcuacugagcacuugaaauauggcugauguaaucaaccauauuuaauugcauuuuguuuuaauuuuaauuuuacauuuaaaaauuaaauuuaaacuuuacauuuuaaauaccacccuguagcuaguaaucacuuguagcuaguagcuauuacauuguacaguucaucaggagaggccacaaauuuaugguaacaaggagugguggaacuggcacaacuggaaaacacaugccccaagguggguggccaccaccuagagauuuuuuuguuccugaagaaacuagaaauuugaauugcuauguguaauucucuucuauuuaacuuuuggcaacuauaggcaguccuucucaugguuccaauaugcacauauuucaguuacuccaguuuaaacaacaccaauuccccaacaacacgguuuaaauuucaguuaccaugucacauuaacucugggucauuggguaaaguacaagcuccacuacuagcucuucaauucacaaauuaccauguagaucauagaugugcaugaugaucagagaccagucacaucacuucuuccaaagucugucagugacugaucacugcacaucugguauucagucagaggcagccagcaaaguauguaguuuuguaucccacugaucuuccagugaugaacccacauauuucaccaaaauggauaaucgaaagagggaacuggccaagaaauaugaaacacaagugaccaaaaacaaaaacaaaaaaccaaaugugacaaccccagaagugcacuuugaaucaaauguaaauaaaauuauagaacaaauaacugacuuugggaaugccaauugcgcugauguucaggagauucuagauauguaacccaaggaauuuaguaaagacaaacuuauuaacauaaauuaccaaagaauuuaugaugcagaagaaaaagauguaccagaggaagugacaucaaaaaagucacauuuuaaaaaacguccuauuucaugacauugaaaacacaaaggaugaaauauuggaaggagauccacacuuuaggagggauuaugacaaucagccaaagcacagaaaagaugccccaucuguacuguuaguugcaggauaagaaaaacaaggcaagaauuguucaagagacucucaauaagugauuuucaaagaaauaaagcacuucaauucuuaguguuucuaauguuuuaaauuacaguguacuaaauuaguauuaguucguuuuuuacuucuuucauuauauuuuucuauuucuuuauacucugauaacuuauagaggguuuuuaaugauuagagaaaaacguuaaaggucauagaacagucauacguuuucccauugauuacuaaguggacauugcaugguuuccgcuugcguggucauuuuuauagucccacacugcuguauaagaugagggguacuuguacuuccaauguguuaaaaaauauuggguggggcaaauaaaacauauagguaacaggccacaaauuuaaaaccugugccaagaacuagugucauaugugaugugcaucuuaauauuaggagagagcagaugaaggaaaaucaaggacugugacuuuaaaaagacauauauaugcagucucucuccagaaagagcagacccgucgucauaugcuccugaauucucccaccacacugccuggcaaaauuaaagucaaaguucucuuuuguuucccaaguagccugagaacugcauguuacugucuaccuaaauaacagaggcucucuaaaagaaaaugauauuuauugagaaaugggccuugucuugggaauacaugugccacaguaaauuaugaguauucagccaggugaaggaagacaaagguuuuuaaagggcaagugaggagaauuaccuaauuguuuugagguaauuauccuugguuacuaggaucaauaacauuguagcaccagaaagagguuggacaggcaguuguugggcagauguccucauagaagcauugugugugugugugugucuguguguguguguguguguguguguguguguacaaaugugauggccuuggugcagcguggcuuuuugcagagucuuuuaugauaguuuuuguuaucaggcauuuguacaugagaacgcucccgucauggccuuuccuagcucuauuugucaggguuuuguuugugacuccauuugauucugacaacuuuuauauuaucaaaccuccugaacucugaaugcaucauuaaaccuggcuguuagcauuaagguuuccccaccaaauguucucuuguacaucacaauaugacugaagggagauuacauaaugaguaacaucaauaccaugcauguucuauauuccauauggauaaugcgcaacaagcaaaauuccugccaaaauccuuauuuugacacaaaaaacagaaugcagcuauagcuguauguuuuccuucacaauguuccacuauaggcccuuucuguagugcauuaucugccgcugguccagaagcucuuuaaaaacagaggccacuuauuuuucauccuuggauccaaagaccagcauauggagcccagguuaggacagaugucaccucuuaguagacuuaucaaucccaucccaugaagguaucccuccuuccuuuucuucccauuuguuuguaucccucauagcuuauaucaaucuugaaauuuuaguacucauuuaugauuacuuguuuucuauugagaaugcaaacugaaaugagggcagaaaucaggaaugucugcuucucagcuguauucuaccuggauacaguauacugcccauagagcacuugcuaaacacugaauuggugggucaauggauggauggauggcugggaugcauggacggaugguagaugacugggugggugguuugaaaaaaugucuaagggaaugacuauuagaacgaaugacuguugaaugaauuacuguuucauuaauaaauaaaaauaaauaaauaaaagcuaaaacuauuauuuuaguaaguagagaguagaaaaaauaacuguuauuuucuuaauguuuuauaaccauaaacauaacauucucuggguugucuuccuuuucccaaguuauguccucagauaaaucuaaaaaugagaauucuuccaaugggugaucuccccugguccaguccacuauuugcugaacuacaagauggagaaguuucacuuugcagcagcaugugugaaaacagcuuggaaauuuuuguagagaauaagcucaagaagagucaacagagaaauguuguuucuacaaaacacguuuuaucucagauugugaaugcaagucugguguugaguugagggaggugauuucucacucugaucuuauugacagggauagucauggaguuuucugucaaccugggagccaccaggaacagccuauagcacauucacaaaagagaucaguauggcugaagaaaaucaaagaaaagagaaaugaggaaacaagggucaaccuuugacuauagcauugcaaaggcagucauucuaggaaggaggaaagaugcaggugaaccaacuaguaaaugguagaacagaaucugaauccagcauaugaccuguggagugacucagaucuggauuccaauuccauuuuugccacuuuuuagccauuugacucugggcaaauaaacucuuaucaguaaccucaccugcaaaauggggcuuauuuauucucauggaacugcauuucagaguaaccaaacagcaccaaugauggacaauucuucaaagaauucuagcauuaaaagcaaaaggacccccaccauuuuaaaucccuaaaaauauaacugacucaugcaaaauuaucaacagguaauuuggggcuuaggucaggaguucuuaaccugggggucccacagaggcuuagcagagggugcauggauaaaaggaaggaaacacaugaacaugaaugaaaaaaaugacacacaguuauuuuuacuaauuuuuaacuaaaauuuuguaucuuauuaaaucacagauguaggcaaugaaccacuguaguaacagcaguaccuaugaguugugucacaguauaaaucacagguauuuaaaaaauauguaaaguaauaacuugauaguuauugcaguuaccuugaaauaucauuuauucuagaaguacuuaucauuacaauuacuaucacacaauuaugauggucauuauagcugcuaccacuucucauuauuuaauauguaauaaagaaaugcauaauucacuguaucacaaauuugcuguuaauacuguguuaacugguauuaaauaacaugaauuuccuugguacuucucuauacuuaacuguccuuaauuaaaaucauuauugggugggaggguugcucgaggcuaggaguuucaauccagccugggcaaaguagugagaccccauaucuaaaaaaaauuagcugggcauaguggcgugcacguguggucucagcuacucaggagacugagaugggaggacugcuugagccuaggaguucaaaguugcaguaagcuaugaucauacuacugcacuccagccuaggugaaggagcaagaccguaccuugaaaaaaauaauaaaaauaaaaaauaaaaacauuauugggggaaaagguauacaagcgucaccaacagccaaaaaggugacugaaccaaaaagguuaagaacuccugcuuuggaugaaagugugacgggaaacuuuauaauggagaaccaggcugucacuaccuaaaucugcugaucaauuucaggauucuaagagcaggacauccagacauuaugccucccuauacacugugauuugaagcacauaauacuacuacuacaaaugcuuauaucugaaaauaauccauagacccgcagcugucuaauagaacuuuuugcgauuguuuacacuaugcaacacagcagacacuagcugcauuugaaauguggcuagagcaaagaagcaaccugaauuucuaauuuuacuuaaguguauaaucagccaccuauagcuagcaucuacccuggagcccaccuuagagcuaacuuacuuuacaccaaacacaagauagagaaacaaguuaaguaacacuaaagggaagcaaacagacaaauccguacuauagaacagucuacaggacaacugacucaguuaaaaaaaaauucaauggcauaacaauauuggauuaaaacagcacuaaaacaaauaauaaccuaauauaagguguggaucuuuuuuggauccugauccaaccaagcaaugauaaaaagacauuuuaaaacagucaaagaacuugacuacugcauuaagaaauuccuauuaauuuugugaaauaugauaauggggccaggugcaguggcucaugccuguaaugagcacuuugagaggcugaggcggggggaucaccugaggccaggaguucaagacaagccugaccaacauggagaaaccccgucucuacuaaaaauacaaaucagccgggcgugguggcgcaugccuguaaucucagcuacucaggagguugaggcaggagaaucgcuugaaccugggaggcagaggcugcggugagccaagaucgcgccauugcacuccagccuaggcaacaagaacgaaacuccaucccaaaaaaaaaagagagaaagaaagaaaagaaagaaagaaaaagaaauaugauaauaauauugccaauuagggaauuuucguagucuuuaaagauacaugcugauguguguagagcuaagaaaauacuucuagcaauugccuuaaaauauuucagcaaaaacucaaguggauaaaugaagcaaguguggcaaaauccgaaugacauuugaaucugguugaagguaaacaggccauccuuuguauuguuuuuggugcuuuuucugaguaugucugaaacauuucaaaauuaauuuuaaaugggauaaugcauuggguacagugaccaacacauaguaaacauucaguaaauguuaauuagcaaguauuagcaucaucaacauuaucauuuauguucucaaaagucaaaacuaagaucaaucaguaaaaaauacaaagagguagcuuucagcuucaucuaagaacaggcucugggaagaugaaaauacaccgucucgugagggaguagccaacagcauauucaagauaacaauaacagcagugacuuacaugauugaguacuuauaauggggcagaugugguucuaagcacuuuccauauaaccccucacucaaucuucacaacaauuucauaagguagguacucuaacugucccugcuggagcagagauugaucacuuggugaggaugcugcagaagagggucaaggugaauggcuuugcuaguugcccuuuaacaucccugauaacccugaacuccucugauucaaugaacaugucauucagaugaauugugcagguuggccagcuggcuggcucacacacacauacagggcaauucuugcuuuuacuuacugaaaggucuuuaaacaccaccuuucccuuucaaguaggagacuaaaacgucacaggaauuuaauuaucuguaggcaagaagaugauaugaucaagaaaaugcuacauuuaaacuacuccauuuacccacuuucaaauuucccaucaauuagaggggaacaucuucccuaggcagccauuugaccaagaaauguccgugguauaucuucgucaacauguuucagaauauaaauccagauuacacaaacuaaaguugguauaaaggcugucaucauauauuauaucauuuggaaagaaauauuggugaccuuauccaguaugacuguuauaaugguaauaaaauugaaucuuugaagauuacacuucuggucaaaguaguaaaaugugaccuuauucuauucaacauugacauuuauuauauuaauuuacauguaaaaaacugcauuagaaugauauuaaagcccugguuagaaauguuagaaaugggaauguucaagaacuucagaaauaagauuucacuuuaccagccauucacagcauugaguuuguuugaugcaaauuaaacuaaauuuccuucaccaaucucugauucgguucuaauuuuauuauuaucacuaucucauucauacaggagauauuuuucccaaugccucuuuaaacauuuuauaaaccuuaacucauuuucaucaugcucuggauaaaaagauaacacagagcacugaauauauaaaccugagucagaggaucaagccaucugcuuaugacggggagagucuccucagcccaguaaaaaugagcuuagcgaugaguauacaucagauagugcacuagguccuagaaggauaccaagguccagaggugagaaaagagagucagaccgccacguggguuucacagaauggccaccaugcagcaaaaagaucgcucuuguugcccaggcuggagugcaauggcacagucucugcucacugcaaccccugccuccuggguucaagcaauuuuccugccucagccucccgaguagcugggauuacaggugccugccaccaugcccagcuaauuuuuuguauuuuuaguagagaagagguuucaccuuguuggccaggcuagucucgaacuccuugccuuggccucccaaaguguugggauuacaggcgugagccaccacacccagccaaaaacauuuuuuuauacuggucaaaauuuuauagggaggucccucccuuaaauauaaguuuugcaaacuuucaguuuggggguagaacauggaaucaugcaaugaauuaaggacaagauucagccacaccucaacagauuauucuauuuucaccauuagcccaaaguccaggcuugcuaggaugggucccaacuguccuuccaauuuuguuucucacuauucucgccagcacuucaagguuccaaccaaaauuaacuuuuugcuauguauuuccucauaugccuuaguuaauauugucuucuacucugaauaucuuuugacuuucuaucaauagguuaagcuagguguugcuaugauaacaagcagucccagcauuucagaagcuuguaacaaaaaagguuuacuucuugccugcuauuuguccauggugggccagcagaucagcucugcccaucucuggcacucugauauccaggcuaagagagcaaaaaccagcucaaauacuguuaggaaccaucccaaggggaagagaaaacugcagggucuuacaccagaaguuaggugcuuaguccaaagugacacaauucacugccauaacuagucaugugguuccaccaaaccacaagaagcauaaugcuaccauacaccuggaagaaagaagaacuaaaaauauuuggucaauaccaucaaugacucccuaucuccaugugucccaaaucugauaauuuuuccagaucuaaguuagauuccaccuccuccuaaaagaaaaccacaguccuuccugcuaaaaggaaaccguucauaugguuaauauacagagcauguuauuuuaccucauaagacucucaugacucucugagaaccgugucucuauuggaauuccguguuucccauaaugccuugcuagauaaauacugcuugaaugauugaacaaggcugucuguauaaugagaguuucaucuccaaagacuucgaauacccuggaggcuaguaauacgugguaagcaauaaaacuuuauuuuuucuuauuuauaucauaaagauacuuaaaacaauauuaaaaugaucauaaagaugaaauaaaaaugagcccauagucccgccacccuaaaccaacaaauguuuucauuucuuuuccuccugguccuauucaaagggcauccauuuccuuuacauagcuguauucagggugcauacaaagagagaauucuaaauagaacagaaguaacugcccagucaacagguuuuguuuguuuguuuguuuguuuuugcucuuccccaagauagagacacauugggccauauccuaauacugagacuuauuuucugcaauaaaauuuccguuaauuuaaagcuucuaagcuguuuaauacagucaccaucauuaggaaauaucaguguagucuucaccacuacuuccucuccuuggcucaacacuggaagaaauugccucuagugaaaggagauugacuuccaacaugagaagaaggaagaaaaggagaagugugugcuaaaucuuggacaguucuggggaacaucguagaccaacgucaccuugucacgguccgacguuaagacaucauuaacaagagcuaacaaccaacauugaaguuuuaaccucauucgugaauuuaucugauuauuauuuugcuccauuuagcucauccaauucuuuucauuuuaucaugcacucuuuuuauuuguguagucugaguugaaccuuuucuaaaacaagguagaaaauacauacauaaugcuucaaaaaaauguuuuccauacugccaaauaggcacuaggaagucucaccagaguugauaaacaaucuagauggccauuuaacccacucagcuuacuuaaaaccaagucuuucuuuuuuuuuuuuuuuugagacggagucuugcucugucgcccgagugcaguggcgaaaucuuggcucacugcaaccuccgccucccagguucaagcaauucucaugcuucagccuccugaguagcugggacuacaggcacgcaccaccgcacuggcuaauuuuuguauuuuuaguagagacaggguuucaccaugauggccagccuggucucgaacuccuaaccucaggugauccgcccgacuuggccucucaaagugcugggauuacaggcaugagccacugcacccggccuaaaaccaaguaagucuuaaaauuuguacucagaacuacuuuuuuuuuuugagauggagucuugcucugucacccaggcuggagugcagugacaugaucucggcucacugcaaccucugccucccggguucaagcaauucucccgccucagccucccaaguagcugggacuacaggugcauacugccaugcccggcuaauuuuuuguauuuuaguagagacaggguuucauuguauugcccaggcuggucuugaacuccugagcucaggcaaucugcccgccucggccucccaaaguguugggauuacaggugugaggcacuguaccuugccucagagcuacuucuauacugagaauaaauaaacacccaaacaccuuucaauguuauuaaauuucagaguaaugacuuuuugucuauuuucuauuuuaauagcugauagauuaguagguuuucaagcuauauuuuaaaauuuuauguucaguuuccuaaccacugccacauguacacauaauuuauacucuuacauuuuugaaaggguuuauuauuuuaugugcuauaguuauugaucugaaucaaaucuuucuuacuugauucaacagacuauagugggaauaaaaugugacuauuuacgaauguuaaccacugcuguaauucauaugaaaucugccaagccuauuauauuaggaauaauguuauauauuuuaucuaagagucugauaacaccuaccucaagucuaaauauucucugaaaaauuugucagaauaaaacaagugcccuuaaauaauauuuucagguauaacugcagacaguugcuuguacguuugucuuuaacuuuaauacugucucaauaugcaugaaacgcuugauaguucaauaguuguuuucaugaguugugccuucauuaagguacaaaacauuaaacaccuggaaugcugcucgaacuauuccuaagggagaaauuuuggugacaaaugaaagggauacauuuuuaagcugaaaaaguugcucgcuacugauaaaagaauuuauaucagaauauuccaauagagcagaagaaagcaacaugaaaagaaaauuaacauucauuaagaaacagcuaccauggugcgaaacaaagaucacaaagccaaaacugaacaacaaucaaauuucuacacaaaaaauaagacacauacaaugccuacaguuccgauugucuaaugcuguguaacaaacuacccuaaaacuaagugacuuaaauaacggucauuauguacugccucuuaugguuucuggaggggguggucaggaauuuuggaucaucucagucagaaggucuggcucugaacuuucaugacacuccagucauaccguggcugagacuagggccaucucaguggcuucuauauguaugccugaaaccuaagcuaggauuugaauaguuaggggcaucccucucuggcuccuuaagguguuuccaugugcucucucccauacgguggcuucaagguagccagacuuaucauauauugccuugagguucccaagacauauaucucaagcuagaaagaaaaccaagaaaagccaaaguuccuuuaaggaccuagucuuaaaacucauuuggccuuacuucucccaucaucugagcagcuccacuuuuaucuguuucauacauggggcuuuggcauaagagcauguugaccaaaggcugucaaaguaaccaaacauaaaaaguuuaaaagcuaguggcugggaugaagucuaaugccccaaacuucaacaaagcuaggugauggaaaaauacugcugaggggaaggcugcuuaggugaugggcaagagaguccuuggagaaugcagauaaucaaaacagcaccuaauuaagguacagauaauugagagcuggauuaucacuaagauuguauguauaaagaugcacuaaauaucuuauuuucaauuucucuuauuuuucuauacuguuauaauagaaauaauguaauaacagcaaaagcaaaaaauaguccuauaaaguguucacauggugaauucaauacuuucacacugggaagaugaugguggaagauaguaucucaggcagugcaguccaauggaagaucuuagaaccaaauguauugaguugaaaacauuaaugcugucauuucugagccaucuuaacuuuggcaaaguaauuaaccugucagagucuaaauguccucaucugugaaauggaagaaauuaugaguucacaaauuuacacugaagagucacugauccaccauucuuuaauucagucauaaaauauuuauggagagccaaauauaugccagguaugauaugguauggaaauacaauaaugagccaaaugccuacaauaaucaaucaccaaacaaauguuuaucuuaagaugacacccauaaacauguccaacaaagauagugucaaaaaauugaugucaccuaaugaauaauuuccuucuuucuuuuuauuuauuuauuuauuuuuuugagacagagucuugcucugucuccaggcuggaguacaaugaugugaucucggcucacugcaaccuccgccucccaggcucaagcaauucuccugcuucagccucccgaguagcugggauuacaggcauguaccaccaugcccagcuaauuuuucuauuuuuaguagagacgggguuucaccauguuggucaggauggucucgaucucuugaccuggugauccacccaccucggccucccaaagugcugggauuacaggcaugagccaccgcgccuggccuuuccuucuuucuugaccuuccuuucuucauaccauaacucagugauaauuaguagggggugaaacagagccauaauacauucauuugugaaucuccccuguccuccucacacuuaccuuuucucuauucccuucucccaagccugguucuggcucucucaugcuucagaaucugugaaauugguucggagggcuucaagagaacugcggaggcuaagccuguaucauaaagauuuaggacuaggggagaggaagcgaacacaaagaaaaguuggaccauguaagaacuagaaggagagacuggggagcugguccuggagugacuccagggcaccaacauguaggggagaaauacugcugaggggaaugacaugauuucuguuucuuugagagauucaagacuggauuuccuuuuaauuaacaugggguggcugaucuauacuucuugaaggcaacucuagguggggguaaaccaccuggggccucaagauuuauuaggaccucacaauagcaaaccuguugcuccccuaaaagcuagaaagggggguuuacaaaggagauaaaccacaggugucagauauguauccaaaacaucucucugaaggacuuuucucaauaaaaaaaagcuacugaugcauuuaaaauuaaguaauaaaacaagaaguaccugugcaugaaauauuuuuacaucucccaccuccaacccugaagccauccuauuagcaaccuacccuaugauccugacaugacccgacagaaggagacuugcagauccaacugcuccucagacucucacuugcacagggggcauuuucaacauguccagggagcauuugcugccuugauaaugaccuuugaggagaggaaaccaacucagaaguaccuucauccuccuuuuaguuugucuuuuauguuuuuuucuugagccaaugacuucuuucagacagcaauaauuuacacuucaggaaaaugucaaaguauagcaaugcccugaauaauaauuaccgccaagguuggaaugaagccuuucgaagaaaugcuaaguuaauuagccacacacuuguuuaccauuaggccaguggagaaaacaaggagcacaggaucagaacaugccugcaacauauggucuuuauuaauggcggcaucucaauuagucuaugggaccccacuucugucaacccagagaugaucugaauaaagaaggagaagaaauguucacaaagcugucauggggagaagaugcuaccugagaccacucaggacacccacaaaagaaacuuggauuucuguuguuuucugucauaccuucauacaugaaauugccucuuuuaaucuuuccacaaugcauuuguuuugggacaaaggucaagagaagggcagauuaggaaauaaggagguuuacccauuauuaccaaaaaucuauuuaaaaaaucauguuuccaugaauaucucaauuuaucccuucuaauucuuauucucauuucugaaauauauacuuuguuuagcuuuuuggaaaaauccacauuuuaaagaaguauacaauaaaaaaauaauacuccuuauuuacaugcuucugcaaucauggccgccuuuccacagaacacucucagacgaaggcccuuuugugccggccuacuuagauguuaccaaagguguacaaaaacgcaucucuugcagauggcuggaagauagcucugagcucuuuguguucaaucaaucccccaggaaaaggcauuagaaauuuauuagaagcagcucccuguucuccucaguuucugagcuuggaaaaagcacacuacacugaaaaagcauuuugaauggaaaauguaaccugaaguaucuuacuuuuuucuuuccuccauaguccuaccaucgauauauccuuuguaggacucuauuaguuugcuaggacgagcauaacaaaauaccaaguaccacaaacuggcuggcuuagaaaagagacauguacgaucccacaguucugaggacaggggccuaaaccaaugggucaccaggguugguuccuucugaggacugugaaggaggauguguuccaggacucucuccuuggcuuguggauggcugucuucuugauggauuuccucacacugucuucccucuuugcuugucuguugcuaugucuaaauuucccuuucuuuaagaauacaagucauauugcacuagggcccaccccagugaccucaucuuaaccugauuaccucuguaaaggccgucuccagauacacucacauucagaggcacuagggauuaggacuucaacuuaucuuucuuugcaagggauacaauucaacccauaacagagaugaguaaaaaaaaaagauauuaauguucaaaaaauuaaguaaccaaacauaaaaacuuuaaaagcuaguggcugggauaaugucuaaugccccaaaguggaaagguaccauugucacauauuucaaagaggaaagguaccauugccaccuauuucccuggcuguuuguuaccuugaugaagugucuacuguggcaaggcauuaugcauggcacugggcaacagagggaaaaaaacauggagccucuaugcucaugaauuuacccucuccuuuuaugccagccuuuucaaccugggggaaaguggacuggcuagaguacuaaucaagcugugaaggacuuugggcuucuacuucauucucccuugcauugacagcuggacaguuaaaagcagcaacaccaacagcugcacagcacccaacucaucaacccacaacaacggugacaucaccuaaguuagcauggaaguggccagucugcuuuugccaauucuuugggacauuaaacccaugauaauacuuuuaauauaauucugugugaaccaauaaugaugacaaacuauucuucuugccugguuggagauaauaaguaacaauaccuccuauuuucuacgaacuguacuuuuuuucuagcaccgugccaggcacuuaccaugauaauuuuaugccauuuucacaaggugagacugauauuacuagcuccauuuuacagauggagagauuacaugucuugcuaaagcuaccagcuaauacagaguaaagguuaaaucugaaaucaaggugucuagaaaaucaaccccaugcucuugagccuuacacaauagugucucuuucaaccuuuugaaccugagcacuuaugacaacugcccaguauauguguacacauauucugugcauguuauagauagacagauagauagauagauaaaauaucuauuuucuccccccaaaaucuaugacuaaugcaauaaaccucccacugauuagacaguuauggcuuuuucucacaucuccaucagugacauaacauauuaagcaaaaaaguccgacccagcugauuaguauuugaugugcugaagagccuaauguuucuuuauaugaaacaucagacaguggcagccuacuuaauuacuagguugacuuuaugucuucaaaauaauaaaacagaauaauccaaacgacaggccaacguggugagugauauuugaacaucuacucgacccuaaaacuguuaaagcaaaaguacuuauccaaaauccaauacuuuccauuuuucuuuuaaauguuguaagucaaaaccagcuaaauugauuuuuugccuuugacuucugcugaaaaguucauuccuaagcagauuacauguguggcuuugcagcucagaggaaauuuuacagccaaguaaaacccuaaaaucaggaaaacauggguuugcugaauacaguagaaagacgugacagaucuuaauuauaaaagaacaaauauaucuugauagaugaacugucuuuugugaauuaagacucaaaaguuuuaacuccuugauuaaccguuacccauuaguaauauagaaaguugugaggcaacgucuucaaacuucuaaguagaacagagcacucccaaagcaugcagaacccccuguaacaucacucaacgcauuuucagcaugagugcccaggguaagccuuccucacaauguugcaaagcaaaucgugucccucauucccuuuucuacucccagcacuccuugguuaaguguuuuaacaggguaagugaugacgguacaggaagagaagaaggaagaggaggagaaagaacaacaaugauaucaugguaaaggccuguagaaauugaucuaccagacaaaacucaagagcucauaugauacaggauuuugcuugcacauggucacaauuaaauaaaugaugaaaaugagacucaaauauagauuguauaccucauuccacuguuacaagcuuucuucuaaaugaggaaucaucaaaaccaaacagaagugucuaucuuaggucaccuuacccucuuuucugauuguugaaauuaaggcagugcaagaaaccuggggagacacuggaaaguguccccaugccaagcccugugagcacaaugagcucaugaaagaaaagcccagagccaacaacuaauaaucgugcuuaaaacucaucauuuaagaauuucaaaauaaacacugaucaauugaaguuauuuugacccaaagucuuacguaccuucuuuugcuuguccauauuggccaucauaaaaaacagcaaaaaaaagaaagaaagaaacaaagauggggaguuguugcuuaauggguauacaguuucaguuucguaagaugagugaguucugaagaucuguugcacaguaaugugaguauguuuaacacuacagaacuguacacuuaaaaugguuaaaaugauguauuauuccauuaacuuaaaaugguuaaaaugauguauuauucucagguaugauaaagacauaccugagacugggcaauuuacaaaagaaagagguuuaauggacuuacaguuccacauggcuggggaggccucacaaucauggcagaagacaaggaggagcaagucacuucuuacauggauggcagcaggcaaagagagaguuugugcagggaaacucccccuuacaaaaccaucagaucuuaugagacucacccaccaucaugagaacagcuugggaaagaccugcccccaugauucaauuaccucccacuguaucccucccacaacacgugagauuuggguggggacacagccaaacaauaucaaaugauaaauuuuauguuuuuuuaauggaaaauaaaauuuaaaagaaggaaaaagaauucucuccccuucccucucucccuaccucccuaccuugcuuucuccccuccagggaagacaugugccuccaggauggaaacaaauggauugaucuggaaaauacuuaggaggcagaacugaaaaaauuugaaugugaggaugagaaacagggagaucaugggugauuuccaagucucuggaucaacugaaauggagaauggauaaggaggaacaccuggaggagagcacgcuuggaaaggcauggugaguuucaucuaacuagagaucaccagcaggagucugcccuguccaucuggagcccaggaaggaggguuaggguggagauucuguacauuucuacagccaacucuaauuuuugguuacaaucaaagccuaugcccuucuaaaaccuuuuucuuccaucacuaaugaucagcuguguuuccagaaguaugaauggauuuauccuauauuucugccuaauauuucauauaugaauacuucuaggcaggcauugggucauauguguaaaacgaaagcaaguacuuaacacaauagaccauucaauaaagcugcuuuucacaugcuucauuuacuacuuuccauugccuuuuucgcaagcaauuaccaucucacacaugcccaguuucaccauucugcagaaccaaauguugaauuuaggcaaacauaggguguucaauaaacagguggauuuugaacagaacaccaaugaauucaggaagcacggucaaccagcugcgucugucaauggaauaaucaguagcuggcugcaucugugcuggcugggcugccaucgguguuuacaagcuggaauugaagagggcucggccagcugacagcagaaguuugcgcagcaccugucuaaaguauauaugacugccuccaggcaaucccauuaguucuccacuuucauggacacuaggacuuguucacaaauuuagggggaaaaauaaaaaagacaaacagagcuagccucugacugagaaaggacaccugaaagagaaacaaucccauauggagaaacagaacaagggggugagaaugagaaagacaagaaaucacucaagaaagccaguaauguuuacagauaguagaaaaauuuugucuguaaacagugggcuugguagcauuuuuuuaaaucagagauguucuggagaaauauguaaagaacucagcccaagcuuucugaugccaggcagggcauaaguaguuuacauggaaccuucugacuuguuuaucugacauaguaaacagcuuucucugaucccacugucccuuuuacgcauuacaagauaacaaaaaguuaugcgauuuuaggaaaucaaguauauaaacagggcuauucucagcacauccacugaauauuaagugcccacuuuuaucugcuagaacuugaugugugaagguaaccaacuuaaaugcacugaagagauugcauucacacagugaauagugacauuuugcuaggaauuuguuaaauuuuauaaugcaagcauacugccguaauguuccacaaaacguaacagucggugcacagcaauacugcccucugguuugugagggcuauuuccauccucaauucauucuagcaggaaaaagaaauuaaagauaugauagaaugcuauccacauuguuauaaugcugguucuuucugagguuaguggucacacacagugcuauagaggcgguuguucuuucuugugccuguaacugcugagguuaaucucucagugcuuccaaaugcauauggacauuuacacauauggacacugaccaauccuaaaagaaaacucaggauaaaucauguucaacuucaaaaguccagcagcuaauucaaagccaugcucuuguagaaggagccauugaaaacaacagagaaaccagacaacagucuuuaacgucuuaucuuuguuuaugauucuuaagaccacaccuggcgugaaccgauaugcuaggucacccugguuccucaggugcauuaggcauaugugagcagugaaacuaugacaaccagaaugcaacauccaauuauaaugauuagaauaacaacaaacacuuaggcaauaauuauuuccauucauucacuucaucuccccaauaacucuacgagguaaguacaauuauuauuccccacuucauggaccacucagugccauacuaagagucccagagccaguaacgagcagacuagauuuaagaucaaccccaucugacuuagggguucugcucuuacuguuguucuguaccuaaagcuaucugauguauuuuaaaauguagguguaucaguuuggugggguugccauaaccgugaguuggguggcuuaaacagcagaaauuuuucuuacaguucuagaaacugaaaguccaagaucaaggcaugggcagguuugguuucuccugaggccucucucuccccuuggcuugcagauggucuucaccgugugugcaccuuccugguaugccuuuguguguccuaaucuccuccacguauaagaacaucagccagaccagauugggacccaccguaaugguuucauuuuaaguucucucuuucuuuguuuucuucuuuugagacagagucucacucugcuguccaggcuggagugcaguggcgugaucucagaucacugcaccuucugccuccuggguucaagcuauucuccugccucagccucccgaguagcugggacuacggacaugugccaccacgcuucccuaauuuuuuguauuuuuaguagagaugggguuucacuauguuagccaggaugggcucgaucuccugaccucgugauccaccugccucggccucccagagugcugggauuacaggcgugagucucuacgaccggccuuaaguucucuuuucaaaggccuuagcuacaaaugcggucacauucugagguacuguggguuagggcuucggugugaauuuuuggggaaaccacaacgcaccccauaacagcagguguguuaacguucuacaaaacgcaacggugggugaauuguaggacuucccucugcuuuaugagggcuuaauuguauagggccuuauuuuggaucuuuccacauucaacaaguucugagaaugugauacuuggaaaccauguucaucagaagagugaaaggcuuucagguaaacguccuuugaucuuuuucaccgugaugcccuccgaugacauuaacugugguaguaaccagcaucauucaguugcuguuuuagaaggaacuuaaaaauggaagauuugaaaacaugauugugaaaccauaauuuugcacugaguccaguauuaacaguuuuucaacagaguuaacucuugcugcuuuuuguuuuaacccugagugucuagaacugaguugggcaagcuccuuaacccacagcacaccagcagccuagaacucuccaagaugucacuuggauuuuccuucugaccugccuuuccugaucccuugcuaccucacccuauagacauaggcuuacuuuucccuaauauuuuccuguacuuuaacgcauagcuguguuuuuaugaaaaauaaaauacugggguuuuaugcucaacuuauuuaaaugauauuucacuacaaauuauguucuucuucuauuuguuuacaucauuaugcuuuugaaaaccaccagaauauguauguguaccucuggaucuaagcuguuaaacauaguagccacuagccacaugcagcuaccgggcauuugaaauacggcucaugcaaguggaaaacuaaauuuguaauuuuaauuuaucuuuaauuuaaauuugaaaaccuguaucuuaauuaugagaauacuuuuaaauauuuuuggaauaucuugaugaaucuucuuuuuucaguuguacauuuuauaaaacuuaaauaugaaucaaucaguuccaaugaaaauuuagccucugauuuaagauguacuauaaaauacacaucagauacugaaaauaguacaaaauaggaauguaaaacauaucaguaaguuuuauguugaugauauacugaaauacuacuuuacauauauuaaauaaaauacagcauuaacaugaucaccuaauucuuuaaauuuaaaaaaguaaaaauaaauuuucuugguacuuuuuuguguggcuacuaaaaaucuuuaaauuacacaugugguucacauuauacuucuaccagacaggggugaucuagguuuuaauuccucuaacuacuacaaguauucuauaauaagcauaaauaauaauuuuacuucauucucuuaucagcaggcaaauagauuguuucuaauucuuuaccauaucaaacaacccuccaaauuccuguuuuuaugcauccucacuaauacuuauuaugaucuuucuuguugcuuuuggucaacuuggugguuauagagcaguguuucuuauuuaaauauucaugucucagaauacugaaaguguacauauuagccauucaaaguuccccuuucguaaacugcccauuuauaucuuugcuuauuaaaaauuuugaauucacaucuuuuauuuaccaauuaguagaaguaaaaagauauauucccaguauaaaucucuuguccacuguuagacguaauuuuucagcuauuauacguaucuccaauauuuucuuagcuuguacuuuguucauuuuucccauaguuuauuucauugaacacaaaucuuuaauuauaauuaaauuccuuaaauuuuaccuuuauuauuucaagaaauucuacccuaguaagaaauugugaagaaauuucaucuuuucuacucuugguuuauaguuucgccuuccauauuuggaucuucaguccaucaugaagcccuauagcacuuagagcagcagaugguugccaacauccuaggcuuagguacuugccauuugagaaucugaacaaaacugaagacuuucuuacugaaagaauguaugugcauaaaauacuauauauauaauuucaggcuguucccagaccucuacugcaagcccuuucauguauccuuaugcaguccacagaauccaggcgcaggauccccgagucucacagauucuacucucuauucaaaaacuucauuguauuuuucauggcuuugcucaccaucuuuuucuggguuaucucauauucucaacuaguuuaugagcuccuuacggacagagaccuagauccaggcaucuccaagauuuuucauggcaccugagagcugggagugcucaauaaauacgccccuuagcaagugauauuccagaaaucagacucagagaagagaaugugguguaaggcccaggggauuacucuaaagaggccuccauuaauucaugcauucaaucaacagucauugagcuuguccacuguuucagguccugggcuacauggaagauaaucaagggaaaggccacaguuuguguccucagaggguuccuauucuagaggggacagcaaaggagaaguaauuauaacacggggcaucaaugcucugcuaaaguaaggaaguagggagcuucuggucugcauaacaggaggguaccuaauggggccuuugagguaggggaagguugggccucucagcaggagucauguuuaggcggagacucacaaaaaugcauaguguuaaaaaaauuaaauuuagccugaggcugucuccguaauuugagucccuaccuaaggaacugcagccuaaccuaacuuagucuauuaaacacaccgaaagccuaauuuaggaugcuuuuuuuuuuuuuuuuuguaacagcagcugagcuucagccaaucacaggcugccaacugaucagaccaugaccaaauaaggugaacaccuagacauaacuuaaggaggaggcaggauuugacugaggaggcagggcucggacaccagaucaaaucaaagacuaccuagaacagggacagaguggaaguacauuuccguaagauaugcccaccacuggugccaugccacuuuaucucuccagcacuuaauagauucuaccugaaccccucacccucaacugcuauuaacugaaccuggaaaucugaguaucuauaucuguagugcauuaaugauucuauauuuugcacccacuguguauuaaugacacaaaaguggagguuucccuucaaugcuuugauccaacucuaagcugccaaguccccaaggcuguaacaguguauacaggauucuacuugugagcaaggaaacaaaccauauauggugacuucucucagauaacaacauacaggaaaaaaauaaaacaaacaaacaaaacaacugccuaaucugggaagguaggaguacugacccacucugugaaacaaagauugguuggguaucuccauuggaacagggcaagaauaucucuacagacccaauuuggcagcaauggauagauaucagauguuguggagccucuauuugcaccccaacuggacuaauuuuuguuuguggccauuaauggggaaaagucauaccccauauucacucuugacuaccccaugagccacuuguuuuuaggaguggcuuucccuuguauauaaaaaacuuggaacagaggugaauguaggauggccacucuugcuucucuaggggucacagucuauaaucccauaagaaccaagaacaccagaaauaaacaagcaacagcauuaauucuagcaggaaucagagcagcaauagaacgaguggcauccuggggcagcuuugccuaucacgaguacacccugaaaaacuagacucaaacucuagaaucccuagccaccaacacaggucauguacuaaagggaauccuagaguccuuagaaucuuuggcaaauguacuucuugguaacucauucugagggcugcccgauuaguugacugcucuuuggucaaacucuguuaaauuaaacuugucuacaguuuuucuuuuaccaguaggcagcucaucugaaaacaguaggagggaaaagagggaauccuagaaaucgaucugucauaaacauugugaacuggcuagagugcuccugccuuuuccugggaaucagaaaguagcagccagacaggaaaccaaaccaccugaucuuuuacaaacaggaaucagaucacuguacugccacauuuaaagccaccaggggcaucccaucuaggaugggaugggaaaaaguaugucuaaaauauauauacauaguguauauaaauauauauuauauauaauauaaauaguauauaaaauauauaaguauauauuacacauauaauuuuuucuuaguauaaguaugucccgcguaauauuugcaauguaacuuacacuaacaaaguauguguuauuuaucagaaagucaaauuuauggcaguuaaaccugccagcccaaagcacuuaaaauauaaaauuacacuuaaaauagagucuucaguauuauauuuucucuggcuuucaucuuagugugagcucugcauuguuccccaugcuucaggcaugcugaccagugagaaugagaauaagaaugccaagcuccaucccaucuuagcaccuuggcuucuguaucuucuuuccauuuagaauguguuuucccucuuucuuagcgugguugguuucuucucuucuuucaaauaccaguuuagaugucaccuccauagagaggccuucccuaaccacaccaccuaaaguaggcuaucccaauuauuuucucucuagauacauauauauaugucaguccauaaacauuuuauucuuucacuucuaaacuguugcccucaccauuaugucagagacuucugccuuuugcaucuuugugucccuagcccuuagcaaaaugucugucacauacgagauacucaacaaauuuuuaucauauaauggaaaucuuaaguuaguauuuucucuggugcuuccaagacaugcauuuugccuagacauguuauuguucgucaugugaacuggcuauggcaaaacacauugccuucagagagaaagagccacacaaguuggaaaggaaaggucacaaggaugaaagaacucuaucaacauuaaugccuuauaaaaaaaucucuuaagagauaccaaaagauggaaagaaauugagucuaucauuugaagacaucccccacccccgcuuuuuugcuuuccugcaagucauaucugagucauaccuaaggcacuuuggcugugccuccuugugguccucuccauuucuuacuacuucaucucaucacuuuaccaccuucaaagaguccuuuccucauauaaccucacaugauguucacaggauuaaaaaacuccaaacguucaauagagaaacaacauuuucuuaaaaauauacagacagacauaugcgaauucuuucaacaugcuuauaaaucuauccacaacccuacucagaguaugcuucaaauguaaaucagaagccauauauauuguauucuuccaagugauuacucuggaaaagaaaaaucacacauauuuauugagaggagaacaaauuuaauaauuuugcucaaucaucaaaaacauuucuaaauaugagcuaugauaggaaaaaaaucaguuuaacuuuacauaugaauuauuuuccuguuuuaaucauagaauuuuuuaaaguuuuggauuagauucaaauuucuucagagaacuaaaugauaaguuugcaaacaauuacuggaaagaaauaaggacaggugagagcaaaagaaagaaaaacgguuacagaguguaaaacuauuuucaagcacaaaguuaaaaacuucuaauacagaaccuggaaaacacuuuaugugugugagauaaaugaaagcguugaggucagauuagaaaaacaaaacaaaacaaaacauagcuucuacugacaaauguaaaugcacccugugauccuguugccaaugaaguggcauugcucugauguaccacucccaucccaacccaagcacacacuugucaaugagcaccaggguuuucaaauuauccagaacucuaucauaaugauggagcuaggaaguucuuucagccucuuaacagcagcgcauuauuuucccuauagauaauacugagaacauggcaacacuucugccugaucugcuuauuaauaauacccaacacagcauuuauuagauagagaacuacuagauguuaggugcuggguuaagcacaggaaaagaaucaacaaauucuacaucauuuucuuuguuguguuggugguggugguuacuguuguuuauaccuucagaucucuuucuacacuaaauuuuuggguagaaauguuuaaauaucauccuuagccuccgcaauaauaauagcauuucaucacuaucacuggugagaaauuuguguuuuauuuuuguuuacauuuuacauuaagaaauuaaugaagugggaauggcuaccuuugcuguauacuccaaacucccacugaucuguguguggguugcguguuugucuagagaggacaguugcccaacacaggaaaaaaaauacccugucauuauaugauuuuucacagaacuaaaaagaaauaaacuacccccauuccaaagcguggccuccuaucuuuuugcuacaccucauauacuuuucucacauggcaagaaggguacccuugacugcucagugccucucccuccucuugaugcugagaugcuccaaaacaccacugggguucuucaggagggauuucauugucaacuccagcuugcaguacagggaagugacaucuagagugggccucuuuuugucacuuuccccauacuaccacacacauaaaaaugccugucaaacacuguccuacauacauggaugagaaaaagaaauaagcacucuacuaugaaagacucuaacuagaaaaagcaaggagaugccaacugacaaauguauggugauggacuuucuuuuuuuuuuuuuuuccaauucucagauuuauuucugaggcucucagccaauuucugugucauaaagauggugcaguucagagcuuaauugcuuuagcacuugcaccaagaaaaacuguauugcaaacaaugaagaaagaagagaggaaaccaacauuuucuaggcacuggccacguggcaaccaguguacaaggcauuuagagaaagcuuuuugauuccauucaauccuggaaaccaacauguugaagggccagauuuuucaccauuuuauagggaugcaaacuuuagcucagagagguuaaaugacuugccaacagucacacaacuagcacuuagaggaacgggaaggcuaacucggagcugaugcugcagcuuacacucacuccccacucccacgcaacacaaacucuuucuaggcagcuucgaagguaccaaacaaguggcuccuaaggacucaguaaacauuccugucagcuggccaagaugaauauuuuggauaauguccagacacgugaaauaccagcuuuaaguuguggaagugcuucaggcacaaccaagucucauuuacguccuuuaaaaaauagucaugaccugcccccuucacacacugucauucuucuggaagguaucugagagcacagcucugcaaaugccaagagcauuaugcaguuuccauacauagggcuuccugagucagguuuggcagggcagggguucaguguacaauauuucugccuuauuucuuuaaguuucucuuggcuacagcucuuaagagacacacagagggaauggauucuguagaagauuucucccagaaauuuugguguagauuagaaagcuugguuugcuucugguucuauuacuugagauuuauuuggaacuaaaagguuuucugccugagaguaaccauuuaauauauuggggaggggggaagaauaaaaugcuccuuuuguuuugcuauuugcaccacccugucccgauucuauuguuugcaguaaguuuuguaagagaaacucuucugcacuccuuauuguguuacaaguuuagauguacccaaaccaucagcaguuagauuccaaguauacgcuuuugauugauucaagugcauuacccgggagggugugugcuuugcucuguuguucuuccagccaacucccuugccagcugcugaaaugaugccaccaccggucuccaugucaugcagauuuuacacccugauaccaggaaagcagaagcauuucucaaaagacuuuuugcuggcuuggcaggaaaacagaaauugcuuuuuaucaaaaugaaaaagguuuucuucaugggaaacagcaaaagcaguuugaaagaggggccaauacuuuuauccuagauaagguguuuucagcagagcagacagaaaaacauguuuuccuuccuuucaugacaucaaucagauccccaaagccagcuaccuuuauucacagaacagauggagcgguaauggucccagaggccacucuuccuggucuggggaucuugccaucccugccugaaaguucucaaauccaagcucugggaacuugggaugcuuuuuucugccucucccacacuccaagaggaacacauccacuauuaugcaugucuucauucuuuguccuggguggaacuucugggggugggagaaugggugauaaagggggaagugggauucacuuugugaacaccuacuagaagccaagccagguacauccuaugcauuauuucauauaaaccuuaccacaaaacuuugagugguauuauuauguccauaugacagacgccaaagaaguagacuaggggaguuaaaugaaaucccaaaagucauauacuaauauguggaauacuaguaaaaucuggaaugugaacccugccuggucuguugcuucagagcuuugaugugccaccaacaaacacuuccaugccucucugcuuagaggcccaguuuaaaaugcuauccucuggauaaauaugugguagguccauacaauggaauauuacucagccaugaaaaugaaauucugacacguuacaacaugaaugaaccuugaaaacauaagcuaagugaaauaagccagucacaaaggaugauauugugauucugaaaccaacccaauaaucccauagauaguuuuuuggauagacguagaaauugaccuuuguggucuuaaugcuugaaguuuauauuuguuuuaacugaguuccuuccucaggaaaugaccuucaggccucucgaaaaaaaaaaaaaaguauuggcaaacugaaacucaccagaucaccacauuuugacaaugagaugcuggaccccucauucucaggauugcuuccuugccucucccuaguuccuguuuucuuauacauuauuacauuucuuccuggcuauauaaaccccugguuuuacauagucugguuuuggucagggaaauggauuugagacugaacucccuucuucuuggcaauacucaucaucucagugacugguuuucugcacggcaaacagcaggaccuagaccgaaccccuaguguuuugguaacaauuccacuucugugagguaccuagaauaggcaagcuuacagagacagaaaaguagaacacagauuaccaggggcugggggagggagaaaguaguccggggaauagggaguuauuguauaaugaguacagaguuguguuuuuuuuuuuuuuuuuuuuuuuuuuuugagacagagucucgcucugucaccaggcuggagugcaguggcucgacucgaucucggcucacugcaaucuccgccuccuggguucaagcaauucuccugccucagccuccugaguagcugggauuacaugcccagcuaauuuuuguauuuuuaguagagaugggguuucaccauguugggcaggauggucuggaucucuugaccucaugaucugcccgccucagccucccacacuguugggauuacaggcgugagccaccgugcugaccguguacagaguuucuauuugagaugacagaaacuucuggaguuggauagugugaugacugcacaacauugugaauguacucaguaccacugaaugacacaguuagaaaugguuaacaugcuaaauuuuauguuauguguaguuugccaucacacaaaaauguucccugcuuuucccuuugaaagaugccacaucugcccugauuccaaagcucuuucuuagaauugacucccacuagcuguaaagugacacaaaagaugaucuacuccaggcaugccaacucaaauccacugauagugacagcuagcaacacuguguuaagaaagauuaugaggauguuuucagggccaaaaaagauaaauaacaugaucgauuuguaaaaauccccucacaaugagacaucgaaauguuggauaaaauacaacaaaauauuaauuguucugggaaaugugaauugggaaacacagaccaaguggcaaaagcuugggcagagagucaugguauucagaggccaugauggucaaauacagguugaucuucuaaaaacauaggaaccgagugaguaagaaaaucaaggcaacuaaaacgaagaaaauguuacaguagguagguagucaggcgugauggggcaggagagggcccucccaacacccccaccaggaaagccacgcuaccaucaggugauggucaggugguuguuaacucucuuuaaaauaauaauuugucacagccagcaccagggaaagaccgucuuccuauauugauaggaaacaccuguaacugguaaucagcaguuuucaggaguugggcgagugagcacaagcaugcgcauuaagagacaaaauggcagaauaugguuuucuggggcauuccacuggaaaagggaagaaagccucaggugggcauacauacaacuucuuaaacacacucacaugcucaccucccacauguuagcaggccacacacauguggguggcccaccuuaagagaagaaccaugggaaaagggacacaaggcccagaaguacaacaacauauaaaacccacgucaaaaggucaaacguuacaugugaccuucacagugccugcuugggucucuuccagauauacuuuccuuucuuuccugugcuaaagcuuuuuaauaaacuuccacuccugcucuaaaacuugucucagucucuuuuccugccuuaugccccucagcugaauucuuucucaggaggcaagaacugagguugcugcaggcccauaucgauuagccgccaguaacccaaauauucauugcccccaacaaaaagagcagagguuuucugugccuacgagguucaugaaugagggcugccuagagcuccccccauucuuguugggucuccccuucuaguacaagacuccuuguagcuuugcaauaaguuuaccuuuuccuuauaaaacuuuacuagcuauucuucaaaucgacaaugguuugacuucaacaggucuucauggggugaucacaucaugugucauccauagaggguaauuugaacuuauaagcauuaaccgugcuccaugaguuguuguuuuuuguuuuguuuuguuuuccuuuugcuuugauaaacaacauacccagauacaugggggaaaaaugguagucauccaauuucuucauauugccagacucacagcaacaggaaagugacguuauuaacccuggggagccucuauaacuucuuaaaccauaaacaaaaauaaagaacauaauggaagguauaauugguguuaaaaaaaaaaacccaaauguuuucugaauuccauccucauguuacacacucaaaaaguuucucuguaaagaaagaaaaucuuugacucaagaaucaacuuucuagcuaucucaaaaccaaauuauaaugaauuuagaccguagaaucaauacugggggacuaacuaaggaucacuaaauccuguguuauugauugcuuggagaaaacuaucuuuuuaaauaugcaucacauaacaaaguucuuuauuucuaagaacuuucuccaaauccucccaucacaugguuuauguaaugauuaauccuuuguauuaacuacuuuaugugucagaaauauuaaaaugcauauuaacuguuccugggaaaugguucugcaguuucuccuaaaaguauacuaccuacuuugaauaaguuacaugaaaacuguggcacauuugggaagaaagcagcuuaguaggagaaaaaugagauuugcaauuauaagaacucaauacaugggugucuuaggcauuuccagauuuuaaaaaaguauaaugacuuuucucccccagugugauaccaaaaucaauggaaugguuuugguuuguuuucuacuggaguguaccaguuagauuuaaucacagagggaaaaaucuuguuuugauuucucuuauuaauuacuucuuggaaaaaugcacuguagcauucuuauucagaauuucaggaacaaaaacuuuucacuuuucaaacugcaaaugaaggugggguaaaugugugaaggagcuaagaucuagauauauuagaguuucuaucucugaauccaggaaggacuuuguuuauagugguggaaaucaagcaaggagcuauugguugguccacacaaugccuagguguuggcugucaugcuccauucagacccacaaucccaaugaaaccugucacuuucaagagugcaaauaauaggauggggaaagaguguuagaguaggacguuuucuaacaagagcccaguggauuccuaccuuucaucuaauaaauuucaaugguuuaagagagcagauccauaggugccacacagcgaaaggaccuguguaaaaaucacagugagacucuggaguaagagauggaaugugauggcccgaggcccugcccuccaaccuugaguccacaacauacgaccucuuuaaaaaacucccuccagaagcccuacaguuuccucucugguuugcgucuuacugcugaagagucuguuuguagagauggauaucugacuaagcuagcuuuccuuuuuuaugcucuuucccucaagaaccaaggguuuuucacauuccaaaauaaaaugcaaacugagagcauuuuguauuuuugcauuucgauucccuguuuugucagugaguaauuauagcaaauaaaauauugcagcugaauguaaauuguuaggcaaccagaucacagcaggauauuuuucuuccacaaguuuuacaucauagaguguuaaauauuaaaauauugcaagucaaguaaacagagaggguucuuugcucaaaacauuaauuuuaaacaaacauuucacuguuauucagaucggaugcuaggaaacaaaugacauuuucuuucaaauaaggugaauagaucauaugaaaggaaagcagacaagggaaucauacagaaggaagggcauuuaugacacgagagaugaauuucagccagaagaacaggagagaauucacauguaggagagaaagcaaaagaaagagaaauuggcaaaacaacauggaaaagagcaagaaaugagaaagacugacuuacugcuagaaggggaaaaaaugaagauacgucucaugucagaguacagagaccugacucaaaauaaggcagcuggggaagaaaugaaauucuuucuaacaucaugaauuucuguuuccuuagguuauuaccagaaagguagaaaggagaugaauuuucagaccuccaaaagaucaccaaucaauaaaauaccaaucaauaagcauugauugaguaccuaaugugugcucaacaaccaaguacaaaauuagacauggccuucuucugagguaccuuacuauggaguugagaugaggagaugcugaaacaaugaaugagaguggaaauguauucuaugcuguggagugaagaaaacacacagcucaggauucaaugauaaugacaaugagggugguugagaguaacugucguaacacucuuauuuucuaagcaccuccuacauuccaaguacugugcuggaugcuuaauauuuucauuuccaacauuuaaaacaauccauuaagaauuaucuccucuagugaagaaaauaaagcuucaaaacuuaaguugcuuguauuacacaaugaguaaaugguagggccugaauuuaaccccaggucucccaacccaaagaucacgaucuuucuucuacugaagugcuggauuuauccuaagaaggcauucuucuguuaauccuuacaccagaaugccagcuaauuaaaacagaaacaaaaacaaacagaaacgcuguuugagaaauguucuuuguaagggagaugaccuaacaugaauuuuuggaugaaauuauaauggauauggaggaguuuuguuuuuuugguuugagaaagaaucuucaggaaaacauauagaauuugcaggagagucauguucauuaaaccaucucagaguuaaagacuggagggaauagauguuaauagccauaaaggccuugcagaaaaaggcaaaccuucuuuuccaguaggagagaagaagugaaaagggauggaggaggagaagagucaacugaggagcaagaaauguuccacaaugagaccgcuucacaauaucucccaguucacaacuaaauuaaaauaaugccuggggagaagacuguuacagauacaugcaaacaaauugcacauccuguuaaguagggcaaaacagacacuuggacagagaaaccagaggaagacaaaauucacagagaagguggagagaacuuuaacuucucaugaacuguggaauugguaguuugaguacauuauaguuagaucuccauugagcaacaaggucccgacugacaucuggucuacaagaucaacuuucuggcaauacgguaaauuuuuugacaguuacuaaaugagacugaauauaagcaaaauaaaaaucaucuuguguuucaagaaacugauauacuccagauacaucaccauagcauauggagauuucuuuaacuagaaaaaauaguccauccaaauucacauugguugaggaagccagaacacugacuuauccauguuuaccacagcucaucugccuucccucccuuaauaaaagcagaggcccagagugacugccaaacaaaaucuaccuaaaaaacaugccauucaauuuuuuuagaaggccauugaaagauaagcaaauuaaauuaaaagaaaggaaugaagagauuuuccuucugucugguuguugagagagaacauuucuugcauauccagcauuuggcaaucucuuagcaaaauggcaaauucacaaacccuuuaacccagcaaaugcauugcuaagaauuugcccuacagauauacuuccaaauaguaugccagaauuugugcaagaauguccuuuguaguauugcccauaaaaacaaacaaaaaaauggagaagaaaacccauauaccauccauuggguuaaacgcguuuugauuuaucaauacaaaacaauauguacagcuauuaagaauaaugagguaggucugcucuucaagauauacuaugcuuugaaacaagcuaagugugaagaauguauauaauaugccauuuaaguaaagauuuuaaaggcuccgugucguuuuguuuagaugucaacaugugcauaauuucuuuuucugaaaagcuacagaagaaacuucacaaugguaauauuuggaggacaagaggccagcaugucagagaagagaaggaaaggaaaguuuucauuuuccucuuauaccuuuccuuccugccugaaguuauagguauggcuaauuugauuuaaaucaauaauauuaaugaaacauaaaaguaaaauaauuaccuaguaauaauaaaacuauguuguuuauaacucuuauuugauguuuggauucucagaauuuacuucacugaacuccgaaaugggugguauuuuugaaauuuuuagcugcaaugaaagaacacaguauaacugaugcaccccacccccaaccaaaccacccucauaccuuguccaccacugccaucucuaucuugcauuugaaaauaugcagagaagacucuguuuccaugcuacagacaguacuucuagaauuuugaccgcauaguaaacagucauuguaucauccacacccugaaugaugagggacagggacagacagaaccuaccuaccaugugagcagcucuagagcugucauagcuauagcugacucuagcucacaaagcagacaugaggaaaagcaaaguuugcaugugcacauacacacaacacaagcacacugagaaugaaggagaacaaugugagacuauacuggucaaagaguauuuaggaucugccaaauaauccaguuuuguuuguauuuucauuuacaucccuuucaccuuaaccauuuucacaguuaucaacucucuaauacacugacacaugcuguguuaggcacuucgcaaguauuaucucauuuacuucucauuuaaaaugccauugguuaauaucauaaucuucccauugcauaugaagaaauugacacuuaaagauauaacacuuacccuacucaaagucacacaucuacaucuagcaagugggagguggcauucaaacauaaacacagcuggccucaaaggcacuaugacucacuguauucauuccugauucaagucucaugccuugcccugagacuguucuuuaggacauaaauugggcaaagagcaaucaacucacaaaaagagaagaccuuccagaccaaaacuaggaaguuuggaaaaaugagaaucaugaaaauaugcguauuacacauacagccagguugaagaagacagaaagcauuagaauguggaggaaccuuaugagcuagaaugcuuaguacuuaaagaaaugucuuugggaucagccaugcuccugggaugaauccugaccuggccaugaucuaacugucaccuuaaccaugucaccgagaggcuuaaccugcacuuacuucuuucaucuguaaaauggauggcauaauagugccugcuucacagaggcauggugaggguugaauaagaucaugcacauuaaguaccuaggacccaguaacucucuguaauuaugcuguguuugagaucauaaagcucuuaaucauuauaaaaguaccugagaaauucuggaaugcuauaacaggaaaacuucugaaaauauagacuaccccuaggcaagcccuuuguuuuacacagcaagaaagugagaccuaaucaguuagaggcaagaugcuucucaagucagucuauugaguuuuuauuuugcacugaauuacacaucuacagagcuuccuguagcaggaaacucugcucaguuugcccauugcucauuccuaacaccuuuuucuccugccuguucccaucccauggccaacuacucauucucucagaccaucuugaagccagugaaaaucugcuggggaauacucgggggaagcauaugauuuuccaguagcaacacugcugcugccaccucucucccuuucuuccuaccgugaauuugaucaugguuccaggaaauaggguggccaucuugcaaauaggcagauuaaaacaaucacuaagacacugccuaccuccaggaggucuucuuguuaccaaagaaaauacaccccuauuuuuuuaagcaacuguuaaaggcaggguuucuguuacaugcagcugaacucauucccagaaaaugauagaaguccuuuuuccauggacauugacacagucuaggaugggaugguggggauaguacaggguacucaccagcuguuggagggaaauccccagguugugagagcucuuuuauuuaaaaaaaaauuaaaauguaagucaaacucaggcuuaguuuugaaguucauuucucaccuuguucucauuuuuaucuugauacuccgaaugaauuucccaacgauaucuaagagcuucccauucccaggcugguccagugauuuuuagugaaauuagguuuuauugaaagugaguugauuuuuacuuauuaauguucugcuaauuagagcacuuugucaauaucuccaugcaugcauuauauucucauguccacagcauguguuuagaaauauguggauaacaagauggagaguuagacuguucuggcccuaaugaccucccgcccucucaaaacgccaacauaacuucuggucacguaaucaugggccaccuuguacuguucacugacuauuuguuauagguugauuuuaaucccugacaaauuuuuuuuuuuuuuuuuuuuuuuuuuuuuuuuuuuuuuuuuuuugagauggagucuugcucugucacccaggcuggagugcagaggcacgaucucggcucacugcaagcuccgccucgcggguucacgccauucuccugccucagccucccgaguagcuggaacaacaggcacccaccaccaugcccggcuaauuuuuuauauuuuuaguagagacgggguuucaccguggucucgaucuccugaccuugugauccgcccaccucggccucccaaagugcugggauuacaggcgugagccacugcgccugacagacaaaauuuuuaaaccugugaauacugacacagcgcuucauguuuugcuagucacucucagugccuaucacagagguaggcaaaucaaaaauucucaugaaguacuagaaaauagaugcaccugucccccaaaugcacagcauaagaagauacccagggacuaaaagcucccaacuccaaaauaaaccuauucaugaacaugagucucuauuccuuugcucagggaauucagugcuaaaguagauagcaaauauauuuauauuaggggaaauaucuaaaaaauggcacuuauagauacauuugcuaaauagauauggaagucuaucugaagaccuagcacuaugccagccauacaacaaucucuucacaaauauguauugaaugaaugaaugaaugaaugaaugaaugaauaagcacacauacacagcagaaaaacagacuaugaaugaauauauauccuuuccccuaaagaaagauacucuaaaacaaaugggcagucaaaacuacaaucucucauuuaacugggaaaaguaaagaacccucuauuucaucuuugauuuccuccuuacaugauguacaaugcaaagggcuugcuagucauauuugucaagagagcccacagguacuaucuggcucaucacagcuuaacuuaucaauugccauuguuguuugguggauauugaucugggaagaccuuguaucuugcgaaagucacuucuacagcaacucaucacuuuuucuuuuuagucgacaugaaggcucaaguguugugguauacugggaauuuccacgcgacagccccauuccaucauuaaauacccagugagagcuuguuaacuagaugaaugucccaauuaaaccagcacguucuugucgcugccuaacagugaugguggguucagacuaacaguuugaagggcaauaacuaaaaugguuugaggagccucaaguguaguuucaaugguuucacacuuauccauucauuuguucauucaacaaaucacucaggggcccagcaugguggcucacaccuguaaucccagcacuuugggaggccaagguggguggaucauaugaggccaggaguuugagaccagccuggucaacguggugaaaccccgucucuacuaaaaaaacaaaaauuagccaagugugauggcacacaccuguaaccccagcuacucuggaggcugaggcaggagaauucuuugaaccaggaggcagagguugcagugagcugagaucgcaccacugcacuccagccugggcaacagagcgagacucugccucaaaaaaaacaaaacaaaacaaaacaaaaagcauuuuuuuggcaggucccaaugucuauuuccaagcugaaaauguuugcuuucccaaaggggcauaaaacugugauuuuucuuaacagcacaguuuaaguggucuugacucugcaucuuaaguucccaggguuaagcuggagaucuugagaacaagaaaagaguaaaaauagcaacagugcaaaacuccagacaucauguuggcuccauacggcuguguggguugugcacugugcaaguucaguguguuccauuacuaggaccaugauacaaauggcagggaagugguagaaaccccacccaagggguauccuaggcccauagugcucccuaguacaagggccacaaacuacuaaauguccaaaaucacaaguaaaaacuguucauuuugguagaggaaauacuugauuucauacacaucuaaauuucacaauuaaagucucaaauaaaaagcugccaaguaaaaaugcucaaugaaacauaauuuuuuccucuaccugauuuuuaaguaaaacaggcaaagaagaaacaaggcaaugauugaauagaaaugcuauucuuguuuuaaaaaaaauuagacgguccuaagaaucuaugcuaaaugauuacauuaauaugcauaaaauacauaaaacauauguacaaggauguuuauuguaagacuguuucucuauuacuaaaauacagaagugguuauauaaauuaugguacuuccauacaugaaaugcuauuaagucaauaaaaagaaugaguaaacuuguaauugcuauccuaaggacaaagcuccaaaacauacucugaaagacaaaaagguaaucauagaaaaauauaauaugauccuguuuauaaucaaaucuagauaauguacauaaagggauauuaagucaugaaacagugcuuggaaagauacacaccagucaucugacaguaauaaccuaugaagaugaacgaggaaguagagaaauuucauauuuuauauauuguaauuugaacuacuuuuuuuuaaauaaugaaaaguguuuguguauuaaguguauuauaaaaaauauccaaauaguucaaaaugacaguaaauuacagguuauguauaguuuaaucccaaccuguuacaauucaugacaaaacaaaugguuuaaaguuaaaauuucuaauguaaccuaugucaauuacacauucugacaacauauauucauugagcacauacauuacauaaaacacugcuccaggggcugcagguccagcaaagagacagguaaggccccugcuuguauagcgcuuuuguccaagacaguaaaagagacucauauauuuuaaagagauuuucaguuaaccaucauuuucauaguaaauaauucaacuaacuaugacauuuugggcacuguggcugagagguuugcugugacucuaguaaaguuucuucuuggaaagacauucugugccauaaagagcauucccugccuaucaaauauucauccuucucagccaucaaucaacugaaguucccucaaacagaauccauaaaacagucauacuuuccauccuuagagggguuuacaccuuuccaagcacuuucacacaucuacgguguccuaagagaugggugacuaagaugcaggagcaaaauaauauaaauuuaccauauaaaaacuuucuucugucuagcacacuuuucuccucgcucuuuacucgcucaaguuuugcugguccuucaguuugcaacuuagaagucaccucuuccagguggcauuccaggcugguauagggauccccccuacaugcuuuuauugcucccuauugccuccauucccucacaagguguggaccaugcugcuuugcaaugaccaacuugguggccacauccaagucacagggcucaggaucaccuggagugcccuggguccaaacucacccucaagaacugacucaccagguaggugaguaucugacagucauauuuacagaagcucuccagguguucugaagcaguuaaucccaagauaugaugauggagguguggaccaugucugucucuacaucaccaucauugaagccacggcuucugacagugccugauauauugcuggugcccaauaaggagcugcuccuuuaucuacugguucuuucaaaaaauauuuacugagcaccucagcaugccagacuucuggugaaugacaaaaugaaccaaucaugcaucaugacgaugauacagcuuucauuaauaagacuuuuugaguuaucugauaccugaagcaacuacaggaacccaauccacaccugucccucuguccccugcuggguagauuagggaagacaaacaaagauuugggagcuuuugucacauucuuuaggugcuuccgggaugccaccaguggguuccaacugcucagcuauguuuagaggucacaggcaaacagagugggcccauugcagacugcgaggcagggugccucuguucaauauaaggauauaguccaugagacagaagguuauuacaaugagguugccuggguuuuccuccccaguuuuauucuguacgccuuuuagguaaauuccuuaauaucuuucuucaaaauaguuggauggcauuugucuuaccuuuaagggauucggcuaaaauccacuugagugcuggcgccuaggcagggaacaggcagcaauuccuacagguccaucuaccugaugacaugaagacuaguuuaugguuaacaaacuguuuuucacucucuuuagaagagaaaucucugucaaaggucacauaaacuuuaccguagucagcaaagccccuucuuauaggauccucccucuauauuuccacccucaucuagcacugucuuccuugcuugccaugcccuaguccugcuguaucaauagaguagagccaccagccacaugcggcuccugagcaccugaauuguggcuagcccaaacugagauguaccagaaguguaaaauacaacccagauuucaaacacuuaguacaagggaaacagaaggugaaagaauccuauucauaauuuucuacacagcuuauauguugaaaucauacuauuuuagauauaucgaguuuuaacaacauauuauuaauuucuuuuacuuuuuauggugacuaccggaaaaacuaaaauuacacaaguggcuugcaucauauuucuaccgggcacugcaaccgugucuguauuggccucuugauuucuguacuauaacaagcauuucccccacuucugaggcuguguguuuuuuugucuucacaugaaugacucucuuuccaugucuggcaugccugacugcuguucacccuucuaaaugcagcuuguauagcaucucuggaauaagacuuguugaaugucuaucuguuuaugaccugcagcaaaguuagccaaaaugcucaaaagggggacagaauugucugcccagacuuaaggcuggggcuccccgaagcugacuuuccagugauaauaaaauguccccacccaaaucucaucuugaauuguagcucccauaauucccguauguuaugagauggacccggugagagguaauugacccaugggggcaguucuuucccaugcuguucucaugauagugaauaagucuaaugagaucugaugguuuuauaaagcggaguuccccucuacacaagcccucuugccugccaccauguaagacguuccuuugcuucucuuuugccuuccaccaugauuaugaggcuuccucagccacguggaacugugaguccguuaaaccucuucccuuuaugauuuaccaagucucagguuugucuuuacuaacagagugagaacagacuaauacagguaauaaagacuugaaggacaugagguaggaaggaaagacaaagguagaggaggagaaaccaagaguguuaccaagccuuagccugaugacaacaggcaguugcuugaagagagacaaacacucuugcuuuaagaggaauaaaucaaaguggcuucggauacauuaacccuagcuugucauuugagaagacagcccuuuauauuuagaauggcuaggaaagacuccuucuagaugauuuggugcuaauguuaagaacaucacgcaagguguccaguucgauggcugucaacaccuucucuaaaccuuguggcccauaccauaucaacaacaaaauaaagaaaccaaccaagucaacaacaacaaaacaucgucaacaacaacaaaacaucaccaacaacaauaaaaauuagaauauuuaagagccugugcaugcuuacuuaugugcugggcacuguuuuacacauuccauauauuaacuuagucuuuccaauuaagucuucaagguagccaccguuauuguucccauucuauagauggagacugaaaccuaaaaaagucaaggacuugcccagcaucacugagcugguaaguggacgaucaaagauuuaaacauaggcaguguggaucccaagccugugcucuuaacccuugcagcauauaccacucuacaucuucuguacuauucucuauugacaguaucuaugaagcuagcgcuucaugguaucaggauaugauacuuucuuaauuauucauuauuuugucuauguaugccuucuuuucccagcuacagcauucacuguuugaagggagagauucaaccaucuccuucucuggaccccacacccaacuuauccuguuauaggcucauggucaacagaugacugcacuguguuacuaaaugccagggaauacacagaaguugugacugcuuacauauucauggaagaaaaccccaacuccuaucauccaaguuugaaacuaggucuucuuuccuauugggggaaauuucugcaggugugaguaauuagaaaauuaaacauuaauuaacaauucaagugacugauuguguuagcaaguugcuugcuaaccauacagguaaauauugugcccccauaugauguuuaaaaauaaggucccuugagcauauuaaguaguagagaugguugacucaagauucaagaguuuccugaccccuuuaauaugucacauuuuaagucuguauauaacaaaacuauugggaaaggggauugccuuacucacucaccuugccuuaucaucuuacaaaauaucuuauauuaaaagagagaaaaggaugacagcucuguaucuaucaccuauuacucauuauccugggacaacaaacagccccagaaucuuucuuuaaugaauauaggcucucauaguacaugcuuauguucgucucacguuugcucucucucauuucaaaacccuauuucucuucugcccuuuaugucuucaaaagagacgcugauauuaauuaccuugcuucucuaaccccucaucguuuucagccccaaacaaucagcuuccugcuuuuaaucuucuaccaaaucuauuuucucaugaucuaccgaagucacccuacuaaguaaguguuucuggaaagguauuuucagugcccauuucccuugaccaaccuguggcccuugacucacuggaaaaaaucacuccacuccugcccuuuguaauauuauucucagcuggaauucuagccucuguccugcaaccuccagcuugauuuuacaauauaaacacugcuacuuccuaacaaguucaccagauauacgaaauaacccuguauuucccacugaaguaaauuagauuguuguucaguaaauauucacucucucuuuacuucuuauuccugagaggaguauacugucacauuccuuugauaucagacuugauuuggcuuaagacaugugaauggagcaggggcuuaaaaugucaugugcauuccugucuuucacuaugagaagcagaugucuuaguuuuuugcugggucuuggagggugacagacacauggacuuaacucacacccuauagucaaaacaagccaagcuggcccacagacacaagaaucagaguaaaugacucuuauuucaauccaccaaguacuggggacaguuugguacacaugaguuuuaugaaacaguuaacugaugcacccauacaaauguuaaaccuuuguucacuggaacaaagguuggaaguuuucuccaaccuuuguuggauggaaauuuucucuuguuccucuacuucuaugguauuaccucucccaugccacuucucuaacuucauguccuguauucucucccuuauuauguuuuaaacuccuuugaagagcaaagcaucaaaaguucuuaucccuagacagacacaaauuaaaauuugcuuauucauucauucauucauucauucagcaaauguguggauuuuagaaaugaguuucugucucaaagguauuuaauacaacaccuggcucagcuucauggacuagagacacauuaucacugaggucacguuguuacuguuuuugcuacuccugcuaacuguuccaaaggggaaaaaaaaacaacaugcacuuuaaaagcaugauguucuuguuggcagaaauuacaauaguuucuucucuugguguuuacucccccaacacuuuccucagcucuuuauuucugauauucaauuacccuuuuucugccuggcuuuucucacuuucccagaagacuuacccugggaaacuuuacuguuuucacugguguacauuugcacuaguugguuuaauuaccaagugaaucuacagccucucagaacauuugacacgucucccuuucacuggauccaagacaugaagcaaugaaaacgaaugggugaauguuacagcaaacucaaccaaaauuuauuuugccuggauucaaggauuaggcuaacaugcuagccaguuucugccccccuaaaaugucacccucuggaaugacaaaaaccuuaauaagauuuggaaccaaaguuccuaugaccagaaacugcucaacauauaugcgucacacacaggaaauaaaggcacauuuuaaacuagagcugcugggucaucuuuaaaauagcagacugccugucaggagaaccaauggaauaaucaaucacucaauuuaaaguggggagcuccuuuaaaaugcuagggugaugggguaugggcacaaagugaauagcugugacaguacaguuccucagccaagauccacgaauguaagcaccagugggaagagcacuagaccaagaggcucaaaaauauacugugaccuucaacuagucacuuaacaagugcucauuguaucauuuaaaaaauaauacaauagaacuccaugaauccaauuaaauuuaauuccauauuauucgaguguuuguuuaaaaugauauuucucaaagcaauggucaaaugaguuuggaaaucaguagauuaaagaagguuaagcagguuucuguuccaugcaacuucucaguaacuuuaauagucuacugugcaccgugaagcucucagaccugguggaugugguauggaacauuccccagacuaauaggaaucaaagauccuguuuguuuaccauggacagccuuguagaacuccuauucucuauaauacauggccaucaauuauagaagacacagagauacuaaagagaauaguuuucuuggguccugguccugaggccuggcauucucaugaagcugaguuuaugcccuccccugugauuuaugccauaccucugaauccuuauaaugaugucccuuuuugaucuuaagauggcuuuaacugguaacuaucauuuguaagcaaaaguaccuuauuaaacaagaaaaacagcuacgugugaguucugaguaaauauugcuaauuuaugucuaucugcaauuguuacuugggcugaaacaaaaguuccagguaaguaugauagucauuuugccagaggagccucaauaaucccugagcugaaauacuuucauacaucaagacguaaucaucuaauauuaggaaagccauuaagaaauacaauuacuacuggaaaugaagaccuuuuacaggagaacagacaugaugguuuuccuuaaaagcucuucccuuuuccacauccacuuucuucuacuuuaaaaugaaagugacuucauuuucaagugaccuuuuauaaaguccaaacaucaagugucguaaauauucuaaguauucagaaugagguccaguacuguaauauuaaguuggauaugccagaaacucagaaaagccuauuucucuuuaaauagccaacuuauaaaauuauucauauugucuuccuggauucccauuauguuccucgugcaagaaagugaaaguguuuuauacaagccacacugugggguaauauggccaaacuaagagcuuucagaaggauucuucucuuauucucuacuucugcuucugcugcugcugcuuuuuuuaaacaaaugagaucagaggcauacugugauuagcaaugcauguuuauguagugagacaccagauuagaaaugauuauuaucaugucaccuaacagagugauaauaaugguacucugagaugguacagcucagcuguugaggauuccuacuacaauaauuauuuuaaaauuaauuuugaagagaaaaaggaaagaaagaaagaugauugaaaccauuaaagcaauccugauaaauaagaaaaaaaaacccaaacacuauguuuuauuccuaaggcaagcacaaaaaauaaaauaaucaccaaagugagacacgacugacugaaagguaaaaggaacauucauuuuccccauccaaggaaaacaauaacugaaaacaauuuaaggcaaaaaguuaagcuucuauucugagcaaaggagaguuggacuguauuuaugugcuaauaaucuauuuauaagaaauaacugauuaaauaagauagauaaaacuuaguagacagaaauauauuuuuuucauagcaaacaaagcaaucaaaagagaaguguugcugaaaauauugacaauuaaaaaucauucaaggacucugaaguauauuucaggcagaaagagagcagccuaaggaggacuuauuacaggauugaaagcaucaccgugaauucauaauuuuuaauauauaaacugagagauauggaaauauauauauaguauguguauaaguacacaugcauauaaauacacacgcauguauugccuaccucuacucacagagaggcugaagcaaugauaccccacuauaaauuagcauaccugauguccagaucuugguuucuaaauaccauucuccaaaaaauaaaaauaaaaaaggaaccagaccuccuuggagaagugguuggcuccauuaaugggacaggacaggaacaagaugagauuagaauauccuguggugccacaaaguuacaaauggcuaaaaaaaaacaaagaaaaaccaaaauuguggggacaggucaaaagaacacaugaaccagaaugaagggauuccccuggcuaaauagggacauaaaauaaaauaaaaacugauaauaucccagagacuacagaauuaaaaaaaaucuacgauuuuacuucacacacacacacacacacacacacacacacacacacacacacauauauagaggggggggggaggauacaaaguaacauguaggaugaacaagucuagagaucuaauauacaauaugaugacuacagucaauaaaauugaauuagaguuuuuuguuaaauaaguagauuuuagcugcucucuucacaaaaaaaguaacucugagauaacagacguugauuugcuuuauguaguaaccaucuuauuguauauauguaucccauaucauacuuuaaaccucaaauacacaaaauaaaauuuauuuuuaaaaaaaugggaggugggggagaaaagcccuuccuuacagaauuucaagucauaaauaaggaguaauuaaauuagaaaguuaccauuuaacaaucaucacaaaaguaacuguuucagguaagaaucaguaguagugaaugcaaaaaaagaauggguaaaaguauaagaaaaaacauacuacauuuucuacaaguauauuccuauaagauacuuauugauuacaaaaggaaaaauagcaauuuuccaauggagaaaccugguagacaccacaccaaccaagugaucaaaguuaauaccaagaaugggagaaaggagcaucagugucuccugauauaaugcacuaagaaggauauaauacuaccucuguaggauucuggccaauaugcaaaaucugauucuaaccaugaagaaaugccacaucagacaaacucaaauuaagaaacauucugaaaagcaauaggcugugcuuuucaaaaaugucaaggucaugaaagacaaagucuggggaauuguuugagauuaaagaacacuaaaagacaggacaacuaaacacaaugugugauccuggaauggauccuggacccaaauaaaagacaauggcagcauuuccauaaggucugcagaccagaaauagcuuuauaucaagguuaauuuccugguucaguaauuacacuauguuuuucuaagaaaaugucuuguuuaaauacacuaaaggagcaaagaggcaucauguaacuugcuuucaaauauuucacuaaaaauuauauauacauuuauacacauauaacauauaugguacacacacucauauauaggugagagagagaaaauauaauggaaguaaguaaaguauuaauaucuggggaucugagggaggaggguagagggauucuuuacauuaugcuugcaacuuuuuuuuuuugcaacucuaaaauuauuucagaauuaaaaguuaaaaaagaaaagagagggagcuugacuuaauauugcagcuguaccauaaaguguucuugaacaagugacuugucuucauugaggcucggcucccccuuugcaaaauagagacaacaugacuucacagggugaucgggguggacaaacaagauggugcugcaaagcuccaacccaagagcuggccccugaagcacacaguaaguauagcuuguuuuugguaaauccaaaauacaacaacccauuagagggcguuacugucugaaagcaguuugggggcacccgaggugaugugcaggccgcagagacaaugcuguucuaggucaggagcagaaacacaggcuccucacacaugcuuuuaaauggggcuuuuuacuuucuaaaauguguuucuacacaauugaaaacaacauuacuuuuuccagagugggaggaugaaagcaaucgugggugggggcuucuugagaagagggguuauuuuuuuuacuuuuaaaaaggucucagaacaguuaaaaauaguuuuuccuuaagcagccucccucugcucccugcucccaccagcugcuccuucucucagccugcccuucucuuugucccuucaccauuuuccccucucuccuuuuugcuuccagucacucauaugccacccacuccugagaacccuaccuucucuuauuuuuuuguuuggcuuuguuuugaaaaaaauauuaaucccaaaugaacaaagaagauacgugggaaggaaauaaauggugagcucuuccuuacuucaccaccugucaaguuuuaaguuuuuccuccaacucacacuaaccuccugcgcaaccauaaacuucagugcuugccaaagcccagaaaauucuaaguaaaaagcagaaaaugaaugcagggaagggggugcauucuuauuguucaucagaucugaaaaaaauaaugcccagaaugucaaaugauauuacacuauuaaaaagguacaguaaagaugugcuaaugauagauuuuuuuucuacuccaauauguuguaaauauuauaaacuaucauuuacugucauuacuuuaaugauguagaauguugaaaacucaaucuggguuaauuuacaaauaaguaauuuugaaaggagaaaaaaauaucuuuucuauuuccguguaaugucccauuacuugacagucaaaauguggauacagccaaaagaaaaauaaugaaggucaaggaggaucaaaauuuaccugauagaguaccuaucuguuagaaaucacuuuccugaaauaccuucucugauuuuagaaaacugaaaaaacagaaaauacacuaccuuugacaaugcuugcgauucaggguugugcuuguguaugggggugggagaaccucugcuaggauaggagaaagcugccagacacaaguucagauuuaauagaaauagcuuucaaaucaggagucuagccaucaaccaguuuuagauggacagucccaguuucaaguaaauaaaauauuugcauauuagagccucguagcccuacuuagcugcaaguaaauuuucugagauuuacucugccuugcuucauuucauccaggcacugauuauuuuuucauucuuuauucaccaaacauuuacuaagcacuucuuuauacaauaaauucugagcaagguacuaagacaugaagaauaaaacaggucuggcuggagacugcacgaaauugccagucugucugagccuguuugaauucauaaaguccccgagaaagaagaaauaggugaggauuagcaacccuguaagagcauuuacaaagaagggagugcaaaagaagaaaauagcaccacagcucaggagggcaaugguauuacuuaccaagggugcaguuuguuugaugacaaaucucaaaacugaaugcagugauuguguuagaugcaaacacuuggaugaaauagaugacuguucuugugaccuugccaggaaagaggaggagugaaagagagggcuagaguucuagucuccuuucugaguuuugcauucauuggcaaccauguaccucuagacaugggagugcaggcaucuaucucuaucaagguacaugacauguaaugaaaggaagggauagagaccaggcaagagaaagcaaagagagagaaauagacagggagauggaaugagguagacaaaucuuagaggaaugcagugcuucuccaaguuuggugcaggaauguucccauuagaaucaccugaggggguuauuuaaaaugcagauuccugggcucugacccaggucuggugagccugaaugucuguggcugggacucuaagauuugcauuuuauauacguuuuggggggugguucugcauauuaaaauuuaagaucagaccacucccuaaauccaagggugcuauuuuacuguuuacuugaccaacaguauaaaugggugucuucaaagccuugucaccacaaccccaugcagccugauccacuuacuucucuguaucacacucccuccucucccaccaaggaaaacagagugauccugaaguuccuuaaaacucaacucaaucuacugcuccucauuaguaauaagguucuguucaaggaacuauuggcuaaucauucauauccugauugagauaccagcauauccuacccaauuauuaacuauggauggacuccaaccaggaaauccaaaacuauaugcugcuuacugaaugacaauaauaaauguaggcucuuauuuaauuaugcugcgguuuauuaacuauccgauaauaaggaaaaccccuaguuuauuauagaucuguggggugugugaauauguguguguguuuugagagauauauacaggacccuaaucagagagagugccaggaauaacagccaugcaugccaggcaucuuuuccuguuucuuuuucaguuacuugaauccaccugugauaaacuugccaaaagaaagaggaaguacaauaaccacaaacguuaagugauuuuuuuuuuuguucuacaaacucgaugaguucacugcauugucuacuuaucuguuuuuguaauuucaacuuuuauuuuugauuucggggugcacauguggguuuguuccauagguauauugcaugaugcucauguuugggguaugauuaauaccaucacccagguagugagcauaguacccaauagcucuuuuucaauccuugacccccuccuucccucccacuaguccccaguguuuauggcugccauuuucauguccauguguaccauguuugucuguuuaacucucacuuauaagagagaacauguaguauuugguuuucuguuccuguguuaauuugcuuaggauaaugaccugcagcugcauucauggugcugcaacagacaugauuucauucuuuuuuuauggccauguaguauuccacuguguauguguaccguauuuccuuuaucuaauccaccauugaugggcaccuaaguugauuucaugucuuugcuauuguaaauagugcuacaauaaacauacagguagauguaucaguuugguggaacaguuucuuuucuuuugaauauauauccaguaauggaauuacuggguugaacaguagcucuguuuuaaguucacugaaaaaccucccaacugcuuuccacagaggcuaaacuaauuuacauucccaccaacaguguauaagcaucccccuuucuccacgguuucaccagcaucugugucuuuuuggcuuuuuauuaauaacuauucugaauggugugaaauggucucucaccgugguuuggauuuguauuucucugaugauuagugagguugagcauuuuuucauguuuguuugcugcuuguauguguuguuuugagaagugucuguucauguauuuuguccacuuuguaauagggcuguuuuuugcuuguugaauuguugaaguuccauauagauucuggguauuagaccuuugucagaugcauaguuugcaaauauuuucucccauccuguagguugucuguuucucuguugguaguuucuuuugcugugcucaagcucuucgauuaggcccuacuuguuaaauuguguuuauguuacauugcuuuugaagacuuugucauaaauuauuucccaaggcugauguccagaaagacauuuccuaacuuuucuucuaggauuuuuauaguuuaaggucuuacauuuaaauauuuagucaauuuugagguaauuuuuguauauggugaaagguagggguccaguuucuuucuugugcauauaguuagccagcuaucccagcaauaacaauaggguguccuuuuuccauugcuuaauuuguugacuuugucaagaucaggcaguuggaggugugagguuuuauuucuggguuuuuuauucuguuccauuggucuuugucuguuuucacgccaguaccaugcuguuuugguuaauguagccuuauaguacaguuugaagucagauaacaugauaccucuggcugucuucuuuuugcuuaggauugcuuuggcuacucgggcuccuuuuugguuccaugugaauagucuuuucuaauuccgugaaaaaugacauugguaguuugauaggaauaccacugaaaaccuguauauugcuuugggcaacauugccauauuaaugauacugauucuuccaauccaugagcauacugugcggucuuugauauuggguccugacuaggccaagaagacagagauagacuggucccucaaaccuuuucucuaaugucuggagaguacauauuuuaugcuuuucaguauguauggccucuauugcaacaacucaacucugccauuacagcauuaaagcagucauauauaauauauaaacaaauggguguggcuguguuccagugaaacuuuauuuacaaaaacaaauagugggccaaauuuagccugcaggcucuuguuugccaaccccagcucaaaucauccucagacaaaauuuagggagcugcuaauaauaacaaggccaugcucugcuauagugcuauuaagcuauugccucagcaucaaauucacccuuugguauucucuucugugauaacuggcacguuuauguauugacaagaaagaugaccaccacauauuaaguggggaaaaaaucacacuuuuuauagcaauaucacuuuuuuuaacaaaauaugauccucuauacguacauacauaauguuguauaaggauucauaagucucagaaaggauaauacugaaagguucagagggguaaccucuggaaaauggaaucaggaguaggaagaaaagauuacucugauuuuuugcuuuacauucuuuuguagucuuugaauuuauuuagaguaagcaaauauuaccauuguaaguuacaacaauaaaaaggaauaaaucaagguggagucuuaacagugcugaaacacuuuuguuaauccauuuccccaguuccaaccuaagcuuuacagaggugcuauugucaagcaaucacucauucguucacucuacacauauaauaggcauccacuuugggccagacccuacgcuaugugugaggaauucaugaaguuuaggaucuagguggaaaaacauaauuauauaagcuaaaauuguaauuaaaacaaauaauguacaugaaggagagauggcaucacauuucuuuauuaauauauuuauuggguauuauaucccauuauugcuggaggauaaaaucuaugccagggaauauaaaaagaugagacagagaaaaugauacgaguaaacacgcugaggacuuuagacucagcauauagguguuugguuccuaccauaucaucuacauaauuuccuuaaaacugcugugaauauaaaaucacaacagcuguuuuaaagagacugaaauugaaauucaaugaaacaaggcauuuguaagucuuccuuggcuuucuacauugauagugacuuuuuuuuuucuuuuucacacucuuagaaucagggauggguuagauguuaugaucuugcuguuacuucaggcaucuucuguuaucauucucccuagaggccaaaggcagagaccaugucuucuuuucuauauguuggaggcacugucuuuugaguuauaugccaaacaccuucucuggaauugguuugccacuucuagggacuggcucccugucgccauguuuguguaauaugacaacagacuuaggcaagugauccuagcugggccagaauuccuuccucacacacucaaaacaggaacaaaagagaguggucuagauuuuacaauguauuaacucaagggaugaagaauuccuuauaaacuagacagagacaaagaucuucagagauaaaagacggguacagacaagcagagagaagauuaccaagagcagaucauucuguccaggugccucugauuuuuugaggucuagguucuuccaaaggcccuacuacauccuuugcuuggguuuuuuuccauaugacaucauucuacacuuacauuauaucuucccuuuucacugaagcaucuauauauaaauuaaagcaucacuaacugaugcauguguauauauuccaagauguuuaauauugcuuuccugacaguagggauuuuuaucugcagugcuucagagccaaagcaaauucuaauguuauuuuuuuccuccggaauguucucccagaaaguuucuaccaguuugcuacaaguugaaugccacuuguugucauuucagaaccucauauacaguauucuuuaauagccagaaacacaauuauaggggaggucagaagauacaucuccaaagucuucuaaguguucucuccugugcccuacaggccaaaaugguuuauauaucaaaugaccuuggacaaguuguuuaucuuuugaguuucaguugucucauuuguauacaggcaauucuguuggcucuacagugcugcuggcaggauaagugacaaacucuuuggaaagucccucacacacagucagugucauuuaagguggcuccuccugugagauuuugcaauuagggauaugaucagucuuaguccauuuuuuguuuuugugaagaaauaccugaggugguauaauuuauaaagaaaagagguuuauuuggcucaugauucugauggcuggaaaguucaagauuggguaucugcaucuggugagggccucaggcuucuucaucaucucauggcagaaggcaaauggaagccauuguaugcacaaaucacauggugagagaggaagcaagagagagaguaaaaggguggggggaugccaggcucuuuuuaacaaccaucucuucuggaaacuaauagagugagaacuugcuuaacccaaaggacaggcaucgaucuauucaugaaggaucugcccuccugacccaaacaccucccccaggccccaccucccaucauuggggaucaaguuucaacaugugguuuugagaagacaaacauccaaaccauagcauuccacuccuggauucccaaaacccauguacuucucacaugugaaauacaauuguuucaucucaauagucccaaaagucuuaacucauuucaaaaucaacucaaaaguuuaaaguccgaagucucaucugugacccaagguaauuucuuuccagcuaugagccuauaggaucaaaaauaagauguuuguuuucaacauacaaugguuucaugggcacuggguaaacagucccauuccaaaagggagaaauuggccaaaagaaagagaaaacaggcccugugcaagucugaaacuuagccgggcagacaugauaucuuaaagcuacaaaauaaucuucuuugccuccaugcccuacauccuagguacugcaaggggugggcuccuaaugccucaggcagcucugccccuauaacuucagugggugcagcucaaguagcugcuuuccuugguuggaguugaaugccuguggcuuuuccagguugagguuacacacugcugcugcugcugguggcuguauaauuugggagucccuuugguagcuccacuuccauagcuccacuaggaacccugauagagauucugugguggcugcaccucuguggaaggucucugucuaugcuuucagagaucuaugagucaucucuaaaauccucugaaaucuaugagucaucaagccuccaccacccuugcauucugggugccugcagacguaacgucaugcaaaaacugacaaggcucauggcuugcacccuccagagaaggagccugagcuauaucuggggccauuugagccauggcuggagccagagcagcugggaugcagggagcaacauccagaggcagcccagggcagcaauacuuuaggccugucaccugaaccauucuguccaucuacaccucugggccuaugauaggaggggugguugugaagaucuuugaaaugccuuaagggccuuuuucccauuggcuugacuacuagcaccuggcuccauuuuaaucaugcuaaucucuuuagcaauuucacuggacugggcaauagcauuggauuccucuucugaaaauguuuccuuucccaccaaauggccaggcugcaaauuuuccaaacuuuuacacucugcuucgcuuuuaauuauaaauuacaccuuuagaucuuuccuuugcugcuuuaauucagcauaaccuguuaaaaguagccaugccacuaacugaggucuuugcagccuagcauuuucauccaccagauaccccacccucaucacuuuuaaguucgaccuuccacaaagcccuaggacauggacacgaugcagccaaguuauuugcuacuauguaacaagggugacaguucccaguaaguuuuucauuuucaucugagaccuugucagcauggauuuuacagucuauauuucuaucagcauuuuggucacaaccacuuagccauucucuaagaaguucaacacuuucccuugucuuuuuuucuucuucugagaccuccaaacucuuccgacugcugcccauuacccccaaccacuggguacuaauuuucugucuuaguucauuuuguaucgcuacaaaggugucacugaggcuguguaauuuauaaauaaaaggauuuauguggaucacaauucuaauggcuaaaaaauucaagauugaauaucugcaucugcugagggccccuggcugcuuacacucaugguggaagaugaaagggagcuuaugagcuuauguauggagagaucacaugacagagaggaagcaagaugucaacaaggugcuagucucuuuucaacaauuaguucccuugggaauuaacagauggagaacucaucccccaaaggcaggcauuaaucuauucaugacggaucugccuucaugauccgaacaccucccaccaggccccaccuccaauacuggggaucaaauuucaacaugugccuugacagggacaaacaaaucaagcaugauccuuagaaacaccacaugguagaguggaaagaguauuuaaauguuagucaggagaccucuauucuaguucccuguucucacuaacuaguugcacggccaugcugcuuacuucuuuccaagaaaccuguaccuucaugcauaaagugcuauucccuaugcccgaguaucauccuacaucaucaugucauggaaaccccaacucuaauucaugauucaucuugaguccugacuucuucagcaaggucuccucaguuuccacaaucagaggagaacauuccuuuuuuugcauaaauaaacacuguacuuggaucucucuuaugggaguuauuaggcucaacccuacuuuauagaucuagcacuacucaauuccuucuuauuuacuuucuaaagacaauucaucuuccaaaguuauagaaaaacaaaguuuagcauuugcugcauauguccaacaaacauaauuaauuggauaagaaacuuggcagguaauuaguacuaggcauaccauuugcuuuuuuaugcccagaaccuagaaaagugccugacacaugguagguacucaauaaauauuuauuaaaugaaaaaauacccagacuugguuaggaaagacuauguaaggcaacaauuucaaggguauaugcuuuuaggccaauucaguuugccaaaaucuagcccuugauguuaaaaggaagcuggggcuuacagaaauggaggaccccaacgcuaauggcaagggcagaaaucaucauuuaugagacauagucucuuguuugguggggaauguuugacagcuagcugcauaauuccacacgguuccacaggagaugauuuuggauguggagggaacacuccaagcacacuucuuaugaagaccuauaaucagaggucuuaacaaacacaagugauuaauauuuguugacuucaugacacauuuauuuucuuuagagcacuuaccacagcuuacucuaacuuuauuaaacuuuuuaguauauuuuuggguuuuuuuuguuguuggugguauccucaauaaacuaugaguucugugggggaaggaaccaugauucccuguccauuguuguacauccacuacacagcacagaguagaugaagcucaacaaauguuggaugaauaaauaugcauauaguaugauggauggaugguugaguggauaaauggacggaaagaggccagcuagucacccauacaagcuucuggguuaugaaccuaaauaauaacacaaguucaacagcaacaaaaauaaucccauuccauuauaggcuggaugaaaggcuuacccacugucuuacaccauuagcgcugcucuaacaaaauaccugacaaugggugauuuauaaagaacagaaaauuauuucucacagaucugggaaauccaagaucaagguccuagcaucuuguuucugaugaggguagucuucugcuuccaaaaugguaacuuguuggcagcuccuucggaggaaacaagugaucaccucccaauggcaacaucucguaauauuguugaauuggggauuaaguuuuaacaugcaauuuggaggagacacaaauauucaaaccauagaacccacuuagagaugacagaauaacgaauauauaugaauuaaaaugaauggaacaacaacaauaacaacagccaucacuuauguagugcuuacuguguuccaggcauugaucuaaaugcuuuacauauaugaauucuuaauuccuaauacaaaaaagugaguguuccuucuugaucuggagccaagacugcaucuaucaaaaugggaaucugaucaucucucccaucugccccccaccccacguacaucaauggucuacaugacaaugcuacaauuaauuccagaaguaaacuuaaccucucacuaagugcccaaccaaagagacugcaugguuucccaguaugaaaaugugaaggaucaauucacaauuuguuuccugcaaaacugucauuccucucuucauacccaucacuggagaaauuacuuuucagaccauucuacagcuugggaauacuaaauaagcccuaaugaguucaaaagucgguaaugacaguacuaauucaguggccuguuugguagaaagucagucucccuucuucaaaagcaaaauaggauuaucaagugagcugggagcauuuucuuuacgugauugauggguagaaaaaguaaucaccuuugaagugccacaacauauaauauaucuccuguguucucuuucuucuucugacacccacaaguaauugaagggaagggagccucuuagaaugaccaacgaagugaaggugacaacccuuucucugcuaucuaccacuagagugacaugcuggggucuugaauaguugagaacugacaugagugucuuugaugggcugcuuugaugcuugguucagaguguaccugccaccagucaggccacacagacuuugggugaaacauacaucuaaggagacaaguguuacuacuucuuagaagcaaagggccugugcaccugugaaagaagaucuguugucugagcucuggggucgggguaagguccgcaagguggaagugaaggaagucaaggagcaaagcaaguugaagcagguaagaaacacugaauaugauuucaaaacaguuucucaucauacucauccauaaugaccgauuaaccacaauguucagacugacaacuaggagaucauuagccucuugaccucagcucacugaugcagaagcagacagucgucuccuuggaaaaggcacugcucuacaguagcuuacuuuguaaggggauuuuugcaacuacaaguaauucaacugaaacagaguugacacucaaaaaccuuaagaagcagggauuaucaggcaggugaacaguuuuauucuuaagagcucacucuuucugaacucuccuaaagcccauccaggcaaggacauaugaguuuguuaucugaaggaagaaaaaugcuuugaagaagauuuauaaagaggaagggucuuugguuuauugacaagaaaguaaaagacuuucuagaguuguaagcgaaaugucgcuguucagguucuagaacuugcuggcuagagaacagauggcugccacuuguuggcaccuggagugacaaggaguugaggaaggaagagagugucauccaugugaucuggcacagaacauucuucucuggagccacucuuauaaagaagagacuggcauguuugguggguuuacuguaugauaugguuugaaucugugucccugcccaaauuucacgugggauuguaauccuuaauguuggaaguggggcacggugagaggugauuugaucaugggggcgguuucucacgaaugguuucgcaccauccccuuggugcuguucucaugauaguaaguuaccaugagaucuggcuguuuaaaagugugcggcaccucccaccuugccuuucuucuccugcucccaccacaugagaugccucacucccccuuucccuuugccaugacuggaagcuugcugagaccucccuagaagccgaagcugcuaugcuuccuguauggcauacagaacugugagccaauuaaaccucuuuucuuuauaaauuacccagucucagauauuucuuuacagcaaugugagaacagacaaauacaccauaguaccuccaaccugcuaauuaagucaggagucucccccugguuggcugcuacccacaggcuccacuacuggugagucguagaagacaaauaaaggcauuuuaaggaauaguacgacaauaaucucuagauacaucugcaaucaaguaacaguaaccccucucagaagcuaugccaguauguugcagauacugaacacacaucuguuaaaugaaugaaaaugaaugaaagaauaaaugauuauacaguguacuuguuucauaauuguaacugguuuauauugauuugguuauaucugcuugguaccaugugaguuuugauuacauaaagaucuacagucuuuguaugacauggccucagaacacaagucaacuucuucaucugguucucaaccuaagaaauaaugaucuguugcaaggacaggcuggccaugguagaaguacgaagcaacauuuuaucuacauaguacuuuagagguaauguaagagauuuucaaaaucaugcuuuuacaaugucuacauuaaggucuggcuuuuaacuaaaaaguaugugaaacaugauagcauuucuagauugauuccauucagaggugcuuuuauuucacacauauaucucagaccaaggguaaguaugguaagaacaagucacuaggaggccagcaagagaggauuaaugaauggaagaaauggaaaggagagugaaacacugguaaacucaucccagcuccagcaagaggggccaagauaucugagcuagcuggaacagcacaauaauaaaaauaauaacaauaaugacauucacugugagcaaaagaacucuguaagcaaaucaaaaauaucagugcuaagggucuuaauagcugauuauaaugaacuuccucauguaaucucagggagcagaaaagagaaaauagauugugcaucuguucaaacuaaacauauuucaagcuggaaccagcuuggugccaaagacaucucugucacagagaagaaaaaauuccaaauggaagaaaaauuccacuucaugcucaaacaccaugaacuucgacaggaaaauuagguaaccacugccucacuuacaaggcaacgcaucaguuuccuauggcugcaguaacagauuaacacaaacuuaguggcuucaaaccacaccacuuucuuaucuugcucuucuggaaguugggggucugacacaggucuccaggugugggcagagcugacaccuugagccugacgcaggucuaaaaucaaguugugcgcagaggugacuuccuuuccagaggcuucuuuuccaguuucuagaguccaacuacauuccuuggcucguggccucuuccuucaucuuuaaagucagcaauaaugggacgaaaccaucucacaucacaucacucugaccugcuuuucugccucccaccuccacuucuaagaauccuugagauuacacugagcccaccuggacagucuaggauaaucuuccuauuuuaacaucagcuauugagcaaccucaauuccaucugcaaccuuaauuccccacugcauauaagguaacacagccacaguuucuggggauuacgacauggaggucuuugguaggagggggguauucuauccagggauccccaaccgccgugccacacagcaggaggugaguggcgggugagcaagcauuacugccugagguuagcuuccuaucagaucagcagcagcauucauuucucacaggagcaagaacccuacuaugaacugcacaugcgaaggauuuagaaugcgggcuccuuaugagaauuuaaugccuaaugauauaggguggaacaguuucaucccgaaaccacucccuccaccaccgggucugugggaaaauugucuuccaugaaacaaggucccugguguccuaaagguuggggacugcuguucuauauugccuacuacaggcaucaauguuucaaauuuacuuaaaaaucuguucagguccagcuaccacaaauacaagugagugccucucauuugugaaaaacuguguauguguaaggugugagaauccuaucuuauuuugcuaggcagagcugacuauaugugcucucagagcccccagaauuccagaaaaccaaaauuuaaaaaaaaauauugaagauuaaaaaacagagagacaguguuacccagugaaguuucuaagagaaucuacccacuaacagacuuuuccccaucucaaguucucaaucauucauuuuguuacauuuuuuuauauuugacaaaugauaucuaaugcauuucauugcuguuagcaguuuagacacuuaugagaaauuaaaaccccauuaagugugaaggcaucuaaacaauaccagaucugccuuccacugaauauauuuugggaugacaggucugcuucaucugacuccucaacaagaacagcuuaugaaacucacaguuuuagugacagggcccaaccggcaccuauuuuuguaucaccuggaaaaaaaaaaugcccacauaggcaauacaucugauacagaaaugaaauuaaauagaacaauacugaggcaucaaccacucagauccauuucacuguuuccuauucugagacaaccuaauugaagguggcauuccaagguuaaauccuagcucugacagcaucuccugucagacaccugucaaaauguaauaagacaccugugaaagggaagugaugccaaagccacaucauuuuccccuacaccuugauuccuaacuugcaggauucaugucacccagcaaacagagugguagcugggugcugcuggcacugugccaccauuugcaggugagggagggaagggaagggaacacaaggggugggggagagagagagagagaagaagagagagagagaaggagagagggagagaaaaaaaaagacaacacugcaaaaggaagcacccaagcguuuuaaguuuagcaaaugauuaugagcauaaaaggacaacucugaacggacuugaauuuuaggauucaucccuagagucuugaucaugaucagaagcagggaauuauuuuuuaauaucuguuuuacauaauuaaggggugguagcuuucaugcaaaugaacgcuuugaaugcucacaacaccaaaugggcuucauuagcuuagcugggcaauuaugaagcaggaaguaaaaagcugagauaaagacuuaucucaaaaaggucugaagcagggcguguugauagccaagaggcacaacgaugcauuuuguacauuuauuaccucggaggcaaaacuucuaggauucuagauagcuuugaaagcagugcauacauuccauuuaacacccaaaugaaacagguggaauguuuaaagaucuguagaaagucuugaaaucguucccacacauuggaagguuuuaccaaaccuucucuauuuauucuaagugcuuuuucuauuguuuuucaauugcuucucucauuucccucccguguacauuucagagaaaauuggagagcuuaaaaugcgacuaaauauaaccccugcacuaagcaaacagugaauaaauccuuaagaaauuauuuuugaagcauauucuuucugauuugauuuaaaaacugcaauaucacaugugagucuugcucaggagaaaggcuauuuguucacaagacgaccaagcauguagagggaaagcugagggugaagggacugaauccgguucucagcuauuucaauacagauguuuuucuagauaaucggccucauuguaaguuaaagaaucaaacauaaaucagaucucucacaggcugagaaaaggcaaaacaacagccuguucguucuguaaaaggaccauucuaguuggccuaucugguacaaccaccuuguuuaaaagacaguaaacugaauccagcaaaaguuuauugacuugguccagaauauuacugagccaccaccacagccaggcuuacaucccagagcuccuguuucccauccugggcuguguauauucuuccacgucaccuccccagguggcuggcuuugagaagaagggaaucauaaaaagaccagaaauaacauauacaccuugaaggaguugacacaggauuuuuucuugaucacuuugcaagccagggaccucuggccagugacacccugcccaggccucacucggccaugcuacuugcuauaggagauggcccgcccacuuagcccgcucaggccgagucugacuugcacacuaguucccaaguucuuguccugcgccccagcagaaugaggauacacugacaaucaaagaaaaagucagggaguuuuauugagugaugaaaacagcuuucagcagaguggggaugcagggguggucccccuaucugaaggcaggaaaguccacccaauuugucugagucuggggcuuuuauaggcucagaauaggggaggggcaggcaguagguaguacucgaaaaagcaacauuagauugguucaacggcauuauucagaaagaaucaaccaagaaaggucaggcaaacagaaacgcaaguucucacucugggucgcagguuucauccaggaccagcagucuggucuuucagccuucaggcuguuucuguugguucggaggugggauuucacuggggacucaccucuaucugacuagguauuuggcugccuccuacuguccucagagucaucuguucaucaguuuguuuucccuguaccuuccuuucucacaaacauuccauuggcagauuucuguuuuguucuguguguuuccuuuccuucuccccaguucaagcugaggcagacgcauggacaaagaaaaacaaacugcuggcuaaauacagagcagagagugucauggaauguuuacagaggaaaugguuuuaggaaccagagaguaggaaaagcucaggcuggggaaggggcaggaggaugcaagagggaaugacuuuaggguauaaaaggaauggaaacggccaggcacaguggcuugugccuauaauccuagcaccuugggagacuggggcaggaggauuccuucaggcuaggaguucaaggccaaccuggccaacacagugagacccuaucucuguuauuauuaaaaaaaaaaaaaaaaaggaauagaagaacucgaguccuuaaagaauuagggucuccauguagaguaccagguggccaggugaaaacauacccaaauaucaaguaaggacacccauuggccagcacccccaaauuuuaguccaguuauuacacccaacuuggacuggcaauuuauccccuacagguaacugaacaucuuauggucugggaaaucuaccagccccuccaaacagaagaugaggagcuuaaauggaauaguaggaagggggagcuuuaccccuugaccaugaugggucuaaauaaaaugagcugggaauuucccuaggagcccaggguagugcuacaaagaggacacacugccccugagguauacuguguucauuugggagcuaucuagucccaguuuuccaagacagacuccagggaaaacaggucuaccuugaacaacaugaguuugaacugugugagcccacuuacacauggauuuucuuucaccuucacaaccucugagacagcaacaccaaccccuccucuuccuccuccuuuacagccuacuuaaugugaagacgauaaggaugaaaagucuuuacaaugauccauuuccacuuaauaguaauuauaauuccucuuucugauuuucuuuuuuuaaucuuuucuuaauucuaccaauuaauuuuuucuuuuuuuuaaaauuuuauuauuauuauacuuuaaguuuuaggguacaugugcacaaugugcagguuuguuacauauguauacaugugccauguuggugugcugcacccauuaacucaucauuuagcauuagguauaucuccuaaugcuaucccuccccccgccccccaccccacaacaggccccggugugugauguuccccuuccuguguccauguguucucauuguucaauucccaccuaugagugagaacaugcaguguuugguuuuuuuguccuugccauaguuugcugagaaugaugguuuccaguuucauccaugucccugcaaaggacaugaacugauuauuuuuuauggcugcauaguauuccaugguguauaugugccacguuuucuuaauccagucuauccuuguuggacauuuggguugguuccaagucuuugcuauugugaauagugccgcaauaaacauacgugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugacaugguaucucauugugguuuugauuugcauuucucugauggccagugaugaugagcauuuuuucauguguuuuuuggcugcauaaaugucuucuuuugagaaaugucuguucauauccuuugcccacuuuuugaugggguuguuuguuuuuuucuuguaaauuuguuugaguucauugcagauucuggauauuagcccuuugucagaugaauagauugcaaaaauuuucucccauuuuguagguugccuguucacucugaugguaguuucuuuugcugugcagaagcucuuuaguucuuacuaauauuuucuuuucucuagcaaacuuuauuguaagaaaacaguauauaauacauacaacauacaaaauguguuaacugauuguguuaucaguaaggcuucugguaaacaguagucaaauuuugggagagucaaaaguuauauguagacuuuugacugccugggagucagcaccccuaaccccugugauguucaagggucaguuguauucuguuagcucaccaauguuuaccugaucuuacacuuguccuaacuucuaauauggaaaggauaggccaaugauauaguagagugcuuagauuugacuguugaccacuggcucucaaagccucuccaguauaacugccucugccucuucaccccaucucccacugugccuaaaacccaacacuccagccaaagaguaaucaugcgcuguugccugaacauaccccauacuugucuccuacuagucuuugcucaugccagucuuccuaccucaaaggcucucccuuugcucuguuuaccucuugauaacuuauccaucuaccaaccaagaauuuuuaacaucugaaaugauucacaaauggaaugggaugggcucaaacgauaaaaauaauaauggcuaauuuggugucaggaacugugcuaagcauguggaauacauuauucucauaauuaccuaagagggagcuauaauaauccucauuucauagaugaggcccaggagggucaaagaacauuuccaaggucacucagcugggauucugacccaaucaguaggacuuuagagcugggcuguuaaccuguacccucuaugccucuaaugguccuucuaacacugugacccuggcauuuuauaauguaacuguuucuccccagaucccuuucugaaugcccccaaugagguguaagcccuccuuacucuggaaguuaucucacuggccucacccgacauauuuacauacuuuuuucaucucaccaaauacagauggucccuaacuucaaugguucaucucaaauuuuuuugacuuuuuaaugguuuacugggaguauuaaaugcauuuuaacucaugauaaguuuauugggacacagcuccaucauaugucauagagcauguauacuggguaagcuucaugaaagcggaaacucuggcugauuuacccacaaucagacugucugagcugcagcagauauuaaaguauuuuucgugaaugaacaucuuucaugcuucacacaguagaagugcuccguaaaugguugugguguguguugaauucuguucaaacaauuaucaggaacaacagucacaguuuuucacaguagcacacuggaacccccuuucuucacugugagugcugcccugacccugacaaucaggucaacuggacagucuguucucaccagucucaauauaggacugaaaagcuaucuucuccaaccaaguuguuuggaucaccugaggucaggaguucgagaccagccugacccccgucaauaugguaaaaccccgucucuacuaaaaauaaaaaauuagccaggcauggugguggacgccuguagucccagcuacucgggaggcugagacaagagaaucgcuugaacccgggagguggagguugcacugagcugagauugugccacuguacuccauccugggcaacagagcaagacucugccucaaaaaaaaaaauugugauuuuuugaaaccauuaaauucuucacuggugucaugguacaaacaaaaucacuugcuuugacucuuggccaaguccagaauugugucauuuuaaaaaacugguuuuuaaaaauccuaaguuguuuccaccugcaggcauaggcagaggagccuucgucccucacuacgcugaccccgagugguuccagucccaucauuccagaaaccccucucuggucuuguaucaaaaacaccacaaaucacugggauugcucugucaugggguagaaggggcucgaggacaaaguuuagcuuaaaaccagagugaauuuauuucuauuacauaugguuaaaucaugacuucuuuucuaaucccuaaagcuaaacaguagagucaugcuggagacacaccaucaucuaugucaaucagacaaaauuaaaacagagaccaacaucuccuuguuucauuuaauuuuguucucuuguuacugcaugugugacaccaagaaccacuugaccuuuggacaaaaaaguaguuauauauaagccauguauggcuaagguccuguuuucacaggccaggaacauguaacagcucuaauucuuguugacucuauuucugaaauagagucugaauauguacacuucuuucugucucaaagucuacccccuaggccagaccaccauugcuucuuaccuggggaacagggcaguaucugcucuuaacugaccugccggcccccgcucccuauucuaauccuuucuguauacagccgccagaagggcuugacacaaauguaaagcagggaacccugacccugugcuucaaugacuuuucaaugcauggagaauaaccaagcacauuaccuggccugcaaggcccugcauaaugugauguggcacuguacagauggccauguccaccucgggccacucucccucacaccuccugcacccugggcucacuggcuuccucucacaccugagcacuugcugcuccuuugaccuggagcucucuucuuucagcuccccaggacuggcucuugcucauccguuaaguuucagcuaagugucaccuucagaaaguccucucuaccuaugcuuucuacaaaggucucugccuucccucacccaccccaugcuauuuucuauuacauuacguauuuuuuucuuccugcuccuuuuuacacaaacugcaaugauugucuuuacguauugacuuacuuaucuucaauuuucccuauuggaauguaauuccaugagggcacagcccuuguuuaucuucuuuggcauuguacccccuauuaaccugcaacacaucacauggauguaaacaguaucugugcaaugaauaaauuaacgaaugccaaguuccaucacauuccaaggucugucauuaccugggccccugccauccuuuccagccuuaucaaccagcgcucucccacauggacaauuacgcaaggcacacugagccacuuccuucaggaauaggucacuuuuucuugccucugaaauuuuauaccagcuguugccucucgcuaggaugucuuucuucccuuccucacucaagucuaauucugcucaaggaucaguuuaauuguuacuuccucuaggauuucaaaagaauuuuugaaugcaccaaggcaaaguuaaauguggcaacaaucugucagaaaagcugccuuuuggugggugagucccagaaguacagaaaucauggcuaaaucguaccuuuaucuucaauacaauaccuggcacacaauagguguucaauaaguguuaggcaaaugagugaguuuaacuaaauuauaacuuccugagaacuaacaacaucucaaucacuacgcucaguauagauugaggcugagggccgccaauguuggcagcagcaaagccugcuuaaauauaauaacuacagcugcauugcacagaaguccaguuagugcagaagcauaaaguuuugagggugugugaaaggaacaaagacaaaguucaggugagacauggaagcaacgagaaaugcaacauggggcgaguaagccagcacuuucugcuuucacuucuaucacuuuggaaacauuuaguccagaaugaucuggggguucuuacuuaugguucuaagacagccuccacauuccucagcauguccagucacaaucaccaucuccccaagaaggcacaaaguaagcaucuguaaauccauaguuggcuauuuuggaaaauuaguguuaaauaagaauaaaaaaaaaaaacccuucaccuuuauguguaauaaagcacugcuuaacaaucaaggucacccaugucaauaacacuccccaagcaaagcuucauaucuuuuuaauuccuaggcucauaaagaccauugucacuuacaucauuacaggauucaagggagaauaacauaaagagaaugugcaggauaauuuucaaaauaaaagagaaaaaaaugacacaucuacauaucaaaccacacaagucccgugucugauaaaaucacaauuauagauuuggugcauuuaaccagucauacaugccaugcauuugcgaaggugccauaugggggaguuguggaaagucaaauaauuccuagacuuuuucuuucugagcacaugugacaaugaauauuauuuaccccuguaguauagaaauuaugaagcuuaagaccccauugcuucuuuuuaauaaaagcuaacacaucacagcuuacugcuugacccagcuccuuggucuuugcacguucuccucucugggcagcucucucucaguuuuacccccuaccacaggaaaggagacagcuguguuucuagacuugacagacuuguuuuuacuugauaaacacauuguauauuguaggggagaaaacgaucaccccuauuccccuccuuaguucuuaugugggcucuuuggcccgaucuaggaaccaaauugacacaacacagauuaacaaagaaaggcguacacauuuuauuaauuuuacacauacaugggaaucuucacaagacagugaaguucaaagaagugaccaaagcaacaugcuuuuacacguuuuagacaaaaacaaacaaacaccacgauaaauuugugaagaaaugacaggauaaaaagggaucuggcuagggaaaauaauuucuaugggagugaccaggagcuauaugaauguaaaacaaguagaagguaaggauuauuucaggaaguuuauuugcucagacacauugcagcaccuaaucacagucuccacugauaaggaauauucucuuacccuuguacggagaaggcagcccucccaaaagaaucuuuauggcuugcuacguguagaaaaagacuggucaguuagcccucugcaauuauacuuuuuccaacguuuucagcucgaaauaaucaacauaccaauucgcauauucugggauggcauguccuucacugcuucaggaauauguuuuccuuugugcuuuacuuggauauuaaguuccaaccaauuuuaauuacaugucgcuugugcauaauauugccacuucuaaaaagcagaucacuuucugaguuagaaagcuuaucugcuuucccuccuuauagacacuucugaagcagaaaggaaguaauuccuaugcuccuaucagauaugggcucauauuucuguuucaaauuuaagucugugaccccuacaugaggccaggauuuugagaagagugaggaagguagacucuuuuuaaaccaugccacaggcaaaaacucagaacucauuuuggggaggaaaaaaaguccuaucaaaccaguauacuauaaauuaaacaauguagcaucaaagauaacuuuuccuuuaguuguuaccccugaguggucacguagccauaagaaaaucaccuccuugucaacacaucaucaaucaaccaguguucauuaaauaccaacucugugcuagaaccugcuugguauaaagaauucuauuuuguguucaaugugugcauucagugcuuugauuguaauuaucuuugaaaugacccaaaucauuccaaacaacuauaagugacuuuauauucagaauagcaaaaagcugacuugaacacacaauguaaaagucuugaagagagagugaauuaaacuuuuuuuuuuuuuuacaacaaucagugggcuuauagaauagaaagagaaagagggggagagguuuuuaucuuuuagaauugcaaugcagugaauagugauacuagaagaacaaucaccaaaagauuacagaugagaacuucagaugaaaauaacaaugaaacaaagcaaaauucaauuaauggccuuagagaaggugagaucagaaagagaaacugaaaguuuuuuagacuucucuuuaagacagauaaaauuuagaauuuuuaaaaauccauaauaaaaaccagaacaaugcuaccucgccaaaguugaguucaaauuuagucacuucagucaccaagaauccaggaaacuuaguuacuaugggaacagagguccuccucuucagaaaggagggcaguguuucuuucaaauuccaccagcuaaauucaagaucaaugaugguuguuuaauauccucucuugaagcucuuacugucuuuaguauacuuuaaaauaaaauaaaaacucaacaauaauggagcucaauuaagcauaauuugugugcuucaaccuuuggcugggugacugcucuguaccguucacacuuguacuguagagcauugcaauuuuuaauuaagaucacucauucuauuuccccugaaccaaccaauguugagguuauuguuuggauacaaaacucuccaggauacggcuucacuuaacaaggacuuuguuucuuucaaguaccaggcacucacugguucugaguauaggcugccugcccuacuuuaaaaugcaucucaacuuuauuucagagacaguaagauuucauuguuacucuacaggacuuagaaauaaaugcaugcauguacucacacacaaaaucucucgauaauuuugcauauaauacaguuuuugugcucuaugccaacaaagaacagaauguuuaguaaaucacagagaaacacuuuuauuucuugagacugagauauguguggcuucucuacuuuucuaggaauuacauuuaaaauguaagaggacaagaccucauucaaccuuuuaugccuacuuuagugaucagggugaaacauauaagaauauugcaacaccaaagcugugugucacuacucagcuaaugguaccuauaaagaaacuucucuuaauuagcuuuacccugaacuaacuuccuuugcucugccauguauaauuaaauauguuagcaagacagaaaugugagauguagcagcuuucacacccaaauuuccgacuccaaauuuauaaaaaguguggauuuuuuuuuaguugaaagcccaucaugaaguauuuuacuuuuacucuaaaaacuuucaaaauuacauuaaaagaagaaaaagaaaaugggcaggaaaauuaguaaugagagaugaauuuucagagaaaagaauucuacaguagucccuccugaucugcaguuucccauucagugcuuucaguuacccuugguuaaccaugguccaaaaauauuaaauggaaaaucccagaaauaaacaauucauaaguuuucaacugcaagcaguucugaguagugugaugaaaucucauugucucucacucugucucuucuggagcgggaaucuuuccuuuguccagcauauucuggcuguauaugccacucaccuguuagauacuuaguagcuaucucuguuaccagaucaacuguugugguauggcagugcuuauguuuaaguaacucuucucuuacuuaacgauagccccacagaagaguagugaugcuguaaauuuggauaugccaaggaaaagucccaaaguaucucuuuuaagugaaaagucaaaaguuccugauuuaguaaagagaagucauaugcuaaggguggcaacaccuauaggaagaauaaaucuucuauccaugaaacugggaaaaaaagaaaaauucaugcuaguuuugcucucacaccucaaaccgcaaaaguuucaaccacaguucaugauaagugcuuaauuaagauggaaaaggcauuaaaucugugaaaggaagacaugaacagaaauguguucguuccuacugauggcaauuagguucgguaccaucugugauuucaggcacccacugggggucuuugauuguauccccuguggauaaggggguacuguuguauaucaaacaaaaucugaggugcccagccaaggacagugcugcuucccagaagagaugagacuccccuauccuuucuaucuucccaaagggugcauguaguguacgcccauuggucucucccuuucaggagugaauccaaaagccacaauauugauggacggcaggaaacguccaguaucugggcucugaagaaccuugaggauagaauccagcuccaaucauacaguuccucuguauggauaccuuaaacaaaaguguauuuuauccuuuuuaauuuggcaucccuuagaaaugugaaacuuccuugugaaaacugcucuuuaaggaaacgaaacuuuuuuauuguaagccuucccauugucuguauauaauuaagaaaagaucagugauaguucacggugguuuuauaauaggugaauuaaucaguuuuaaaaagcugaauuuuacaugcauuugacaaccaaucugggcacuauuuuccuaggaaaaggcucauuugauuaaauaaauuuuaaccuuuaaaagcuuuaauucuuuuuuuuuuuuuuuuuuuuuuguacacaaaggacucuuuugugaugguuggaucaacuuacacauccagagcacaugugcauagauaaaacuuugcaguaaacuauccuguuacagauagcuuuucuuacacauaaaaauacauucugaugagcaaucuaggggaaacaaaacuaaaaaaaauuaaaauacagauauacaauucauauucuaaucuuaucagaauaaccuacuguuaaaacacaaacugaggcaggauaaaauuuuaaagaguuuauuugaucgaacaacaauucaugcauugggcagcuucuaacuggaagucauucacgagcuccacagagggaacaugauggguggacuuuuauaggaaggucacaaaaguaaagcaagucaguaugugacugguuauagcucuauaauugccuuauuugcucuaucccauuagaaagucacuaaauauauauacauaaguuuguuggcuacuuccaacuggacaggcuuaaguucuguuuuccuuuaauauaggcauuugcaaggaauagcuuaaguuucacuuaagcuuugcaagccaagcaagguuuaggucacuuaugaggucugauaucaucuguuucuuucaggccuagucuccauuuuaauuuacuuuaacacuauccauaagaauauuaaaaacaggcagcagauaugcagauauuuuaucaauacaaccuuuuauaaauacaggaaagaauaguguugacagucuaaauuugcuuccuugaggcauuaucuguuugaccagauuuaaucauuuaauuugaaacaaagaaacaaauacuacucugggguugcugugaaaggacauucagaguggacaaaaccucuuuaaacuuuucuucaagguuucaucuucacauauauguuaguuugguuacuuugacagauuggucaacuuaauccaauacaguuuuauggguccggaaagugcuuugcuugacuuugaccguaugugucaugucaguuaaguuaaaagcuaauucaauguguccacuucgggguuauuuccaucauaaggcauuauguuuuuacuuggguuguaugggggaguuccucugaauugacuagacagaugggagguuuagacacaguuuaauauucuguacuugcagaagcaacuauugagagcuuugauuacaacuaaauucaagcuagcucaaaaguugguucucagccauuuaagucaaaagguuagguaaugucacucccuccagggguucauuguccaguuuuucuguguauucauuuuguuuuuauuucaugccuaucuaguacccaccccugugucccaccuaugccugaauucuuacuguguaaacucuuuuggaugggaaaugaccagcuccugcuacugaccacagcccucccucuugccagagccugaaggacaggggacuccuagcucgacagaucaugcuaaaauuauaccuugugcuuagcauuucuuggccuuuaauccugucccaguuacuucucuuuuuuuuuuuuuuugagacagagucucgcuuuugucguccaggcaggaguccaauggcuugaccucagcucaccacaaccuccaccuccuggguucaagugauucuccuaccucagccuccccaguagcugggaucacaggugugcgccaccaagcccagcuaauuuuacauuuguaguagagacgggguuucuccauguuggucaggcuggucucguacucccgaccucaagugaucugcccacuucaaccucccaaagugccaggauuacaggcgugagccaccaugcccagccauuccuucucuuuucuaagauuugaguucucauuguuaaucugguaauuuucuuuuucacaccagauaagcagagcugguuucugcauugcuaacugggagcuuccuaacuaaaagagccucacaaacaguuaauucugcucuagaugcuguaaaagagggggacggggguaggggcagggagagagagagauuacagugauaaaaugaaaaugcuguuucagccaggaaguuuuuucucccccaucucauauauuaaaaugggccugauuuucuaacuucagcauaaaagcccaguaagaaauauuagcucuucaguuaaugucauucacacaaggaauuuaucagcagaguuuguguuugaacuuuucaugucaucucacgcaucucagaggguauuaaacuccauaaaacacaaucccaaaagugaaauauuucccacuuuuacucuauaagugagucuuagggaacggaaaaaaaaauuccaugucuggcuuauuccuaaagagagaguaaauagagauauuucuugggccaaauaaugagaagaaucacaacccuuaggguuuauguuccaaaggccuccaaaucccaacagguccagcaaagcagaacagagaaaggggcugaauauacaugaagagaauaacagaagcaagugguuaaugguuuccuuaaaugcggcagaaaauggcuuauguguaccuaaguauccuauaguacugagacuuaccaagaagaaaaggugaaaauggaacuugaggccccuggaagacauguucuuagcuuugccugcuggcuuucugcauaaaucugaccuuucugcaggugaaguucuucuuuacagcccaguuucuccucuuaguuggcuacugacccacaguagcagccaaaauuaaaccaaugauguauuucucguacuuccccaaaucacuuuucuuuaaauaaguuaauaauaauccaaacuugcauuuuucagcugagugcuuugauacuugcuucucaaaaaacuacuuggaagguaaaggaguuuucuuuucgagaccucgaucagaaauacuccaugauucacgcacucaguuaggccuaaauuagcccaauguuauggcuauaaaggaaacaggaaaccuguguuccagggacaaucuucuucaucacucuauucccagcguccucucauaugaggacacgggggguugggcuaccuccauagaaugauaauaaaaguuugccuccaaaauaauuuggaauuuuuggguuaagcaucaggacauuucauaucauguaauauacuaacauucaguauaaaucucuaagcaggguaagugggcucagaauaagucacaaucucucaacucauuucaccaucuugaaaauuucuuccauggagcacaaagaugaacuaaguaaucaccacauuccucgcaacauuuauacuuucugaucaggacaaaaugauucuaaggagugauuaaagcaggguaagagagucuucucacccuaaugaauccaaagaucaccaaauagacacccaguuuauggcuuagugauguaaaacaggugugauucagagccaaguuuacguaaguucaaauucuguuuccaucuuugguagcugugcauucuuggauaaguuacaucaccuccgagccucaguuucuuaaucuguaaaacagacauacuaacaugacuucauagagguguuugaaauagauuaucuaaaauaagcaccaaguguuacauauaaugguuauuucaguuauucauugauuuaauucaauuaccauuaagguugagaccuggucaucauuacccaguuaaggaagggguuugacauaaaaaccacucaagauuucuucccacuuuaggacuuuaugauugccuuuaauuuuucauguuucaauuauguaacuaaaaucuucuauuccauauauaucagaacacaccccaucuaaucucugcuaaguguuucucuacucugccugucccaugaaacaauucccaaagccuaggagagucuccugugauacagauaccaaaaugacgugggucagaaguaacucauacauccauauugucagaggugaacuauacaaaauacugaguacacuacagagugaucugauaggccaagaagaaaaaaaaguaaucugauagaccgagaagaaaaaaaaaguauauguuguuucucuacuaaagaaugucaccgcauauugauuuuucuagucuuuuacaaagacuguguucagaauuuagaucaguguuagagaaauucacuuauaaauucacauauacccguauauaaggauacaguccuguaucuaaggauaaaguccuagcuuaaaucuggaaugaguaaaaacaaaguguaaaguuaaaaaugccccucugguaagacaaacauaugcuuuucacccaaaggugcaguuaaagaauaacaacaaaaguugguagugagaucccucuaaaaccacugauauauaauagacuccuacugacacccuagaaaaaugaugccaacccaugcagauuaguuucuuccagcaauguaauuacccauuucuuuggggcuaucuuuccuucaauggugauuugagaaauaccuuucauuuauacuccauuuugcacaaauaaacuacauuuaaagcucuauaauuagcuguccuuugcuacuguaaaauucaguguuuuuguccaaaaggaacagacuauugauuuacaaagaagcugaaaugcugucaaacuacccacugaagaaguaagaaaaaaguggucccuaucuuggcucugccucuagacuagcucuuguccuaccucagcuuuguauccacauaccgagccuucuguuaagguuuagacuugcacagccaaggccucccaggcaucuccccauugacaucuaagagacaccucaaauuaaacauccaacucuuugccugaaacaccguuccuuaagggcuuuccagauuagcccuuuuuugccucuauuauuuguaucucuuaaaugcuuacuauugcaagauguagaaaaucccaacuaaaacgggcauaaaccauaagagaaauuauugucucacacacuaagauaaguggcucagugaagcuaaguaugggauuauuucucuuugcucaugaaagcaucaaugugucaguuggguucaaguacaagaaucagaacccauucuagauauuuuaagcaggggagauuuaauacagcaaaguuggugcuggagaaauaacuuggagggcugaaaguacaacucuagguagagccuucaguaaggacucccagaacaauaucccauugaccucauggaacuuguaaggagccacuccuccugaagcugucuuggagccauaguaaaaucaagaacuugucaccauuacaacugacucuacuaaugcaagaaaccauagaaugcuuaucuguagcuguggucccgaguuucagaagccugaucauagcgcugccacugcugcuucugccaucccaaccauuucguaaaacucagaaagcuggagagugggcagaaaaacacgacugcagggaaccuggacauugccacagcuacguuuaccagcagaaacagccaaaggagggcugaaauauggccuccacauggcuuucaccuuccacacaucacauauacacaucuaauuggagaagacuuuuuuugaagcuggcuaaaagagaaucugagaaaugaugcuuuuaguuuugcaacaacuuuaacuugaaugaggauagaauggaaacuacauaaauucaucuagagcauacgaaaauaccagcuuccugggugagucuuuacauaggagcaugauggaagcaagcagcaaucaaggcugccacagccuuugauauguucuaacaguagagaagaaaaaaaucucuuuccuggcuauggcauagaaggccuuccuuuacuccuuauggaaccacuuuaagccauuugcugacucacagucgaauaccacugaccauggaaugcuaugggcugauuggcucagauggacaaucuguugagugucaaccacaguguagucuauagugugccugcuuacauaacaucuaaucauugagggcuuuccugaccauccaaucucaaguagccucuucuccugacccaugaauucugugucugcuuaccaauagguaagucuucauggcacuuaaugcacucugaaauuaucuugccaauuuacuuauuugccugcuccuuaucuccuuucccuacuaagacgcaagcucugugaagguaaggauccugucuuuuucacgucuguauccccaacacuuacagcagcaugaaacacauaccaagcauucaauaaauuguuuaaugcauaaaugaauaggcuauaauccauguacuacagaaaccuuaccaauaaaaugcuuauguucuucccaguuaggccagcuuagcaguuuauuuaaaaggggaugagaaagagagagcuguucaacguguguguggccauacacagugaaucuacuaacugguuagucuuuugggauucaguguuacaucuacuaugcgccagucacuguacccuacuauuagcgaugcauaaaucagaaaucuuggcccaaaggaggacuacugguacaugaagauuaagauucuacgaugacagcugcauuggaaaacaguaucaugaaaaguguuuuggagacgggugcacaacaaugugaauguacuuaacacuucucaacuguacacuuaaacaugaucaaugauaaauuuuaucauugggccgggcgcgguggcucacaccuguuaucccagcacuuugggaggccgaggcgagcggaucacgaggugaggagaucgagaccauccugguuaacauggugaaaccccgucucuacuaaaaauacaaaaaaauuagcugggcgugguggcgggcgccuguagucccagcuacugggguggcugaggcaggagaauggcgugaacccgggaggcggagcuugcagugagccgacaucgcgccacagcacuccagccugggcaauagaacaagaccccgucuccaaaaaaaaaaaaaaaaaaaaaaaaaaaaaaaaaaauauauauauauauauauauauauauauauauauauaauguuauauguaucuuaccacaauuaagaaacaaaaauaaaaauaaaaaauacauuauaaaacaagcacaaccuuuuauguaaauuacuuacuuaauccucauaaucagacaagguaaacaguaugaauauuccuauuuuaaaaauucugacccaguaagguuaauuagcuugaucaaguuuauauagcuacuuaggagcagggcugcgacuagaauuuaaaaaucuccaacuccuaagaucaugagcacacagauacacaaauaagcaauagcaucauguuuucaaacagucuggucucuucccuggcucugucugaaugacagacucucccauuguuucuuguaaacaggcaauuaauuguacacacuaauacacagaaauggcccuuaaaauaaggaagaacaagagaaauccuuuuuuuuuuuuuuuuuuuuuuuugagacaaggucucagucuguuucccaggccugagugaaggugcaaucucagcucacugcacucuucaccuccuggacucaagucauccucccgccucagccuccugagcagcugggacuacagguucaugccaccaaguccagcuaauuuuuguauuuuuucuaaagaugaggugucaccgucuuugccaggcuggucucaaauucuugggcucaagcaaugcaccugucucagccucaugggaaaucuugcacugaugggcuaaacuuauucaaaaagaaaaaucuuccuuaaaauuaaaaaugaagaguaauagcaauuguuggaaguguacugauucaaggguauccaggucaacugacagaagagagaggccagaaaggaaucauaguauacugaaaagccgcugucugauaaaaguuggcaaggcagauucuaggaagaaagagcucuucaacaaacaauggcuaacuauuuaaggaaaauauguuacauuguuuucucaucucaugucaaauauuaaaauuaaucacaugcuuauuaauaaaauaagagcagaaaauugagccauauuauacacagaagaaacuuuuaucuggauuaaaauagauuuuaaguauaaagaucuuaaaacaaaaugacaaaggaaaaaaugaaacauaacgccccagaaaauuaaaacuuucagcuccccaaagccauuaucaauaaaaugaagugaaagaauagggagaauauguauugaaaaaaguauuaaagacgaagagcuaacaucuucagacagagugcuauucaaaucaauaugguacaaauccuuuauuagaaaacuaaauuuaaagcaugaguaguucacagaauaagaaauauaugugguuaacuaccauaugauaaaauacucaacuucacuauauucaauuaacuacgauuuuaaauaauaaaacgguaauuuuguuggaaaaauaggcagaguauuuucauuuauauucaagucuucagaggccacagguauaugucacuauaagggaaaauuggccuacauaucaaaauauuuauucauagcguucuggcaacuuaugccaauguaaugaucagagacccacacaaagauuaguuguaaaacauuugucacaguuuuauguauaaccauaacaaaacuguaaaaaacuaaaugagagaacaaauucugauacacaaaggugaauacuugaaagacauuaagaaaucagguuuucaauacuucauaaaaugaaaaaguauugacauaguaaaguauaaaaaaguagaacacaaaauguacaaacacgaauagguauuaugugcauguauaauacauauauauuauaaaucuacaaagaccuauccauauaugcauauaugcauuuagauaggaauuuuuuaaagcacuggaaggaaauuuacucaaauguuaaugaugguuauagaugagaaguugaauuaauguuaacucuucucuuuauuucucuccauuuuucaaauauucuuuaauaaauuggaaguguauuagaaaacauccaaugaugucaugaacacucauucccuagacauauuaaaucuguuagcguuaacuauagacuaguguacuaugcuaagguguuaugacaaagaaaaagaagcaguagacagauacaaagacauuccugacauuaggagaacuucuggagaaagagacacauguugguacaaaggcuguaauguaaguaaaguagaaauauaaacaaaaaaagcaugagaauuauauuguaguugaaagccagaaaggcuuccuggaaaaggugguguguaacuuuuauaugaaaaagcuggagccccaucucauggaacaguggcacaaaguauucucgauagcgggcaucaccauuugaacucgauccucagccuucaauaaaaaucauaaagcccaucuucagagccccucuuuucuugcuucuccauaaauuauguacuuuccucuuuucucaccuccuugagauacuguuuaccuaggaaugagacaauucauuuuuuacagcccaucaugaacaauucugaaaaagaauccccucauucauuacaagacaguaugaauuaaagcucaagaaugaacucuuccuggcauuucuaauuaaauauguagucuaccuauccucuaauggugaaauaaaaaguagccccaauauuaaagcaauuccaaggaucaagcaagcagguaaggcagauuggccaagaaggaagagcaaggcacugagaaaucacaccaugacgcaaaugacuuucucuguugauaugaaaauuuuuuccugccauaggugauguugauauucuaacaauuuuaaaacacaaaaaaauuaaggggaguaacaaaauuucccuucuauuuuuugaguuauuuaccgcuaacaaucuccccucuagaaaaaguuacggaaauauuguacaaaaugcaccauggguuaaaaaaaugauuuaaauacaggaaauaauuguuauuaaauacaucuucuagggagauccacucugucccaauccuuaaauuagaaagucagcaaaaagaugaacugaaucccugauguuaauuguacaggcuuacuggauuagaacuagagauaauuaauugcuaaauuuuaauaugcauuggacuaaauggcugauaagauuuccaguaguuggcuugaauuccagaagggaaugauuauuucuuccccggccugggagcccuacaagccgaagacauuuaaaaugucuguauuuggaaugaaagaaguuggguaaauaguagaauagguuacagaauggcaaaaacuucuagaaagaaaauauggaaguucaaauugccuuuucccauuugaaauuuagaauauaauacuguauagaaaagaggauuuaaauuuuuuuauuuuuauuacagcuucagugauuagcauuccuguacuauaaugucaauauuaaauccagacagacccaaagucuauuacuuccuaucuaaaaaaaaaaaaaaaaaaaaaaaaagacacuguuuaucaccuagguaauuauauuuuuuauguucuuaagaauuuaggagcuugcuaugguuaauugggaaaaaugugaauuaugguuaagucgugccuuuuuuuauuaaacuuguaacaaagcaaaugaugaagaaccaacaacuugccaaugcugaggguccagaugaacagacgcgcagagaaugcagaugagcugauuccauuaaaaaguuggcugcaaggguagaugaugaagguuaagaagauguaggacuauagaggccaccagugaaaaggaaaaaaaaauccccugcuuccucuguacaaccuucaggauguucaaggaggaagaaagaccaccaacugcagggucaguacccagaugccuuaggauauccaugaggcugucaggcaccagugaaaaucaggucugguugugcaucagaaucaccuguggaguuuguuaaaagaugggauucugaccuccauucuugcaaaaugcugaugauccaagcggugaguuugagaccaaggauauuauuuaucuuuuaacaaaccucacaguaaucgugaauguacagcaagguguuauaauguauuuugauaucuuauuuuuuagagacagggucuuguucuguugcccaggcuggagugcaguagugcaauaaugucucaccguagccuccaguuucuggguucaagcgauccuccugcuucagccuccugaguagcuaagaccagaggugcacaccaccauauccagcucauuuuuaauuuuuuuuuuuuuuuuguagagacagggucuuuuccaggauggucuugaacuccuggccucaaggaauccuccugccuaagccucccaaagcgcugggauuauacgugugagccacugcacccggcccuguuuuaauuuuuuaaauuuaacuuuuaaaauucaaauauagguagcguuuugguaaucucuuauuuuaaucugaaugauggaauaugucaaggggugacugacaguagggaggcauaauacugucaggagcuuccuacagugcuuucuucaauuacuuuagaaucuuuggucuccccagagguaaagugacucgcccaaggucacacagugaauuaacaaaaauaagaaacgaaugcuaauauuagaaaguacauaccuccuauaauuacuugcuugggcaauaaacuagaaguuaguaaauauuaagaacuucaggguccgggccuguaaucccagcauguugggaggcugaggugggggcggcggggggggggggguggugaaucaccugaagucaggaguuugagaccagccugggcaacacggcaaaacuccaucucuacugauaauacaaaaaaaaaauagcugggcgugguggcgggcaccuguaaucccagcuacuagggaggcugaggcagaagaaucacuuaaacgugggaggcggagguugcagugagcugagaugcugccacugcacuccagccugggcaacagaggaaggcuccaucucaaaaacaaaaacaaaaaaaacnucagggucauuacccuauuucuucaauuuuuaauuuauuuuuuauuuuugagacagagucucacucugucauccaggcuggagugcaauggcacaaucucagcucacugcaaucucucccucccagguucaagugauucuccugccucagccucucaaguagcugggacuacagguaccugccaccaugcccagcuaauuuuuuauuuuuuguagagacaggguuucaccauguuggccaggcuggucucgaacuccugaccucaagcaaucugccugccuuggccucccaaagugcugggauuacaggcauaagccaucaugcccagccuauauuucuuuaauuuuaagaugccuauuuuauguuuuuaacauaaauaaaugaagaugcaucuuguaauugauauguuuaauauggaagcacucauuuuuuccaaaauaugaaaucagugguguacuuacaacuaacagcauuauaaaauccaggauauaugggagggguauugcauauuuauuguuucuuugaaacaagguuuucuaugaauuaauuuugucccuguauggguacugucaucgugucggguaaggaaaucaagacucaccugugcuagaaaccuggaaauaaacuguuggcauauacuugccuccuauggucagcaucuaaccacucauugaguacuggugacucaauuucuaccucuucaggcuuuuuucccuucccaguuuuaaaacuucaaccgucccuccaguguagcacuaaucaaaucuaccacagagcugucacauuuauccucauuaaacacauacuugauuccaugacuuccuuuuuauaaaacucuacuggcuccccagugcuuucagaaucaagcccaaauaccaucaaauggcauuuaggguccugugaaaucuguccuuacccugccuuucugguaucacagucaucagcugcuucuucccugcuuaaaaaaucagccuaaucaacauuccugaagcuuacggcacuguuaccacauuucuaauaguuuaaacuuucaaggcccagcuugaacaucacaccuuccaccaaccuuuuccaguccucucauuaaaaucaauuucucccaucucagcauucccacaauauacagcacaaugagcauguagucuugccugauguaugccugucuguccacccaacuggacaguaaacucucuggcagcagaaacugggccuuaaucauuucaguuuccuccacagagaucagcacagugccugcacguaguaguuauuugcuaagcaugaaaucuuuaacaaagccagaauugauucugaggcaggguuaaagauauuauaaauaaaacuucacugaacugaaauucauagucccaugcagggcaccugcauauuuuuauuagguuucaccauggaaggcauaauuuuagguauuauuaugcugaugaagcacaaucuuccugcuccaacuuggccaaacccagggaagcaauuuccuauuugauuaagaguacgacagcagcgaggacuggaguauaaaaauuuacuguaggguugagaauguaagcuuaauuguggaucaaaugggaaacauucuaaacagcauuuuuuaaaggaaguauuugaacagccuauuuuaaaauauucaauaucaucuucagcaauaggcaaguuuuggaaacuagcaaguuucaagacagguacucacucauucucucuucugcaggauccuaaagaugguccuggggacuaucaguuacuuaaaugucucagguuauuaauucuuacuuuaauuauaucucagcuaagugauuuuuuuuuuccaccauuugcucacauagcagcgaacaacuuuacacuguuaucagucuucacauagcaguucccaaauuuugccuuuagguuuauaucaugugcaaugaguuuuaaaaggcuuucuccacaaaaucauaagagagccuuaagaguuucauucucugccugaccuccugaaacccucaaaagauaauuaaagaaucaugaaaucuucuugugauuucauuuaaaaaacuuuuuuuaaaucauugaucaugucuucauucuacuaaaccauuuaagaagugggcaauuuaaacuaccccuauaaugguucacuagccucagcaaucaaggcuguaagaagacagaagccuauguccaacauuauuauuaguaguaauuaucuguuacauauuaaugcuacuaaaguaaaaugugaucuauauauaaucgauaauaugacuauaauaauguauauaacaauccaauauaguuucccccuuuaucugcuguuucacuuuucaugguuucaguuaccugcagucaacugcaguuugaaaauacauguguacaggccgggcacaguggcucaucccuguaaucccaacacuuugggaggcagagguggguggaucauuugaggucaggaauuugagaccagcuuggccaacauggugagaucccaucucuaccaaacauaaaaauuagccaggcgugguggugcgugccaguaaucccagcugcuuaggaggcugaggcaggaaaaucccuugaaccaaggaggcggagguggcagugagcugagaucaugccauugcacuccagccugugagacaaagcaagacucugucucaaaaaacaaacaaacaaacaaaacaaacacacacacacacacacacacacacacacacacacauuagcccugugccuaaugucacagugccaucccuuggucccacuccaacaacuauguaugaaauaaaccugugauccuaucagucauaucccuucuccaagccucccuuucugaaacucuaugccucuaauucuaugagacauuucacaauguuguaucuacagucaacuaagaaauaauauauuuggguuuauuucacucuuugcucaaaccaaggauaauuuaucaggccugcuaaguauaaucugcuuuccuaaguauugugagaaauaugaaacagacuacacuugcaaaucuuaaauugugauagaagaaaugagagaaugcacaaaaguuuucuuuucuucagaagagaaauugcaacuaaaaaaaaacgccuagagauaauaaaagagacguuagaaagcaacacacaacugucaacucaaauguacugcuaauuacucuagaaagaaguguucagcauucuaauaaaaacauuauauuaguauaauguuugucauuaacaaagaguugcuuacaaccacaucaacagauaagauccuaugauacguguugucuggggcaaagcagggaauugugggaaauguaaaacaaauuuguguugaaucccggcccucagggaacauuugaguucaugaaauaaaacuaggaaucagaaagacugggcaagauuuguuuugcuaggaauucaggauacaugaauccaugaggaaacaugaacgucuuggaacucgaacaggagguggugguaaaaaucuaggaguuagguaaacagugucuagccacaagaacagaggagggguuuaaaccucuaagagaucauuuuaugggaaaaagcagccccuccugaaaacauucaauucaggacacgaaggacagauagacacucagagccucagagaaaaaaguaucuggugaaaucucuucuagaaacuuuggcuggggagaguuuggaauguugacuuaaagacccacagugaagucuagaaaaagauagaggcagcuuguuacaauuuacaccaacaggaaaccauuuagaagggaagaauaaauguuaguuaaacuuuaaagauuaaauuacaaauuuacucaagugauuuuaacuuuuacugcacaaguagcaauuuuaagucauaagggaucugaaauguuuccagaguuuuaaaauggacuguuuuacacaagugaaaaaaagauuuuggcuucuagugcugagcacagagcaauccuaugccuuguaaugggcugguauaauugugcaguuucauuaaaauaauuuuauuacugacuuccuaguuuucuguuaauuaucauuucagaguaagaaaaacuauuacuuuuaaagccuauauuaaaguaggcuuaagcaagcacggaaaagaaagccagugagagaaaauauaaaaagaagcuauuaauauuaacaguuacaguuggacacuuguucauuucauaaaucuuugcaguauuagcaagauugaugagaaguaguacaaaugagaagcacaugagauaagcgaucauuuguuaucauuacugaaauauaaaguaugauucaguguuucauaauggauguuaaacuugauuuaacauaugguuggcucauuugcugaaaacuauccuuaaagacauaaacucauucuaaagucaaagacauugucuuaauaacagucucugaauuaucuuucuauaagagacugaguaaccucaauaaauacaaacuuagggagaaguugugaaaaggcuguuccuuaaggagaaaaaaagcaaauguguuauauacucugauucauuaaacauauuauagagaauucuaaaauaucguugaaagaguaaagaauuaauguguuuuaauaccaacacagagucuuuugaauugauuuucaaaugaugaguagagaaacccaaucacugcugucagugcuucagcagcuaccuaagaaauccuccuuugucaacuucauuucucuaaucaugagagaacgccagugcccacuuuaaguuuaguggauuaagcagaccacugcaagugcugcuaaaauaauuuauaaucuaucauuauacuucaguagugauaguauacuacugaaugagaauacacuggauucucauucaaccuggaaugagacacuuaaaaauauuuguuacaugaguauauuccuauccacgacuuaguuuugucugaauucucacuuccauuaacagaaaugcacuaaaaauauauauauauauauauauauauauauauauauauauauauagagagagagagagagagagagagagagagagagagagagagagagacagagagagagagagauacaaagucucacucuguugcccagacuggagugcaguggcaugaucauggcucauuguagcuuugaacuccuggguucaagugauccuccugccucacccuccuaaagcacugggauuacaggcaugaaccacugcaccuggccuacauuuuuuuuaaaacaacaauuuauguaccuccuagagacaccagaccaguuugaagacuagccgucuucaacagucccuguagcaauuaugcucagaaaggcuuauuucuugagcuagcaaguaucugcccuaaaaccagguucauuaauaaaaugucuaucuuucaaaaaaaaauacuugaaucuucuguuuucccugauguuugugucuuucuucauccuuggauaccuauucuuauaacacagcccaugcucaucugaaauaagugacuucaagucagcuccauuauccugcauccugccugcaaaaaugaucuagauauggggaguagugcuuccccuuguucuauacacuauaucaauauaaguuguuagacugcaucuucuuuaaucaaagugucaucuaauucacauuuagccaucagaagcaugucuaccaaagagcaaugcagccaaauaagcuuuaugcacccauccuuagguuauacuccuuagcuaauguuacucuuauuuggcauugauuugauuuauugacaacaaaaauacccauguuugacaccaacuagccuugaugugccacuauuacugacucucucgacuuugcucccccaauuuguaaaaugagaaguccaagcuuucagugauucaugaaagcagaguccacugucagccuggccacacaacuagccccugaggaucuugcuaggggucaaaacccacauauuagaucugauggggcccuccaaauucucuauuuuaguaaguucccaaaugcuucucacgcaugucucuuacagaauagauauagcugaaacaaucuacaauauuauauacugaacucauucaaccauuagcucaaaggaaaugcaugcuaaaccagcugcacaauccacucuguggagaaauccagcagccacuccaagaagcugaccuccaaaggucauggagcaagauggagaugaagagccagccagggucuagaguucccacuuugcucucuuaccagcuguacaacuuuggacaagucuguuaaccucucagagauuaggauaucuuuucuguaaaauggugguaauaaagccuaccuuagagggaaauugugcaaauuaauuuuuaaaauacacauguaggccaggcguaguggcuuacgccuguaauuccagcacuuugggaggcugaggcggucggaucgccugaggucaggaguuugagaccagccuggccaacauggugaaaccccaucucuacuaaaaauacagaaauaagccaggugugguggugcaugccuguaaucccagcuacucagcaggcugaggcaggagcaucacuugaacccgggaggcggagguugcagugagccaagaucaugccauugcgacagaacaagacacugucucaaaaaaaaaaaaaaguguauauauacauauguguguauguguuuguguauauauaugugugugcguguguacauauauauauguacacacacacguauguauauguaauguacuuacaaaaugggaggaguagagacacucgggaggacugcauuuggcuuuauucauuguuccuucugguauagcagcuaacacacagugaguacacuaaaaaaacaaugcuuugaagaaacaaucuaauccaacuacccaugacacguguuauucauucagaacaguuuauugagaggccucuuugugugaaacacugugacaguccauuugcuccuucaaaucucuuccuccccuucuuucucuguucugugcugcagaaggcugaucuauguggacuacacugacaggccccuugguguucuggcuucuccugcaaguuggccagugagggcuucauaaggauaccaaaugagaggaaaaacaagaacuuggucugaucuagcagaaagaucagaccaaggccccaaucacagagaucuccuguuucucccaaaguacucuguuuucccaaacaucucuccuacuguguugcaguaccacucccucaccuuaucccuuugggcuugagucuuuaaaacuccacugcuuaccauccccagguuccuguacuaaccuugugguuccucuaaaccccaccagugccucucuauaucgucccuuuauaaagaaguucucuggagcgcagccucaguugaguguacccucucuuccaguuggaagucugauauaaacaauguguuugaaguuagggaauacaguaacaaacaaacaagucaugaucucucauggaauucuaacuacuaccacugucauaacaaacagcuaccguuuauuggacacauaucccauacaagcucuauagaaguuguauaccugagguugcuaucaucaucucuguuuuucaaaucaaaaaaccaaaccuuggaaauauaaaacccacaugaguaucaaccaacagaauuugauucacaacagaacucagauucaagccagagucaacccaauccacagcacacgcucauaaaugcugaaguauuaccacauuuaccucaacaaugucccugccaaauggaucuucaaugugagucauaagaaauuuuccccaauccuucuccccaugccagaucuggggauuuucagaaagccuagugugaaaauucaggagaccugaaaugugcccucuuaucauaucuacucaccaacuggcuugugaguuuccuccucuuugagcuaauaccugcagggaggugcgcgcuuccguaacuaguggccuuuguucuaaccaccaucucugccauuuuuccugugaaauuucaagauaaaugcaggcaagcaagggagagagcccuuggacacucuucucuaguauucuaggacuuuucaggccugccuggugagaucagguaccuuaucacuagcuucuacuugugcaaucucccaauuacacaagcgaucccaucuagauuuacaaguggccauccucucugacccacaggccagagaacucagcccacgcaauguuuuuaaaauagaccccaacccaggggaggcugacaggcacacagcugcaccaacuuuauuaaugaguacccagaccuuuagauaauugauuuccacuuugaucccagccuacgcauuucuaucucugauaucuaaauagcaaaucauguuaucuuacaauuaagugauaaucuucauggcagaaaaguugacaggucuauaaauggcuucugcaagugauuaaaauaacuuccucccccuuuccacccagcccuggaaauguucuacaacuucacaaggcuauuacuuguuaauaaacuccccaugauaugaaccucauucauauucaacaaguuuacauacuaaguuacucuccagaaaugauauacaucuuauuuuuuaugcuuaaauaagaacauuuuauuuauuuuuuauaucuauuuuuuuggagaaagggucucacucugucacccuggcuggagugcaguagcaugaucuaggcccacuguagccuccaccuuccaggcucaaggauccucccaccucagccuccugaguagcuagcacuauuggcgugcuccuccaugucagcuaauauauauauuuguauauauccauggcagccaauauguauacauuuguagagaugaggccuuacuauguugcccagucuggucucaaacuccugggcucaagugauccuccagcuuuggccucuccaagugcugggauuacagucaugagccaucucaugcagccugcaaguacauuuuauuagccuuaguaaguuacacaaagucagcaaaaccuuugacuuuaauauucaaguaauauuaagauuguuaaauuuugcauguauaugcauggauaugaaguauauacaagugcagaguaacuugaagaucaguguugaaacaacauugaguauuuaauaugaaaugagaauaaaugacuaaaagaagauaaguuuuacuucaauaagugaauugaauauugaacccugauaugguuuggcuguguucccacugaaaucucaucuugaauuguaguucccauaauccccacauguggugggaaagacuuagugggagguaacugaaucaugguggcuguucccucaugcuauucuugugauaguaaguucucacaagaccucauguuuuaagggacuugaccuuucacuuggcucucauucuucuccuuccugccaucacgugaagaaggacauguuugcuuucccuucuaccaugacuauaaguuuccugaggccucuccagccaugcugaacugugagucaauuaaaacucuuuccuuuauaaauuguccagucucggauaugucuauuagcagcaugaaaauggacuaauacaaacccuuacuaugcacugaauucuggggcaaguacccaagauauuacagcaaacaauacccaccaaucugcuucuauggcagaacugggccacaugcccagaaggcaaguaagaauuacucugcaaccaacugaucaccauaguaacugagcaucagguagaaagagugcugggauugauuagcagagucugugauuuggauuggacauagaaaugauauaguccauuccauguaugcucaaugaacacugcacaggugaacagauaaggcugugaccuccucugaggcaagcucccugguuauuccaucuccauauaccucaagacuccuaacacaguucuuugcacauaauagacauucauuuugcaggacagauaccaagaugaauugcuucaguuuguuuuuaacaacguaauucuauuuccaauuuagauaauucauugauuucacaccuuuccuuccugguuacucuauacuuaauuuucccuuuucuucuuuccuuuuuuguuuguuuuuuuuuuuuuuuuugaaacagagucuugcuccauugcccagacuggagugcaguggcgcaaucuuggcucacugcaaccuccgccucccggguucaaacaauucuucugccucagccucccaaguagcugggacuacaggugagugccaccacauccagcuaauuuuugucuuuuuaguagaggugggguuucaccauguuggcagggauggucuuuaucuccugaacucaugauccgaccucucaaagugcugggauuacaggcaugagccacugugccuggccucuucuuucucuuucuaaaagcacaucaauuuacauuucuacaucugcuuccuacaaagaauuuccucugaaugaauucaacaaguguccuguacauguaaauauauguaugaaucuuuuguaccuauccaugucaaaggguuuuugaagccaaacugaaaacuuuccuagacuacauguugauguucugaauauccacauuucgaggcucuuaacaaagcuguaucaaacuccuuuucuucugaguaauauauuauguacguaaaguccuaggagaugcccuaagucuacuauaagugaauuuacuuuuuguuuucugcuuugcuucauucauccugcuuugcuuuuuuucucaucccaaauauaaacaucuguuuuguuaucaaguuaaaguuaaggagauauaaaacccucucagauuaauguacagcccauuauugaauucuggaucuuagugauauccaauauauuaucaugaauuuuauagaauauacugaacuuuuaauucuuaucugauuuaucuucuuaaugaugcuuagauuuccauucaaaaauccugucucuucucacccuuuccacacugugucuguuuuugugcccuuuucuagaguuuuacauuucucuuuaggauuaucucucucuuucucucgcucaccuacauacacacaccacacacuccauguccaaauucacagucuaagcauuuuggugauaugccauuccucuucuaccuuuguuagaaguuccucuuucccauggaaucaauucuaccggaaaaaagugaaaaggaaccuuagagagcaaucauuaaaggugcaaagggaaagguccccaugucugggagugucucuaaccagcugugugauacgugccauguaauaucuggcuuugguuuucucaucucuaaaacuggaggguaaaacaagacuaugucuugaaaccuuucuaauucugaaauguucacuauuaucaguuaacauuuauugugcuuuucugcauggcaggccucaggcuaacggcuggcuauaacuagcacuauccaugcucacaacaacuccauaaggaaggugccacgguuauccucauuaugucacugagaaaacugagguucugagagguaaagucauuucacaccugaugggauauggauguaagacuggaacucagacggcaugacucucagguuacagauucugcaucacaugcucauaucaacugaucuguauuuuuauacaacuucaaaaaugaaaacacugggcaugugaccuauaaauaaugaaaucauauacaaaaauaaagaaacaccccacauuguugaaaaauuauuuccuuuccaaaaauuacuugaaagggcaucaguaagcccuggcauauuuguucaaaauacagucuuacugaauagggguguguguguguguguguguuugugugugugugugugugguguguauauacacacauauauauguguguauguguguauagguguguacauacauacacauacauguguauacauguauauagacacguauacauguauauacacacauacacauauauacacauauauguauacauacauauauguuuauauauauacauaugugacaauaaaccaguagaaagguauauauauacacauauauacacauauauacauauguguauauauacacauauauacauauguguauauauacacauauauacauacauacacauguauguauguauacacauauauacacauauauacacacaaacccacagucaucccuuggauugguuucaagaccccugcauauacaaaaauuagcaguugcucaauucccugauaugaaugguauaguauuugcauauaaccuucccaccuccucccauuaacuuuaaaucaucucuagauuacuuauaauaccuaacacaauguaaugcuauauaguuauucuaacauauuguuuuuauuugcauuauuuuuauuguuguauuacuuuuuaugguuuuuuucccaaauauucuugauccacaguggaugaaauucacacacgcagagcccauggauacagagguccaacuccauuuuuaaccaauacucauauucgcacagauucauauaaucucacacuuucaaguaacguaagcacuauaugaucccauuauauuaucagcuugucaagaaaacugccuaugcucuguguccuuuauaaaacaauguuccuaccuaauaagggcagcuacagccuuuccccccaguucucccugcuauaagguggcacccacagauaugucuccuucucuuuugccuaagaaggcccuuuugauuucucuuucaauccuguccccaagccugaacucaucaguauccccuacugcugccagucuaggagagacuccaaucaucuuccccuacugcugagacagcagccuucuaccugguagccucugcccuccucaguccauucuccacacugcuugcuuuccuaucucuucucaaagccaaucacauaggucccuuccucacuuaaaaccccuuuaugacuccucauugcaucagaaauaaaaucugaacucccuuccacuguuucagaggcccacucucaagcucuccacaucuauaaagugccaacuagucuuugccaguugucaaacagacugagcuuagcuuucucucaacccagaaccuuuacauacccuggcuccuugauuuggagugcucucucuccaucugccuucuacagucggaccuucacaucuuucaggcugagacagaacccuccuccagagagcuuuccaugucccccuuauuuagucugacccaagcccauuauucucucuucacucuucauuuguuuccuucauaauaauucugauugaucauuguguuauccaucuccacgugugugugugaacuauauucucucacuaucacacaagccuccggaggauggaaagcagcuggccuugcugauagauacaucccaugcauuuaacucagagcuuggcucagguuagauggucacuaguuauguauuuguuaaacgaaugaacauaugaccucagaucuuuuugccuuaagagaaagaaaaguaaaccauuugaaaaggggggaaaaauuauaaggcuagcaaaaguuaaugguauuggcaaacauuacuacaggcccuugauagauguuaaaagaauggagaaagcccuuuaacauauuuaauauaucaucccuaguuggaagauacuuuuagaauugugccuaugcccaaaaguuaauaaaugggugaggauauucugugugacuaagaggggcuaaugaauugauaaguauuucugugagauuuacuggaugguugaaaaaucucuguacauuuuccccugauugucucuaccuuucugcuggcuuauugucaugcugauuuuuauggaucuacauucaacagcuaagguaaauaagguaaaaugccagagaauaauccaccauaauauaguagaaaacuuuuuuaaaaucaaaauuccuguugcuaaacccaccaucuaacaccuuuuaucacauuugagugaucuuuaaaagaacaucacacuuaaauucgcuuuugaguuagauuacugaagacaaaugacauacugaaauagcaucuaaaagcguuaauauacaaacaucuacccaauacagauuuaaauauagcagugacuguacaccuaccgaaacaugaaagacuaccaggagacagggauuuaauguggauugauacuaaaaagcuaauggaaauccgguggucuuuaugauugagauggaacaucuuucacggcucuuaaaaccuuaggcuggacagugaagacaugggcuggugcugaugaaggagggcuauaccccaagccugggaaucuggaaaucugauguguucggccagagaaacuccaaaguucuccguguuucugccuuucucuacccccacaaacuucaauucuucccuugcuaauaaaauacuggaaacugaguaauaaaaggcaaauuucauuucaauccuuugggcucaaagccagcucccugccaaaacuucuccugccuggagggguagagcagggaaugaguuggggcaagcacagauguccugcuucuacucuagagggagagaucugcaaaggguauggcucagcaucuugucuaccagcuaaugugauucauaaauaaaucacacagggagaagugugggaggccccugugguucaauucuuuaucucuuuuucucuuccccaguguggaagauuguccugagaguguggggaccagggggcagagucaccuacauggucugcuguacagcagcucuggcagcuuagcacaacccauucacauacugggcagagcccuuccaauguuaaccucugccagagcuccuccugacuuuuuuuuuuuuaauccuaaaagaggaagcauuucaaaugaccuaaaucuaaaaauagaguacuucaugcucaugacuauuuuaaauagcaucuaaaauaaagaauuaaaaaaaaaaacauguuuccauuuuugugacaguuuccccuucccuugaaaaaaagaaaauacuguagagcuugucauucaaucuaaaaucagacuucgugccagcuggaauccuagguuuauuuauuacugugcacaguucuuacauuaacuguuuguuaaagacugauuuuaccaccacugagacacaauguaagugaaggucuuuccauguuuuaccaaaaagagugauucaagcaugacccguccaggagaaaugauauuaaagaaaagggacagaaguacuacucagucacugauccaacuauauuucuggagaaaucaaguuuaaacauaaguaauugccuaauggaguugggccaagguggagauaggaaaauauccaugacacuuccaguauuugcaaaacagguucaaaaauaaaauugcaacauuuuauggucuguaacauacuuagucacuuagucgcagagacaucuggaaaaagauaauccaauggggcagguuuuuauucucuacuuuagaaaauuguucacauuuauucccuaucauaguuucaaguagaaugguuauaauucauccaauaagcuuuuuuaaaaagcagggaaucacaguuucugggcguggggcccacaggccuuuacaaaacuucauagguuuauaccuacauaggucauagauugugaaugacacacaacaugaugacuauguucaugaacacacaugcucauauacauauauacaugcagucaagcucaaccuagauucacaaaucuuacaagguuuuacuuccacaauaaugggcuccuguucagucucucuugccagccaauccuccaagagagacaccgacaaauguagacacguaaacaugcuccuccaaacauggaauagcuaucacuuauuucaagucaucaaacguaugagucagcuguaucuugauacaauuaguugagguucucuuucaauguacuccuuagacacucuguggugucaagcugugguacuauggcucuuucacuagcucauuaccaccuccagcagagucugccuugguauagccucagaggcacagagcaagcacucaauaaauauggaguagaggaaagagaaagguggacaggaaaaaaggggggagggaggaaaggagaugaaaaaggauagaagagaaagggaagccagugagggagugaauaucuagcugagaauggaggaggaaucucaaauaaaaagggcaaagucagaggacacucagaaaaacagaaguggauggacaacagugccacaggaacucaaaggugcaauguuuucaaaagauagauagauuccaaagauggcacccacugaugaagcuuuucuauuaccagggucacauacaaacaaaucaauucggcacccagggcugaggugguacagcgucacguccuuaaaaugccuucagggaccaggcaaauagcauaaauauaagauuauaggcgagaaaaugcuuaaguuucaagcacagcaucuguuucaagcagaaaaacugugcagaucaaacagcucagcccagacucuaucccuacacccuggagcuaacaaaucaauuugauucaaauauuuguggaauaccuacaaugggguuuuaaucacaaaacuuuacuugaacagcugcaaccucuagccucuccaggcuucuuuccucaucauggggagaaaaacacaaacauuucaacauuuguugagaggagaagagguucuacaugaaguaacccgacugacuuauuuguacugagaaaggaaaagcaacuaacccugaccuaccagaacuucucaccucgggcaguggcagugagcagaggucucagcagcaggagccugcacaaccccaaaggacauagcagagacuccaauaccaugucugaagcaacuucuuugaaaucaaaaugcugaucuucucacaugcugauuacagacacuuccauuaucaaacagaagaauuuggggcaaaauggauucuuaauggugucuguuuccuacauuuucuuaucaguagaguggcucaaaaucuaaauccaccuaaacuguccaucaucgcccccuccccaccaacaaugcucucauuuuauccuguauguguuuuuauaaaacgucucaccaucuguaacaauauauguauuugaguaauugcugguuuacuguccauugccuccacuaaacuguaaacuccaugaggucaaguacagagucuagacuugcucaugacuaaaucaccugcaucuggcacauagucagcaugggauauauauuuaucuguuggcccaacaaauaugacucuugcugcuaucugauuuuacacaagcacaccuccacuggcacaacacaaggagaggagaagagggaggcaucuggagagcucaaugucaagguuacuucccagcugccauuccuuguguuuccugaaugcaaguguaacuaguaacuguacuaacagagccaagggcuauauauucuucuucaucccauaaacagaaaaauaaacaguucuguggaacugugcaaacccaacuuaaauuucagauuccagacccauuaucuggcacccuuugcucagaaauacuuuacuaccacuagaagacaaucuaaccccuggucucacauaccacauaaugcugaaauucuuccccauucugucucaaaccugcccacaacuccguuucaugagggcugagccacuauccaauuucuauccuuauagggguucgguuuuagacuaugcucacaaaucccaaauucccagugaguucaggaaugaugcuuccuuaccuuaccuuacauaggaccuugaagauuucuauuacccgcagauguaacaugcaguuguuaagaccgcacauugcaucagcccacgaaaugaguugggggcuauccagccuggccccucucacgaggccauguaccuugugggggagcugugucuccacaaaaggaguaucuuuuucuauuuuauacaaacaugcccuauggauuaguaacagucugauacuagaaaaaaggaagcucaaaacuucacaggacauggcaaauaaaacccagugaccugauaagagguacaauaucuccuugguuuaauauuucaccucuucuaauuagaauaaaauauucacuaggaaaaauuuuuaugauaguguccuuuuggcauuagcaugaauaccuccaaggagccguauuauucaaacaauuuucuauuucaaaauacacagguaguaagaacuaacaaaucauuacauuuccaccaaaugcacggaaacaacaaacuuaacuaagaaaauacugaagcagcuuuucccaacgguaccucgccucccuagagcggaaugguuuucuuuuaaggaaucccuauugaugccagaaccaccuuggaagaauaauuaaugacauuuugaaaacugaacuuccuucucacugccuuucauaaugcaaagugaaggggaggcggggugagagucccccaggaacacacaaugcauuuuuacaagagcuucuaaagccccucagugagacagaaacacacuuucucauuuaagcaaaacuuuagaaaacuaacaauuaaaaugugaguuaaacugaggaaacaucuuacaucugugauucucccuccagaauaauaugacuagguagcuagcugccagacacucuuguuucagcaaucaugugacuaugugaugagggcuggcuucaugauucagguggaacugaucagggcacugacacugauggagacaaagcuugucaggcaugauguccuuguaggcaacaauaccugaaacucuguuaggaaaucugaggucuuuggauagaaggaaggaaauaagccaaaggcuagagucacacagucaguaucacuucagacaagucagcacuggaucaaccucuucaccuguaaaaugaggguaagaauauccacucaauaaguauaugauaaaaagaaagugacaacacaaaguguaaaugaauauuuaagcaacaucuacacauaagagacccuaaaugaauauccguugaaauaaaagcaaugguuacaugcuucucauauccuguggcccacugaccucauuagucauuaucuugaccagcuccacuugcacagcauuaugaauuacaugugugcagggcuauucaauugucuaguuugauguucuuaaccuugugaggcaguaaauauccauuuuaaagaugagaagacugaaguuuacuucacaaucuuaguggcuccaaucgaagaucguccacuguaaaauucaguuaucugccucaugauuucacggcuuauggcucuauggaaguucuauucuuaacaugacgcaaaggaagucagaaguugcaaaacucugaguuagauaauuaagccaugaaaagugauugaugcuaagcaucuguacacaacaugugaaccaagggaaugagugacuagaacccaaagagaguuuggaguuauuuggcugugacugagaaaugaugggcuaggaauccagguaacaacaacaacaaaaguaaauacacauugucucuccucuuugagaagaugaaagaaaacaucuuuuucaguucaaugaugcuuccuguagacagaaauuuucucauugaauggacaaaacuagcaagugcacaaguuaauaauaaccuuuuacccaagguuccauagcaaguuccacaugcuaugcuaucaucuaggcucccugccugccucuucucauugcauccucaugacaaccucauaaguugucaugcuaucuccaaguuuuggauagagacugagucucaguagagguaaguuuguuuuucaggcaggguugagcuuuucgaaguacagagagaacuggggaauggggugcuucaaagucacugaaagagcugaagcugugggcucuagaaagacauccaggaugaccacgaggaguaccacuacuucugccaccaucagaaaggcagagacucaggaagucaccaacagaaucauuauuagaaguagacugucugaauuaugaacauggaucagaaagcugcugucaccaacacagccuuugacuuuauaggaaagccacacuagcaacaaaauaaacgcucuauccacugcuucucaguggcccuucacugaguggccagguacugaaagaugagugcccaaaagcccgaugucuccuccaauguucuagccagcaaagaucacagagaauacagaaaguuggcuucagucucaauucugucuuccaaaacucaaacaagugcaucuaacuggcaaacaaggaaucagauccagggccuuagcuguaaagcaucuggaaauguaauguuugaccuucccgccuuucaguacaggaaggcacgugaugaggaggcuagcaagguuccugagagcucaaucacugugucuacuucaucagauuugccaucccauagcugauuccuaauuaaagggagugagaaccaaaaagggggcaaagccaaguauaugaguaaaugcacagaaacaugacagacuaauuuaaccagagaacuaaaaaggguuuagcacccacuaagugaagagugcauuuggaaacaagguggaggauauagcuggagaggcaagaaaaggccagaugaugaaaagucuaucaccccagcuuagaagcuuucucagccuaagcuaggauaucccuucugaacuucuuagaagccuugcacaauccucagcuacucauugaucacacagaauuguaaccauucauguucuugccugcuuuacuguucccccugacuaugagggugggaggucaagggaaaggaggggcuauuccacuuuguauuucuagaacauagcacagugccuggcccauaaacgaaagcuccagaaauacguguuguauggaauuacgucccgagguuccuuccacuaucaaucaucuacuuaaaaaggagaaaaugcucucuuuaccuuaaguaccuuucauuauuaaaaaaaaaaaaugguuaacuauggccacgcaauggcucucaccuguaaucuuagcacuuugggaggccaagguggguggaucaugaggucaggaguucacgaccagccuggccaagauggugaaacccugucucuacuaaaaauacaaaaauuagccgggcauggugacacaugccuauaaucccagcuacucaggaggcugaggcagagaauugcuuaaaccugagagacagaguuugcagugagcagagaucguaccacugcacaacagccugggcaacauagugagauuccaucucgaaaaaaaaaaaauugguuaauuguagauuacagauugauaauuguaagaauauauuccuauagacauauuuuuguacauuuauguacaguaguagacaaauguuguuucuguuaacugaaccaccauucucccauucugaugauagugccucaauuuuccuguaggaaaccacagcuacuccccucacaugaagaaauucacaugagggguaugaccucagcccugggguuucaguuuggcacaugacauggcuggaucaaugaaaguucuccgugggauucuugauaugagcaacuuggcagugagggggaaaaaguugcucucuuaugcugagauugcuacuaguggcaagauaguaacauuguauggccaaugaccaccacaugagacaagguguccaaagaaggcaacauggaggaaucagagcccauggagggaaagacacagacucuauuuuuuuuuuuuuuuuuuuugagacagaguuucgcuauuguuguccaggcuguagugcaauggcgugaucucagcucaccgcaaccuccaccucccagguucaagcaauucuccugccucagccucccaaauagcugggacuacagguaugcaccaccacgcccagcuaauuuuguauuuuuaguagauacaggguuucuccauguugaucaggcugguuucgaacucccaaccucagaugauccaccugccucggccuuccaaagugcugggauuacaggcgugagccaaugcgcccagccgggagagacacagacucuuaacaacacugaguacucggaucuagggugucaaagcugucaucggucaguaaauuucuuuuucuuuuucuuagaaggucuaggaugguuucagucugguaacaccaaaagaaauucaaaguuuuaaguuuaccauacauaaacuauuaguugaagaaauggcaaugacuaaauagcagaagaaugaaacucagcuuugggggacaucaaucugucagucaucuacugugcagccauuucgaggggggauaacuggaagagaugaggcuaucaccuggacauucuuaagagaauuaaaacauaauaagcccucucccugucuaaaugcacagauaauugauuaacagaaaaugaucauuacuaaaauggcuucagaguuuuucaggguugugggaauuacaauuguucugaaagaaaacugauuacuuacaguuuccuccuaagauuguaguugugcaguaaugauauugagacagcaugaugcccauuaaaaaaaaaaaaaaaacacugaagacuuuacaaauaacugagccaaaugagauauugaaaaaucaaagcgagaaagucccaucacuaaaaguauacaaauacaugagaaucagccaguaaaacaggaagucacucucaucuaaaauggccuuugcuugucaucaaacucauauagaauuccuaaaaucugucaguguaguagcuucuaagugauaugucaacaaauauauucacugagaauacuuauucugccuagagccaauguuuuuagaaaaacauccuaaagagucaacuguuaaaucacuaaaaugaauguuuugagcagguguuuggaauugugcugauuuauccauauuuuccaguuuaauuuccacguuuaccaacaaacuucagcaagaaaacauaaaauguaccuggaaggauuauguucaucauaaauacaaggacaguugcgcuaaacauaucuguacugguaacagugauucauaaaccauauucauuaaccuaaauccuuaaaguuuucuguuuaaacuguagugauuggaacgccaagugucagaguuuaaaaugguauuuuuaagcuauuagcaguugacauuuuaauuaggcauauuuaugacagacauggggggauaaaaaagaagguaagcaaggaauaaaaggugcaucaaggacacaagaaaagagaaaagaauuaccauccauuccuguuauccuuuucuuuuagcauaucaauaggaaagcaguauaacuaacuggucaagaauguaagaucuaaagccagccuuuaucagcucaaaucaugacucugauauuuaccagcugugagacccugaacaaguuacauaaacugcaucuguuuccacagggauaaugccagcacguagcucauaagguugcugugggaacugaauuggguacugcucaaaaaauauguugcacagggcccaagaggaaagaaguauucaauaaaugcuaacuacuacuauauuauuuguaaccuuacuuaccgggucaagggcuaauagugguaguaaauuguugcuuaaaauuuuauuuauauauuucuucuugaaccagaaaagaugccaggcuauuuauuuuuuaauuuuuuguuguuguuauuguuuuacaaaggguuucucagucuguuguccaggcugcagugcagcagcacgaucauggcucacuauagccucaaacuccuggguucacagagugauccuccugccucagccacccaaguagcugggacuauaggugcacaccacuaugcccggcuaacauuuuugcguuucuuuuuuuuuuucuuuuuuuuuuuaagagaugggauuucacuauguugcccaggcuggucucaaacuccuggccucaaaugauccuccuagaucagccacucaagucacuaggaucacaggcucagccacugugcccagcaugcaagacaauuuaagaggcauacaaaagacaaaaauauaacucaacuuaagaacagauuaagaauuaacaagauaagaauauuuaagaauagguuaaguaaacaaaugucauagacaaaacuagagucaggaacaagacaaaggauaagaaucacuuagauauggcugcucuaagcagcuacuaguuugucuucagcuuucuggcauccaacacaagaaagaaaacugggucugcggcacaauuuucaauauucgugagauuaaaauauacuaaaugcccagaaagagagaguacagugauuuuguuagaggccgagaacauaaggaacuaaggccaugcagcaaaucuucagaggggcacaucauagccacgguagauagcauugccaaacucaauuucuuagcccuccuuguauccacaccuguauauggccucuggggccacacguauuuccccaccucuucagucaaagcuugguccuaggacuuccuuaggcccugauauauggggagaagugacagugcaucuucacucaguucucacccucugccuuaaaaggucuuaagcauuucugcuugccuugcugcaucuccacuacagccauagaaguaagugacauaguuggugugguugcuagucuaagggagaugaaaaacacaaagcaguauggagcagagccauccacugagcccagccuagaucugcuaaaccccagaugauucacuaagacacaagcaaaaauaaaugauuauuguuuuaaacuucagaguuuugggauaauuuguuaugcagcaauggaaaacaaauucaguaacaaaaugaugacacuuuuuaaagcaguauuucuauugccaacuauaagucaaacaguaugccuucuaaauggcuuaccauaaccuaucuucauaacuuugauuucuaaacuuauuaaccuuguuacuguaauuucagagacccucaacaauuaauauaaauuaaauuugucacucacccuacuaaaugaaaguacucuggaauacagucaccaaaauuaaauaaagguugaggucauaggccuccaaauacaggccauacagcauaagcaaaauuaacugggaggugggguagggaggcaagcaguaggucauaccuuaaagagagaccaacggcuuccaaaguaacaacacuaggcaugaaaguagcccauguguggcccucaggagagcugccauguguaugaagacacacuggacugagaaaucagucucuucaaaugugugcuuuauucaaaagauaucagggcagaugucccacaggauuuguguugauuugaguugcuucucacaugagcaaagcuauccagcauccauacggcagaaguuguuauggggacuuauucauuuacacauggauaaugaaacucaugagcaaggcuggggagaccaacuaacaacucuaauaacaacaguaauagcugaaucccauugauauggauggugcuagucacuguguuaagcacuaagcaucaauuauuucauucaauucauugaacacucauaauaacccaaggagguaguuauuuuuauucauuucuccaaccaacuuugccuuuugcuuuuacaggcaaguauucuggagcuuggagagacugagggaccuggcuauaguuacaaaggcaccaccuuguuugacaggggcucucaggcaaaauuagaacagguaaacuugauuaguauuugcuuuagguaagucuugaacauuuucucaguuaacugaagauuuuuuuuaauguuuauguauuuuuuaaugaauacauuauaauuguacauaauauuuacgggguacaauuugauguuucaauacauauccguguuguguaaugauccaaucaggguaguuaguauauccaucaccucaugcacuuauuuggugaaaaccuucaauagccucuuuucuaguuauuuuguaauaaacaauauuuuacuguuaaucauagucacccuaccaugcaauaaaauaccagaauguauuucuccuaucuggcuguugauuguaguuuuaauucuuuucuuaaauaugaagcuucuguaacuucaacuggucugugaaaauauuaugccaaauagaaagcacuuuuuguaaauaaagggcgugugaugcacuaugaacaccucccaaaugauuuggaggaaaaaaacaucaauuccagugauauuguuucagauuaucccaauggucuagguuuauuccaaagacuuugaccuaaaucccucaguauuccccuucaacuaacucucaacccauuugaaaucuuauucauauguucucacuguuagauuguccaccuacaauuuuuuuuuguccuuugaauuacuuucuacugaaaauaauacacagaccucgguguuauuggaaauugcauugugaauacacaagguuuuuugucuaaauuuuagguaguuuucucuuucuguugcuaccucaaagagauaacagauucugcagucacauuauauguaaauuauguacaagcuucaccacuugggcuuguacauuauucuacugauuuucuacaguggcguggggggcacauaauagccagcaacaaauuauuagaaauuaaauucaaacccaguguaugcuggauaugagcauuuccaaugcauuuugccuccaauuuaguucagaugacuaaaaacagaccugugggacuguuuaaaggcacuaaaucuccacagaaucaugcagugcuaugacauaggcauucuguucucaaauauucaucauuuaucagcaacggaaacaaacauaggauucacaugugcaaaguaacaaaauagaugguccuagcugacauaccaguuugacucaacugacuauuacccuuacaaugagcagcuucuuaaaccacacuuauccugguccccuuuaucuauguuagagaaacaagaccaucucuacuauuaauucugucucaaaacuucagguuaccuaguuuuuucccucaaagauuauucaucuucgacagucaccacugcuucacaaaacagauuuuauuguuuucuuugccaauuaagggcuccccaagaacagugaauaaucugucagguuguuauaaaccaucaaaaguucuagaaaugucacauuaccuccuucaaauauuuuuuaacaugcaacagggacauacagcuuugucaucaaaagcuguauugguuuccucauauuuucuaaucuacaccauaaagggaagauguuuaucauaauggcaaaauaaauaauuuagccaguccaaaucucuuacaauugcauguggcaaaccaaagucaaacugaaggagaggaggguggaauagagguuaauuugcucacaugacaagaagccuugugacuuuauuuaggauaggucuaggcagugaggcugguaaacauuuaacaauauacucauuuaaaaaaaaaaagggcaggggguaggagggggcugacuugcagccaauuucaagcuaccaacacgcugucaaccagcucacagaauuccugaacauuuaacaauaggcuauuguaugcugggaugagccauccccagcaugauacuagauccagcuaucaaacaauaucauaaacaccccauccucucuucucuuuuuccugcuuuacuucaucugauuucauucucaaacagauuuacucaaagaugacugcagaggaauguucucagagggcucuaaauagguuggcuuuggaucugcccucuuaaaacuaaacauuaccacagaggaaugaaguauucugaucacccaguuugggagcuagagagaauggggguagcuacguucaaaccauuuggaugaggcaggacucgccugaaaugggguaaguguagcccuccuaagaaagaagcacugugcggaugaacaucaugaacaccauccaaguuucaacaugucugagauuaaaucugcagcaaaaguuuacuccauuucuggguguguaaagcagcuaaaacuuccuaccaugcguccgcuauccauggaaauccggaacaaaagcuuaagauccaagaaaauaaaauguguuuugaagaaaaauaugcucuugcaacauaaagaagcugucuucaguuacaaauagauauaaaaugugaagauauauaauugcugcauaaauuuauuaauagaagugcuaaugccauaaaucguacaucuccauuuugacacgcaauccuuuauuuuccuuucacugaggaagaaaaauaaaggagcggaacugguaauauugcuugcaacuaaauuggauuuuccaccagagaaagcuguuuagaaaaagcuauucuaaaaaagcaaaauaguacucacaaaaggguauuaaugaauccaaccaggaggaaaaagccuccaacaauacaaagcuuuccaaaaccucuuucaggacugaaagccaaaaggaugcuuugaacucucugucuuugcagaaaccaucucaccuacaaaccgaguaugagauagaguucaaauuuuagaauaagaacucuuaauucaaacuacaagucuuaacugacgauucaagaggagagacugcagcagcucuggguuucgaaggaaaccgauacauccugcccucaaacugugaggcacuauaggagcaagauguaaaggaugcagugccuuugcgcucccaccuccgccaccgugggugucauaauacagaggugaaaguucaacaugcgacagguagggaugcagcagacucuguggcuuuauacugcauaggucuuucacugcuuggucacagaauuucuuugaauccuauuuguuuauacacugauauuuauguaauaacaaaagaguaaguaaagagcaaggaaacagccaagaaacccugagcaaauuuuuuucccccuaagaauaaaggaguugaguuaggcuaucuucccggagcuucucuuuaucgcuagaugcagucagcuggaaacauaugccugcuaauugcugaaugugugccucauggagcaacggugcaguugucgaacgaccucggggaaacaagucuaggccuauuugugcauuucuuucuuucaccaugggacucaagugcuucgccaggccacuauuaggacaguggaaaaucaagguggaaggcucugaugaaaucaauuaucacuaaguuauuuucacuggugaagggguuuccucacagggguuuaauaguaaauuauucuuuccaugggaugugcuagauuaauggaggaaacaaagcaaacaaauguugccugguaagacuaagaggagggucccaaaauacuaauauuuacugcccaugaagagauagccacauucacaagaaaauaaauguaaaccuacaauuccagaggcgaaaaggaaaaagaaaugcuaaauggcaguuauuuccucaguguuauacauuacacauaucaauaaacccuagagucccauacuauacaugccauauggauagauaaauggcauaugugguaauagucuuucaaacuggaugauaguacuuugcacaagucagggaugcagcaauuguuugaaaauagggaaaauaaccauuuucuagcauuaccuagugaaauguaaguguggguacaguuugggagaaucuguauaguauuuauuuuuauccuagcaaacuauacuuuaccuuucugguagaauuuuaacuuuggauauuuuacaaauaucauauauagucuugguaacaucuuuuauuuaaaaucacaaauauuaguuggauagauguguuaagggagauuuaccagacugcauacacaaaggaggccaucagacaugggcaucugaauugauauagguuacaccacaccguaguuaaagaccaaauaucugccaguguucccaauaaggaaagauaacuaagauaaaagaaugucucuugcagaauuaagaccuugggauucuuuuaaagccuggguuuacauccuuugcucagaagagaaagacacauuauuucaauauauuuucauucauucuuaggcauuaacugucuuaauaaaggcagugcuucucacuuaaaaaauaaauuuagcuuuaacaaaguaaguguaaacgugacccuaauuuucacucugcuguccuuucuucccuguugugcuuauuagcugcugcucuuugaccuugaacaguaauccuuugagcaugccuccuuccaccaucaagaggagguucccuacggucugguaguauuucuaucauaguuguugacaugccagggaaaauaauuuccuuuggacacuauaacccuucucgaaaccagcuccuucaaacaacucaccuaauugaacgugaaagacaugaaaccacuggugucagaaauuaaauauagguguuucuuuguuuucuuuggcauuucuucuauuuacuuucugucaucuaugccauaggauuuagaaaggaaagcuauggaaauaggcaccaucaacuagaacucaaagagagaauuuuguaugaggaacacaguccaccagcagaaauagaauaguguuggauauacucuucaacaugcuuuuuuuuuuuucaggaucaauguugauggacuguauugaaaacaaaaggguaauucuucuauggaguugucuugcaaaauucuauucuaggguuuugucuuuguccuuuguaagcacaaagcaaaugagaaaacaaguauaugguauuuugaucaaaauauaucugccauuaaaccuaagguuccggagcuccaugguaucuggaagaugcuuuagaggguagguagccugaaggugcugcggugccaucaaagggcaaugaacaucuguugccccauagccccuuuccuccuccuccagcaacaacccugacaucauuugggaauucaaucaucuccuccucucagucuauaaggucgcaguagaauuccauccuuagacaugaagaaugugccucaggccaagcuaagaggcacaucuuacuccccuaugccccuaccccccuaccccccuacccauagagauuugcugugggauagacacaugaccuaauccauucuaaucagggugacucucaggaugucuacaggagcuauaaugaaagaguuguaaugucuacagcagaaauaaugucuucugcuggagcuucugcagccauccugccaccacugguuaggcuggauaaaaggcaaaccuuuaagccuuuuuuuuuuuuuuuuuuuuuuuuggugaccaaguuuugcuacuuguugcccaggcuggagugcaguggcgcaaucucagcucacugcaaccucugccucugggguucaagugauucuccugccucagccuuccugaguagcuaggauuacaggcaugcgccccccacgcccggcucauuuuguauuuuuaguagagaugggguuucuccauauuggucaggcuggucucgagcuccugaccucaggugguccacccaccuuggccucccaaagugcugggauuacaggcaugagccacugugcccggccugccuuuaagcauuuaaugggauguuaggaauacgguacuguaauuucuccuuggguauaaaauauauuggagucaaucacuguugccccuacccuaguggggauauggcaaugaucucaccccauaaggcaaacacuagaaauuuaugcuucagaauuccaucuggcuuugguuacuuuuugauacuuaugauuauuauuuuuauuugaaacagaggcucacuauguuuuccaggcuggacuugcauucuuuagucucaggugauucucccaccucagucucgaaagucgcugagacuauaggugugcaccuuaauuauuuuaagaaaagaauguaauggcugggugcagucgcucacaccugcaaucccagaacuuuaggaggcugaggcgggcagaccgccugagcucaggaguucgagaccagccuggccaacauggugaaaccccuucucuauuaaaaagauaaaaacuuagccaagcaugguggcgcaugccuguagucccagcuacuugggaggcugagguaggagaauugcuugaacccaggaggcagagguugcagugagccgagauugugccacugcacuacagccugggugacagagcuagacuccgccucaaaaaaaaaaaaaggauuuaauuuuuaaaaaucagcaugaacugaaauuuacuucacaauggaauuaaagacccccaacaagucauaauaugcuuauauggcaauaucacauuguuugugugaguuauaaaguuggauggauuugcacuggcaucuuuucacgguuuuagugagagaaucaugcaucauccaaggaacucugauguaaaagacuggacaugagaauuauuacagcuuugaaauucugucaauuuccuacccauuuagucagauuuaagaacaguaugaaccuaucuuacccaaaaaaauagguucuaaagucaguacauaaauuauauaaucaugugauaugacuuuaucauaucaguuuacauuccugaauauaauaugguccaauaucuucaaaacauaucaagacucugaucacuucuuaccauucacaccauuaucaucaaguugaaaccaccaucaccuguuuucugaguuacuuccaaagccuccuaaucaguccaaacuuagucccaugcaauguauucuucaaagaaccaguaaauucuuuuaaaaaauaaauaaacagaugagaucacagcacuacuuaacaccucuaacguccucccauugcaaaaucuguaccgugacuuacaaggucuucucgauuugauuugccccaucccuauccaucuaaucccaauuccuaccacucucccucucucucacaaagcuucagccccacugucuuucuugcuguuccuucaacauuccaagaucuuucucuccucgggggcuuuaaaccuuccuaccucugccugcaauuguuuuccucuuaauacuuccaaggucucccuuuugaauccauucaguuuacugcaccaaucucauaucuucaaaaaguuuuuccuagaccuccuaacaaaaauaaggccccuuuccuaauacucacuauccccuuauuuuccuccuagcaccugcaacuauauaauuucccuguugacaugcugauuauccaucuuauccacugaaauauaaucccuaugggcacaaguacuuuuguuuauuugcugcugaaucauagcaucaagcauagagccuggcaccuauaaauugcucuauaaauuucuggugaauaaaugaaucaaucaauaaaugaaucuuccaacaacaugaugcaacacagaccaacguucagauccuacaaggucuaauaauguggcuaaaggggcaccuguucuugguucccuuuggugaaaaccugauaaucaaugaauggcaagcauauuuacauauuuaaaaguuugccugcaagguaaucuuaccuugaggcuguguaauaggaguaaguaucuauuagcucguaggaagcacaugcacacauguauguacacacauaaacuacucugaucucucaugucuucaacaacuugacuacauuuuuaccugaaaaaauuauuguagcuauuacuaaugugaugcacuaaccagagagcagaaacaaauugaguuguuuguuucuccaggagggaaagcaggccgcagcuacuuccagaaggucaagagaucaggguaugaauaccuaagacauguguguguauauuucugccacagggaguuuucacacaauacacaaauggaggaucaacuaacaggcugccagucaaggggagauucaagaaguuucaaagaaaugcucugaaccccaaaauaacaaaggaaaacauguuuugaaaaguacacaaagacaguucucuuaaaaaucugccaggacuccuugccaaaauggcauguuacacauccccuucucuauaaccuauaccaucugggcuuuccguaccccaccagcaggguguaagaaugccuauucauuugcaccccugcccauauaaguuauuauaacuuuuuaaaaaucauucccaaaccuguagguuaaaacaugaugucucccugcuuuaauuuggaggucucuaaguugcuuacgguacaaccucaggauccauucaugcucauuuuguagcuacaaaagaaaaagcucuaaaggaaggccaagugaaauccuggacaugcagugugaugaagaaauaagggcugcugcuuaaccaagagucaacucaagcagucucugugaaguucuuucucacugccucuguuuauuuuccuccucagccaacacacgacuaacagcagcaucuugaauuugcguuacaauuuaccaagcaccuuuauuuuccucaaugaucuucauaaaaauucuguacuauggauaagaugacucuguuuuccagaugcagauccagaaaauggacuuucccucagugucuccaguuauuaaguaguaaaacccagacuagaaccuguguuuucucauggccucuucaaaguucuuucuacgauggcauaguuccuuaagauaaaccgagugaaagaaagguaacuuucacucacaauucaccagaaaaaaaaaaaaaaaaaaaaaagaggaggugggggagaaagaggugcuacacucagcugagcccaccuguuugguuucuguuagcuuugaccaaagugccagucauuacacuaaaauucuauuuugagguuuaucaugaauauugguuucuacaaaauucuucauuaauuaaugcuagaaaacacagcucucagucaauugccauggggcacaauacccaggcacugcuuuucuuuguucuucccagucuuagggacaccaauccagauagaauuacguccaaaaguagccuaaggccacguuuaugaaauaaaaacaccaaggacacaggcugauuuuagggcaaauuuuaggucuggcauuuuaucauucugcucuagaucuagggguuaaacucuacugaaauaacuaugguugcuuuugguggaaacccccuuccccaggcccuuccagcccuggccaggauucaaucauccauucaacagcuauucacuacacauucacauugugcuaggugcugggcauacaaugaagaacaagauagacacugcuuuuguucuuuagagaugacauacuaguaagagagacacacuaaaaacaaguaaacaaacaaaguuaugauugacuauaaguguaauacucuaaaggaaacaaacaggggcacuaauggagaauaacgaaggcaccuucuuuguuuaggguggccaagcaaggccucccuggaaaguaaguuaguaacagaacugccauuaacccacuuaggccuaguguuccauuacuggaaugccaagcaugugggaguuauccauauccuacugcucaaagucaucgccaaggucugauuuuucacucaugcaaaaauucaaaaaauuacaaccuccggcauauaugagucaauaagcauuccuuccuugaccuacacaugcuucaauccauauuauuuuccuuaguagguggcugaugaacaggucaaaaaccaaacaggccaugguagggauggcaucaggcauaccgaaaaauucugcuuuagaaaucagucaugaaaggucauuccaguuuaaauuacaaucaacauauagaagcuagaaacuccaaucagggcaaaaauggccucuuuauaucccaucaaggaaucauuuaucuaagaugacaagagguauauugccaacaaauccacaauucuguuuccaauuaaugcaaacuuauaauauuccaagcuguuauuagauuucaauuaauaaccugugaugccucauuaaugcaaauaugcucuucguggugcuaaaccuucauuagugaaauggguccaaugacaugacgguuucauaugauaauggaacuaugauuaaaaggcacaauuaaucauuuucuucuacuacauaaucucugugacaguuuacuuaugccuauaugaagcauuuguuucuugcaaacagucaauuuauauuuaaacuauucaauagcagaaagaaaagcagaaauaucauacuaaauuaucucuaauaguugcaaagaaucccagcaccaaguuagguuguucaagaauaaggaccaggcacgauggcucacauacaccuguaauccgagcaucuugggaggccaaggugagaggaucacuugagccuaagaguuugagaccacucugggcaacauagugagaucccaguuuuacaaaaaaaaauuagccaggcaugcaccuguacucucagcuacucgggagacugaggugggaggaccaccugagcccaggaggucgaggcugcauaagccaugaucaugccacugcacuacagccugggugacagagucaaaaaaaaaaaaaaaaaagucacagagcuggugccauucuccauuaagagcauaaagugugaaacagaaaaucucagucacacggcugucagugcuuuuucuuucucuugucuguguacuuuccauucuuugaacccugaauugcuccaccagcagguucaagccagcaacagauccugaaccaaacacagcaaaaacaggacacuauucccaccccucauuuucuccccaacuaccccacgcagcaaagucugacuugaagcgaagcugccuggaacaguccauuacuacuaccugcccaguguccuuccccaauucugacaauaacacuguuuugccuuugcagaacugcccaucucucauauccaugugggccugguuggguggucaauugcaacucuucccucaagcagccagagagagggucagaagcaaggcugggccaucaaauaccccaauacucagcacagugauugauccaggaaugggcuccugaauccagcagucuccuggguuuuuuuucugacauucauuuacugcuaauaaagaauaccacguugacuccaugcguuagcuuuguuugcuguuugugauuuguggagaaucgcagaagugaaaaguaacaaacacaugucaagggccauccaccccacuccaaccuccaccucaaccgucacccaaguaaaguccagcuccuuuagacucccucucucucaguccccaguguuacuuauugccaagagacauaaagcgugcaaaagccacacacuucuccuucuaaaguaaauauaguuuuaaaaaucuauugagauuucauuuuaauuguugcuuaguaaccauugcaagauuggaacuguuuccuagcuuaaaaaauaacacuauaaaaaagaucauuuagggccgggugugggggcucaugccuguaaucccagcacuuugggaggcccaggcuggaggaucaugacgucaggaguuggagaccagcccgaccaacauggugaaaccccuucucuacuaaaaauacaaaaauuagcagggcguggugaugcuccuguaaucccagcuacucaggaggcugaggcaggagaguugcuugaacccgggaggcagagguugcagugagccgagauugugccacugcacuccagccugggugacagagugagacucugucucaaaaaaaaaaaaaaauuagauauuuaaaauuaagcugucuaauuguuuuaaaacucagauguuauaguagcuuugcaucggagauacaauccuaaaaaauuuaaaacaaaacaaaaugacugggugcagcgguucacaccuggaaucccagcacuuugggaggccaaggcggaagaaucacuagagcccaggaguucaagaacaaccuaggcaacauagugagaucuugucucuauaaaaauuuuuuuuuaaauuagccggccauaauggugagcaccuguagucccaucuacucaggaggcugaggugagaggauuacuugagccuaagaaguugaggcugcagugagccaugauugcaccacugacuuucaccugggcaauggagugagacccugucucaaaaauaaauaaguauaaagcaaaauguuugaggauuuuauuucaauaaugccaaucuauuccucuucaacguuuugaucuaauguaugaauugugacucuguccucuuggcaacaaaaguaaugcugggucuuaaucaaugugcauuaguaugcuagcaaaaugauacuucuuccauauguaguuauauauuaaauauauauaaaauagaaguguuagauacgacucuuaugauuaagauauaucuuuauuuaaauaacuaucccuuacuggaaaauaaauauggauuuauacauuuuugauuaauaaaucaauacucauuuauaaucugauuuauaaauauuuuuuauuuauaaacauuuauugauuuauuaagugcacaugauguaauaaugguuucagugccucugccaacaaucacuggcugcuaagaguugcuagaguaauggauugaaaaaugcaaaagggccugaaagcaugguacgaaagaccacagugaaugaucgguuaugucggccaaggaugugggacucagaaaugguagcaggcacaucaagagcuuuuuuuaaaucuaccgcaacguggaaaaguccaguuguucuaccaguaggugcuucaccuuugugaagucacaauucucuggcuggcugucuacucaucuuuaaaaugagaguuuugauuagaugaccucuuaugucccuucuaguuugaauauucuaugauauucugaaaaaaaauaauaauaauagcucuuguauuagcaucccaagcagucuggugugggacuagcuaaauacaggcagcagugagcuucgaggugaaagcucugaggaaaaggcagaguagaagaagcaaacuuucacugagcuguuuagccuggagaaugauaccuaaaaagcaaauuacccuguaagaggacuugggaggaaagugcacagugaauaaguccaucaucuucucccauauauuuucaaaaauuauuccuggaauuauguugcaaaggagucucaggauguuugcagccacaggaacuggaaacuauuucacaaaauaggaaguguagagaucgggcagauucagugaccucacaauguuaugggugaccccagaucuucugagcuuuuugcuuuagugaccuugugaagacuuugucuucaggcuaguucccugaauggugaugagauggcugcauguagcaauuggugcucuuugcuuccuuguucgguuccugaaagagacuaguuguucuuccuuagaagcaugagcaaaguucuccuuaccacuaugugguccaaauugguuccuaccagcucaucuuugaaucuuuggcaagacagauggaaguauucugauaaggaacaaaagaagaaaaaagcaaacccuugacaucuggaaacuacucaacacauauagcugggccucacuguuagaaacuaaccuggcacucauagccaggccacauuauuauccugcugggcauaaacaaugucacagaacauaaacagcucaagaaaacccacucugagaccaugauaaaguaagacaaaacaagacuauuucauaauuucucucucuuuuuuuuuuuugagacagaaucucugcccagucuggagugcaauggcgcaaucucugugcacugcaaccuccgcuuccaggguucaaacaauucuccugccucagccuccugaguaacuaggauuacaggcaccugccaccaggccuagcuaauuuuuguauuuuuaguagagaugggguuucaccauguuggccaggcuggucucaaacuccugaccucagaugauccgcccgccucugccuugcaaagugcugggauuacaggcguaagccaccgcgcccggccucauacuuucucuaagcgcagacaaagaaaaggucacugcacaacuccugagauaccaaacauccccguccauuagcuacuaagagugacugcuacuucauuaugaaaaacagguuuagccucacuuuagacugucuucccuuuagagaugugagauauccaaucauaaaauuauccccacuuugugacagcacccuaugcagaaugaaucucccucccuuccuuagacucucccccaaaucacccaaaugaacuccaaauucguucuaacacccucuuacugagauaugcuaugguucucugugguauguguucucccucacugcaaugagcaaagaacccaacuucaccuccaaguguguuccuggaggucucuagcuagagggcauuaauucugauuuuauacuaauguuugcuaaccuuuuucauuauuaccccccaaggagccucuuuagacuuuuuuuucuaaucaucccccaccauuuaauuccacagauauacuguauauguuugaggggaggggguuugaaagagggucucacuuuguugcccaggcgggagugcaguaacccgaucauggcucucugcagccucaaccuccugggcucagaugauccuccugccucagcccuccaacuagcugagacuacaggugccugccaccacacccagcuaauuuuuguauuuuuagcagagacaggguuuugccauguuacccaggcuggucucaaacuccuaggcucaaaggauccacccaccuuggucucccaaagugcuggaauuauaggugugggccauaaugcccagccgauguguguuuuuuauauagaaaggguaagauucucucccccauacauauccucacaagccaauuuucguaugguuuaaauuaaauuauaaggggguagaaaggaaguugaagagucuaccacaauacguuaaaaagcacacaccuucuuagcaaucuaccuuuuuaguacaguaauaguaacacucaaugcuuuuuagcacuuuccacacaccaggcauugcuuuuauacaucuauuaauuuuacacagauuaaauaauuuuauccauccaaaaaaucuacaugguagaugcuagaauuauccccaguucaaagcugaggaaacugaaggacaaaugagccaagugucaugccccaagucacuagguuaauaaaugguggagacaccaaauaacugcccucuaacuccagggaacaugcucauaaccaugaggacacauugccucacacucaacagcggcuccagaaacacuccgcucaaugcgugcacaaaugagcaaacgagagucauaauuugcaugauacuacacugccuuguuccaaauacaaacaaggcaguaaaaauuacggacauaggauaagacuuaaaacuaagaugucugcuauacagagaaacauauugacggaaaucuuucggggcaaauuuuuaaagucugugcugcaugacucaaauguuucagaaaacuaaucccauucugugcuuaugugugugugugugugugucugugugucugugugucuguguguguauguuuacaagguggaaaaugccuugguuaagaaagggaggaagagagggaagaggaaaagguaguauguuuuccccuaaaaauuagagauuccgaagugaugaugacauccuccaaccgcuagauggaacgcaguucucccacaccauggccaugacugcucauuugaacuugcugcuucauggucauaaggccaggacuuccuggcuuccucaugagccaccacauuuuccauauuuuuagagcauucuuccuacagaagaaaccuauuuugcauuguuuuuacaacuaucuuuuuuguuguuguucuaauguugccaaggaaucaagaaccucaaaaccuaucuucuucugaggucaagccauccacucacaggacuucucaagcuggagcccuuaguugagcugauuuuacacaaucgaguagagaaagaaaauggcuuuuuguggugagcaucugcuguuuuguuaaaaaugugguuaaagacauuaacaaaagugacauuaccagcuguuguaaugucaagcagcuuagcuaaacuguuuuuuaucaaaugacaacauaugacacccaaaucaauuccaaaccaauaacacauuguuacuuguaaaacagagcugaaugagagugagaaugagagcaugugugugagugugacagagagagagagagagagagagguuaauuaaaauacaaauucaaauuucuccugaaguaggaacaacagacaauaugauccugauaauuuucauuaagaaauuuuuaacuuuaucccagacaaagcaaaaaaaaaagacgauuaugcaauccauauucuuacacaagaaacaguguauuucuuuuguaaaauucuuguaauagcaaaaagauaugacggaguuucuggccacuuaaaaucugacuuggcuucuguccuucagccauauaccuccuaacgaguaugacaauaacagaagaacugacuuguguggcuauguuuggucucucuauuuuuaucugcccaucauguuuaauuaucaggcuauuaaaagguggcaaaucgguagcauugccaacugcguugucccuauggcugaaaagccuguggcaguugaaacaaccaaacccuucccaugggcaucacgaagcuuguaaaagcaaaacggcacaacgucugccugccugccauagucauggccaauccugaauaaauguuuaauuuccacaacugugaugaggguagggccugauuugugccagugcuuaggaaucuccggguauuucaugugcacaauuauuaauaguguaauucacaaaugccaagucuacccuuaaggccugagcucaguccugcucugcuagaguuggugugacuuagucaucaagaaagaagacacuuucaagggcaugauuccuccuggaagaaaaacaaaggagugugcuuaggggauaggacgcuugccaggaacagaagguaugcugcacauggagaguguuucgagguagguaacucaggagggaccugcauuugggggaaaaaaaaacccagaaccaacagaagcagcagaaauaaacaagcaggugugugccucuaugucuacuacaugaaaggaaaacagggcugaaagucacaaucagcauauggagacacacaaagaggggcaccugggaaaaucaaugugcaucaggcucgauggugccugcuuccuccaggagcucacugcauuaucacagguggauaaagucaccccuucaaugggcacaaguagaucacucuucucugcugagauuggauuaaaggcgacacugaugcuaacagcaagaagaagguaaaccggacguuggaaagaauuuucaacagcaaagccacaguacaggacagaucaccaggagaaauguauggggaaauguuagaaaaguauggaaagcccuagaaauuucaaaaguccagcucugugaggagacagaggaaggggcagaaugaccugaaaggccauucuagugcuauuacuauacauaggaaagcuuccuugagggcauuacguuuuagguuuccaauaaaggagagaccauuuucaauauuuuuuaaaauuuuguugugucauuuuauaauaacuuccaauguagaucuuuuaauuuuacucuugcaauaaaccuguacauuuucuauagucaccugccuauuuaaguccuuuauuacagaagagguagaauauaggccaaaugccagaaguaagggucgguuacaaauucucaagugcuuguuuauuucuggauuacuuuauugacucauuuauguaaccaaugagaucgugcaguccagccucaguuucccuaaauauuuagaaaacagguugaccaugggaucauaguaguggggcaucugguuuucuucugauagugcuauuuguuaaauauucuguauuaucagaugcccuacugugugccuguauauagacuucaucuuauucuaaugcuaacuuuaugaaaugcauuucauuuuuaccuucuuuauagaugagaaacucgcuagcaaucacaauuaauaugaggagaaguuaaaauuggaacccaugacugauuucagagccaacauuuuuuagucacuacgcuauacuccuaccuauaaacuucuaaaaacacuguucacaaguacaucauuccccuauggcuucccuggauauugagagaccuggauuauaauuggaauuuuugacuaagguaaacauuucaaccacaagaccugauagaaucuuuccuaugagaauuggucucaggcuuacaacaaaacuagcaaguucuuccagaguacagagcaccccuguuugaggcaagacccagaacuuuaaaaaauucuaacaaagguccuaguuucucacacagagcucuugguuuuggauaagacgacuuuagccuaggcuggacugaagacaugaggggaaguucugcaaaagacauugugcacacauuaucucuuucacugcccuauggcccguaagauguuccuaaccuggaaacugagaacugcacaggucaaguaagguguccaaacucacccagguccuaagaaacagagcacagauucaagcccaguuguaucugccuccaaaaugagugcucuuuucuguuacaauacaugcuacuaugucaccuccaaagguagguagguacuaccuuuacccacacgcguguucuugaacuccccuuacaucucaccuaaugugaaaagccugcaugacccccugggacauauaaggcccuggguaguccacaaccaccaccccuccacguacacaucagcccccuuucuuccuguuaacugccacagaagccuccuucuguuccuccaaggcccccugugcuuuccuuuguacaugugguuccccugucaagaaaacuguucccuacccaucucugccaccuugcugacuccugcucacccuucagaccucccuggaggaagccucuccagcaucccuggccaggccagauuucuaugguuuacagcagaguuucucacccucaacacuguucacauuuggggccgggugauucuuuguuguggggucugcaccgagcaucauggaaaguuuagcagcauucacuagaugcugguagcaccuaccccucaguucugacaaccagaaaugccuccagacguugccagaagucccuagaggacaaaaucacuccuaguugggaaacacugaucuauugcucuuuagaaucacuuuccuuaucuucagagcacuggcuccagagcacaggaugugcuucugucauucuuugaccaucuccuccacgugaaaaugaguuucuuaaaggcagagacagugcuggcuucugcucacccucaaauguccaguguucaggggcaugccuggcucaaagcaggauuccaacaaaaacauuuuuuuuggaauuucucccuaaaaaagguuuggugggagaucauaaacuuaaguagguagcuaguggaagacugcugaagcuuuuuugaauaaaaaauaaugccagcagaguucaggucaggggaaaugaaucccuggcaggauggacauuaaccaaacaccuaacacaucagcagaacuuucugccaaagguguugagagguuaucagcagcccccacagcacaaacaggugucagaaugacaucccaccaaaauggcagcagggcccuaauuaaaagaagaggcuguucuuucaaguauugccaugcagccauggcacugcugggaugugucaaaucacacccaucuaaaaacacacaccacgaccugacaucuuugcccagcugcaccaucccacguuuccgugauggauauuagaaaauaauguaaccucaacugacaaguuuauuaagacacagaagacauuacagaggcccuuuugacauuccaaucucuaacgcagucagggggagaugcugacuugccaucauuauugaaaguaauuggucaaaaaaaaaaaauaaaagaggugagagagaaggagagcaauccuauaaagcugucagguuaauuauuuggccuacaggugugcucagugcucuugaucugccuaccacugggcuugccagugcuuugccaguguuuucuccacccucacuccuaguuugggauaguucaaucuaaagcuaagagaguacauuuaaagcagaauuuuaccuuggccaaguuauuuccuugccuaauuauaccuacguaccaguccaaaucuccauucuucccuauggcucuguccuguuggcauaccaaacuccaauuuuccaggacagauaacccaguuagaaacaaccgacuugugugaaaugccacagagagucacaacgcaaaaacaaguuuuauucagauugaauuuaauuuccuaggcaguuuagaucacagauccgaaacccagacauuuucacaagccaggcaaauaaccugaaugaguccagugagucagaugggagccaaaaggaagugaugaggaugaugacaaacaggaacagcaggcugugagcucaguguuagcagagaaaacccaccgugccagggaagcugcugaugcuacucccuggcucuagguccaccacacgcagaguagaugcucaauuaauauucagugaaugaaugaaugccugcccaagcauucacccuguuguuuccaugucuguuauuuccaccagaagaauguuuuguaggcuuaaaucuccagugccuucagcgcaacugucauuuggaaaguggugaacuuuaggaauuaaagaauggaaacaaagaguacaugggagucacuaaugcaugugggagauacuauucaugccacuuccaagaauggggaauccguacagcucauugucauaagugauguuauuuccaacuuguuaugggugagcauuauuuagaauagcuuggaagaccacaauauuuugcaauagacaugguagccugucagggauacaaaaugaagacuaagacuaagaaugucaaaugagauuauaaagauaccuaucuuugcucaaauaagcaaagggaaaaaguacacccucugccucuucuccucuccuuaaauuccuuuuccccuuacucucucaaggaguaaauauauaugcucauauauaccaacauaaaaaggacauugguagaagcaaacaauacagaagaguauaacgggaaaaauacaggucccacuacugagagguguccucggugaacaauuucagggcuguguguguauauuuacgugugaaacauaaauaggaucgugauaccuuacagcaacuucuguuuuuuucaccggacaucuauggcauuuuuuuauacuuacaaaaaugccuccuuugcucuuuuuaucuacuguuccauaaaaacucacuuuauaaacacaaaaggccaauuuuucucacauucaucaaggaaaggcuccuguaauauugugcucuuuuuucuaccuccaauauuauguuuaagcaaaucaugagaaucaauuaaaaaguggcuaacauuggcuuguuucuacuguaaggacuguuuuuccauaauuugggcuugaaaaaaaauaggguugucaaagcaugagguaaguagaagagaagcauuaaccagggguguuaggaacaggaaauguauuuuugaggaagguuuuggaagaggaguuaugcauccaaaggguucagaauuaugggccaacuauuccuauguacaaauugaagacauuauauaaacacuacaagaacugaaugcauacucaucuuuggcugcuauuucaaacuuccagggacaaauauuuguccuuauuauaaacauacauccaauauguguuaagugcucagaacaugucaagcagugugcuaagcaguacccauguacuaucucacuuaauucucagauucacccugaaaguaagguacuauuauuaucuccaguggaaagaugaaggaauucaggcuuaaggcuacacaaagauuagugagacagcaaagaugaaucccagcaaucuaucuccagaacuuggacccuaugaccuucacauuauacguuuaaaaaugucacagacagauggacacauaaaacuguguugcuuucauguccuggguuucucuucuaaaagcaaagcauauuuuuguuuucucuuucccuaacuagauuuccauuuucuuuggugagcuuaagggagugcccugccaccuuaauaccaaauauuauaucuagggugagaaggagagaauaggaagagcaagcagcaagggccuucagaaacuauuuguacuugccucccaagauagggcagcuugaccuuauccauguggcugacaguccaguugcucuagucaugcaccugugagacuacuuucugcucccuaaauaugccaaacacacaccaugcuuugcaugggaacucucccaccccucgacacuacccaguuauucacaugaaggagucuucacuuucaucagauuucugcucaaagacugucuuuccccccuuucuaagaguucugccucauuaaccucuuauccuauaaucuguuuuguguuauuuuugguacuuguggaaauaaagugccauacacagucaaguguuuugugaaugucaccaucacuuuaagccucauagauaucccacuucuggaacaauagaaguaugaugcuugauaacuauuuguugacuaaaauaauacauugcauacuacuugaaacacaccucuuauucuaguaggaauuaucuaaucaaaguuugugcauguauguaaauauauccauauauacacaugcauauguguacacacacacacauauuugcauuuugcaguuuagacucuuaauuaccaauagaggaaacucaguaaguagcaugauagaaaugcaacuaguauaaaccaacugaauuacaaacacaggacuuagaggauaacugggcauugcaauaauugugaaggaagaugcuuagugaaugauuagagggcaacuauguucugauaucugugaaugaacugcacagucuucauuaauuucacagaaaauucauuuuuguccuguugccuauccugccaugaaaguggagaauugcucagaaucuagcuuuagauaauaacauuuguaaaaaauuaaaauuuguggcagggcguaguggcucaugccuguaaucccagcacuuugggaggcuaaggcagaucaguugagcucaggaauuugaaaccagccugggcaucacagugagaccucaccucuacagacaaaaagcaaaauuagccagguguagugguaugcgccuguagucccagcuuuuuggagggggaagaugggcugagccugagagguugagaacucagugagccgugaucacaccagugcacuccagccuggguaagagagugagacccugucucaauaaguaaguaaauaauaaacaaauuuguuaucaacuuguccugaguugaucaaguugcuauaguuaacuaugaauuuauuucugauuuugauguucauaguugcagaaacuccaaaaacuccuagucaguacacagacggaggccuggcaauaaacacuugaaagaauugccuguuggaugaaugaaugaaacaagagaccgacagacuucaucccuccagagagauaucuucuacugcuucucuaugauuguuaggccgauguaauuaaucuaacacauggagcagauuuuacccuucauuuucaaguacauugucuauuaacagcguccaugagcccucugauuaugcaagguuccuguuaauggaucucugccaauaccaaccaucaagcuaaugaucugagcuugccagcuccaaggugaaggaccacucuugggcauaucucuccaggacucaaagaagaauccccucuccaaaugaucuuggagaagcagguguccacucugccugccagaggcucugccagcacagggugggggcaucaagggaggagaaaauaaaacccaguaauucauauggguugagauuauugacuucacuuucaaagaagauaaagugaaaaaggaagaaccguguuuuugaaagguaagacaggggacauuauccugcguuucaucaagucagcuuuuucaugucaggcgaugguauaucuccuguaacuugucaauggcaccacacagugaagcuaaaagguugaagauuauuuuuguaacgauugauacucuuucugccacagcagucaagcaucugaagauucuuccuuucucuccucugcucuggugaauccuuuuaaaguucuugggugaaagagcugcaaaccccagcagauaucaaaccugaaacacuaacuugacauaucgggaugugugcugcuauauucacugcuuggcuucaggccccuuccagagcacuugaaauacaguuggaggauucuuugaauaugggguaaaaguacguggaugaccuagauugucaaaggauucucuucaaccaaauaagaaaguaaguuugggucagcacaugcuaucagcuagaaagacugcucaaaauugugugugccaaaauaaugaaagaacgugccaauacgucaauccacguuuguuuccugcccccguuccugccacuucacagcucuaaauagaaacacacgaagagaaauuccaaugaaacaaaaggaauaucugaaggaucucacagcuuucagggguacuguaauacccugaaaacagugugguuauuccgggcuccacaaacuagguagaaauaaacauccaucauugcauagggcaggaagaacagcaaaagcauguuggcuaauuuauaaaugucacauacaguguucuuuguuucauugcauagggaggcaacguaaugaaaacauuaaaaaccaucuuuuggugauaauuguuguuuuaaacugacaaauuauauaagucaaagugaaauaaucuuugcaacuccauagagaaacagaaaacuauuaaggcccuuagaaacaucacaacccauguuccccuuucaaagguuagaauaauccugaguauauuuugggaaaguaauauccuaagucaguaaaaggucagugacagggaagauucuuccacaucuucaggagacaaaaaguccccuggagaagagaaaccagguucccuggugacauuccgcagaaaucuccagcuguuagaagaacuuggaucuccgaggccacccaaacuucaacuuaagaaugcaacaaaguggggaugaaacaguucccgggagggaggagguagaauaaaaauggaagcaaagcuacccuacagcacuaaucuguaaaccugcuucaauuggcaagaaaaagaggaaguacuacacaugccugaaaugacaauguagcacauggaauggaccucugcuguuuucgaugauccagcauuccuccugauuuuccuuugggagaaucauuuuucaccuacucacaguucacaugauuggagaaggcgccuucuggguacaggcauauaacuaaacugaauaauccauucccugacuucaucuuuccugugcgaguugguccaaggacuuuuguugaaaccacuggaagagaguggcuuucuugacagcagguuaauaagauggauggagguaaucagguuggcaaguggcugggcaacuguccuuaucaccauacaaaggaaaucuuccagagaacaaaggaaucacagaaggaaguggaugugaaagacagccagagauucccaacaauauaugauucuguaaauccaaccaugaaugaagcuugguauccccacuauuugagccaauaacuccuccuguuggcugaaguuacuuugacaugcauucuuaucacuugcaacugauaauccaucccacgugaguauaaaugugaagaaaucauucuaaguacauccaccuuaccaaauggaccauguuuugcucaccagugugaccccagcacuuaggacaagagaugaugugagaagacuucaaauuauuguucaauaauuuuuuuaaugauuauuuguuaacucaugaauuaucuuccauauucauaucuuuuaaaaaugaaagaaaaucaaagcagguuucuccuuucugucuaaauccuagcaagaucaaacacuggggaaaaaaauaacauucucccauaucuaucugaccccagaaaaauuauuacuuccaaauaguauuuaguuuuuggcaguuauuuaugaacagguaaucuauauaauuuaauagauaaaccuauuuaauuaucuauuuuuucucccacaaacaggaagaccagugucaaaauauugagcaacucuccuaagaacaaggcaugcaaucucaaauuccugguuuucagaaaagguuaauuggacaagcaaaaacaaggagccaacuuauuggggagaacuggaggccuaggaaaaagaaaaggcccaacuuucuauccccaacagacacuuugggaacugauaaaauuaaacauuuuucaaagacccuccauuuccuauuaccacaagaaagucaaaauauuucuaucuuuuaauuuaacuuuaucuugcuuuucuuuuugaaauuuuaauuuagggcaauauuucugagggaugcuauuuuuuuuuaaauaccuucuuuccuucagcuaauguaaaacaaauaguuacuccuggaaauuacuuuuuacuauugguuccaaagcuacaauuugcagcaaauaaaaggacucuucccuucuacagaaacauucagacaacuacauauugagaggaagguuuauguguacuuggagccuuugggugauguucucuuuggccauaugaugugguacucccaucagccugccauuuagugacuccuaucaaagcaaaccucucuaaaaacagacacuucaaagaagaugacuaauugugggugccaacuggaugcugaauugcugaauuucugaaugguuuccaucucauuuuccaaagaaaauguaaaauuucagaguaaaauugccacuuuucuuuuuucacgauguaguauuugguggcuuuuaaauucacagccuucuauucuuggaauuuuuuaaauuuuaaauuaacuuuccuuccuucauuccacauucaugcauucauuuagucauucauucauucguuuuuuuggagacaggauccuguccuguauacagcccaggcuggaaugcagaggcaucauuacaguucacuguagccucgaacuucugggcucaagcaauccucuugccucagccucccaaauaguuaggauuauaaccaugugccacccugcccagcuauuuuuuuuuuauaaaugggaucucacuauguugcccagauuuguaucauacuacuggccucagugaucccucuugaccccucagaucauuaaacauuuauuaaaugccuuucacguaucagguagugaaccaaugcugagaacauaaucaugaacaaaaauccaaacagccccaguuuuuacagaauauccagauuaguaggggagacagguauuauucaaacaagcacauaaguuucuuaauacaacaaaaggcgcauggcucuucaaauacaaguaacagaggaaugaaacugagcucaggaagucaggagagcuaguuaagggagugaaaauacgaguugagagccagguaguaaauaggccuagaagaaguauggguuuuuuguuuguuuguuuguuuguuugcuuugagauggacuuucauucuuguugcccaggcugcagugcaauggcacaaucucagcucacugcaaccuccaucucccagguuugagugauucuccugccucagcaccccgaguagcugggauuacaggcaugcaccaccacgccuggcuaauuuuguauuuuuuuuuuuuuuuuaguagacauggaguuucuccauguuagucaggcuggucucgaacucccaaccucaggugauccgccugccuuggccucccaaagugcugggauuaaaggcgugagccacugcaccaggacugaaguguguuuuguuagaauaagagaaagaaagacgugggauaggggcagaaaaaauguugggaaaacggaaagaacagcaggaacagagacccuguaguggaaaaaacuuaguauaugugaggaacuaaaaggcagccaggguggcuggauacugagacaagguuggugugagaugggcagaggcuccuccaagcaggacuguccaggcuguugcaggaaagaggucuucugucuacuaguaauagaaaugauccaauuuacuccauuaaagaaacaaaacuggauauauucaacacauuuucucuguaucuaacauuucaguagaagugauauaaagauugcuaccacauauucugcuugcuucaccuacaucuuacuguaugauauggguaacgaauaaaacacauucccccuaucuccauucuguauguauauaccauuauuuuauuucaucaugguaucugaaaagcaauuauaaaucaugauuacagcagcugaaauuugcugaagacuuacuaugagcacggcauuggaccaacuacuuucuguccauuuccacacuaaaaucagcuacaaccuuaaacagacugucccauccaaagcuagccucucagguugaaagaucaugauggauuaugcagcagggacccaccauucccagacugguaucuuaggguccagauuccauccaucaggcacaccugggaagaaggcaaccucacuuggccuucuauucaccagugaaucucaaguaucucuaaugauacuugugguagugcaguuuucugagucagccacccugguaugaauuagacuggguaaagugaauguucauccauggaugcagcuuuccauuuuuuaguggcuuauaaccaaggcauacugcucuuaggaguuuauuucagagaaaaaaaguaugaacagccaccauccuuaaauguacaaccuuuucucugcaacagcuuguccuuaaauccaggacacaggaugacaaauggguuucccugccagguccugagaggucugugggaaggugaggccuaggcaggaguggagaucaacgaagcaugaaaugguggauguuuccggggcugcagaauuuuggagaauuccucacgcugucugcucaacuggucucaguucucaguggacucuguggggucaggaggagcccuuucucuggguuuucccucuuucucccucagcagagaaaaucgagaaaaggacauuaaauucagugcagucacugugggugcuaaaauauuuucaggaucaaugguggugcuaaacuaucuccauguuucuaauauauauauauauauauauauauauauauauguuuuuuuuuuuuuuugagaucgagucucacucugucgcuaggcuggagugcaguggcgcgaucuugguucacugcaaccuccgccuccuggguucaagugauucuccugcuucagccucccgaguagcugggauugcaggcaucugccaccacgcccagcuaauuuuuguauuuuuaguagagacaguuucaccauguuggccaggauggucuccaucucuugaccuccugauccgcccgccucagccucccgaagugcugggauuacaggcgugagccaccgugccuggccuguuucuaauauuuuuaagacugaagugcuuuuuaaaaagaaaaaaaaaucuuauggcuacaccacaaaaaugcaguguccuuggguaagggacccacccaagccccuuggccuuuuacuuuccagguaucauuuuucccuuugauaguacucuugugucugcaaaaaaugcucugucuugauaugcuccuggacuguaagauuuugauuguuuuguuuuauauuuuguuuauguuuauaugcaucuuauauuucccugaaaacuaauuaacacuguuggccuuucuaacuggaaaaaaagucuauuauuuuuauacuaguguuacaaaacagaaguucagagagaaaauauaauuuggccaaaaucacauggcuaaugagaagucaaguuggaaccugauuauaaaucuauuugcuuucaagguccaugcuuuuuuuuuucaagcucagauaaauuucacauaauauaaaauuaaccauuuaaaauaaaccacucaguggcauuuauuaauaucaauucauaauauugcacaauuaugucuaucuaguuccaaagcauuuucaucauccuaaaauaaaacgccaugcccacucagcaguuauuucuuauuuucuuuuuccccagccccuagaaaugaccaacgugcuuucugucucuauggauuuacuuauucuggauaucucauauaaaugcaaucauacauuugagucacuacagcaguuaacacagugccuggcacguagugaauuuuaaaaaauauagguugacugugugaacgaaaggauagggguggauaaugauuaaaccaccauaaaauccugagauauuguucuaauauccacugcaugcucuccacaaaugcuccuucgaauuuuaucuucugugacgaugacacuaugucaaccuauccacagagcccagcaguguuaaugccgcauguuaauaaaacaccccucuuuccccacagagcuggauuuuuauaaaaugaagcuuuagaaucuagauaaccaggacacaguacacugaaugucuacuccuaauauguuugcacaaagcuaaacuacacauauugcuaccuaaaauauaaaacuaaugugagugccuacagaggaaaauguggaaugcugaauagggugaacccccugcuauuagccuggaaaugaugacucuguugugaaucuguccuacaggguaucucagggucugagauaauagcauaauuauauaugcuaacucuuccuaguuauaauaucuuggaagacaaaagauauaggguaggagggaagaaaaguuaagccaaacaaaaagaaaagacuaaauuauuuuuacucaacauaaugacucuuugggaagucuaaauggcaauacgagcaaaguuacaaugcauacuucagaaaggagagguaagauagaagauaaaagcugugcacauuuauacacauauucuacaauggacaauaaaaugagaaaugcacaguuuuucagaagggcaacaagaacaccucuaccuccucuaaaaauuaggauaucaccaacaaaucguucaccaaguuagaagcugaagcauuuuaaaacucaaugcuauuaacagcauacuugauauaagcagaagacaguggguuucauuacuguuaacuacccuaguacaacccauagaaaccaugacucagucugaaguagcacacucuaauagaacuuccugugauaauagaacuguuccagaucuguucuguccaauaugguggccacuaaccacauauauuuacugagcauuugaaacggggcuaauguagcugaaagacgaguuuuaaauaucauugaguuaauuaaacucaaaguuaaauuuaaauagccacauguggccaggugugguggcucacgccuguaaugucagcacuuugggaggccaaggaagguggaucaccugagucaggaguuagagaccagccuggccaacauggcgaaaccccgucucuacuaaaaauacaaaaauuagccgggcauguugguaugugccuguaaucccagcuacucaggaggcugaggcaggagaauugcuugaacccaggaggcaaagguugcagagagcugagcucguaccacugcacuccagccugggugacagagugagacuccaucucaaaacaacaacaacaacaacaaaagccacauacuaguagcuacuauauuagagcaacucuaucagauauuaauuaguaaagaauauagaaauacucucuagcauaguuuaccugcauuucauaagggcaaucaaaauagcuuuaagcauguguaguacaggcauacuucucaaacuuuaaggcugugugauauauaaacaaacaccuggcaacugccauauggaaacggacaaacaccuagguaggugggguagagauggaacaaaguggaaaaacacaagucagguaaguaaaaaagcucaucgagggcugaaaugucccaaagacuuggagagucaggccuuccuaggagcuuuccaucuuacaaagcugaguauuggcaaauguuaccagagagauuuagcacgaggaggaagcugguuuaaugaaaagagcugcgucaaucaugagccgauggaaguccugcucuagccuuuggcuaucgagccauaaaauccguugcuuggaaauaugaaacccuuuuggcuacuuaauguuuucuccaauuccucuaacucagggaaaaggaucauggaaagaaaccaaggagggcaaagcaaggagaaaggccagaaauccaaagaggaagaccagaaacaggaagaaaaaauacaacauaaaauugugggagaaaaaaaaaugcucauagggagacuggaugcucccagggugaaaaugaugaaaaaucugugcgaaagagcaugcccaagcaguuagcaaagaccuuugugaauuuauguacaaaaccacaaauuacacacaugcuucccaggaacaacaaaugcugcccauaaaaauaaauaccugccauuaaaauaaauaauaaggaggggaaggagagagagggucagggaaauaauacaauaagccaagguuaaaaaaaaaaaaaagcuagaagaaguugaacuugaccuagaauuugauagucaguuacuuaauccagaaaaaaugaaacugccaggcaaaaguacuagcacaacuggcuaugaaaaaaacuaaaggcauucacaaagguauugguaacucgucuuaugaucaguuucucccuaacacuaaaguuuccaauuaaaaauaaaaaacaagugagguaaaaggaaugauucuaacuauagucccuucgcauagaaguaggucaaaacagaagaggcuuacugggauggggaaacagacaaauuccauuuuguaauacaccauggagaaagguguuuauugaaaguggcagcuuuagcaccauuguuuugcacucugagauuagugauuuuugaaucaccuccuaugguauuacuuuuacugugcauuuagcaaugucagcugagauauaauuaugccaaaccuagugauaugaucaucuaccuuucagguucagcuaaagaguucucacuccaucaagacuucuuuuucucugaaaaggauucccacuaaaauacugucauuuccuuugcuuugucacaaucacauuuugguauaggcuggacugggucagugcugugaaucugagaggagauaauguacuucaagucccaaaguauuuugaguugcugguaugccacauaggauuacaaucacaaaagaaaguuaauagugugacucaaugcugagaguccuagcuacgggaaagugagacaagauugguuucauaccuggcagcacuagaauuuaacguuaauaugaaguguccugauuagcuauuauauaaaacacugaaagaagaaauuucuguucaggagguauucagaagaacugaggaggauagcuggcuauuuagugccagagagccaagucaacuuccaauccccaugggcuucuucagugcacaugaccuauggccaagccccaucuuuuuauuucacaaauguuaacuucccaaauggguuagcaagggaaaacuaucauuauuauaaagaagcgcagauaaggcagacacaauggcucacaccuguaaucccagcacuuugggaggcugaggcgggcggaucaccucaggucgggaguucgagaccagccuggccaacauggugaacccuuucuguaauaaaaauacaaaaauuaccuggguguuguggcgcacaccuguagucccagcuacucaggagacugaggcagcagaaucacuugaacccuggaggcagagguugcagugagccaagaucauaccacugcacuccagccuggacgacacagcaagacucuguugguggcgguggggggagggagaaagaaaaagcacagauaugucaagucagauucacuucaucaacucuaagauuuaaauaauacuaacacuuuacucacuauuuaaacuacguuguuuuucguccauuagcucuuccucagcaaucugaucccaugugauauauauugaagaaagacuuucacagaucaaauaagguagggaaauucugaaaacuaaacuguauuccuagaaauauaccaugguaugagcauauuaaagacccugagaaguucugcaguaaagaaaucugauauugcccucuguauucuccuaaagcguuuuagcuuggggacgauuuucccuuuguucuuuauauaaaauacguauuaccaucucauauucagagcccuauaaaauauacuucaagaaauacugaggggccccuuaauuacacuauaagacucuuaacauacaguagguuuguaaaaagauaguaaaaaggauuaaagauuccucagaauuagcuuuucaugggcagcaaaagaagugagaaaagaaugguauuuauugcuaccuaccacguggccgcauuccauuaggcgcauuucagucucaguaaaucaccgcaacaauucucuaguagguaucauuauucucuuuuaugcagaagagaaaaccaaaguucauagaugccacacagcccacucacggucccagaguuaagagacggcagggcagggauuugaaaggccugugcccuuuccccuauaucacagugguguaaucuuuucacacuaugcauacuucuauaaagcaaaaccauuuugaaauaucuguccugugugacaucacaauauuguuaaugguuuccuucuguuuccaguugucugcuuaguauaaugaaauuaaaccauuaaaauggaaauggaacuuguuccgugaccuucccuuugugagaauaugccaaauuaaaucaacaugggauuuuuggaggaugugccauuuuuuuuuaagaacagggucuuucugccaagacaggaaaacuuauaagaaauucaacuaccuagcuacaggaccucaaauauuagguuauaauacauguuucuguagguuguaaguguguaaaaaaaaaaauagguuccuucagguuuaagaaauccaaggucaugaaaacaggcaucuggccccagcuagaacccuggucuagaacacuaaggaaaagcuaggccaucuuucauuucuuccugacaucuuggucucucuaaacggguucucuucguucugcaugcuacaugaaaggaaacagcuaccauuaauuccccaguauugcucucuccucauaugugaggucaaauagauucaagauggaaucugaaugacaauucuaaauucucugaggaauuagagcccaaccuuggaggcaauccuccacggggacuauauguaauauauuuauguaauguaaauauggccaauggaaauuacacagcuguaaccacacaaacugggacaagcagccucuggagagcauggagagcagugguguuuaggccaccaaaacagcuuauacaaagacuugacaaaaagcacacaagcucgucaauggaaaauuuaugagauaaugcugaagugauuuuuaacuaggaagaucacgggcagcaaagugagucaaguuuuaaaugaaaaguagaaaaaauauaccgugcuguugcaacaaaaauaacccaacuugugcuuaugcugaaguuauaaaaaggagaaagagaaaaacuucacaccugcaacagcaucauuaaaacauaacaggaugguuuggguuugucagaauuaagggccaccugcuguuccacacuucacccucaucccaaucccagucccugaaagaaaugaaaagaaagcugaaggaauuuucauggagacaaaaucgagcagagacuggaucugccaaagacuauuuuucuagucuucaagaaauauccugaaguacuguuucuaacagcuucauuuuaaaaaauauuuuagcucuuuguuugucuuaggcauucagaauauaaaauguacauuuuauauuuuaauucucuguuagaaaaacagggcauauguuguaaaaacguauggaggucuuccuuuauaauuugacguugaugcuuuuucacagauaagcauuuaucuuucagaaucuaaauaaaaugccauauuuaaauuuuggaauuuuaaucuguaucuggaagaaccaaacagaauuuucaccaucucuaaauuacuggauugcaagauuaaagaaucaaguacuuugaucuuauuuaacuuguacaguacucacaaaauuuaaaacacugcacauauuuuaaacaaacuaaguaagcauuuacuuauauuugauaaucuggauauuuuuaaauuuucuauuuuaaaaugaaggugaguaggaaaaauuacagucucuuuaaaguaccaugaguuaaacugccacauugaugguaccauuuaccaaccagcuaugagaaguaacaaaauaaaguugcaccaggaauauuacuauuacucucuacaaucauuacacagauuacaaauuuuuuuaauuuuuuuuuuuuuuuuuuugagacugagucucacucugucaccaggcuggagugcagugguacaaucuuggcucacuacaaccucugccuccuggguucaagcgauucucccaccucagccucccaaguagcugggauuacaggugcccaccaccacaucuggcuaguuuuuauguuuuuaguagauacgguguuccaccauguuggccaggcuggucucgaacuccugaccucaagugaucugcccaccucggccucccaaagugcugggauuacaggugugagccacagugccugaccccagauuacagauuauccucauuuuacagaugggaacaucuagguucaaaaagguaaaggaauuucccaaggauauauagcuauaggcuaggauucauggccuggucuaaugucagaagcacccccuauuaccacuggcaucaacagaagaccagaguagaguuuagguuguuaguaaagacauguuuaauaagcacaaagccucuugguaauaauuaaaauugaaaaucuucauacagauuugugaucuggucucacaaagugaaaagcucaaugcauuucuuuugcauuuauugacuuuaauuuucauuuccauagcucuuuauagccuucaagauauugucacauuaucucauucugacaguuauauccuucauauuuuagcauuuauuaaguuguuacaugucugacuccaaaagaaauggagguacacccuccuauauauaucucuaccugugauacaucauagcaaucaccuuaugcaugaugcucugaaaaacaaauccgaaauaugcaacagccuagauaaaugggaucacaaaaucccugguggggacuuuuaauuauaugcuaaguaagaggcagguuaugcagaacuuucugaaaaaggggcagaggguuuucagaacgauaugagauaacuucuaggcuguugccauggcacuuguaaacuguccuggcgccaaugggagugucuuuaugcuaaugagcaaugaaggcaacuagagguugcuuuccuccccaccugguaguuuuggcuggcuucuucacugcaucugaaaacgggauugacuaaauccugcuucuauuagugggaccaugaccugaaaacaaauccuacaggccuccuaccucaacaaggcagcaucaacuguucucacaauaaaccaaauaucaaugauuccaugauuuggugagagcacugccuauuagcaucuuuaaguagcacaaaacauggcagcagacgcucuccuucauauuagguugcaucuagucacuaggcaaaaucuugguuaguuuccuuucauuuuaaauuuugcucagaggcccagugggcacaguggcugacaccuguaauccuagcacuuugggaggcugaggcaggcagacagcuugagccccagaguuuugagaccagccugggcaacauggcaaguuccugucucuacaaaaaaauauaacaacaaaaaagucaggcacagcagcacaaaccuguagucccagcuacuugggaggcugagguaggaggaucacuugagccugggagcuugacacugcagugagcuaugauggcaccacugcacugcagccugggugacagagugagacccugucuugaucaaucaaucaaucaaucaauacuuguccaaaugaguuguuaguuccuccuuuuauucucuauaaaugcugccagucgggggcaguguguaaaaagcagaaaaacaaagucaaaaaauaauggaggguuaaaaaaaaaaaaagaaaaaaaagaaaaaacaauggaggguuccacuccuuuaaaagauauucuguccaugacaacucccccucugcccauuuccugaaagaauaaaaaggauauguaguucuuucucucugacaucuucugaauaaaguaucaccuucaauucaaacagguaaaauaucuugaaaaaguggucagaggagcuggccaggcacgguggcucacaccugcaaucccagcacuuugggaggccgaggcgugcacaucacuugaggucaggaguuugagaacauccuagccgacauggugaaaauccaucucuacuaaaaauacaaaaauuagcuaggugugguggugcaugccuguaaucccagcuacuugggaggcuuaggcaggagaaucacuugaacccaggaggcagagguugcagugagcugaaaucacaccagugcacucaaaucugggcaacagagugagacucugucucaaacaaagaaacaaauaaacaaacaaacaaaaaaauaaaagugguaugauggaggauuguuuugaaaguguuuuguucaauuugaagucaacaccgugacuaacaaguuugacugacagugucccucaaucagacacacuuagaagcuccacagacuugaccagagguuccacagacauucuggguacuucaaaaaaucacaccacaggcucaagugugccaugucacacucuuuucaaaacuugacaaugccaagucaaucaaggaaacugauuaagugaugccgacacccucuugccuccccagaaucccuuuaaaaccaagaccaacuguguccaaucucuauuagggccaguaacuuuuacuaagaaaaaauauuuccuacuguggcccagauccugaugacagucaacagcguuaacguuuuuacuuuuuaauuuuagacuaguuuuaaaucuacagaaaaauuauaaagaguucagaguucccauauaugccacaccuaguuuccacuauuauuagcaacuuccauauaugauagaguuguuacaaucacugaacuagcauucauaaauuauuauuuauauuaauuuauuuuucguuuuuuuuuuugagucagggucuuugccacucaagcuggaguacagugacgugaucagagcucacugcagccucaaacuccugggcucaagugauucuccugccucagccuccugaguaacucggauuaccgggcauuaucacaccuaauuuguuuuuuauuuuuugguagagaccaacucuuacuaugcuucccagacuggucucagacucuuggugugagcuaccaugccuggccucugagacauuacuauuaacaaaagccucuauuuuauugggauuuccuuaguuuucaaucuaauaugcuuuuucuacuccaggaccccauccaagauaccauauuaacauaacuuauguugcuuaagacuuuucuuaguugugacaguuuaugagaccuuuacuguuucuuaugaccuuaauaguacugaggcaaguauguugcugaagucccucaguuaagguuugucugaugucuuucucaugauugcacuaugucuaugguuuuuugggaggaacaccacaaagauaaagugccauacucaucacaucauagcaacguccauauuaucaacaugacuuaucaccgaugauguuaaccuugaucacugguugaaguauuguuuauucaauuuuugcauucugaaguuacucuuuuuuccuccuuuuuaagcuguacacuuuggacaagaaaccacguguggccgacauuuaagaugugagagcuaggcuccagcuccuugcaguauuuaugagaacuauccggaauucugcuaaacagauuuuucaauucuaccucauuuauuuguuuauucaaucauuuauuuccaucccuauuuauucaaaucuuuuuuuauauuuuggguuauaauucaauaguguuuauucugcuguucgaagcgacccaucuuuggcgcuugggaacuccuugaguuggcuccuaugucccuuuaacacacucccauuauugugauuuauuuuguuguguuuucugagcacugucuuacuucuuggcacuauaacgugcuccaggcucaucauguauauuucuugcugaagucccagaauuugccauuucuccaaagaaccuugguuucuuuuauugggaaauggaauuagaaacaaagaucuggguguuagguguauuuguugcucccacgguuuauucgugaagcagaaauguacccugguuuuaguaaaugcagaaugucagguauccaccauuuacagcgucaaauugaauaguuucaugguguggggaaaaaaaaaaaucgcauguuucaccuauuaaaccucaccccagaaccuucaguaacaaugauuuguuuaccaucuccaugguuuugucuuuaccagaaaguuaauaaaguugcaucaugcaguagauagccuuuucagacuagcuucuuuccuuagcaauauacauuuacuauucauccauguuucuauguauaguucauuccuuuuuauugcugaguaauguuccauucuacagauguaacagagcuuguuuauucauucacuuauugaaggacauuuugguuguuuccaguuuggggaauuaugaauaaagcugagacaaacauuccagugcaggguuuucuaauuucauaaguuuucauaucaguuggguaaauaccuagguauaugacugcuggauuguaugguaaaacuauguuuaacuuuguaggaaacugcaaaacugucuuucaaagcgccugugcuauuuuacauucucauaagcaauguaugagaguccuuguugcucuacauccucccuauuaaugguauugucaguuuuugguauuugguauuugcucuacauccucccuauuaaugguauugucacacaccaguggcugugugauaguaucaucuuguacuaauuugcaacucucuaccaacaugugacguugaacaucuuuucauauguacguuuuccaucugcacaucuuuagugagcuauguauucagaucuuuugaucauuuuuaaaauuagcuuguuuuguuuucuuacuguugaguuguaaggguucuuucuauauuauggauacaaguccuuuaucagauuuguauuuuguguucucccagacucuggcuuggcuuuuuucuucauagugucuuuugcauagcuuaaguuuucauuuuaauuaaguguaacuuacgauuuuuuucaugcauuauguuuuuggugguguauauaccuacuaacacauuaccaaauacaagaucccagauuuuuuucuagauuuuauacuuuugcauuucacauuuaggucuauuauucauuugaguuuuuuugugacauaugcaaggucuuugcuuaaguucauauuuuuacaguggauguucaacuguucuaccaccauuuguugaaaaguuauccuuucuccauguagucacuuuugugcccuugucaaagguugacugaauuugugugaguuagucaacuguuuuucaaaaaggcucagcauuuucgaaaauccaagaaaacaggaagguuuaacuugaagccaagagcaacuugacaguggcagggcaaugucaucacuacuguguauguaggucaaaccaagaauguuacacagucauaacggaggugggcugcguacagaacacccugcaucuccuaaaugguuuauaaucacugauuaauccucugugaguauagacgggccucauuagcucuaguaacaaggaaagacaguguuagauugauaaagcuaagguugggaaagagaaauuagagcagaagagcuguaaaaaggauggaaagugccaugcccgcaaacuuuguagauggauguuuuuauuguauuuguuuuuuuuuuuaacaaauaccaccaucuuuucauuuucuuccuauguucuacacucccucaaauuaggaggcauaagauauuuaaauucaaaugggagcuuucuacucuagcucccacugauguguauuucuuauuaaagcuuugugauuauuuuguauuuuaccaguucaugcccguagaguguugaggccuauuuuaucaaaacugaaauagcucgugauuagagcuuacuuaaaauaugcaaaccaagacaaggucaaagcaaccuuucuuucagaggguccugugggggaucaaaugguauacauugugauucauuuucauucuucuucuguguguuuacccaugauggccagggaacacaaaauacaagccucucacuggagucagcgugcaaaaugugaaacccccuaaugucaaacugcaaucaacacaucacaagccugucauuaaauuggcuucacaaaauaaaagugagaaaaaagacaaaugaaguuaccacacguaauacagaauugaaguggaugaggcugaaguuuagaagagaaguuguccucugaggaccgaaguauaaaugcaguuuuuaaauuaggccauggagggaaacucuuggauuguuccauugcuggugcccucggaagccuucacggguuuccugugaaacacgcaauguaaagcagugaaugcagaauauuugauccuaucuuuguguuaaugagucuucaaucuagagagugggugaucacuuacaaaaauggccuucugcugacucaccagcccugccuauuacauucacccugcuccugcacaaagccagaaaaacugaacaacaagcagcaaauaaauuucaauaaacagauuuauuguccuauuucaauacaaaucacagucuauuaagaauaaugcacucuaguccagguucugacagucaaagaugcugauuuaagaagagaauugugcuccuaauuuaauucauucauuugcaucucucucuucuaaguaugauauaauucagccuuacugaucauagcugguaaucacuccucuguuuuaugguuaaaauugugcuuuuaaaaaauuacaauucuaccuauuuauguggggauuuuuauauauuaugguucuaggaugaaugguuauuagaugacaauaaugaaaaaggcaagguuuaucaaagugaccucugaaauuaccccauacauuuucaaaaugaugcaccuguauuacacagagcaucauagauuccaagcacauuuuccauaacuaaugauaugacuuggaccaucuacaccuuuugucagcacuguuuucugauuucaacauaguacaauccauugaaugucagacucuaacaggugucuaugaacucagggaucuugacaguuucuuucuuuuuuuuuuuuuuuuuuuuaccauuauuacauuaaaggcaaacagaauucaguuccuucaaaauuagacauuuucaacuuaugucccagcuuucuguuauuccaccucacuuuuguacuugguaaaauaaauagaucacaccguagaugcugacaugcuucuaucacauauuaugauauuuuggcuuuauuuuuuaguugaaaaagugacuguauuuuguaaaauuauacacaaccaagaguuuaaauuggauucaauguguguaugcuuuccgcugaaugauuccuuuuucucugggucuugccucaaacaagaaaccauuaaugaguagugaaagcuuuggacacagauuuugugaaguuucauaugaguuaaggagugccuucauuucauccuucaaauuuugacaguaacuauuuuuauaaagaaauuaauucagcuuuuccaaacuucuuuacauugcaucauaauauauaucacaccaugaugacaaacauugaaucuauuucuauuaaagacaaacaugcacaauuuccaucucaagugaaaucuugagcaaggauggaaacuucucaaagaaagaaaaaauaguaagccaccuuguauucuuaagaaugcagaauuucaaaaugagacauuucugagcugccucucacaaagcaauuuuuuuuuuagccgcagggcaccccaguagaaguuaaaaauagauuacacuucuauucaucuaaaagaaggacacuaauaugagcacuguagcuuucugcacuucaguaaaaaucagaaaugaucugcagcccggugaauaaaguugauucacuuagagaacaccagcauuucucuccucaccuagcuuuugaaagcaagcaugagacagccccugccuacaaaauugcagaggaauuacucucaauuacaggcuucugucuguuaaaaaguagagcuggugaucagucugaccuuuuuucucugacaagucaaauaaaugaaagggaaaaaaaaaucugacagguguucaauuuagaagcugggggugggggggaaagaggagaaagaaaagaaaagcuuguauucucuaacuagaucuccggauuuuuuuguauuauucauccuauuuuaaaaguuccuuuucagugaauaaauugcauguggcaauguaauuuucuuaaagucacucaccuaauguuuuaauuugaguaucauuuacugaaaucuucccacaaucaaucauucaggcuuuuaguuucauacuuuagauacuuuagggcaauucugcugaaugcuacaacuccgcccuacccccauucuuccuuccuucuuauaaguagauuacaaaugaccacagaagaaugacuuuucugguucccugcauuugcuauauuuauugcaagacauggcuuguaaacaccagccuccacauuuuaccugauaaugcgaucauuacagaauucacuagaauuuggucggcauugguauuauuugaaugugaauguuuuaguaaugacaugaaucguuuuucagcucucugacauuuacccacguuuuuucauuucaaaagaguuaacuacuuugcuaaggacugaaaaaguuguucugaugaaaguuaaauucuaaaacauucuguauucuucggaguugguugguuagguucuugauaauccagcacuuguucagcaaaacuacuaauuagagguggaagccauguaugcauugaacaguuaccucuucaaguuucaaagagagaagaaggaccaaaggaugcucuuucccuuaggaacccaucugaccugcauuuaggccaguuaaugaugacuuccauucagcuuugaaacauguuucuuuuaagucagcuacuuuucaguagggaaaaacuauuuugagaauuaaucauucucaaacaucauacagaagccaaccaguuaaaauaccacaaucuuaaacagaccugcaaacaacauuuggaaaguugaauugugauugacugaugacaucacagaaccaaaauaacgucccacauucacuucuugcucuguuauuuuuguuugcuucauaacagucagaacugcuuuucugagauggcugagacaguuuucucagaaaugacgcagugaaauggcuaauggccagagagugggagugagaugagaccagaaaaaaaaaaaagaaaaacuaaaagaaaaaagguggaaaagaacaaaggugauguacacauaccccuaaaagcuggccaaaagauaguuauaguaaaaauucuaagggagggcugggcacgguggcucacaccuguaaucccagcacuuuaggaguccaaagcaggcagaucaccugaggucaggaguuugagaccagccuggccaacauggugaaaccgugucucuacuaaaaauacaacaucacuggggacuguuguggggugggggagcagggagggauagcauuaggagauauaccuaaugcuaaaugacgaguuaaugggugcagcacaccagcauggcacauguauacauauguaacuaaccugcacauugugcacauguacccuaaaacuuaaaguauaauaauaauaaaauuuaaaaaaaauacaaaaauuagcugggcaugguagugcacacguguagucccagcuacuuggggaacugaggcaugagaaucccuugaauccgggagguggagguugcagugagccgagauugcacccuugcacuccagccugagcaacagagugagacuccaucucaaaaaaaaacuaagggagauuuugaaguugugucuuuuuccugugacugggaggcccugggaagcuaagaaaauuuuauugaacaucugcuuugcuuccaggagauaaagucuuccugauacuuccuucuaauuuaagugaggcaguaucccacaauuaaaaaaauaaaauaaaauaaaaaaacaaugguuccuuucuccaaagagucagccagcaaugaucaagaaaacagcacagugguguauacuauacagcuuugguaccaaugccaacaacccaaagugauaaaaaauuaagaacagaauuuauacaaaaauaaugcuuaaacacauguuuuauuaaaagcuauagaaaaagggauacauuugaaauaaaaauagcaguauuuucugcuuuaauaaccaacuguugacuagucucguacuuagaaaacggcagguugucaccuagugaacuacucaaaaaucucucuaacuagcaagauaaaaagcaguauuucaaguccacugaacugaaaugaacauaccauacgaacauaauggcaguguacauugcucacauacaaaaccacaucauaaagccguagugauuagaagggcauagugaccaaagcaugauccucuccuccagaaacagacucaaacacacagaaaaguaguauuuuuuuauaugacauugcaaauucaugaggccagaugaauuaaucaacaaauguuauuuugggaaagugaggacauugaaaagaaugugaacccuaccucacaccuuaucccaaauaaauuggagacagauuaaagauuaaaaauuuuaaaaauaaaaauguuucauuuaaaacauaaagcauugaaaacagcaaaaugauuuaaaauacuuuuaaaaagucauuuuuaaacauuuuuacagugggagaaacccaaaagaaaagacuaacaaagccaauuacagaaaaugaaaaguucagauaauacaaaccaaacagaaaacaaaccaaaacaccuacaaucaaaaaaauaaagguaaaaggcugggugugguggcucacaccuguaaucccagcacugaggauuggagacugaggcggguggauuacuugagaccaggaguucgagaccagccuagcaaacauggcgaaacccugucucuaccaaaaauauaaaaauuaccaaagcaugguggugggugccuguaaucccagcuacucaggaggcggaggcaagagaaucgcucgagcccgggaggcggagguugcagugagcugaguucacgucacugcacuccagccugggcaacagagcaacacuaugucucaaaaaaaaaaaaaaaaaaguuaaaggauagacaggcaaaaguucaauggccuuugaaaaagguaaacugagggcugcugaaagcccuaaagcaaggagacaaaugcagauguagguuuaggacucagcaugaaugcuguggcuggagacaugggguauggcagaugccuuucaugaaagccaacagagacucaucucccuaccucccaaauggcuguggaggaguuuccguucugugacucuaccucuccuguauggguggacacguaaccagagguaagcaucugaucuaugaacaaucaacacagagauugaguugagccaugcucucuacagggcauucagaaguaaaugggauuuccaaguucaauuagcagaguugccugcaucucauauuugacaccuuuacccuacaugcugcuuaccugcccaggaucugaacuucuggauauguaucuuuauuucaccccacacucugaguccuaacuuucuacccucuaaaaugauuccaccaccauccgugaaagcagaacugauaacuacaggcugcgugacucauguuugguuuugacuuuucguaaccacgauccacauuaagagcuuuuucaaauaauuguuuauagguuauaugaacuucauaauuuugaaugacacaaguuucuacugaagugauuggucugccacuuccacugccagugaaagaauauucucucuguguucuuaaaaucauucauucuaaaugacacugggguaagaugaccgaaaacuaaagggaugacauuuugcuuaaaagguagaauuguaaacaccagacugcacucagaaaaauggagauuucucaaaauuuaaaauccucaaccaugagaaggauaauuaacaaaauacacuucagaaauaugaacacuuagaaugcacuuagucacuuuacgagaacuacuguaaucgugcccaagccuaaaugcggaugugaguauaaucacugaccaguugcagcaacacugcugcugagaauggaccugcaucagaagacaugccgagggacagagcuggucucagcacccuuagguuucaaugcauguaagagccaguguucaggcugcaaaggucugggcauuugucuuuccaggcuaacagaggaggagacaaugagacucuacaucaauuucccaguauauucugcaaagugauaaugaauuucuaaaagaaaacuaaauaaaaauaucauuuaguuggcuaaagagcuuccagaagaaaggccucagaccauuucaaaaagaaaauggacaacucucaaacacagggacauagaugaggcagaaaagaagaaauaugcauaccuauaaccauggccuugacaagucauuuuauagaaagguaagauccaagucuugaggcacuugcucaagcauucaaauauuucuggggccaaucaagugcuggcuguggagaugccacauccugacccugcaaacaguuuagugggggacacaggcuuucacauauaugacuguagcacagugugauauguccaaugucaggggccaguaaugagaacaugggggcaggaaaggaaggagagaguccucacaccucagccaaagugguucaggaaaacaucccaggaaaagagguguuugauauggguguuaaaaaaugggcucgcuuuccaaucuaaagaacuugaaaguaucauagacgacacaaaugugaagacauccaaugaucauggauuggaagaauaucaugaaaaugaucauaaucugauuauccaaagcaaucuacagagucaaugcaauuccuaucaaaaaaccauuuuuuucacagaaauagaaaacucaauccuaaaguucgcauauggaaccaaaaagagcccaaauagccaaagaaauccuaaacggaacaaaucuagaggcaacacauugccugacuucaaauuauacuacaaagcaauaguaaccaagacagcaugguacuaguauaaaaguagauuuauaggccaauggaacagaauagggaaccuagaaauaaagcuaaauacuuaggaccaagugaucugaaacaaagcauuaaaaaacauaaacuggggaaaggacacucuauuuaauaaaugguacugggaaaccuggauagccccauguagaagaauuaaacgggauccuuaucucucaucauauacaaaaaucaacucaagagggauuaaagaccuaaaucuaagacaugaaaccauaaaaaucuuagaagaaaaccuaggaaaaacucuucuggauauuggccuaggcaaacaaucuaugacuaagacuccaaagcaaaugaaacaaaaacaaaaaugaauaaaugauaccuaauuaaacuaaaaagcuucugcacagcaaaagaaacaaucaucacaguaaaaagcccacagaaugggugaaaauauuugcaaacuaugcaucugacaaaggacuaauauccagaaucugcuaggaacucaaacaaaucagcaaggauaaaaaacaaauaaucccauuaaaaaaugggcaaaggacaugaacagacauuucucaaaagaagauauacaaguggccaccaaacaugaaaaaaaugcucaacaucacucaucaucagggaaaugcaaauuaaaaccacagugagggcugggugcgguggcucacaccuguaaucccagcaccuuaggaggccgaggaggguggaucaccugaagucaggaguucuagaccagccuggccaacauggagaaacgcuguaacaacuaaaaauacaaacauuagccaggcauagcggcagggagcuguaaucccagcuacucagggggcugaggcaggagaaucacuugaacccagaaggcggacguugcaguuagccaagaucgcgccauuccacuccagccugggggacaagaaugagacuuugucucaaaaaaacaaaaacaaacaaccaaaaaaaaccacaguaagacaccauuuuacccccuccagaauggucauuauuaaaaaguccagaaacaauagauguugacauggaugugguaaaaaagggaacauuuauacacuucugguggaaaugaaauuaguacaaccuuuauggaaaauaauaucgugauuucucaaagaucuaaaaguugaccuaccauucuaucuugcgaucccaauacuggguuucuaccgaaaggaaaguaagucaugagaucaaaaaagacaccugcacacauauauuuauugcaacacaguucacaauugaaaagacguggaaccaaccuaagugaccauaaaccaauaagcggauaaggaaaaugugauauauauauauauuuauauuuauauaauuauauuuauauuuauauauaauuauauauauguauauauaauuauauauauuaauauacauauaaacaugauauauauacacacauauauauauguauaccauggaauacuacucaaccauaaacaagaaaaaaauaaugucuuuugcagcaacuuucauggaacuggaggccauuauucuaagugacguaacucaggaaagaaaaaccaaauaccacguguucucacauacacagaggagcuaagcuauggauaugcaaaggcauacagaauguuauaauggacacuggagacucagaagggagggugggaggggcgugggggauuuuaaaaaacuacauauuggguaccaugugcacaacucaggugaugcaugcccuaaaauuucaggcuugacugcuauacaauucaucacauaaccaaaaccuacuuguaccccuaaagcuauugaaauuuguuuaaacgaaaaaaacuugaaagugauacaguuuuaaucaaccaguuacugaggauggacauauuaguuuauuauugccgcugucacaaauuaccacauacuuagggcuugaaacaacacauauuuauccuaucguuuuggaagucagaagucugaaauggcugucacugggguaaaaccaaaaaguaagcagggcuguguuccuucugggggcucuaguucagaauccauucccuuacuuuguccagcuucuagaggaagcccacauuccucaccucauggugccuucccacaucuucaaagccagcaacaucaggucaaguccugcucacaccacaacacucagaccucugcaucccucaucacaccuucucucacucugacucgcuugccucccucuuucauuuauaaggacccuugugaauacauuggaccuaccugaauaauaccagauaaucccccuaucccaaaauuuuuaaccuaaucacaucugcaaagcccauuuggucauguaagguaacauucacagguguuggggauuagaauuaauaccucuuugggggaucauuauuccaccuaccaaaguggguuagggaccacacacccgcccuaagugcagacggaagcagcaauggccuaggauguguaacauacauacauacauauaaacauauauacagacauacauauauaacauauauuacacauauauacaugcacacacauauccauuacauagaugauaucauacauauauacaauauauacauacuaugauaguaaauguuuuauuuguaaaaaaaaaaaucaagcaggauuauauuagucucauuucuuauacuuugcuaugcuuuugugugggcaaaaagccguauggaucauguacuggggaccacagguaaguacauacagccaugcagacaccccaugcauauaaacuccauccaacauguagauuacugcaccccaaauagauagauacauauauacguagacagauaaaagaacugcuuuucaagucgguguuccccauagugugguacauauuccauuuacuaauucaaacuuuaaaauucgaaaagcagcauacuuaacaugcauuuaaaaauauauaaccaucaugucagucaugauuucauaaaugccacagcuuggaacuauucugcccauaguagucccuagccacauguggcucuugucaauguaaacugugacuaguccaaacugagaugugcuauaaguguaaaauacacacaagauuucauagcauuaaaaaaaaagaaaucucauuuaaaauuucuuauugauuugcauguugaaauaauaggauacaguggguuaaauaaaauguaaaauuaauuucuccugcuucuguaauauggcaacucaaaaaucucaugugccuugcauuauauuuauuuuaacaguacuggauuaaaacaaugccaaagcaguugugaagugaaaacaaaaugaguugagcuaaaguaaauauuaguaaaguuagcauaaagguauuacaaauaucuugaaauuucaaagcuaauaaccuauguuugguaacacuauacaacaucccuggaaaauggaauccagcuuuugaauauuuucuggaaaggguaucuuaguacuuccgagguuguucaauguagugguagagggggucaaaugaaaaacauuucuucuuuguauugacuggaaaucugaaaaaccuuuguacauuucucuccaaugcccuuaguucuggcuuauaaagcacagcacaaaccuacccacuacuauccauaacuagcugguucuggccuuuugaaccuuuaguuucaaggcucccaugaaaccaacacagcagcuuuguaacuucacaaacuugaaagaccacauuguuggaggaagauucuuacugcaggcccuggcauuccccauugaugagcugaaaucaguuauuaugagguucuguauacaccuucugaugauggauaaaacaaaugcauaugccucacaggcacagcaggaauuaaaaauacauuaguucaucgcaacuucagaucugggauugaggaacguuuggaugacuuuuuuuucuuuucaaauaaaguuuagaugaggcaggaauuucacuacagaguagaguucugagacucuccagguccaguucagcacuuggagagaaaucaaauacaucuuaucuuagguauggcacuaacuuucaucaaaaaauuaucauaugcucagucacaaaugguuauuguaaaaucuuuacuaaccuaagugcauauaaaaauugugaauuccuaauacaaagcaguauuugacuuuuaaauuucauuuuaagcuuggcccguucacuuggaaugugauuacagaguaaauuaaaaaguaaucacaugugaauuacauuuccucaugaauguaaugacuucaggaggcugauuaauguuaagcagugccuguccuacugcaugcauaccuucccaggugagauaugcaagauagcugucgugaguuguuuaauuuucuuuuacugguauuccagggagacugccugaacacauaauaggcucagcacauucauuaggacugaggauguucuucccuuugguaugcucaagucccacgugcaaaauaccaucaccgucaacuuaugguuaugagaaaagcccaagggaggcggugcagcucugguaccauuuucuaccuagccaaguuucaauuucucaaucucucuuucuaucuuuuuggcaaauucuucauauuugaauggaauaauuccagagaaucacugaaaaaugcauuugcaccaguguaaagguaacgaauugucucacaaggaaugaaggcuuauuaauaaucuacaacaguauuacugcagagaacaaaauuuaaacuaaguggagcacaggaucauuaacauauuuccucucagguaauggggaauguagcagucuaaaauauuuacuccuuucuguagucagguuaaggcauuguuuucuaaaggaguugucagaggaaucacgcuauuguuagaaguggaaaaggcuuggugcuucauuauuucugugcaaaagaagagcaaauacaguggauuuaguagccagccaaggaaagccagguacuaaaaauuaccuugggacaaaaguuggucuuuuauuccugugauuccccauuccacugggaggaacaaugaacuaguagagcagccugagaacauguuacaucauaaucuagaacauauagacagcugaugucaugaaacugucauacuauaugugaugcucucugacaucaucuauuauauaaaauuuuguuuuucuuuuuuaaguuuggugagacaggcuaaauugaauucaaaauccaucagugacucaugaccaucaguuagaaacauucuggauugggagccuuuggaaucacaggaguugagagacugccagcucacuucauugucauuuaacuguggguccucaaaggggaauguuccaaaugucaugucuucccagcuuuguguggguggugggaaaaugaagagggguaauagcgagagaauuaaugucaggagaauaagacagaaaaggccuacaauucuguaguuucuccuaagacuggcuucaggauuccuuugaguuuaauauuucuguuauguuuuuauccugagauauuuaaauuuccagaacauucaaggucaaugauaagacuauuagaaagauuuuuauuuaaacauaaacucaaaagcacucaaggauaaagaagaaaccuaugagaacucugaguagguaaccuacaauucuucuguguuaaggagagaguagagagaauuacucuuguguuucaaacugggggugucaaacauaggggacuaaaaaugugaaauauaccaguauacaauauaacuccauugccuuaacugagaugacagacacuaauauucuuuuguuguacuaggguuuuuauucugcauuuguuguaccuuauaacauuuuuaaggccuuuacuaacccacugugugauucagaagagggugaucaagaaagugagugaccuagagaacacaccacgggauaaccaaucaacauagacaagguaagacuuggacacuagggaugggauuaggaacagggugucuccauccagaggacaguacuggguccaggcuauaaaggcagagacacuggauugugggugcucccugacgugcuaaugagaguucuguuaccaacaggacugggauaaucaauuucccuucucugcauccccuuuccacauuuuagggccugauguuugacagccaucuaaugagcuaaaugaauucuacgaauucugcucuaccauguuggauuugcucuuguggauaauacucagcagaccacuacaauuucuagugggucacaaucuacuuuugaccucccccuucucuaggacauaucccuggcauuuuccuauacaugaccaaaauuacuuuuagagaauguaauuuuguauaaaaugggaaaaauuaauuaaaucauuaaaauaugaaaaggauccucuucuaacaaggucuuuccucuacagggcauccaugcuuugaacucuagggacagcauuaaacugaagcaccagugucuuucuucuggaaucagaaucccuuuguugcuuuugggggaaaaaaaaaaaaggcugucauugaacuuuuaauuagguuccaaaaaugugaccugaggcaauaauagaaugauuuauuuuaaugcuacacugcucuugaugauauucgguuaaaaaugggccagccuuugaaacacccugacaccacacacuggcaucuacaauguugaggcuacugauucaguuuuauuucccaagaugucuuucuuuacuccuuuguucaaccacccauccuucuguccauucauccauucaacaaacaucaacauuuauugccaggcauuaaggacagacaagcaacaaaaauaaaauggucccugucuccaacagaacuuacuaaaguucagcugggaagacaaccacuuacccaacuuaaaauagaacaacguggguggaaaguacucaguccaauuuaaagagaccauaauaucuaaguuuuggucuuuacugcucccucuagccuggguuuuauguuugguuuagccauuuaaccaccacuauguauaacaacacguauguuccacugcugauuuuaccaacagaggccagucucacggugggaaacguggcucccaaugguaucuuauauaccaaaugaucgucuaugguagauuucaaucaucauucuaaauucuacauuguggguuuguauuucugagugccaauacaaaccacaauacuaucuauuuuuuaagagauggggucucacuauacugcccaggcuggccuugaacuccuaggcucaagugauccucccacuucagccucccaaguagaauaucuuaaaguccagggccauucagaggaagagagaugcuacacuggguagauaaucagaagaaaagaaucauuuaacaaccacccuaccccccaaaaaacccuuucucucugcaaaauggaagggccaucuagaaagaaacagaaucauucauacauauuuauuuuaaaaccaauaauuaaccaccuauugcaguacugaaguucauggccuacaugggauuuauuauacugauuaguccacuucuguguauauuuaaccuaucucauaacuuuuuuuaaacagucaauacuaauaaauagcugaguucaucuaaaauauauuggaucuaagacuacccaaauuuuccucaaacauccuaacuagaccccaguuaaacuucuuuuggagucucagggagaaaaaaaaaaaaauagaaugcuuuagaaauucuugauugaauuuuguuacauuagcucagcauaagcauuacagccaccaaaaccacucuuaccaguaaguucuccauagcaagagauggcugccugucccaggauugcccacauaugucuucuuaggauacuccaggaacaaagaggagaaaaauaaucuuggaaauucuguagacuguuuugacuuuuuaacccauucauucaauccauaaaaaugaacaaagugcuauaauguuacaguggaaagagcaucuuuucagaggaagauagcuggaauuuuagucaagacuucgucacuaauuaucauugugccuuuaaagcauaucacuucacuuuucuggaccacauuuacuuacaagaaaaaugaggaaguuggaccaaugaccuaguagcacucguuucugauucucagucugaagucaauggaugcuauuaacauggaaguauuuugaagcugcauuuccugcaggggcaaagcaaugcuuccuccacauuuuccugacuccuuucaaguucuccuagagagcuccuaagacaauucauaaagagaaaggggguacugcugcccaagcacacauccuuugucacgguguguggucaggcacuaguuggcauuaauuuacuuguucacaguuguacaugagacauuauugguagaguaguuaugguugccugauuguggauguguaacuaauucuggaaaaggaugcuauaaaguuacaauccaaacaaucucagcaggugucacuguagucaggagaacauaucuucacaaauacucauuauuuauuuauccuuaaguaagagaaggucccuaccagccagccuaaaaguacugagcucuguuucccaucauaaggccaagaaucaucaacuuuguaagaucaaaaggggguuuuauguaugcucugucuucgugcaggucuaaguggagccaugacaaccugaggcacauuuguagauauuuuuucaagguuauaggcagaauggcacuccauagcaucagucagaaagcuacucccaugcccuacuuugucuaugaccucagcuuuaucuacuuuuauuuaugaguguggagcuuaggauuucagugacagaauaauuuguuugacacauuacaguuaaaaaaaaaaccccaauagaaguacauagacauacacacacacgugucuguaaaauugguaaaaucugacuaaacucuguggauuguaccaauguuaauuuucuaguucuuacaugagacuauaguuacuacaguuaagcaagaugcuaacuauagagaguuugcaugaagugugugugagucuuugcauuuuugcaacuccugugaauguugaauuauuucaaaacacaaaguuaaaaaaaaaugacaaccaccaaauaauuaagaaaccuauaccuucaaaagcaagauuuaaaaaguaauuguaaaaguucaggaauaguguaaugacacgguucaucaucagugaacaccucuccuucaaaaaauauuuguaugauaauaaauaucccucaacaaaggcauguaagucaccaguauucauucccaggaaauaaggacugucucuuucaaaaauauuuagaggaccugagaugacccuuuuccccuaggucacaccaagaguuuuuaucacugaaagcuccuuuuugcaauucauaguuuugacaaaaaagauuuuagugaugugucugugucuccagaugcacugcucugugcaacuauauaauaacuauuaccuggucaaccuaugucagcccauuggaacugaucuuuaagaacacaaaaacauauauguacacacugguaugaacagcaaaucauucuuaaaauauuugauuuagaaaaaaaugcaagagagaugauaguuaauauccacaaaaggcaacacaauuucacaaauagacaagaaggggacaaagaaaaacuaaaagaaaaaaaugggggcaaagacaggaacaggaagacaaacuucgcauguucucacuuauuagugggagcuaaaaaucagaacaauugaacuugugaagacagaguagaaggaugguuaacagaggcugggaagggucauggggaggggggugaauaguuagugaguauaaaaaauagaaagaaugaagaauaagagcuaguguuugauagcacaacaaggugauuauaguaaauaauuuaauuguacauuuuaaaauaaaagaguauaauuggauugcuucuaacacaaaggaaaaaugcuuagggagauggauacugcauuuacauuggugggauuauuacucauugcaugccuguaucaaaauagcucauguacuccauuaauauauauaccuacuauguacccgugaaaaugagaaauuaaaaaaugggcaaauauauggagagguauuuuauuuauuuuauuauuuuauuugagacaaggucucagucugucacccaggcuggaguacaguagcgugaunucagcucaccucagccuccacccccugggcucaagcgauccucccaccucagccuucugaguagcugggauuacaagcacgcaucaccaugcccagcuaauauucugguuuuuuuuuuuuuguuuuguuuuuuuaguagagauggaguuucaccauguugcccggacuggucuugaacucccgggcucaagcaaucuuccugccucggccucccaaagugcugggauuacaggggugagccacccuucccagccugaaaagguauuuuuaaggugggacaauauaaaaagccaauaaaaaugaaaagaugcucaaauuuaauagaagucagaaaauguuagagaaaacaaugagaugucauuuagaccuaaugcacuaauacaaaugaaaauaaggggaaauaccugcucuggauuuagauaaauggauauucugauacaugguagauuaaaauaucacuuuuaaggcuuuaugaaauguaauguaacaauaccuaucaauauuuaaaaaguacauuuucuuaaaucuaguacuuucauggcugacaaucuaucccauuaaaaguagguuauuagugagaccccauuucuaccaaaaaaaacaaaaaaaucuggccaggcaugguggcaugcaccaguagugucagcuacucaggaggcugaggugggaagauagcuugagccugggaggcagagguuacagcgagccaauaucgcgccacugcucuccagcuugggugacaaugagacccugccucaaaaaaaaaaaaaaaauuauaugagcuuuuuguacagugauaagacaaaacaaaaccacacaaaggcuggaucccaccagcagaaaauguuuuaaaauuauguuaccgccacuggacauaaugaauuagauuuauacaguagccuugaagggauuuccucaaagaauuauugaaagauaaaagaaugaguaauauuccauuuuuguaaaacaaugacugaaaaaucucuccagauauguauauauaaauacacguauguauuaacauauuagcagguugacaaauacacaaguauaaucauaggucagaacgucccaaauucugcaucuuggcacaaguauaagauaauaacuuuuaucuaacacugggguggaaagauaaagguuguucaucaccagaaaugaugagccaaaggauagagccaccuaaaaagcaguauuugagcaaaggaguuggggaguucaaaaggaaguuguugccugaggaggauucugggagcacuccaggaagagggaggauagagcaugguggaugaggugggucauguguacgggaaugggauaguaccgagugaaaacaugggaacaaaaugacgcaaaguucagaaauacacauacauacauuuacauauaugaauacguauguguauucuugaauuucauggucauauuuaugcauuuucggugaaauuguguuuuuaaaacuuacuuuaugucuuaaaaauaacacuuaaggcugggcgcgguggcucacgccuguaaucccagcauuuugggaggccgaggggggcagaucaugaggucaggugauugagaccauccuggcuaacacggugaaaccccgucucuacuaaaaauacaaaaauaaaaaaaaauaaaaaaauaaaaaaauuagccgggcgugguugcaggcaccuauagucccagcuacugggaaggcugaggcaggagaauggcgugaacccgggaggcggagcuugcagugagccgagauugagccacugcacuccagccugggcgacacagcgagacuccgucucaaaaaaaaaaaaaaauaaauaauaauaauaauaauaauaauuauaacacuuaaaaaugagcccagguagaugaucuuccaguaauuucucccuugauuuucuuguucuugcugcuauuaaaaucaagagggcaccauauuucucccuuugcucuucuaagauccaguacuuaugauaagaaaaccauaguccaacacacccuauguaaguuauucuguguaucugagcuucagauguaaaggagcucuuucagacuucaggguuaugagaguuucugaauagccaccuggcaaaucuggguagauguugacuuucccagcaggccacgauuuauugccaaaagcacaauuuuuuucuuuuguuuugacuuaacaugccagaaaaaaaacacaagacuauaagaauuaaaccuaaugcaucacagcuaagcucucuaaggcaugaaagaggcaagggcugcaccaaaacgaauuuaucaaucacggaaugcaggaccccuuguaugauuagcuuaauuauuuaaagaaugcaaaagagguggacgguucuaccauuaaauuauccuguuuaaagaaaaugccaacucgguaagcauuucuaaguggacaggcuauuucaauagaguacauugcugaauguguguguguguaauaauaaaagaggcugcccuuuaaaaauccccacaccacguacuuuuauuaauuuaauuugguguccacuguacuuuuuaguucgcuccaguugcaauuacuauucuaguuuaauuucacauauauuugcauuguuucauggaaacccuuaccucgguaaagaguaaaaauagauaccucccacuagacccaccucaaaaggauauaugugugugaaaacauacauacacaacuaagugggaugaaagugaucuuuagagauaugggauaaaggaaaaaccauuugaaaaaagucucagaacacuccuaggaagaccauauguacuuccucauccagcaaagugcuauuucaaauguguuaaauaaguagggagugugucagugugcgugugugugugugugucucuguaccaauaaacauccagaaaaaaagaggggaaaaagucaauauaaaaauuuagaaauuagaauauuuacuuuuaguuaagaaaauuucuagaaaguuuuauuuugauauacaaaauauaagacagccaucucaacaaucguguccagucauucagcaaucagccaccacugacaaccuacaccuuuccuuccuuucaauaauggccuuccaacagaccucgaaaggcuucuauaugggucacuuuucuuacuauaucuguauuuuuuuuccaaaccuaauccuguuuguucugaauuauacugaguuucugauaaacuuuaaaauguuuuucuuagauccagcugcacuaagaguauaaagcgaauuuagaaucaccaccccacaguccccccgccgacaaaucauacuauuuaauauggcggugaugagaacaacguaugugacuaccgugacacucaauaaaaaugcuaugauuugcuuuuuaaaaagucagaaaccuauagaauucguaugugaguuccacucauuguuucuauaaaaaggucauucugauauguuuuagggcauugucaugagaaugugugaaaaaucuauaggcuuacaaaacaugaaaacucaagauacugguugguaaggacaugguagggguaauguauucuuagaagagaggcugcaucauuucugcagauaaauuugaaauuuucuucaugcaauuuggaauguaaucucuuacuagauuaaauuuuacagcucaggaaggugaggagcugguaagagcaaacugcaugagacaagaguauagauauccaacaaacaaugaggcaaccaaccugauucacuuaguacuugacagcaaugcuuuuauuagaaacacuuuacuuaugaccuauuaccagugguuccucuacuauugggauacauuuaaaucugucauuuuaaauguguuuacacuuuuucuguguacaagaacugcugacaaaggcaagcgugauaugucauacugaugacguguuaagcugaggaaauuuccacugccacaggcaacacuuuaaccuuaugaaacauuuuaaucacauuuuuauugaagaagcuuauuaaaagaugcaggcuuucagaacucgacaaauuuucuugauccuuugccaaaucagagguaggcaaaguguacucugaaaucaccuccccccaaauuguaaauucauuuucugaaauuagauauugacauuuaagcaucauauaaaagucaaacuuuucuaggauggcugagaaguugaaaauccuaaaugcccacauuaugagaaaagaaguuaaggcaaaggccaauauggugaguaauuuuaaauuuacacuuagcauuuagccccuuuucugcauuagucccauguuaggaaccaacucauucuuucauauccaacauauguauuuucaguauuugcuaagaaauaauccucauuucaaagcauugguuauuauuuucuacaaaagcuugguuucucaauaguauaauucuguguuugcagacuauaaaaguauagcucugagaauaugaaagaaaauaaucaccaggacaggcaaucgauuucugugugggcaaaaauuuuagaccuuuuuuguaggugaaugacaucagagagccauuuagcucuaaguuuccaugacuaccuguaaaauggagauaucauucauucacucauucauuugauaaauaucaagagaacauccacaauauuucagguacagaacuagguggcauuggggugacagagaacacacugguuuugccuuuaaggacauuuauagucuacuugcuuucuguccacuucgacucagacauaaagaauauuuaucaaauauaccggaagucccagaauaaggguacucuaaauacaucauucaaauuucaaaauagaaccuaaaaaacaaaugccaaaacauuuacccaauguauucaggccuuaugaaccuagugauuaacauauuuuuaauauguuauuucagcuauacuguaacuauauggugaaacacaacaaaccaaacuacuugguuuauuuaguuuaguauaaagccacauuuaguaguauuccaacucagugcucuucggcaaguaugugcacagcuauauuacgucuaggcacuguaacaguggcuagggagaugaugacaugaugacaugaugaucuguuagaacccugugaccuuaagaagcuuaugguccagaaagacauacaaaugugucauucacuaugugauacuccucucaaucucuuccucucaccaucucaccaucuuucuuacauuccuacuccugauuugguccagacaauccacccaucuuccagagccaagaacucuguugagccaauaguaaaaaucucauucccucugcaaaggauuuguuuguuuaggaaaguugugugacccaguuucagccaacaaggaaagugagugaaaaaccauucaauagggcuuuugaaaaagacauggaaccaaucuaaaugcccaucaaugaugaacuggaucaagaaaaugugguacauauacaccauggaauaguacacagccauaaaaaggaaugagaucaugucauuugcagggacauggaugaagcuggaagccaucauccucagcaaacuaacacaggaacagaacaccaaauaccgcauguucucacucauaagggggaguugaacaaugagaacacaaggacacagggaggggaacaacacacaacagggccuguuggggguggaggguguguggggagggaaccuagaggaugggucaauaggugcagcaaaccaccauggcacacguauaccuauguaacaaaccugcacguucugcgcauguaucccagaacuuaaaauaaaaaauuaaguaucaauccaaaaaacacaaaaacaaaaaccaaaaaaaaguuucuucacucuuuccaaaaagagguaaaagauaaacccaagugaauggagaauuugguauaugauaaauaugcuauccuuaaaucacuggggagaagauggaguuuugauaugaacuguugggauaaguggauagucacaugaagaaagguaaaaucagauccauuccuuagacuuuaaaccaggauaaauuccaaauggaucaacuauuuaacuaugaaaacuaaaauuaaggacuagaaaaaaacaugguaauaugucaucucaauaaccuaggaauggggaaaacuuuucuaacaauuauuuaaaaucccaaaguaauaaggaaaaacauggauaccagugauuacauaaaagauuccagaaacaaauugggagaacacauugguaagcuucacuagagauaaaaauccccaauauacaccagggcugcaaaaucaggaaaaaaacagcccaaaaucacacugaaaaaugagugagaaauaugaacugauuagcucauaaauaaaugcaaaugggccuuaaacauaagaaaauacacuggacugugcuguuaauaugacaaaugcaaucgaaaacaauacuaauauaacauuccucaccuaucugacaggaaagucuuaaaguucaacaauauaguauguuggccagacuuagggaacuaggaauucuuauauaguugugguauaaauacaaagagacauaugcaaacccuauggauaaguguucaucaauaccuagcaaaauuacauauguauuuauccuuugacacagaauugcacuucugggagucuauccaaaagacacacuagcaaagauaaaauauauguuugcacaaagcaauucacugcagcauuauuuaaaauaacaagagauugaaaauaaaaauguuuauaaauaggggauggagugagaaaaaaacaugguacaucccccaugauggaguacuauaaaaccguaaaaaaaaaaaaaaaaaaagaagaggaggaagaggaaaaagaagaaaagaaaucauucuagaaagugcaacuaaaugcucuccaggcuauuuuucuaaagaacgaaagaaaguugaagaaaaauguauagaguauauauaacuuuucaaagaaaggauggaacacaaauauaaauguauuuauauacauacauguauguauauccacauacaaacacauauaugcaaccuuauguauauauuguauuuguauuuaauaaacagaguaaguauuaaaaauuugggggaggaagaaacagaguauaagggagauauagaaguuauacuacuuugaacauacugguuuuauagauugauucugaaaucauaaauauucuacauaauuauaaugcaaaauuaaaucuaaaaaagcaaucucuauaaauugaaaguaaaauaaaccuaauuucauauccaguugcuaucauaagcacucacagaggugcuauuucuagcgauuuuauuuaagauacauaacaauuuaaaggaaaacucuaaacugcucaugguaauuaaauuauuuguaguaggacugguaucgauauucugagacucuugugcauguacugugaauaaaucaaagaauuaugaugguaucauuaagugcugagguuuuguuggggaaggagaguaugguugaaaugaaauaaggaugugagaucaaugggguaaggcauucugacuggggaaaaccacucucccaaagaugagccuacaaguugccuuagcugguucuccaggcuucuguuucuaaaguuauugucaugacaucuuuuuaauguucgcuuuucauaugaugaggccaauauauacauauuaaaguacauuuacaugcauauacacacguaaacuuauuuggauagcauguucucaugcaucgaucacauuucugauuugagauaauaguacacuagguuaaauucuuccuaauugacuguggccaagucugcucacgcccagcaucggaccucacauucuuuccuaccuacuuguuuuaagcugcuggcuccuugcagucacuuggcagaaaacacuucuccucaaacuugcauuguauuucuagcuuucacucaucaauaugaauuuuaaggcucccagugaaaaccaauuuaagguauggagccuguuuaaaacaaggacuggcuccagucacacccuuauuuucagaaaauaagccucugaggcacucccaacauagggacaugcagccaggacgccaagugguaugcuuugguagaaagaauuaaaaacaacuuaguauaaaaacguuaggguauuuguuggauuuaaaaaguuuagcuaauguacaugacagcagaccucaaagcaccagaagacucccuugucuguaauagagcuucagauagaacacaccucuugaaauaauacuaauaucuauuuugggauaauauaagguauuuucuccaaaacacauaucucuuucacauaacgggagacauauaaguaaacagaaauaucucugaagacaacuaaguguuguuuaagcacuaaaauaacaaucuaaugaauuaguaagauaagaaaaaaucuauggggagaggaauauuauuuaguuugggaaaauaaauaugguuugcaaggcauaugaaauaucacugggacagaggacaggaaauaauacugggccugggacaggauaugagaaaaacaagaugaaauggaagaugugagaauucagaauagacaaagaaaaaggacauggcggagcaauccugggcgcuaaugauuuucuaagaaaccagcaaauccggguuuguuccugaggauguuccaaguggagcagcugucuaucucagggauuuugcuaacuccagaagccaucagccuagugcccagugaauguuuaauacugagaugcuuucaugccaccugaaagaaaagcaagagagggaucugugucccucucaaaguaccuaguacuuuaugguagcuucauugguuuauugcguugauuauucaagauuccuuggcugacgaugacaagaacacaaaucaaacuagccucaacuagaaagagaauuaauuggcuuauauaacuagguauuccaaugauagagagaacaugagacaaaucuggaucaaggcacauacccuuucuugcucucucuccccccaucugcuucuuuccgucucccaauucuguuugucucugaucagcuuuuggccucauauucuucuuccaugagcagacucugaaaucccaaacccacagcuuuuuugugucaagucgucucucuacauagaucagauuucaccgaagcaaucuuacugacagcuacaugggagaugcuucagcuuccuggaacaaucgcuggggcauauuccugugauucagacauuggacagacccaagucaagcucccacaggccacuacacuggccauuuccaccacaaccauacaggauggggaaggagcaguuuuccaaugaaucccaacaacagauuuuucccacuauccuuccaauaagacuauuuuuccuccaagggcauggccucucaaauauuuuuggccuucuccacacuuuaccauaacaucuccuaaauauaugccccauaauuaaacagauggaaaccagaauuuuuauuguagacaucaucagugaauuauuuucacagauugcaaauacauuccuucaauauuccauuaccugauugugaucaccuaauuagcagaugaaaacuauucagaguaucaggagcauaagaggaacaaggacaugucaauuugaaaaugauauccuuagaaagcaugccuaucuacaucuccuaucucuaagucauaaauggaaagcauuuaacauacuuacugaagauuuuuauaugugaaaaaugggaugguucagguagccuacagauccugcaaccgugguguguggaacauaggugucaugcagaauaaucucauguaauaagagguucagaggguggucgugacuagcgcaaugggaagcuaaguagauacgauuccaggcccuacccucacuacaaacagaagguccaagauuucauccucuuucuuauuugagaguuucauauuuuucauuuuuuugaaaaagcaauuguacugccaaacuaaaaaacuuacaaacaagcaacaaauuguauuagucuaaucaccucauuauacuaaagaugaaauaguuucuaaauacagauccuaaacuugcugucauuuaaauuucaacacagcuauccuuuuacuucaccaggcugccuuucuuaauuugauuuuacaaaggaaagcuuuuuaaaaaaaacuaaaacuaaaaaagcauaguauucuaugcuugaguucuuagacuacacauaaauauuuaggccgugcuuaucagaauuuuagaauucugaagagccucccugaacugucaaaaccucuaaaagccacaccaugcuggugaggcgacagaguaaagggaacacuuacauacugcugguaggaauguaaauuaguucacucacuguggaaagcaguguggaaauuucucaaagaucuuaauaacagaauuaccauuuaaaccagcaaucccacuacuggguauauaaccaaaggaaaauaaaucuuucugccaaaaagacauguacacuccuauguucauugcaguacuauucacaauagcaaagacacggaaucaaccaagaugcccaucaacagugaacuggauaaagaaaaugugguacauauauaccacagaauacuaugcagcuguaaaaaaaagaaugaaauuauguccuuugcagcaacguggaugcagcuggaggccauuauccuaagcaaacuaacacaggaacaggaaaccaaauacaacacccucucacuuauaagugggagcuaaacauugaauacauauagacacaaagaugggaacaagagacacugaggacugcuugaggagggagaugaggaggggcacauggauucaaagccugccaaucauguacgauacucacuaccugggugacaggaucauucauccaccaagcuucagcgacacucaguuuacccguguaacaagccuggaugcacaccccuggaaucuaaaauaaaauaagauaaaaguaauucauucaauuaaaaaaaauaggcugggccugguggcucacagcuguaaucccagcacguugggaggccaaggcaaguggaucaugaggucaggacuucgagaccagccuggccaauauggugaaacuaaaaauacaaaaacuagcuaggcaugguggugcacaccuguaaucccagcuacuagggaggcugaggcaggagaaucacuugaaccugagaggcagaggucacagugagcagagaucacgccuguaaucccagcuacuagggaggcuaaggcaggagaaucacuugaaccugggaggcggaguuugcagugagccaagaucgcgccacugcaguccagccugggugacagagugguacuccaucucaaaaaauaaaauaaaauaaaauaaaauggcacagaagcaucaaauguggauagaagaaauaucuaccuaugccucuguugaaauaucaaugagucugucuaauaaaugccugcaauaggcuacuuaauuaaaaugaauagcuuuagcaaucaccuugguugacaacauucagaaugaagagcaaauaauaguuaacacuuauucuacauaauuacucuucccuuccguacacaaaacauguacagagccugggcuugguaacacgaaauuuccaauaaucuaugagagaacacuuaaagacuuuacacuuaagaagaauaauuuuuggauuaauuuugaaucuauuuuccaaaaguaaaugacuuuuuaaaggccuagucaguuaccaugauaaauaaagacauacacuccaaguauuuggcacauguaauuacaguaaaaugaacacaccccauaucaagcacaucuuuguaggucaagauggcaauaagaaaguauuuuucacucugguccacagugaucaaagggggaucaacacugaaacuguauuucagaaugccagccaaaagcuuugaccaugaaagagaagcagugcuggccaguugcccacaagacugcauacuacauuagguuuuaauacauuucaaaaacagagaauuuauauagaaacugugacaauuugaagaaguuugcugggauaaucuuagaagacugaucuaaagacagucuaggacagcugcaugcaauucuaagagucagaucuguuuguuuguuuccgagauaagcgucaaauacuaauacagauaagagcuaaaacuaaaauaccaauucagugaaaaagcuaaaacccagaagacguuuuauuucauuaccugucugaaguuauuuuuaacagugacaggucauguucuauuucuucacugggguaagagagaauauuugaaugucccaaauauauuaaaguuauaggcaaaaaugcucacaaaccauuuagaaaaugauucauuuuacugucuaccuaauacugagcugaaauacucuacucuaagcugacugcuuagaguauguuuacuaucugcuaauccuauagcucgcacuuaaacaaggcugguuggauagauaauccagacaaaugcaggguuccauaacagagcauuuuuaaaugucuuaggcuaucaccuaagccacaaacaaaauugauuuuuccagacauguuccagugucugcuuacccuuuccugcuaccaacugucaucucacuccccugauaaaacucuugacauguuuugcaguauccucuacucccuucccauuccaaacagcugucuucccuuccuggcagaaacucccugacaucuggauacucaggauggcuacuguuaugauggacagauuccauuuuauccaacuacccagcuccgagaauauaaaaaugagcaaaaggaggagaagugugauaguuucaccagcuacacaaauacuaguucaaguaauggcuauauuaaagcauuagcauguugaauaauuuucuuuuaaaaguccaauuuugugacaucuguaaaaugauacagaauguuaaaaugcgaugauucugaaagaauacacaauuacaagcuuccuaaauuucuacucagguaaugacaacaaauccaagcccauagcucaaacauaggauuucugcuucauggccuaauuugauguuuuuuuacuagauuuaagaacaaaaacauguguguuagaugaagacagaugagucgaagaaaagacaaaacaugagucacuuuccuugagcucaucgcccauaucccaucaaucaccaguuccacuuugugcugcuuccuaaauauguaucaucucuugcauauucugcuacacugguuucuuaaacuguuuuccuauauccauucucccacuacuucagucuauucuccauaagcagccagugauauuuuauugaagugcaaauugggucauaucacccuaacacccccuuucuaaauccaaucaguggucccccuuccuuguagaauaaaaccuacgcuaguccacauggacccuaaagcuuugcauaacucuggucccagcuucucucuggcuucaucaggagccugucuuccccucacucaacauauucaaaccacacuggccuucccuccauuauccaaaugcaucaaauuucucccauuccuaaggucugcuuuagcacuuuucucuuugccuggcucccuccugcccaugguucagaucucaauuuauaugucacuuccucaaggaauuacucugcaaucaacugcaauauguuauguauccuuuuauaucucucaugggaucauggaauuuuucuuagcagcacuuuuaacaacuguauuuaauuaacauauuaagucagacauuaaagagauuugcaaaacuauaaagcaaugccauucucaauuuuugguuuugaaaaauuguuaauucuuguuuaaaaauguuaucuuaaugugcaaaauguuuauuauuguuuuaaaguauuauuuuaaaaaaauuuuaauuucuaauauggcaaauaucaauagauuuaacaacauaaacaaaacuucuuucggucgucaaucuuuuuuaggaguauaaagggauucugagaucgaaaaguuuaagaaccacugaauaagaaauuaaacuauggcuugugaaagaaugagauacuacauuuuaaauccuuuaggaauacuuaaaauuguaguuaaauauauuuuauguaggaaacaaagcuuucaaguaauguugcuaccuuagaaagaaaaugcuuaauucuuauauacugcuaagagaauuauaacaggauuguacagcuaggucauaagcaaugugucaauuauaaaacaguugauaagaaaguucaacuugccaugacaaacauaguuuacagcuuuaaaugaacaauuuuuucuuugaaagcauucuaacaaauguuaucuuuaauaacaaacacauauggccuuuaaacuuucaaggcaaagauucuugaaaaucauaauuaaaacaaaccuuucgaucuuacagaaaaguucuuaacagaagacuaacaauuuugcaaugacaagauggugaauaugugcucaauacuaauuacagucaugaugacugugauaucaacaaacccauauaugguacuuuucuaagagcuuagaaaucagccuuaguuacuauuauuauuagcccaaggauauguaacuuacccugcaucugacagcuaaguaagugacauaaaugagguuugaauccagggucugagcucuuaacucuauacugccuacauacauacauacauacauacauauauacauacauauauaaauuaaccuuucuuauccugcuucuaaacaaagguaagggccacccagucaaugcuuuguauucuuccaauauucuuuccuagaacuucuucaaaggcucucaugaagcacuggugaaacuggaaaucacugaauuuuacuaccauuuuaaccaaggcugaaucaaauaauuuagaaguuaauauuguuuauuuacccagggucuaucuacccacauuacucucauuuuguucacaaauuaucuaauuuccuacugcaucuggcuuugcuuauuuuggguuuucauugcuccugaagauuuuucuggcaaauucuggguuucugccccucguaauccuucuguggacauucaacaugaaauacuaacguuccuaggccacuggacucuuggaaagcuaaugcugugaaaucuuugcuuuguaauagcccuauacuuuguucaauaucuauuucaucuguguaacaaguauuauaaauaauaaaaguugggagucuccaguaacugagaaaauucuacccaaagucaacauauuuauguuaaacaaaagguaguuuguauucucaaaaugaauugaguuauugggucugacauccuccugauuaaaauguaaacuuauuauugaguaacgaacuuugaacauagucagaauuuuagagaaacaucaauuuaaaauauauaauuaaacagacagagggcuguaaguucaucugacagaauauguuuacuuuuguugaaauguuaaugaugucagugauacuucccugucccccuucauuaaucuugggaaaauaaacuaucuguuucuccucaaagcuuuguucuccucacuccauuucuucuuguccucacccagaagcuaaugaaguaaaagcuuuagggcuucuuaggcuaacaccccuucuaagaucuuguaucuaaaugugugguuauaauuguguaggcuuuauccuaaagaggauaaaaauugcauaagauucagacgcuacucaaccuggaucugccuuacgugaguuguaaauauuucagucaacuugcaauuacugcucauauuuuuguuucucuguacuugcagccgaggaaaauccuuuggaguggcucauggacaucagucccccugauacaaaagcuuauuuuggcaagaaaguggcaaagaauuacaagucaggauagaggcuaaacaugaauuuuagaucuaaauuucuaucaauagguaauuagaugaaaaacaauaauaagguagauccauaucagagacaaaguggaggccucuaguccuaaaugggccugaauaauuuagaaauguaacuuaaaaauguuugguuuugggaacauuuuauguaaaaauucaggugucaaaaaucagaccugauaaaacuggguauaaaugcucuggccugaauauauuuccuaucuaccucccuucacucauuuucaaggccugccuguccccaccuaaguuaaauuuaggcaagcccaaaggguuauuauuaaaguuauauuccucaaauuauggaaauaaugcccaagagauauuaauuauuaaaaaaaauaaaucaacugacauaauagcauucauaauagcauucauacuauguuucaacuuuuauuuuaaaugauuuauauaauuucuaagaugaauucaaauuauuuauuaugguauacaguauuuuuuaauauucagcagaaaaaauuaagcacaaauuuuauuuuaaauaacauuuccuaccaccuuuaaauauaacuucaguagcagacacuguguugaugguuuggcuaaaggaggacaagaaaauaggaccugcucaaauucaugcaugguggcaacaaaaauucagggaucauggcaccaaaaaucuuguuuuccaggauggaucacagacugaggaagcacagauuauacauuuagagccgacauucauuucuucacagcaguauuagaaaagaaaagccacagucgaugccauuuccaucuagcugcauccaagccuuucugcauacagagaaauaucuaauuacccaauacacuagagcaacguguggggauuguuuuaauauauauucacagcaugugucauuauggcuccuggcggcuauuaaaagggugggcuagcaacaugaauuaacaauaacacauuugguauaugauggcuuuauaaugccuaaagcauuuagcuagucucauuauucuuaaugugcccuacagcucacaagaaucauguaacuguguauucagcuggucccaaaugcuaaauggaaagcaaaauaucuccuaaaaguaguucugaguaacugcuaugucuaguuuucuuccuuuuucaucaacuaacauggcauauguuauaaucaacagauaguucuguuuucagaacguuuuuuuccuuuuguuuuagacaagcagaacaacucauaauaguagacaacuucaccaggagaacagcaguucaguacaacaggaaggccagugucuccccaguaccaccugcuuaagcuacuacaaggguucccuuaacagagaugccugccucuauccauccuccuacagcccauucuccagucagcaacuauagacaucugugaaaauaucagaucguaucacauuacucuucagcuaaaaguacuccaguggcuucaauauguacuaagaauaaaaugcaaacuucuggucauuucccacaaggcuccuucaugcgguggcugccuacuuaucucugcaacuucuguuuguaccauucucauuacuaaaccugaaacacggcgcacaccuguaaucccagcucauagucauuccagucauuccacacuuuuagcauuucauggacccucagccuggaauacccuucccauagaucuuuuaaugacuggcuccuucuccuucuucagaauucugccuaaaauugaucuccucagagacuauccuaucuguagcaaccauuuuuucccaauucucuaucgcuguccuauuuaauuuuuuuuuuaauuaggccuaguagagugaaauuaguuguuuuuucagcaugauuucuuaucaacuaucccuauauaaauguggguaugcacacacacagaaauucgcauuccauuaggagcacggccuuaucuaucuuuccuauuaucaccuccccaguacguggaacagauacugguaggcaguaagugcucaaaaauuauugggcauggacaaacgaaccugcuaguuaagcauuuccauccaggagacaaucaagggagcucaacuugggaauguauucaaaucaacucuuugaaauuccaucuaacaacacaggaaaucauucucucuuauuuauuuauucaugcauucauucauucauucauucauucauucugagccaggauucaaguccuagucccucuuacuagggcagaaaaaguauaagcucucgagaagaaauuauauucuucuacccuccccucccuguucuucaacuucagucauucaccugcucucugguaugguuucugccacuucuguguauuacagguaccaacuuucacucaaugcucuuuucaccuuuuuacaauagccucacacuaagcauuagguuggugcaaaauuaauugugguucuugccauuaaaaguaauggcaaaggccaggcaggguggcucacgccuguaaucccagcacuuucggagguugaggcggguggaucacgaggucaggaguucgagaccagccuggccaacaugaugaaaccccgucucuacuaaaaauacaaaaauuagcuggguuaaaauauuauuuuaaauaacauuuccuaccaccuuuaaauauaacuucaguagcagacacuaugcugaugguuugacuaaaggaggacaagaaaauaggaccugcuauggugugguggcacacgccuguaaucccagcuacucaggaggcugaggcaggagaacugcuugaacucgggaggcagagguugcagugagacaagaucguaccacugcacuccagccugggugaaagagcgagacuccaucucaaaaacaaaaaguaauggcaaaaaccucaauuacuuuugcaccagccuaacaguaauaacuuuaggauaaagaguuugcuaggacuaguuuuuccugaauuacauuacaauuacuccuugacuauuaaaacacauacccauacguaugcauuuacacguauuuuuccaucuacaauagucuccuccaacauuugggaaaacuggaucagagaugaaggaagacuuucuuccagggauagaggcuccccucaggcagaaugacauugcagagucccuggagggcuccuaacuuuuacuaggcacucaguggugucaugcucugugcuuuauuuauuacaauaccccuuugaggagguauucauauaauguauuuugcaggggaggacccagguacagggagcuuaagucaauaggacaaggucacauagcuagcaaaaggcagaagucguguucaaauucagguccaucugggcaccagauccauucuuggaaccgcugaaucauacaucaucuuugcaacacguaagcgauccaugcuuuguuuuacaauauacuucuuuccuaaggugguaauccgagagcuuuuauuuacuuauuuuauuuacuaaucuaaaaacugcacacacccaccuucccuucaauauucccaaguaacaagcuuguugagaaacccuacugaaaacaagcugagccuucuuuucauuacucagugauuuuuaaguguugcuaguuuuuauaccauuagacuuuuauuuucauaauuauaggcugccaugggcuucuuccaaagcccccugccaagucuucauuccuacauacaggugcuaauugcuuucuuagcaccacugguuauucucugaaccuuuggauuucaccaccuacaauaggacccuggguuuuucuccccuucaguaacccuuagcacaauggucacagucacuccauggcugacuugguucuggcccacaagucucaucuccucauucucaaagcggagucaaguuaauucugugcccgugcugcguccuguucucucucaauucuuggucguggugcuugauccucagguuaaagcaacugaacucuaguagcuuugaaacaaacuuguauguuuccuccuccccuccauauagugugaacuauauauaacuuaaacauuaacaauaauagcaaacuuuuauugaguuccuaucagucuccacaccaaagccucucaacaaauuuauuucguaaaaaacaaacaaaaacgagcaaaccucccuguggaggaguaccgauuuuaucccccuuccgcuaucuuccagaagacagcacugagguucacagaggagaauccauucuuccugguuccagaguccguacucuaaagacccacuacccacuaucccucuugugaaaacugucccaaccugauccugaugcaaaaugauggcaaauaaaaggcaguagauagauuuuuacaguaaaagagaaacagaagauaauuaacuugaguugugaaaagaauucaagaagggagaugcuuccuuucaagacauauaaucugcuccuguaugucuuucacuuguucuucaaggaaucuucgaaauguuccccucacaaaguuucuccuuaugcucauaucccuccuaagccauccaugaggguacccaugaaggcccaguucaccggagcugccugacguacugauuaucccucucuaaagcauccucuuuuggacaacaaauuauauguccacccaaaccauaaucuccaugagggcagggaugugccuuauucuccuuuuuaucucucaccaggauuuuuauuuuauuuuauuuuauuuuauuuuauuuuauuuuauuugacagggucuugcucugucacccaagcuggagugcaguguguggucuuggcugaaaacuccggcucccagguucaagcaauucucuugccucagccucuugaauagcugggauuacaggcaugcaccaccaugccuggcuaauuuuuguauuuuuaguagagacgggguuucaccauuuuggccagacuggucucgaacuccugaccucaagggaucuguuugccuaggccucccaaagugcugggauuacaggaaugagccaccacgcccagccaggauuuuccgauuuuaaaucaguacuggaguaaugcuugcuaagaagucuuccccccaagcuagguagaauuucgucauuacuaaguccuucauagcauuuuguguucgucucucuuacagaaauuaucacaugccaacuuuaauaguucacagaccauauaugccaugccucuguggcaggccugagucuccacucaucuuuguaucccuagauaccugauuagauacuuuauccagugacgugguuaacuacaugcugaccaacugaacucaauauucuuuugauauccucauuuugcaggcaaacucuuacuguccugccaauggaacagaaaauuugagaguugugagaucaaugauacaccaagugcuggaggaaagaagacagaguaucuguaccuggagaacaggagaaaguuuagaaacagggcuaaaggacuaggagguauuaucuagguauaaaugucuggguauuagggaugggagagaguugagagaaccucccaggaagagggaaaagacagggcagauacaagacagucugcacgcagaauggugugaguagguuguguggcuccugauggcugaaguuuaaaaucagaagggagauuugaguagacgcuuacuucucaacaggcuguucuguuaaauaccagagcaacaguaaauaagcauuuaaugcaaaacuugcccucuuaaaacagcgacuuugggaucaucaaaacugcauuguaacugaagauaacagacggacaggggagcaaauagaugaccucaggacagcuuauuuggggcugagacagaauacagcauucucucuccacuuuugcacuucccucagcagaucuacagaacugcagaggaccaaguccugaccaggaaugugaccauaccaaagggaaaacagucauuucaacauuucugugggugccugugcugaagggacccagugaggcugggcgcucuguuuauaaaacauaauacgaaucaugggacuaagcuauuuagcagagcagcaaugggacagccccacagggagagaaagggugaggagauguuaacaaauggucucaggggaauccauuuggggaagaaggucccaguggugaagaaggaccagaggacuuguacaacagagcugucuucuguucaauuaaaaagcacuguuggcugggcgcaguggcucacaccuauaaucccagcacuuugggaggcugaggcaggcagcccaccugagguagagaguucaagaccagccugaccagcagggagaaacccugucucuacuaaaaauacaaaauuagccaggcauaguggcgcaugccuguaaucccagcuauucgggaggcugaggcaggagaaccgcuugaacccgggaggcggagguugcggugagcugagaucgcaccauugcacuccagccugggcaacaagagugaaacuccgucucaaaaaaaaaaaaaaaaaaaaaacacugccugccugcacuauacuaacauguucuguaaucccucuccuuuacccuaagccuuuacuguugcugcacacaaugauugcaggauuaaagcacuuuggaaaaaugaaaaacugggaacguguccaggcugaaaggaagcauggagggaaaacaacaguugguugucucucgagacuagauauagaggaaggagggagaaucaggaaggggacuuauggggucacauggaugugucuagggauaagaaugagaagcaaauaaucauacagcccuauggccuugagaagugcugguuuuggagcacgcaucuaucuguggacacugauaucccaucuugucucuauugucacgccacuucucuaugugaaugugagccauuaucuucuccucuggcuagaacaucuaucuaccuaacguaguaaaugaaucaaauuuaauuuaaaggaaaaucaaaagucauuuccaugcacugacauaagaaagcacuuaaucucaauaaacuagcaguuaggaugaugggaaaaucuacaagggcucagagguaugcagcaaaucaaaauucuccccauuuguauaauggaacaaagccaaaguaagcuuucuuccuggccuaaaccacauaaccuaacaccuguuagaaaaaugggcuggggcaaugagcugugaccaccggugauucaaaggaaucacuaaacucuccccaccaguuucacagaacugcauuggaaaaugacuuuuaccaagauucuuaauaaaaucaacaucuuugccuguuucauacauuauuagauuuuauggcaugcauuucagaacucuaauaccuuaacucugucuacaagugaggugggauucccgaaggaccaccaucccaccucugaaaauauuuucauuacccaagucagaggaagugaagaaaugaaagcuuccugaaucuggccagcuaaauagcuugauucaaguguguuauguuuucauuauuuacauuucccuuggaauuugagggcugucuucaaauuuugugacaccuguauuuuuuucaccuacuucuguucagugauuuccuggaagaaggaagaacacggcugaaaugaacaaucaacgaacacugauuuaaucuauaccacauuuaccuccaauuagguaaaucauggaucacuguuuaaaaauauuuuuacaaggccauuggauaaaaacaaguauuagguaucagucagugcucugauuugggaagagccauuuacggucucuaagcuuaugucaucucaucuguagaaugaaagugacugauuccccacauggcuuccaacuccaagaacuucuggaaugcuguacugacacucauacagagcugauuugggguuaauuauuguuuuucauuucugcuuccuuuucuugauggauuuuaucaaaaagugaaccauuuuaaaaagcaauuacuggacauuuuuuaagaacugcaggggagcuggagauaguugcaagagggagaccuauuagguuuccuuuuucuuuuacuaccacuuaacuuuuuccuccaagccucuugccucacaauaaacauaaaaacagaugacccuaucacuccagacuguccuucauaauggcaacaacaacaauaauacaagcuuuuaauuuuugaacucccacuguacggcagaccuuuaucucauuauuggaaggaguauaaaguaaggcaugaaaccacuggcucugacauacuguaugaucccauuuauguaaaauguccagaauagacaaauccacagacacagagcaaagaaaauuagugguugccagggacauuaagcauaggagaaugagggugacuucuuaaccagcacagggcuuucuuuugggaagacgaaaauguucuggaacuauuaauagacaggaguaguuaugauuguaugaccuugggaauacacuaaaaaagccacugaauugcauacuguuaaaaggugaauuuuuuugguaugugaauuauaucuacuaaaaagauaaaauuuaaaaaaauaaaacacacauccauggcucuggauggagauuguccagguucaaaucccagcccuaccgcuucucagcuuuucuaagccuaaguuucuacauguauaaaaugggagaaaugacaaauaccucacaaggaaauuagaggacuaaauaaugcuacgacuuuuagguacaaaggccaauuuauagcguguuuuaaaaauauucuuacgagacccuugaauaaaacaauauuagauaccaaccaguucuuugauuugagaagagccacuccuggucucuaagcuuaagucauuuugucugcagaaugaaggggacugguucccuacaugagcaucccauaaauuuuccuauucuuauguaauccccacaauaguucuauaaaauacguagaacauuacugauuuuagagaugaagaaacaucaguaaagggcaaggaaguugcugagccacuaaguggcagaggugagauucgagaaaugucagaauggaaccucacacucuugagugacacaccacugccuccugacccacauauuaauaacccagcauauguacgaacugcuuacugacuucuuacuauguugcagaaacucagggacagugcccucaagaaagucauuaccuggccacuugcaguggcucaugccuguaaucgcaguacuuugggaggcuaaggugggcagauuacuugaggcaaggaguuugagaccagccugggcaacauggugaaacccugccucuaccaaaaguacaaaaauuagccaggugugguggugagcaucugcaaucccagcuacuugggaggcugaggcaggagaaucacuugaaccagggaggcggagguugcagugagcugagcuccugccacuguacuccagccugagcaacaaagugagugagacaucaucaaaaagaaaaaaaaaaaaagaaaaagaaaagaaaagaaagaaagaaaagaaagcaagccauuacccaagaugggagaagaacaacagugcccagggauuaaggaaauuaaggaacagguguacacaguaaaaguauaaaaguagauauuuuuaccauauaauucagaaccuucugucuuuagaaggggacuuuccuaucagggaaaauccagaguaacugggcugagaaaaaacauuauguagaugaacuuuugagaguuucuaagaaaauaauuaagagacugagugcuguggcucacacuuacguauaaucccagcacuuugguaggccaaggugagaggaucauggccaggcauugaagacuggccugggaaauaaagcaaguccauaucucuaaaaggacuuuuuuaaaguuagccaggcauggugaugcacgccuauaaucccagcuucucaagaggcuguggcaggaggacagcuugagcccaagacuuugaggcugcagugagcuaugauugugccacugcacuccagccuggccaacagcacaagacccuaucucuaaaaaagauaacaagaauuaaguguaaucggccacucaccucuaugccaaauaccauauuuuacuuaagauuucaaaucucguuguucaauaccguggccacuagccacauguagcuaaauuuaaauauauuaaaauugaauaacguuaaaauuuugguuccucaguucacaccaccacauuucuaguucacaagagccacacgcggccacuggcugccauaaugaacagaccagauaaaagagcaugucuuucaaugcagaaaguuuuaagggacagcacuaaucuaaauauaaaaucacaucauucacagucaaauaauaagagaaaaugcaacauuuuauuucauauccuaaaaagagauuugguauccaagugaauaccuggaacuacuauaaaugcucaccuaaguuguaagaugacauuauaauuucuuaucuacacuuuaaaaauaacauuaucugaucauauugcucugguguaaagauuuuccagaaaaaaaaucacuuuccgagacuccuuauuuuuaaaaaucgcagauagcauaggcaaacagauaaugaacauguaagcucacugcaucucaguuuugaaauggauucaauucacuggucuugaaaagaaaaguucaggacauuggggaaaacucaguugcucuggucucugaguuaauagccuuaugaguagaaugccuuuuuguccaaagaauucucaaaauaguauuauuuuuguuuauuuguguuuuugagauugaaucucacucugucugcucaggauggauugcaguggcaugaucuuggcugacuaugaccuccccauccuggguucaagcaauucuccugccugagccuccuaaguagcugggauuacagccauaaaccaccacgucuggcuaauuuuuguauuuuuaguagauacgaaguuucgccauguuggccaggcuggucuugaacuuuuggccucaagugaucugcccuccuugaccucccaaagugauuacaggcgugagccaccacuccuggccuuaaaauauuucaauaaccauucuaaugugagcagacaugguaguggcaacaacucggaaauaaaauaaucuuaugagguuuggucaaauacgccaauaaagcuccucugccaucuugccucugagccaugcucauauuugugaaaugggaggaaaaauuuuucuccuucuuugcagauauauuauucuccuucuuugcagauauauauguguguauauauguguguauauguacacauacacauacacagaagcgcacacauauccaauagaaguugguaucuaucauccaguacuucaguuuuuaaguauaacugacacacauauacauauaaauucaauuaauuauuuuacagucugaacacuuucauguaaccaacgcccagauccagaaauacaguauuaccaacaccucagagucuaccugccgcagccuuccagguacccucaaggguaaccaacaaccugacuucuagcaccacuggugaacuuugacaguuuccacaucuuacauauguggcacucuuuugugucuagcuuuuaucacugaacaagacaccaucuaguuuugacagaucuucgccacaaggcagccauuuaaugcuuuccugccuuauagaauaacuaauccuuauugagcacauauuaugugucaagugcuuuacgugccuugacuccuuuaauucccccaaacaagcuuaucaguaaaguauuauuauuaucccuauuaaauagaugagcacauugauguguaaaauuggcuaggcuauaguucccacuuauucaguuacauacuaaucuagguauuccugugaaaggauuuuacagauguaauucaagucucuaaucauuugacuuuaaguuagggagauuauccuggguggaccugauuuaaucaacugaaggccuuaaccauagggcugaggcuuccaggagacagggagcauaaaauaaggagggaagggggcauuuuucuggagcagauaaccaugagcaacaaucauccauuaacuuauacaugccaauaacagaugucacaccaacucaaagacaaggcucuucaguucauucuugaauaggaacuuguaguagaaaugguaugugccacauuauuuuucaagccagcccugaugucauuuguucaugcacacugucccuguaagaacacucucauuuuucaaguccugcaucauauuucaaguugggaaaaauaaggucacucuacacaugguagggugauggagguguuuuuggacagccagacuuuucagauuuacucaucuuuaaaagcaaucucagugaaaggcuucucuugaguggaucuaaauagaucucaaguaaaccuaggagauuuuuuaagaacaggagcaauuucuuccauuaucuuaucccccuuaacauauaucauugagcaggacugaagggaagucuugguaaguacagaugcauguuaucauuugucuccucuuuuucuauugaaggcugauuuuaaggauuuuccauuuucagaggugaaauuaaauggaauccuuaguuuucccuuccaacccucaagacuuccuccucaagucuucuccaucucaauuauuagcgucccacauucgcuggguuuccugggccagacucaguagugaucagcaagucaguucugccuccaggcauaucccaaagcuaaaaucuuaucuccaucuccaucuccaguauaagcacccuuguucugaccauucuguuugcuaaacacagacaaggagaccugagugaucuccuggcuuccacuccugccccucuaaagccaugucauauacaacagagagcucauuuuaaagcugcaaauguaguaauaucacucuccugcguacaacuccaaaugagacuggauaugugaugacacuaaggaaauacugucaacuuuuagaagugauaaugauacuauggcuauaguuuuuaaaagaguucugauguucuagagaucuauggugacaaaugacagcaugccuccuucaaauaacacugugcagugguggugacugggaaggggugcagcuggagagaagggauagguaaaauaagauagaccaugagcugauaauuauugaaacucggcaauggguacauugggagucacuauacuuuucuauuuucauaucuuauaacauuuuuauaauaaaaaacuauuaaauccccaaugacuccugacugcacuuagagaguaaaaucuuaagaacuuguauggcucaaaagguauuuaaugaucugacugaugccuggcaauccaugauuuuauccaguacccagcuuuguccauuaacugccaaacagcuguaacagccaucccgugccuuccagcccuuugccaccauaggaccuucagacaggcucuuuucagccuuagagggcuccuccccaagaugugccagaugugcccaguguugggcuccuucuccuucagguguccacuccaacaaacuccucagagagggccuccuccaccaugcuaccuaaagcaccuucccuccccgcucuccuccugcccaccccucugcacccuuaccacucuaccuauuuucuuucauuauuucuucauaauccuuaucacuuuuugaaaucaucuuuucucuuaaguccuuuugaaaaauaagcugauauaguuuggcuguguccccacucaaaacucaucuugaauuguagcucccauaauucccaugugucaugggagggacccgguggcagguaauugaaucaugggggcaggucuuucccaugcuguucuugugauagugaguaagucccacaggaucugaugguuuuaugaaggggagucccccuguacaugcccccuguacuuacaucuugccugccgccauguaagaugugccuuugcuccuuuaucuucugccaugagugugaggccuccccaaccacguggaacugugaauccauuaaaccuccuuccuuuacaaauuacgucucagguacaucuuuauuagcagcaugagaacagauuaacagacaagucacuuauuaucaauauacuccccauacuagaauacaugcucugagaucauugggaccuugucuguccaguucacuugcaugcuuccagugccuaugauagugccuagcauaaaaguaggauuccaaugaugacacauuacacaaauccuuuaaaucagaccagacaauuaaagcuguguacauagcacagggacaacaaaaaauaauaauaauuaaugccuuggaaagugaaauuauccuuacauguauauaucuguaguauuaaugaauaguuaacacuaacggauuucauuugaauuaaacauaugucaacauaaugaauaacuacuuacacauauuaacacaauuaaugaauaauuaauaccugugaguuuucucugaauugcauucaauauauccauacacaauacaugcacauacacauauagucuuuauuucauuauucugauaccgaauauauaacaccauuguuggcuuauauguaaggaauaugacaguuuaugauugcuauaucucgagcaggagauuuugcuaaauguauuguugccagagcuuagauuuuaaaauucauuucuaagucuuagcugguguuaaaccaugucagcauaauaagcaaguuuugauuuccuuucagauguuccuggcugcugaaagaauugauuuugaagauuuucccauugaccuauagggcugugaagaagagauagcucuucuuaaucucaaagauccaaacugaguuuacauuccccagccuuuguuuggaugucaccuucagagcuugcuucauuaugugucucaggagaaacacagaaguauuagugauaggacacugacugguagacuuuaauccuucuuugagauguuguuuaauaaugaugguuuaguaucacauucgaggauaacuguaguuaguuaauauuuuuacuuuuaauauaccuacuuucccaaguacaaauuuauccuggggcuacguaggugacccaagugcaucaggagcaguuucgaacaagguguaacuucucaacguuacauggaauaagagagagauucaaaaaucacauccaaacucaaacaucauuucaaagguccuuucccaucuuccucuccccaaaaacaacuaaaacauggcauauugcaucuuucaaccauggucaaaauccuucucuguuaaguagauucuauguauuuuuaaauaucuaugcuuuuguuuguuguuuuuuuuuuuuuugagacagagucucacucucucacccaggcucgagugcaauggcguggucucggcucacugcaaccuccgccuccuggguucaaaugauucuucugccucaaccuccugaguagcugggauuacaggcacccauaaccaagcccagcuaauuucuguauuuuuuaguagaggcaggguuucaccgugauggccaggcuggucucgaacuccugaccucgugaucugcuggccucagcccccaaagugcuaggauuacaggcgugagccaccgugcccggccauaucuaugcuuuuaaguauuguuuuccuucucagacguuugagaaacucaagaaggaaacauuguauacagacucagacuuaaccucaaugugaacauacacagcaacaucauugacagucuacaguuacaugaucucaauggcaagugugguccacugugaugucaauuuuauaaagggaagcuugaaaaacaucacaacagaaagaaagcugucaugcuugcuuugauuaaagaggauguaguauguuucauaaacagguuaguucucacaggaagguucaauaaauggaagcaaaaagcaaaaacucacaauggagauccucccaguguuugaauuuuaaaaaauaaaggucaguuuaucacuagagcguucaauuggcuccaggguucauaggguauuguuagacuagagcuccuuuugcuaaaaaacccagaggacuucuuguauuuugcuucuagcuaucugggucugcuuuuaauuccucagacauacucuucugcugcacguaguucucacaccucaagacccaugaguuugcugucugcccaaaugcaucuucucuaucuuucaacauccaaguugaaugcaacuucuuucagaaagccuuccauuuccaugacuaguaccucauuuucaaaucaauuccauuguucuaagugguuugaccuugcuggguucaugcuuuaauuccucugauuguaacaauaaaaaguaauuuacuuucuauguguuugccacacauacuagaugaggcccuugaggacaaagauagcaucucauuugggucuguguccccagagacuuccuccucagaaaauguugaaugaaagaaucaaauaaauaaaggaaugaugaaugaagcaagccaacagcacccuucaacucucaguuugcuucaaauccccacuacuacccuuccauucuauccccaguagaauuuuucuauucucuuuucagucuuaaacacuguuaaaauuucaagguaagcaucacugaaaacugaagugcuguggcacaauggguuuuucuaaugaauuauuuaucuguaagcaguaguucauauucacauauuuuuuagagaccaguugccuuucuuugugaauggauauguucauguauccaucuauuagaugcuauugucuuguuuugcaaggcaauugaguguuuuauuuccuuuuuuuuacuuauacaguaauauuugaaaauauucucacuguaaaaaauucaaaccauauagaaaaauauaaaaacucccuuaucacuccuuuuaauccacuuuccuccccaaaagcaaucuuuauuaucaguuucagaucuuuuucuaugcauuuagcuacauaugcacauauacaagcuuuguguuuggguaggagucucaugcauauguagaaucauaagguuuuauaaacuucucccuucaauuaaccauguaucucagagauagauagucccagauaaggaacauaccucauccacuuuaaguacuagcauuccacacuuuggauauaccaacauuuauucaucauucccauggugacuaaaauauauugauacuccauuuucacucuuacaaauccuagaucauauuucuuuaugaaaaagcaccaagaguuuucaaaaauagaauuacuagguugaaggguaugcacagacuggcuucccagaguauggaacuguuuauuucuccauauccuuaaaaauugugaauauuaacagguuuuguuuuuccauuuuuuuuuuuuuuuuuuugguuaaucugaugauagcaccuauuuccuacaugaccuaaaccaguugagaaaugcccauauuuacaccuaccaugguguguugcgacuggaacagguucaagugaaauauaccaagugacugcuaacagccuccuaccuaacuccuuucagcuuacaucccaguaacauaaacagggauccacacugaauucacguuuaauuaucagaagacagggaccuugaugagugucuucacauaaacuaucuuguuuaauccucuuagaauccugugaaauagaaacuuuuauuccuguuuuauguuugaccacagugaggcaggccacccaagaucacaagauuguacuugauuccacaaagcgcuccacugaccccaaauuaagaaacugccccauacuugcauucgguuugcaguuuuccacuguuauugcuucuuggugccuaauguaacuacccacauaaaaacugaagaugucucuaccuauuauuuuaggaaaagcucuggcuuugaaaauacugaauuuuucugggagaagcagcugguuagaggcagguagaaauuaagaauuugugggccgggcaugguggcuuaugccuauaaucccaguacuuugggaggccgaggcggguggaucaccugaggucaggaguaugagaguagccuggccaacauggugaaacuccaucucuacuaaaaauaauaauaauaaaaaaaaucagccaggaauggugguacaugccuguaaccucagauacuugggaggcugaggcaggaaaaucgcuugagccuuggaggcggagguggcagugagccgagauuguaccacugcacuccagccuggcaccaagcgagacuccgucucaaaaaaaaaaaaaaaaaagaauuuguguaucagcaacaaauacaaacuuuauuggacacucccucccuuucuuaaugaguuccucagguuuuuuccagaacuaaaccaagucaugaaaugucagauaauaaagcccuuaaguauuaauguacaguauaggugaauggcuacuguacuuacucuaucuuagcgauauuuaauaauauuaaauguuuuaaaacuauccuaucuaagaaugaaauaaaagaaagccaugguuuuauuaucuuaagaaauuuauaccacucaacuagcuguacuaagcaaaaaaaaaaaaaaaaagucacagcaccauggaaaaugaacacaaaagaugcuuucuaaaaugcugaaaagcauaaaauaaaagauuaaaacauuucacuaugcauauguuaugcuggaaccuugaagcuaucgccuacaugagaaugguacuuuaaagauuacugaauauguuuucugaaaguauagaaugaucgauucauuuuucaaacccuuaguguaguugcacucuuccuuucccugacagaugacaaggcucagggaaagcaaagaucagagcugaggaacaacaaaaaaaguuggcaccugauucacuuccccuucaugccaacccuguuuuucucccuuaucauacaacaaagcaaaaagaaaaguauugaauaugaaaaccaaaaagauuccccaugacugagcuuuggcaaguacaaaugcauuaggaauggagcugauuccugugaccuuuucaauuaugauaauccugcaaagaaaauuaaaaucauuuucuaaaacaugguccaaggaguuccauagauaauugaagaaaauauuuaggaacaucccuggcauuuuucuaagaauguauauacuuagcccaggucuguugcacacugcagccauuucagccaugaguauuugugagcaaaaggucaaauuaacuugagagauauuuuugcaaagccuacuuccagaguuuuugcccuucauuuuuucuuuuguauauauuuacauuuugaaaugggaagacugaaaaagagggaagcuauauacuuguuucugcuuuggucugaaaauuugguaguugaauguacuucuuuuugaaagcaucuuuuuggcugggaggagaggcucaugucuguagucccacuaacuugauuuggaaggcuaaggugggaggauugggugagcccaggaauuugagagcacccugggcaacauagggggaccccagucuuuuaaaaaauaaaaaacuuggcugggcaugguggcacauaccuguagucccagcuacucagggggcuaaggcaggaguguggcuuaugcccaggagcucaaggcugcagugaaccauggucauagcacugcauuacagccuaggcaacagaccacaacucaaaaagcaaacaaaaaacagaaucuuuuuguuuugggcaugaaaaauaagugaagaggcuuuagaguuccuaggaucuccacuggauuucuaacaagcaaaaguuucccuaaagcauggaaaaacacacagauuuaacuauauuuaaaguaaaaugauccacaaagcucauccuugcccaauucucauuuaaugaauaagaagacuaaauacuucagaaaaucaaagacuaccuuacuaauagacuuagauaaauggauuucaguuuagacccaagaagggaagucaaaucuauagauacagcaucuaagaaguugagaccuugguucucuauucuacucucccuauuauuggccuuaugaccacaaguuggucaguucgccucccuaagccucaguuucucacagggaaaauaggaauauuagcaaaugacagagcaaauucacaggacugcuaucauaggauuaaauaaaacaacacaaaaaacuguaaaaauuauauaauacaauguaaacaagcaaauggcauaauaauuauuuguccuuguucaccaaguuagguuuucaauaucaauaugcaucucccuaccacagcaggacagagacagcuacaguuacuggaaacuauaaaauggguuccagucaacaaaagccauuggacugcuuucugauucuucuaauagaaaaucagagcauuaguaggagagaauggggaaaaaaaggcuuugcuucaaauuuauauuucuguuccugauaccuauuaagagccaguuauguagcuauuaagcuacagcuugcaauuuaaaauaaauaaacugauaacaaaacccuuaaauuuccaucaucagagcagaucaaacuacaacauaugcuaccgaggaugcaaagcagcuaaugaagacuucaauaucaggauuaugacccuuaauuucaauaggaauguguucuguuguuugagcucacacauaacgagaaaaaacaucacggaagcacaaauaaacugucucauuaaaaagcacuuugccuugguccaaauauaauuucguuuuuauacaauucaaaugcuauagaacaaagaaagagaaggaagagggaugauaaaugcagaggacuugggagggaagccuguucugcaauaauugagauggaaaggaggguucaaccugcacuccuuuguuuguggagacaaaguccucaacagcuggcagauagcaggaaguagaaugcugauggcuuugcaguuagcuucaaaaccuauuagcaacccucagauccaagagcuguaccugcuuugaaauaaaccaggaaauagggaauaaaucauuucuucuggagggaaaaaaauuguuuaaagugauuaaaacaugccacagguuucucacacaggaggaauuaaggaaacuauuucagaacuuaaugggaccuguuaaaaaaaacagauuuguaagaauuuaaaaguaaauauuucuuuaugcaaacuuaucauagugaguaucuuuuaaauacuaaagcuagggaugcacuugcaacaguuuuuaggaaacggggguggaauggggaaucacuucacugaagaaguuuaaagacauauuuauuccucuguggauuccauuucuuaaaagacugcccugaaacuucuuccuaaauucugucauaauucccuaagacaguaccaagggaauuaucauucuuuauuagaugccaaagaaacauaacaaggaucacaaaugaaacaccagaaaauuuaucaaauaagauuggauguacagacccauucuaaagagcauuccuucucccccauguuuuaagucaaauuuauauuaaaaaucuugaauuuucuaggaauuuuaaguacuguccccuaauuuuccauuaauaagcacgcucaugaguaugaaaaaaauauuuauuuacaugcauuuauuauaaugggccaagaaaauauuucuauguaaagguacuaucuuccuauuaaucuguaguuuuuuugcuuuuuuuguaaggguugaaagaaagagaaaagcaacagauugcagguggggauagaggcaaagagagauaaacgguagagaaaccaguucugaaaugucagggaauugccuggagagaguuaaauauacuguuucugcggacccauucccagauagguaccgccuauuccuacauaugaagagagaagagaugaguuauauucaugacuaguaggaguuaguuuaucuugcuucuguuuuuuaauuuuacucuaagacaaagggacugcuauaaaagaggaagaaguggagcuuacucuaauuacucuuuauuauucucuugaucaucaucaccucuaguaauuuuguaauucauuacaguaauuuaucuaaguuuccaaggauuuuaauauguucuuuagcuccuagguagagaaaaauugugguaacaaucaaaugacuaaucacaauuauugguuaggaaaaugaaaaucacaaugcaaucauuauaaaaacaggguguguauguaauuacacuaaaacuucauugauuuaggccauuauuaauauuugguaacaacuaaaaauauguauuaucuuucacguuuuauuucuucccagcuucuccaguaugaauaagaauguauacaagaggauguuaaugaaaacaaucuuacagcaucacaugguauuaaauagauuuuuaucuguagcuguauauuucaaauaaaauugauauuuugcuuauuuucagaggaaauuuguuuaaaauccuauaauauuucauguuggcuucaaacucuauauauuucaccccaaaccguuucucaguacauacuuacauccuuuuuucauuaacauguucacaaaacccauuuggguccuuauuuuucugcaaaguacauauuauuuccaggcauguucuauauucguguguauguauguuugcuucuccccaauccacauaaucuucaugagauaaauuauauugccuucuucacuacuaucuguagcuucaacacuuagaacaaugccuugcagagagcagguacuugaggcaaaguugacugcuuagauaacuccaauaccucuucaccucuucccaucaguaacuauauuauuuauuuuuagcugagcacagggauccccgaaauaaagaccacaucuucuaauuucaaguugacugcuuuugccccuucuucucucuuucauucuuucuauugguuagaagauggucauaauggcugaaaacucuauuagacagcacugcuuucaguccuucuuccucauacaaacacauauguucauauauauauauuuauauaaacacauacacauaugugaacaucuccccaagcuucuccaucuccuugcuuuuugucagcauauuaacacaccaggagaaguagauguuagucuaaucuccaagccacuaggucuuuacuugaauugauaggcacauuuucaagugaaccacaauggccuugaaucagcguucucauuuuaucagugugaugucaauauucaguccaaaacuaaaaaaaaaaaaaaaauuagauuugggccacucauauuuaacacugaauaugaagcaaauggauuguucgccuuugggaggguggucuaugauuaaacagaaauacaggguuaccucuaagcagcuucauuuugcucacuuggauaacuaucugguuaagugguauucacagaugggaaaagaguuaacacucaaugaaugcuauguugucauuaauucaacaacugaacaaaagggacaagauccccacacucauaaagcuaacauucuaguggggcaaacaaagaaacaaauaacaucaacaaaccacacucaauugguuucuucagagaauguaacacuacugacaaauuaguauugucaagaacuacuggccauggagaggcgauggggagagcuugaccugugccugcauacacucuagggacugagcuuaaaaucuugacuuuaagcucaacaaauggcuacaucuuuugaccaaauuccaucaugcuuuaagcuccacgguuuaagccccugaaguccuuuagaagauagaggcaacggcucuuauuuaaucuauagacaccaguucaacagcagaaacuauuaucuugaacaggguaacaccuacaaccgugaggaaugauaaccaccuucuuaaacguugaagauauaaucuguacgacaguggcaggugaugcuuuacauuguuuuauaauauuaucccaccacccaguucuaaaauaaacuuuaacuuuuuuguuuuuuaaagccaggaaaggagauaaagaaucaaugaaaggucaacacagaacagacagaaaguaccagaugugcucucuaaauuauguucuguaagagucagcagggagaacagaaauaauuuauuucaggaauccugacguuaccaucauguacacucgguuaaaugguuuguauagcugaaaaacucagacaggucuuacaccauucuccuuuacuucuaccacuuagagaaauucaaucaaaggcugagguuaaagauaccaguucccaucaagccaguauauauauuaaaaguggcuuuucugaucacagcaauucucaggcaguuuagguguagugauaaaccuaaaaauauaaucugacaaauuuucaacuguucauucuaauguucaauacuucaguuauuauacuucauauuuucccuauaaaugucaaggaaagggaauugucuauaggauacacacauaccuauauacacauaaauguauggggggagggauggaauuuccauuaaauaaagagagaaggauaaaaggucacacaauugucacuuucuaaaaauaauuucccaggaucuauaauuucucagagcuguaguaaauuagucacuuaaacuuauuaaaaccaaaaauuuaaggaauaccucugaauauaacucagaauaauguaacaagauaaucaugagccuuuacaagauuucauguugauuaacaguaaauagcuuuuuuacugacugauuucugcuuccaaaugacaccgccuaaacaaacuuuguugccacagaagccacaaaauuguaaggcaaugaauuucugaauuggggccucaaugagaaguuugauuuuuaggaucuugaguguucugaauugugcucaacaguauuuaccacacguguugcuuguuuaugagacagagacuacaaacaucuugaaugggacuuuuauuuaaaauucuagauguuucacauuuauauuuuaaagcaaaagaucuuacauuugaucagcguggcuuuuaauuuuaguuaugauuauuuaaaaauaugcuaagauauuccugacaucucaaaagaacaaauuauuacugucugucaaugcauuuuuagaaaaacuguaucauaaaaaauguauagcuucauauaauuaaaacauucagguagugugcauugacuaaaguaauauggacuauuaaguaauucaaaauuguguuuagcggcagcagcuguuuaauuaaaagguaaaaacugcaacuaauccacuaugguugacagaaauacagccuauaucagcagucagauccccuaggauagagaauauggauaugaauucaagaagucaugagcuucauuuaaugaauauaaugaaaauaaccacaauaaaucaguacugaaacauacuuuauaucuaaaauuaucuguauguuggcccacuuuuaauuuccuuguagcuaauaauuuugcauuucgauguagcaaaaaauccuuuaacauacauauugucaaccaucaaugcacacagcuuuuaucagagggcccauagcauaagcucaacuuauaaggaggcuagaaauguucuuagaaucagaugaucccuucaaaguucuaaacuucaggguucaauauucaaaguacucacucauaauuaccuucuaucauggagaaauacaaaauggccaauaagcucauaaaguuaaucaaccuuaccaacaagugacuaacugaacauuacaauuucauuacaaaauuauuuucaccuacgauauuaggggaaaaaccuuuuuguuaauugaaaaaagaaacuagugauguugaggaugauauagucauuuguaaagauaaucaagcaauauauaugauauucccagcccuugauccagaacuuccaauucuaguggaauuacacaagugggcaaaacuuuauguacaaaaauauuuauugcagaaauguuuuuaauaucaggaaaauguuuaaaaauauaaaucaauauuggcaacugauccagaaacuaugguaagcauacagugaacaauuaucugggcauuaacaagaacuggaaaaaaacuaucuguauguacauuuuaugugacaaaaccaaaacaagccauuggacaauaaaugcagaauaaauucauuuuuauacaaugaauaauuguaaaaucaaaagauauaaaaaaaauuuucuuaaauuugccuaugcuuauguuaaaguaaacuguuuaauucccuucauaauuuucugcuuaaaaaaugcuuauuuuuauauuguuuacccuggcugugcuuuaggaaauagaucagaaguauggaaugaggcagaccaguaaagaggcauugcaguaauacaggcaaaugagguagaaauggaaauguagagaaaaacaaaauuauaaauggcaaauaaaugaauucuuuuuagaacaguuauacuaaaauaaaaagucuaccuccagcaaauauauauagagaguuaucuuugaaggaggaaaaccaaaucauuucaacaguguucuuuuauuuccaggaggggaaaaauguccuauuaaaauggcagaagagaaaaggggaaggaaggggaagggucucucuuuuacuuuacaaacuagaaacaaacaguucacagguuucuuaacauucguaucaaaugucccguggauuuuauuugcaaauuaugaggccagcaaagcagaaaaugggagucuuuaauuaggaagaacagguggcugagaggcacaaggugaguauuagccacaucucugccuggugccaaaaaacacagauccgaccugcagaacaaauuuuaagggugagagcguaacugucuccaguuggaguggagcuugaguggagcucaagcucuguauucagcuuuucugaauuauauuuacuccuauuuaaagugaaaugguuugcucuucagcuuugguuggaauuuaccaauuacaaauuauugaccuucuucauauugacauucuccacacagucuacaauccucucugcugcaguugaagcaaauucuugaccugccaaauguuccuguuucucuuacuggguuuucaaaaugauucuccuaaacagcugauuacguauuuuaaguuagaaugacaauauagggcuuauaaaaguggaacacagaggauuuucagugcauugaaacuauucuguaugauacucuaaugguagauuacaugcaaguaacuauuuguccaaacucaucgaacauacaucacuaagagugaacccuaauagaaacuauggacuuugggugucaaugaugugucagcucaucaacuguaacaaaugugacacucugauagggaauauugauaaguauauguggaaggggagggaguauucgggaugacucuguaccuucugcuaaauuuugcuauaaaccuaaaacuguucuaccaaguaaggcuauuaagaagugcucagagcuggguaugguggugugcaccuguaauccuagcuacuugggaaucugaggcaggaggaucacuugugcccugaaguuuaaggccagccugggcaaauaucacaagaccuugcaucagaaagaagaagaaagaagaaagaagauagaagacagaagaagaaagaaagaagaaggaagaagaugaugaagaugaagaugaagaugaagaagaagaagaaaagaaacuuaaaaaccacuuauacauagauacauauuuuuuaaagcuuuucugucauuaaauguuuuggguuuacaaaauuaaacauuuggcauucuugcucaaaaacagcaguaaucuuaucuuaaaguucauaauaaucauauacgcccagccucuggcucucaacuuaugagucucacauuuaggcaaauuuuuaugaauugaaccaauggcauuucauaguaacguaaguucauguccaagugccacagcuugccacuugcuugauuuuaggcaauuuucauaacaucuuaugccucaguuuccucaucucuaaaaugagagaaauucacauaucuacuucacugaguugugacaauuaaaugaaagaaugcaguuaggagcucagugaagggcuuagcacacaguaaagacuuaagaaauguuaacucuuuuuguuaugacuaacuacaacuuaauguaaaagggaacuacaaguaauuuuuuaaaucgauaagcacauggagccuucgaggagaaaacaugacaccuucaaaaaugaauaugcaagguuuggaauucguuacuucagaguagaauuuuaccagguuagaggaaugacuuauaaccauaucuaaaaauugucauucuucagugcauugcucuucaucugcauuugaagcugccucguuauaaaaaagcuguaaaacguccucaaaguaacuuuaguucuucccccuaagaguucaaaauccacucccuagguuuauucuuugguacaaaaaccuucaaaagcugauuugcugaugauaacaaauuuguuuucagaaauaauauuccugaucugaggugauaaacaauucagaacuuucauaucauuggggaauuacauuuaagagaucaacuggggaucugugaaauaagaagcauuuaccuugcuagaggaaugcuagccugcauuuaauuguauaauauuuccccuucaggguguaugagacagcguguuggaaaauggaaugauucuuggcuuuauucagaaagagaacaaaggagagaaggcagguaaaggacacagcaccauggaaaugacauuucguuuccauuugaauucuaaaguacugaacuuuuaaaaucuucauuugaagaaacucugagaaauuugucaggagggaguaagaaaaaugauauagccuaccacuuaagauagggugccaaaaaacauuaacaauuguucaaccuaaaugguuaguauucagguugaaggguggcagaauaugccaccccuacauaugccacuuuagcauaaggauuauuuugagcuaaaggcacuuaaaaaacagcaggugcuagaagggcgcugugacucaccccuuuuucuucccgaaugcagggauaaaaccccaauacagaagauguccucuuuauaccagaaggaaagucacauuuuuaucaucaaggaugaaaaggugagaccuggagaaugcugcacaaagauaccaugugaaaauaauucuuaucuuccuuuagccugccuacagaguucacuuacuuuuccacaauugcaucuuuucagucaaucgaauauaaaagcaucuagguuuugccauuucuuuaugucuucauuuccuaaugagggcuccauaaaacuucuauuaaguauauuugcaugcuuuucuucuguuaaacuguuuuacaucaguuuaauucucaggcccagccaaaaaacucuaacaaggcagggguagaauuuuugccuuccucacaagguguucguuuuucuauucuugaaacuuuccguauguuucacaauuuuuauaaacaaaaguugggggaaugaacuauuacuaaaaaaucuggaagacaaaauucuguucucauuugacacaccgaguaucuauuuacacuuuucucggaaacagcgucuucuccuccuccacaaaacccaugugcucugagggaggcugacuccaucacuugggcuauaaggauaagccacagcucuggugaggacaacuggcaaaaucccaucacccuguucauuugauuggcucaggggaugagugagagaugaaaguuggaccaauaaggaugaaggauuuuuuuuucaacaguuaucagaagagccuuuccauuuuccuacaagacaugaauggacaaauuagaaaggcccagugccaggagugacauuagaaccaugaucugagagucuccuggagacugggcacaauaucaaggaaauacagccaagacacacacacacacacacacacacacacacacgggagaagggggaaggaaaaagagggagaguguauuaaucuguucucacacugcuaauaaagacauaccuaagacugggcaauuuauaaaggaaagagauuuaguggacucacaguuccacauggcugaggaggccucacacgcaugccaggugaaucaagagcaaagucacaccuuacauggcagcaggaaggagagccuguacagagaaacuccuguuuauaaaaccaucagaucuugugagacuuauucacuaccacaagaacaguauggggaaacugcccccacgauuuaauuaucuccaccugucccugcucuugacacauggagauuauugcuauucaaggugagaucuggguagggacauaaccaaaccauaucagagaaaaacguagagagaaaaaaggggaaagagaaaaaaaagagaaggaaagguagaggaagagaggccauacaugcacuagauaaagucgcaccuacagcugagcaagauaguuuccaauuauccuagccaauaaauucuauugucugcuuaagcuagaaugggucacauuuuuaguugcuuacuagugaaauuauccuaacaugcuaacaggcaagauaaaaauagucugagcaaugacuaaaggagcacauuuuuuaccucauauacugacaauucaagagcauuauugcaucauuugcugccaaauggagaggaaaguugguuccuaaggacccccucggccagaaaaguacaaaacaucuguugaagucaugggugacuuguuagcaaaguucagcagcaguaaagcuuccuaagaaacaggucuuuucucaccagcggguauugauauaauuagggucaauuacaauuuagaauuuccagggcauggggcugaauuacaguggcauuuaagagcucugcuaaauuuucccauucaucuugaagauuucuggaggaaccuguuguaauuaaguaaucuucuucuuuucauuuuuaugacaauuuucuucuucaggcuuugcaauuacccacuacuccaaaguaccuuccuuuagaagaagaauuaaaaaaaagaccaccugauuuucaaucgacaaugagacuugguuuugcugccugcuaagugauggauugugauguguacagcaaucucuaaauaagcugcuucaacaagauuuuuuaaacucccacugcccucaccaaacacagauaaucccaaaaacucauugucugagugggugaucaaaaacgaaagaggugacauuaugauugcugggcauccuuuacccacgugguuuguaaguagcccugggagaugugcaaacaaacucuauuacuuccuuguggguuuucacauaugcuucccccauacagauuuuaugaagacauaccuuuugagcuuuaugcaaucgaggggaaagagcuuucacuggauuaagcuauuccaauugcauuuaccuugggcaacaaaguaaaccauauccauaaaaaacagccagaggcuuuuaaguauuaggucaauagcacuugaguaucauauagucccaaaagaagcuguaacagaucauguugauuuuauggaaugccuuggcucucucuggggagggaguaguacauagggagugaggaacauuaugacaccuauuacuaucaaccacuguucagugauggcuuucuaugcaagcacccaaccacccugagaaaaaaguacuaacaucuucaauugcacaaaagaagagggaaaaauaauuacaguuaguugucuggucugugaucauccagcucaagugaaaaaacuaaaauuugaaaaccucaucuuuccaauuccaaaguuuauauuuaaaaauuguacuuccaguguugaaaaguaucuuugggaauaguuaugccaguuucugacucacaauaagauacacuccaugcauguuguguguguguaucuaaaaccauccuugacccaguacaggcacuucuaguuaaucuuucaacugaucuuauccuuguccagcgugugggccacugcucaugccauuucuucuacacagcauaccuuucuuuucccucccauuuccaccuauggaaaucuugcuuguaagucaaagcccugcugugaacuaacuaugugcaagacaugacaaacacagcagucagacagauguagccucuuuguuaucuauuccauaauaacacgaggcauguaauaguguuucacaguuuaugaagaccuuccaaugcacuuccagaauggccaaaauuccagcuaacucuggaaaacgcauuccaaagagaaccaacuagaauaaauggggaaaaauuuuaugucaugaguaccgaaugugugccaaguauuuccauauaugccuaacuuaaucauuggcuguaugacaaaauaugauugcaagcauauuaauguauuaauucaaaaauauuuuugcaacagcucuguuguuaaagguucuguguuagacacuugaugcaagcaacacaaagaugaaucagacgagaggaaauaaagucuacacaaguagacaaagaaaaacagugcuuuauauuggacauuaacaaacaaaaggaaccuguaaucccagaacuuugggaaaccaaagcgggaaaauugcuugagcccaggaguuuaagaccagccugggcaacauagcgaaaccccgucucuauaaaaaaauuuuaaaaauuuaaaaaauuuaaaaaauuagcagaucauaauggcaacugccuguagucccagcuacuagaaaggcuaggugggaggaucacuugagcauaggggggucaaggcugcacugcggcaugaucaugcuacugcacucuagccugggcgacagugaaacucugccucgaaaagaaaaaaauaaauaaauagaaggaaauaaacgugugcucaaaggguauuaugguaguagacaccuuuauuccagcagcuaguacuguacaugggaaagagcaaauaaugauuauuuaauaaacagauaauaaaaaaagacugggcugggcgcgguggcucaugccuguaaucccagcacuuugggaggccgaggccgguggaucacuaggucagaagaucgagaccauccuggcuaacaaggcgaaaccccuucucaacuuaaaaaaaaauacaaaaaaaaauuagccgggcgugguggcgggugccuguaguuccagcuacucgggaggcugaggcaggagaaugccgugaacccaggaggcagagcuugcagugagccgagauagcgccacugcacuccagccugggugacagagcgagacuccaucucaaaauaaauaaaugaauaaauaauaaaaaauaaaaacaaauaauaaaauaaaaaacacuguggccucaucgaguuucuacuguaguacaccauugaaagagcacagaacacugaaguauucauugcuacuuauauuuuuaaguuuuuauuuccauucuacacuccagugagcaaaucaaaaugccuacugccaaaaaaggcucauaauuaauacauuuuuacuuacaaugaaggcuaucauuaguauaucaccaauuaaugucagaaaaggaagaucugucaugauauucugaaucgacauuguaaaaaggagaaaauauauggauggaaaguauucuggcauguuucuaguuauuaagaacaacucugcugaacagcaauuugggaugaugugaaaugaaacaaaugauaucacucauuguauucagugugaugaucaguuggcaacaauuacaaaaauguaccaguaaggauauaauaucaaaugucuauagauagucaaaauugcaaauggcauggaaaaaacauaagagaaaaccaucacaccuuucucucuguuuugcagucaaugauuuucucauuuguauucuccuauacuguagacuucccaggacagagauuaccugagguucuucucuggaucucuagacaaagcccacuguccaauacuuaauauaugacuguuaacuauggaaacaaggaaggaaggaagucacaauuucauucugaaaacuaauccaccuucuuaucagccaauauguccuccuucaaggagcagcacuggaaaaacuaaugaaauaaaacaccaggacaaaacgugguauccuucuccagaaugcacaggaaauuucugaauauuaccaagaauuaaauauauuugauuguuauauagccucaaaugggccagcacuuacuugugaguuacuaaucuaaucucaacuauuucuuuucuuuacaacauuguauuucaaaauaacucaaaccuacaauugguugcaaguuaguacgaugaauaccugcaauacccuacuucaacuguuaagguuuuaucauaucugcuuucucucuuuuacacacacagacacacauauaggcacacacucagcaauaucaucaucauuuucccaauugcuucuuagggcacaaugguuuggguauucaagaaaacaagaauaaaagucauggcauccugcagaccaaagcaagaccuaacccuugugugagguauaaucaguaucuugagugaaaucauuucccuggagugaagaguucccagugcaaugaacagugagaacuacaaccggaaaaacagguagcaaagacccuaauaacuccauauuuuaucuaauaagaaaugaagugcugaagauuugugagugggcuuguaaccaaauaaaaugauuuuucccaauauaaauuagagauacuauaucaaacgcacagcagagacaagaaggugguggcaggaaaaucaggcaaguuuaaaacaccuagaguauuagcaaaaaaauacauaauauaacuggauuuguucuauuccucuaacaaaauauaacuaaaaggguuugaaaagucaucggccaacaauauuuaauauaacauacucaaaucacauauauuucaauuaauuagguuucuacaggaguaaugugguauuuggacuuggacauuaaaucaauacuggccuuacaguuacuucccauguucuucagcccuccauuacaauccacuccccuacccaaaaaucaauaccaaagccuuauaugagacagaaaggacaguaaucuuuaaguggaaauaggaaucuaaauuacaauuguaaaugucuaaagcuuguagucuggggauuuuccuaaugggaauauuugaugugacuuuuuguuauucuuaugguugugcucauaagcacaucacaaggaugguuuaaaggcccgagcaccauaaauuagauauucuuuaagaaaucauguucuugacauauuuuuucauuaucugagaagaaugaaacagauuuuuuuuguuaauuagugcuaaggcauguauuuugcauuagcauuaaguuuaccaaaauggcuuuaaaaacuugaacagauggcagaauuauaauaacuuuuccuuaugauuuagguuaagaauaaagugucaugagaauucuccuccuaccuaacuuuucuauaaaguuaaugcauuuaauagauauggcauguuuguuuuucucacugagguguaaacaacucuaucacaccucagaugaguauaaugagaugcgggaauacauuucaauacucucuaccuaggguaaagggauuuuccaggguuuaaacaucaaaccacgcagaaacaacuccaaaccuucgacaauaacugcacaggauggcacagggguugcaaagacagaugucuuuaggggccuggcagguacugaaaacgaguaaaguagacuugcucugaggauaauagggaguagugggaacugcagccagccggacagagcaagcaccacccggggcgacaaacccaacuucucaccaacugcuuucaggaauggaaugaaggcccugaguagcuggaaucacuuauuuuccaaaagccgccccaaaucuaacuuuccuaugugaaaugucccaauaaaaauuucgguggcuaguuuauauuuuuuuaaagaaaagauaaaauaaaaagaaaugaggacuaaagaaaacagucaguggccuccaggaggaaccaugagacauuagucugcagccuuagauggauaucuauaacugguguucauggaccugggagguggagguugcagugagccgagauugugccacugcacuccagccugggcaacagagcgagacuccaucucaaaaaacaaaaacaaaaaaaaacaaacaacaaacugguguucaugguuagugcuauggcuuauuucaugcccuguccuugagggggaucucagccccuaagugaaacacuugaaauuaguaaacugggucggcuugcaagccugauuuuugaaaagguauuauggugaaaccuggaaaccugcaugaauucuaauguggcccaccuuuauaccuaugugagaugaucuugagcucuguaaccuccauugaucuuaccaguggcucagcuagcucucauuuuauuugucuucuugacucucccuuaaauuccccaucgugccuauucccaauuuaugccucuuaaaagucauuaguaacugaaaugagcaaaguuuaagaacuggugccucuuccuggccuccauaugcuuuaauuucauugcagcauuggauaucucaucuucccaugucucuuaucaucaaccucaagcuccccaaauuuccuugcucucacuaaauuuacccauuuuucucaagccuuuuaagauuucuuagaauccagaacuguaagcaauaaauauuuguuguuucuaaaucacccaggcuaagguauuuuguuauagaagcaggaacugacugaggcaaaauguuaucuugcuuaauucagaagacagacccuaugguuacgccauuuuguagaugagcuaacuaaggcuaagagaggacagguaacuugccugagguuacacaacuaggcagaagccaaauccaaauaccagucaagcacuagccaccaggcucuccuuucucaucucccacuucuaaucaauugauaacuuugguagaucccaccuugguuuaguaccuugcauccacaccucugugccaucccagcaccaucauaauucuaaucauacauuucaguaugauuggucaggugcaauagucuccuaaucuccuuaauaucucuaguuucuuucucuucaacacaaauuuccacacucuaugaucuuacuaauauucagcucccaucauguucuucagaaaaagaaaaauguguggaaccuacgcaaugucuaggucuguucagugucuucaagguauuuuacaacucuguuacauuacagguaacuaauaguaaugcaaaauauuaagacaugcaaauuauuuccuguuugauacagguuuacuuugaccuccuuccuuccugccaccuggaggaagaaaacagcuuugccuccauuuucacacacauuucaauauuccuguuuuauaaacaugccuguuguuuggauuaucuuuuaaaccaguuauaucaucugcagcuucccuugugaauuaaauaaaaucuuuaacacagguucauuucuguaucugucugagaguuaugacuuaaccuauugcugaaaauguucuucuaacauguuuagcuccuaacagauccuugcucuaaaaccuucaauggacaccaguugccaaaugaauuaaauccagaaacguuacccuggaauucaaaacuaagaguaucaucuacucugucagucauauauuacacugcuuguccauucacauccugcauggacaauaaaagaaacuccgugggugccacacauuucacucucccaguuuucuuccucugcugaugcuacucuuucacccuggauuguggcuuuucauagaguguucaacauaauagcugcuguggaugcccuaacccaugcuucucaaacauuucacaguaguaacauggcauagggauuaacauuugcuucacugaaguaggggagcaggaggaggacaaggaagguggagguaaaguagacugcuacaagcagaaauuucuuugaugucucaugcuuuagcucaaaaauauaugcagauuaaaaaggaaugagaucauguccuuugcagugacauggaugaaacuagaggucacuauccuuagcaaacuaacucaggaacagaaaacugaauaccaaauguucucaccuguaagugggagcugaauuaugagaacaaauagacacauggcgggaacaaaacaaacuaaggccugucggagggucaacggggaggagagagaauauccggaagaagagcuaauggaugcugggcuuaauaccugggugauggguugaucugugcagaaaaccaccauggcacauguuuaccuauguaacaaaccugcaauccugcacauguaacccugaacuuaaaaguuggaaauuaaauacacacacacacacacacacacacacacacacacaccucugcagauuuuguacacacuccaucauauaucagcaggggcuuuugugaaaaauaauauugccaccuccaaauauuacaauaaaauuucccuuccuggcaggugacuagucugugguguuguacaucccaugaaacacucugugacaacguucaacuuuaccugagcccugugcucccagaaaaccagaauuaagaaaucuucaauccuuucuguaagaucccaucuccaucguuccucaggauucccuuguuuagcggccucucuaaaacuccaggcccacuuccucuucuucaaaauguucuaccauaauuaaugcucucccuguagcaguauccuaaauaaaaucaccuccuuaacuguccagugcauuauaucuuugacauauggcaucccuucuuugaaaaguccaugauuuuagauggugcuuccuaagauuauuacuuuaaaauauuaaauugugauaguaguauaggggaaaaauauauuuuccucacucaccacuaaguucauggcugaggcaccuauaacaaaagguagaucaacaaggaaaaagcauauaaaucuauugaaugaauuuuacgugacaugggagccuucauaggaaaaugaaacccucaaaauagggaagccugugucuuuuucuauguugguuugauggaaaaguggauaguaaugaaaaaguauuauuggaugaaaaaauaugaucuaaugguaauaagcugggagggacuuuggaaggccuguuugcuaaaucuucuuugugucccuguaucuucagagauaaggauguucccuuucuccagaucuguggaggguaccucuugaaugagggucuuaugagaaggggaaggggaaggggaagguaaaagagaucuuccugcuucugcuauguucucaaauaucaagaugccauauuuugaagucauguguccugaacccuauucaguuaaaaaaaaaaaaaagaccuaccuugaugugguuccgaaagauuuuuuucaccuguccccauuuaaaaugacuaccaaaguuauagccgucaaaacuacauaggaaucucugcagcaggccaggaauugcugagguagagaaauagaagaagugggcagagaccuuuccuaucacccuuaaaauaucugaaaacuaaaacuacuggaaauagacacuaguuuucauucaaucuuucuuucaacaaauguugcucagacauagcagaugagcggcuggguacuggcuauacaaucuguucaggggaaagcuauggaaucuugauuaaaacuuugaaauccaaaccacagauaagaugaaaaggaagaagaugaguaguggguguggagagaccuucaaagccggaaggcuacaaaacaucaaaacauucugaggacaggaugggaagaccuuaaguuauggcaacugcaaauaauaauggcuuacauuuguuuuaagggaguaucuuaaaauauucaggaacuaagcuuaguaauuuacauucaucaccuugcuaaauccuuagaguaacuccaggagcuaaguacuauuauuauccccacuuaacauaaaaagcaacacagccucagagagguuaauuaacuugcccagggacuugcagacaguaaguagcuaggcugcccaacucaaaaucauguuucaauaaugcaccccaagugcuguuaccauggguuuucuagaaaggguauccaauauaaauuggaauccagagugagguggagaaagaguaaagagugggucagauuuccuaugccaacucagggagugugaacuucacccuggcaaugggaugacaaggaaauaauucaagggagggaaagcaagaggcugggaccuagcaauggauaccccuguaccacugggccccuuccagagcaugaaaaugaaugagaauaggguagaauacaaccacaggcucaagugucucaauaaccacaaggucagaaaggauuugcuuuaaggcaauauuuaaacgccagugaacacucaggucugaauucugugcaucuaaccacuacaaguuagaagagaaaaaaauauuaguguucuuaaggaagaucuagcaaaaccauccuuccaguucuaagggccguagaggguguaggagguugguucacacuucaggguguaccaauuaaguaugaugacugcagcaaaauagugaguaacacagcuagauauuuaaaagccucaguuacuggauuccugccacugcaggaaacuucugucuugacuaaauuuaaaaaaaaaaaaaagaaaaaaauagugucaggagaaacaaaguguaaaauacagaacuuauuuuucuuccugccagguguaagcguuaaaacuuggcguauucacuauuguuuagaaguuugaaaacuuuuaacaaaacaauagaacacagaagugaaaaagugauuguuggggcuuuagacuuaacacaaagcuuuugcaaauaaaugccucuauaaccuuaaugaauucuaauaaaauauauuaugcuauuuuuuucuuguaucugucagagguguuugaaccagagcaacucuaucuugaauagcggcuggguaaaauaaggcugagaccuacugggcuguauuuccaggagguuaggcauucuaagucacagacgagauaggagguugacacaaggugcaaaucaccugauaaaacaagaugcagaugcguaaagaagcuggccaaaacccaucgaaaccaagauggugauaaaagugaccucugguuguccucaaugcucauuauaugauaauuacaaugcaucagugugcuaaaacacacucccaccagcgccaugacaguuuacaaaugccauggcaaagucuggaaguuacacuauauggucuaaaaagaggaggaacccaacccucagcuccgggaauugccaaccccauucccgggaaagucaugaauaauccaccccuuguucagcaucuaaucaagaaauaauuauaaguauuuucaguugagcagcccaaacugcuuuccaaauaaacuugcuuucacuuuacuuuuuggaauacaaaaguauuuuggaauaaaaaaaguacuuaucccuuuacuuuccuaauaaaguugauuucacuuuacucuuuggacucacucugaauucuuccuugcaugagguccaagaacccuuucuuaggcucuggauugguacccuucccaguaacauauccacgacaggugagaaaagaaaaacaaaagacauauauaucauauuacauccuaccuaagaugguaccaaucgcaaggaacguauuaauuucagagacggugaguauuagaaucaucaaaauacacuauaauuaucacauucaugaguccuguugauacauuuauuuuacugucuaaaauucaggaguuuaugguaagggagucuauuuguaagagacccuguugauuuucacaagucaagaaacaauaaacuucaagacauacuaaaaagaaaccagccugaugucagauccucuucaacauagaaacuauccucauaguaaauuaaauugaggaaauauuuaauggauaagcuugacuuuguaaacgugccuuccugaccaauagguacguuacugaugacguucaggacaccccacuuuggcacuggaggaaacagcagaagcaagaaggucucuuggaccuucuuccugcccuucuccucugaagcagacuauacaguaauucucugaccucugcaguacaucauuaagacucccauuucagagguucucucacuguaccuggagaaaaggaacaucucugucucucugaagacaaagggacacagaagaaucugaacaaacaggccuucccaagucagcccaguuuauuaccauuagaccauaaccuuuuauccuccuauaauauuucuccccuaccaucuacuuuaucaaacugaacauuaaaacauguacauuucccuaugucuuugggucuucauuuuggaaugauccugugucacauaaaacuuauguuaaauaaaguuguauguuuuucuccgguuaaucugucuuuugucauagugucucagucaugagucuagugacagaugaaaaaucuuuuguccccuacagcaucuaugaagauccaaagaaugucaaaguauaauuuuuaaaaaguuacaaacauugcuuuuagauaaauauaaagcaaacauaucaaaaugaauuucuuaaugagggaaccaguagcaugguguauucauacaaaaagaauuaaagaaucuaaguacaaauaggcccugacaaugucaaacuuuaccugagcccugugcuugcagaaaagugaugguuaacaaccaccccuacaaaccuuuugaaaauuaaaggcaaaacauccccacccuuuuugguucugggaaauggcugcugaagagaacuacccuuccccaaaugacuuagauaugacuauucuuacucuaucauaauuuucacaaaaugugcagaccaccccuuuuguuuaccuguaacaaggccagaaagagacccaacccuuuuuaccucuagccaauuucccacucuguggcucaggauugauuagcuaagauuagaacucuuuuuaccccuaaaacugcuagacgcugaaauaaacauuuccuguucagcuaacugacugaaauucccugacggcaaaacaaucccagcugugaaucucuuaccuaaagaguuaaccaaauaaacucuuuaugugguuagguacuuuauaugacuuaguacauauaaaguacaaagaaaaaaagauaaaaaaaaaagacuuggauuugaagaacaaagaacuuuaguucuuugaaaggcacaguuuaggaaauaaaaagccaagucacagacuagaagaacauauuuuuaaugcaaauacuuaauaaacgacuuauaucuagaauaaaaaauaacuaauaucucaguaagauagucaacccaauuaaaaaugagcaaaguacccaaaaugacaucguacaaaagaaaacauaauuacaggaaaaaaaugcuuaucauuagucauuagggaaaugcaaauuaaaacccaaaugagauacugcuacacagcuaaauagaauggcugaaauaaaaagacugacaauaucaaguguugacaaggauuggcagcaauuaagaacuuccaaauguugaugguagagugaaaacugauauaaccauuuuagaauaccacuggcaauuccuuguaaauuugacuuuaaauauagcaugugacucaguaauuccacuuguagguaugcauccaagaaaaaugcaaacauauucuccaauagacucaucuaugaaaaauuauagcuuucuucauaauagccauaaaguagacacaaccuaaauguccacuaucagaugacuuaacaaacuguaguauaaucaugcaacaauacuacucagcaaugaaaaggaaugaacuguugacacaugcaguaacaagaaggagaaaaggccccaggaacaaaaagauacaugcuacaugauuccauuuauacaaaauacuuaaaaagccaaaccuaaucuauagcaucacaaagcagaucaguggaugccugaggccaggggugguagagaggagguggaaugcaaaacuguggaagaaacuuauugauuugaugacaguauucuacaguaauccacaguguauguaaauuuuauguguguugcuguauauaaaugauaucaaaaaauuaaaacuaaagaaauaaagucuuuagcuuaaaugcaucuuucaacaaguucuucauuugcaaucuagcuuaucacauuagaauaauuggcagucuccuaggaaacuggucuggagaaagugaguguuuuuuuuuuuaaaugaaaagauuuuagauuuacguugagaauuuuaccaaucaucuuaaauauuuuuccuuugaaucuauuugaucuguucaaauuaaacuuguuauguccugaggugguuagcuaaggguaccaucaacaaaguauguggcaucagcuuccagugaauuccccaaagugggggagaaaaauauuagagauggauccaaagagaaagccuuucaccaaaaucuccauucagccuugcuuuucaucacuuaaauccuagaagaaaauguucucugaggaccacucuguauguaggaguagccugaugagcaaacauaauacuucucaaguauagacaugauaaagcagcaaagucaaaaccauggacagauucaagucauaaaaggauuuugaauacauuuagccaugcacucacugauaaagccuuccuaccaauaguucagcucauauuacauauaacaaggaccaguagcuagaaaagcuaaagcuuaaaaagaaaaaauuaucacaguggaaaauuaucauuagaaauacucaacuuaagaaaagacuugaaaaccucuucuguacacacagcacuuuaucacuauaaguuacugguucuauuaucuuauuuaauccuaauaacacuaacaauaauacauuaagagaguuaauagagaguuaauauaaaagcacaauagagcaaacacugcauauagagcauuuagaaguccuucgaaagccucugcuaggaauggcuucaaaacccagggaguugaauguggacucuccuuuucuccuuucuuuuauuucagugguucuugaauguucaaguacauaucaauauaucaaaaccauguacucauuaaugagccacuuaaggaaggaauuuuuaaggcaauugugaugaaaugcgacuuucaccucacuguuucucaaucuuuuuuucaucaucaucccugcaaggagcguuuucuaauugccccccugaaauuuuaauaccacagauuuucuuuauauccuuauacguauugucucuaugucugcgcuuuacacauaaaaagaaugacuuuuuauugcucccaagaauuaauuuucaccggcuugggggugauaucacucccacugagaaugcacgaccuaaccuggaccucuagcuuaauaugaaccucuccuguuuaucuucaauggcuccuuucaaugaaaagucuacaucccagagccuucuugguugaagcauaucuauuaaaguuuguuuucuuuauaccaaguuuuucccaacauuucugcugaaguacacaaugauaguggagaaggaacauacaugcugaaaaugaaaaacauauauagacauauuuagcaagcaggaaauguauuugagcucugauaucuuaaaacauuaagcaaacagagaaagaguagucuuuuuaagagaugguccuuggacaaguggauaucuacacacaaaagaguggaaggcuccuacuucauagaauauauaaaaauuaacucgaaauagaucaaagaccuaagaguuuaaaguauaaaacuuagaagaaaacauacauguaaaccuucaugaguacggauuacacaggggucucuuagcuaugucagcaaaagcacaagcaacgacagccacaacaaagaaaaaauauauauaaauuagacuucaucaaaauguaaaaguuuguauuuugaaggacaucauuaauaaagugagaagacaaucaaagaggaaugggagaaaauauaugcaaaucacauaucugagaagggacuuguaucuagaauauauaaagaacuuuuucaacucaauaauaaauagaugauucaaauuuuuuaaauggguaaagguuuuaaauagacauuucuccaaacaagauacucagauggccaauacgcaaaugaaaagauacucagcauuaaaagccaucagagaaauggugaucuaaacaccaugagucaccauuuggcacccacaaggucaccuauaacuaaaaaaaaauuaauaaugauggggaaaaaucagaacccuuacaucuugcaggugaucauguaaaaugaugcaucuaauuuauuauauacauaaagauaguauauauaaagguauauauauuacccagcaauuccacuccuaguuauacacccaagagaaaugaaaacauauguucacacaaaaguucuauaugaauguuuauaacagcaucauccauaaaagccuaaaaguggaaacaccccaaauuuccauugauggaugaaaagauaaauaaugugguacacgcauacaauggaauauuauuagcaauaaaaaaauaaaguacugagacacauuacagcaugaugaaccaugaaaacauuauucuagcugaaagaagccagucacaaaagaccacaacugugugauuucauuuauaggaaauguccagaacaggccaagauauaaaaacauaaaauggaaucauaaugcccagggccgcggagggggcuucaugagaaacagaaaugacugcuaaugcaucugggguuucuuuugguggugaugaaaauggucuaaaaaugacuauggugauaguugcacaauucugauaauguuccgaaaaccacagaauauacacuuuaaaugggugaaugguaugcuacauauauuauaucucucuaaagauguuugagcaggggaagggaaaggauuaaggaggaguuagauccucagaucccaucucccacuccugauagccaggagauugcgacacccccucauccuggccagugacuuaagcuuuguuccuguagagaguaaaauagagggucucugacauagaguaccccagcaaaaugagagagcagggcugcaggagagaugucucuaggaagaugaaagugccagaauaccagaagugcaugaacaucuugagaagguauuuagacaaccagugaagacuuugggggcuaagacagugauaaguauuuacaaaaccaagcaaauuaaaaaacaagaaaauuauuacauccagagaaaucaaaagucaggcaggauagaaagugugaugguaguuuacuccacacuucagcuuuagaugacauuucaauacuguacuaauaugaauauuaauuucaucaaauuugcaguaaaauuacauugagauaagggacagaagaagagcgugugcaauagaagugaagggaagacuagugauauuaguuauguucucugcuuccauagugcaaaaucaauagaaagagcuugaaauguaaaaaauaaaaaaguauacauauuacuuagagauacagagauaaauacuaaaauaaucaguuuaaaagaaaugagggagaggaaggagggacaauguagggguuuugaauuauuuuuuaguaacaagccuuauagggcuacaugaggucacauauacacacacacacaauaaaugggaaaugcuugcaaauugcauaauguaaugaaaauuuucaaauacuuuauaaaaauaccauggaaaaauuaugcuauuauaagaaauguuaugugaauuguguucucaauaauaugauuuuugucauaauacaaaaauauuuuaaauuacucaguagguaaaguauuuaacuuuguucucaaauaagcaaaauuccucaaaagaugcagcauguuuauccuaggucuccacgggccucugaacacaauagcaauuaccacuauaaaaucccagucugagauuuugugcuuaacauaugaccguucuuccacacuuagcauuuucuacuguauacaucauuaauucguuuaguaaauauuuaagcauuuacuaaugaucaauucaaguaaaauaaaaauaucugaucuaggacugauccuaacaaauuaguuuucuggaauuauauuuuuucuagauugcugaucaccacguacaugaauacaaaacuauuuauugaagaugugugauauucagccuaaaucuuguaaaacuuggacuugauagucuaagaagcuauuaugugcacacauauuugaaggacauuuuuaaaagugcuaaacuauaaauauucugauucacugcucucuuacaugcacuaaaaaugacuucgugcaaucacuaaccaggagguagguuuuguaucuuacugaaaaugucacuuaauaaauaaccuucaaauuuaaaugcaaacuguggauaucauucauagaaccucaaacuugcccuugaagucuaaaugggcaaacaagguaacuacaaaaagcuuuucaggcguuaacacccuacugcuucaacuccuugaaaagcagucugaacuuuugaguuuuuagcauaauauucuuaugcugaauaaucucuaucuccuauagcauuuaggcugaggacguuaaguaugauguacuguugggauaauuugcaauuuucacuucucauucucagauuagauuacuaacaguguuggaggaaaucacuuuacugcauaguucauucauagcaguucauuugucuauucaaaaccugaugucuuguuuauggcuguauauccuaauguguugcauuaagguguuaacagaacuaguugcaacccuaaaauuggacuaggcaacaugacuugggacuggcacagucagagaccaggaagcuggacauuuauugaguaagaagaaagggaaauuuugagacagagaauuugcaauuauguauuauuuacauuaugugaaguugacuuuuucauuagccaguauacauccuugauugugacugcuauauauaguuuacuuuuauauccuccauaguaucuguguucacaguagguguagguguggucgacagaauccuggccaccuauagauguccauguccuaauacucagaaccucugaauaugcuuacaugggaaaggggcauuaagguugcagaugaugaagguugcuaaucugcuggccuuaaggcagggagaugauccuggauuaucuaggugggcccaacauaaucacaaggguccuuaaaagauggaagagacaggcugaagagaaggucacagugaugaaaagugagaagucaaccugcccuuucuggcuuuaaagauagaggaaggggccaugagaagcuggaaaagucaaagaaacagguucucuacuagagcuuccagaggaaacacagcccugcugacaucuugauuuuagcccagugagagccauuuaagacuucuggccuccagaguuguuaaaugauuuuauuuuuguuguuuuauguuacuaaguuuucaguaaucuguuauggaagccaucaaaaacuaguaaaugauuaauuuaaaacuuucaaaguaaaaaauaagaacuaagaagaacaccuaaaggaauaaguaugagccaucaagauauuuucaguuuucuacgucuuuaaccuuauugggaaccuuugguugauguaguuaaucacuggaguuuuccuguccauucauuugaaaucuagaauuucuuuccauuugaaauaguuuucuuuuacugaccagaagcuaaacuguccuggaucaccugcuggcuguucuuuugagaaaucuugguauuuuccagugaguuaugacugcacuaugggauacuacuuccugagaacacaaaaguugcuuuagcuuaucgcuuuaggcagauauuuuugccucaguuaucuuuuagcuguguaugacuuaaacacaaaaauuuuaaaaaugugggagugcaaagaaauaucuuuugagguaggcagucuuuuaucuauuucuccauucaaccagcauuugcuaagcauuuaaaauauccuagcauugagccaggcauugaguaugugaagacugaacaacacagggucauuuucuucaagaagcucacagucuagugaagcagauagaaauguuggaacaaauaagaguuuaagaaaggaaucuguaaguguuacaggaacuuugagggagaaaugucuaacuucauuuuaaaaaacugccauuucgguucauaaaaaauggggaguuacaccccuaugggugaacauuugcugaccuuguaauuaguuauaaacucauggguugguuagaagauucuuuuaaguaucuauucaggcccauagcuuucucugaaaaugaccaggccucauacgacgccagaacuaacaugaccaaggggguguaucugacucuacacugggccagccaaucagauucucaguccagagaauuuggaauuagaauucaugggaugagguuguaucuguugugacagcgaagucaggugacagagacucaguggucuaagagaccaggccacgcaggcgcauggagccccagcacagaaggcagcaaacagagaaaaagaaggccaaagcacagacuccgaccacaacugcaguucuugcuugccucccccagugaggcuuuguugcccucucucuuuccugcugcagugagagacacauuuguguccuucacauacaaucccuauuuugguuaaaguuacuuugaguuucuauuacuugcacagugacaugguucuaccuuuuuaaaacagauuccacauuuucaccaguccauuugccucaauaaccuuaccugcaauaugggaagaggaaagcaguuuccuuucagggaaaaggcaguagaacucauaaaagauguucaaguauaaaagcacuuggacuauaaauuaucauacacaugcagaagauugaaaucuguaacugguuaugaaauauuguucacaaaugaccccuauuaaaagccaaauggaaggauuuuccagcaaaaaugagguaggaaaaaagcucaaauaaaaaugggccaagauucuaggcagagcucuaauauucaguuucagagauuaguucggcuuuggccauuuccaagugugaaagagggauggggcgaagaagguaauggcaaaaagagaaagaaucuacaaagaaccauggggaggaacaccggcaaggauuuuauccuuccagagaaagccauaucugcuguuaaaacacagugcacagcagacugacaaugaucuucuugcaauaggucauagaaagggcauuaaaagacaacuuucaaaggucucaaacuagauaaaccgaaaucaguaauagaggacuuaugcuggaccuauaggagauuuucuuccaggugacuauuaccagaggaaucuacauaacaguggacugcugcuauuugggggcuaacuucugcugcccaccuuugaagucacuaauagcuuguuagcacagaagccacgcuccguggcucacaccuauaaucccagaacuuugggaaacaaaggugggcagaucucuugagcucaggaguucaagaccagccuggucaacauggugaaacccugucucuccaaaaaaaacuacaaaaauuagccaggcaugguggcucacaucuacacucccagcuacucaggaggcugaggcaggugaaucgcuugaacccaggaggcagagguugcagugagcugagaucccgccacugcacuccagccuggggaaagggagugaaaccuggucuccaaaaaauaauaaaauaaaauaaacgcccauuagcauagacaaagagaaagacaagaaaguaaaaccuuagcuuauguuauucccuauuagcaucucugauaauggauuuguucauuaacaaguuaggaacuaauugaacuggagauucaaaauaaucuaaaaauuucaguucuugauguuaguacugcugucucuaugcacuaucaagugcacggaaaguauagaggucaauguauggcacaucugcuuuccauuaccaugaaauucacuucaacacaucacugucauaaaaaaguccuauacuaagcauucuguuguugguauugauccuucccuuccauguuaugaagauaguuauucauuuuugcagacucaacauggcauaaugccuggcacagagcuaauacucaacaucugugaauguauaaaagagcagauaguagaggcuccaugcacuucugaauugcugaccauaauuguuaacauuuucugaaaacuuaccaaacuccagguguaguaccaagugcuuuauguacauuguuucauuaaacccucacaacaacccaaugaggaaacugaggcacagagaccuguccaagaucauagacuacuaacuggaggaagugagaugcagacagaggcagccugguuccagagcucaagcucuacaccacgcugcaguacugccucccguauucuaguccucucaugaaggcuugcugauggucuagcacauccuucaugcucugcgggacacaaaaccagacacaauuuuaaccuugcucuuuggaguuaagagugagaguuaagugguauuuauacaauuaacuccaauaugaagcagaauuuaacaaguaugucuagaaaugaggcugaagguacagaagacaggaacacaacucuuagcuaggaugggagagaaauggaagguugcauagaccagggacacauaggcugggccuuaaauuauauagaagaucugcaaaggcagagauagagaccagauuauagucagcaaaaucaucacaugucagaaaagucagugugugucuggggcuaucuggggcacaggguaucuucaggaagcaguaaugaugaauccuuuaaugauacucuaccaauucccccggugugaaaacauaucaaaucuugagguacagaaagggggacaaaccgaggacucccaaaacuaaucaaagaauacuccuugaaguucugaacauuaaugaggaugaggaccucacugaauggccacuucuguacaaacugaguuugaagucacagaaauguuagaacuguaauccuaaaacucaguuaagagggaagugcaucuacaaaucaagacagaccuccagcugaaaaugccucaacagacacuugcauaggccuuccuuccaccuuuccgugugcaaacggauacugugauuuugagaaugaaacaugauagcuccugcauccacuacuaacaaaagcaagugacuggcaaugaggguaaaucaggccucccuugaguugguccuugaaggugcuaucaaauuaacguaugucuaacaauucugucuccauucaaaucaauucgccuagguagcuaaccugcucacuguuucucuaacaagguaaacaauggauuaguaaaaacuacacauaucagaccugguuucuuacaacauuaggcucaaaaugcaagauuuacauaaagagaacaucuauggugagaaauaauuugcuuagacaggaaauuuuaucacugccauucaguuaguuggaaaaugaagauuuagagauuuggggaauucucuaauguucuacauaagcauaggguaaaauaaaaacuucguauuucuuugaauuaauauccaauucucuucuagaggaaauuuuauugaauuggaaguguaauucuucuguuuaaaagaaagccucagccaggcaugguggcucacaccuguaaucccagcacuuugggaggccgaggcggguggaucacaaggucaggaguucaagaccagccuggccaacauagugaaauccugucucuacuaaaaauacaaaaaaaauuagccaggggugguggcgggugccuguccucccagcuacucaggaggcugagggggagaauugcuugaacuugggaggcagaggcugcagugagcugagaucacaccacugcauuccagccagagcaacagugcaagacuccgucgucucaaaaaaaagaaaaaagccucauuauuuuuuauaaugaucaugcugaucauacugcuauucuagucacugucaauaaacaaaaugacaauaaauaaccauuacaaggcagcaauuaacaugaugguaccuccuaacuucuaagcuuguuucuuuaacgugaaaacacuauuucuauuggcaaguauguagaugagagcugagucuuccugaaggacagauugaaagaguuuucacaaauauuuaaaaucacagaaaaaguaauguucugaaacauuuacagaaauuaauaaaaguaucucaucuuuguguagauuaaauauuaaaaugcacuuauauaacuuuuauuaaaauaauuaauauuuaacgaagacaauugaaagaacacaacuaugacaaauuacauuuuggcaguaaugauaagccuuugaguucuaguucuuucuccuuagggauguuacauaucuguuuucucuacuuaaaucacucugccucauuaucaucucugccuucuacucucaguucagcuugaaaguucaucuuauacaggguuacacgauuuuauaauaucagauaacucucuuucacaccacuuaccagagcucuaauacuaacuuaugugucucauucuugguugaacauuucucuaccucacuagauuauaaacuccuugagggcaggcacugguuccacucucuuccacuaaauccccaacuccaaaacccuaacaccuuaacaccuaauauauauaucaccauuuacauaucagucacucaauaaauauuugaagaacgaaaugacaaaauacccuuuaccugaaugcuuaccuaaaaauguaucuuauauauggaaugaaugauccacacuuacuacauggauguauaaacucaaacauuauacuuuucuuugcacauuugagaauaugugucauaagcuauguuuacaaugauauggaaacaaaaacuugucuauaacaaaaacaugcccauagcaauaacagcaacaacaagaagugguuccaaauucaaggugguagcacagcuuuuuucaaaaauuugagaaaaaacaaaucuauuaaaacagaagauauagucucuuggacuccacuaaaaugagucuguucaggucuacuacaaaacacaucuuuaagagagauucauggccuuaguagccagacaguagguauggcccagaccuucccagcacagccuauguauugaagacuuuagugaaaacacucaugucagcaaauuuagcauggauaauugcaauaggaaguucuauaacuuugcuuuagggaaaaaaauucuauuuuaauuuucauucccaaacagaauuauguuagaauaacaaaauaaacuuccccacauuuaucuguuuuuuaaaaaugauagucucaaggaagagaaacuuucuuuucauucauuuaauaaagauuuuugcauuuuauuuaaagacuccuuauggcuauauuuuaaggauucaaguucauuuauuugugauaacuagaaaaauuuuuugucccuuugugaaaauuuuggaacuaggcauauuuucauuacuguuuucauuauuacugacaacuuggcucccugcucugggaaauauuucuggaagaaaagaaaaaaaaaaaaaaacuaugaaucaacuaacuuacuuagcaaggucaucagcuuacucaccagggcuuauuucaagacccucucugugccacaaacacaagacuacuuugucuaaacucuuguccaauuccaaucauuucucugacuugcaguaccugccuuaaaguaaugcagaacaagcccagaacuccauaaaugugcucuccuaauuuauccauuuugagcaacuaaucagauucucucaaucuuguauauucuuuuccuauagaucuaaaaucauagcuuugcuugaucaacagguuuuuccgguagucuuguggaaacuugacaguaggcauucaucuuauauccacuacacagaaaccugaguucacagauguugucuuagucaaugccauacacacacacacacacacaccugugaccagcacagugguuggcacauaauaugugaucaauaaaugcauacuuaggaaagaagauuuuguucuauaguauuacagagggucaaaguucuuauaaaggagagucaguuacuaaaacuaaacugauauucuaucuucucauguggucuuucggcaucaguccuauccuacacaauaaugccuugcaaucuguaguugugaaauuagacuucuuuuuaugugugcacaaauuaagccaguuucuacaaauuaaagaacauccagcaauuauugcucuccuucaagcugaccaauaggauaaguuuaagcaguaguuuugagaauuuguuuuugcaauuuuuuuuuuuuuugagauggagucucgcucagucgcccaggcuggagugcaguggcaugaucucggcucacugcaagcucugccuccuggguucacgccauucuccugccucagccuccugaguagccgggacuauagauacccgccaccaggcuggcuaauuuuuuguguauuuaguagagaccggguuucacuguguuagccaggauggccucgaucuccugaccucgugauccgccugccucggccaccuaaaguacugggauuacaggcaugagccacugcacccggccuguuuuuguaauuucuuauacuacaauguuuccuucuggagacagaggaaguccagcagaugaagucuaaaauacucugcuuauuuugugaaaagaccaggcauucacacaagcguuuuucucaaagcugagaaaaaggaggcugaaggugcaaaagauaucagaguacucauucagaacccaagagucuauaaaauauaaaccuggugagagaacuggccucagccaauggagaugccucaauaguguuugugucacgagcgaacaaggugaaucauaaaaauauuuuuuaaacuucuguuucaaaggugcaaaaggcauauauauuagucucuuugcauuacucuaaaggaauaccugagacuggguaauuuuuaaagaaaagagguuuauuuggcuauggaucuguaggcuguauaggaagcauaacacuagcaucuguuuggccucuggugagggccuuggggagcuuacaaucauggcagaaaacaaaggcgagccagcaugucacagggcaagagagggagaaagagagagaguagaggaagucccagccucuuuuaaacagccagaucucaugugaacucacagacugagaacaaacucacucauuacugcaaggaugacaccaagccauucaugaggaauccacccucaugucccaaacaccucccaccaggccacucaaccaacaauggggauuacauuucaacaugagauuuggagcggacaagcauccaaaguauauaaguacagcagcuagaacuuucaguuacuuaaaaaaaaucuugcugacaucuuaauuaccugcugaaguccugguggucagcaagaaagcagugaaaacauuuaaaauuucaauuuucauauuaaugguccuaauuucuggaucugguuuucucuuuuaaccauuugcauaaaaauguuuugugagggacauauaaagaaguuggaagcugcagauauaggcguuaaaaaggaauuauuuagcagacagugaggguauggaguccuccguaagguuuuccuuugaaugaaaagcagccgccaaaucauuuucuuuucuaacaaagagcagccuguaaaaucaagcugcagacccagacaagcaagcuggaagcuugcaauggaugaaugccagcaguugugccaauaagaaaaagcuaccugguacuaagcaugcucaaaauggcagcuccaucuucccuuuucuuugccagccacauguagaguaacgagcaggcaacauggcgccagcugggagaagucgccauuugcuuaagaucaggguagggcauccagcuuccucgcauguuauguaaacaucacaccucguccaaccaaucuuugggcccuauguaaaucagacaccgccuccucaagccugccuauaaacuccaaugcacucugccacaggcuggaagucucauucaggcacccuuuucucucucaagagagaaagcuguucuccuuucucuuucuuuugccuauuaauccucagcucccaaacucacuccuugugugugugugucccuguccuuaauuuucccggcaugagaugacaaaucucggauauuaucccagccaaugacacugcuucacugcaauuugcaacaagaaaaauauuuacgacaaggaaaaaagaugaaccaacuggaaauuaaugacuuuuuuagauucagcagagaacugagguccaaagcaaacuaguauccccaaauuuggagaaacauguaaacacaaagaaucauaagaucagauuaccuaaagcaaaaacagaaggaccuaggaacugauacgaacacguguaugauaauuuugacaaauugcuggaggcucagugcagacuagcuugagaguuaaaaacucuugcagccuagucuuaggggagacuauacuuuucugaguuuuauguccaagaacccuaucauguucucauggggaagucuggagaaaaaucucagggaagagaaaaaguaaccauuuuggaaguuucccagauuguucucuguaagaaagacacguccuuucagggaagcuauuuuaccagaguucuaucugacuugggagaagggcaauuaguccccuccagacucuuuuagccuuccugucuaaugucaggggacgaaaaaagggcucagaacauuucagaagaucgcagccuagaaacucaggcucacuaagaaaacugagauguaaucauaauauacaacaauuauccuuccugagaccucaucaccacgugaagaggucuuuggugauuacaacugagaggugaaacacacagacucuauugaauaaggagcucuuaggaaagcccaaagacaacagggaagacaaaaaauacgagcacacagaagcaucuggaacuuaaagcuacagcaagcauuaaacacaguccagcucuaagcuagauuaacauaaaaccucauaacaaaaaaaaaaauucuuaguucccaucacucgagguauuauuuccagcuuucaacaacaaaaauaaggcaugcaaaaagaaauuucuuaaagauaaacuuuaaacuauuuuaaacuaaauaaaaaugaaaauagagcuuagcaaaauuuguggaaugcaaggaaaacaaugcuuugcaggaaauuuaaagaacugaacacauauaucaaaaaagaagaaagaucuaaaaucaauaaucuaaacuucuguuagaaacccacagaaagaaaaacaauuuaaaccuaaagcaaucagaagaaaaacagaauagaaauuagagcagaaaucaauuacauugaaaauaggaaaucaaucagagaaaaauuaacaaaaccaaaagcuaauuauuuucaaaagaucaauaaaauugcuaaaccucuagucaggcuaaccaggaaaaaaagagcaacaauacagauuacuaacauuagaaaugaaagaggggucaucacuacugaucucacggauauuaaaaagaugauaaagaaauaugaugaacaacucugugaucucaaauuugauaacuuagauaaacagaggcaauuccuuaaaagaaacaaacuaccaaaacucacaaaaagagaaauagauaaucugaauaggucuauucagguuauaucuauaucuguaucuuuuuaaaacauugaaucaauaauuaacuuucuaaaaauaaauaauaaauuggguccagacaauuuaacugaugaauucuaucaaauauuuaagcacaaaaugauagcaauucucuacaaccuucuuuagauagguaaagcagagggaacacuuccuaagucauuauguuauaccagcauuacucuauagcaaaaucagaauacacgugcaaaccccauuaaaagaaagaaaaacuagaaauuaauaucgcucgugaacaugauauaaaaagcgucaacaaaaucuuagcaaaucaaaucuaauaauguauaaaaguuauuauauacuacaacuaggauuuauuucagguacacagcugguggaacguucaaaaacucaacaaacauuccuagcacuuugggaggccgagacgggcagaucaggaggucaggagaucaagaccauccugacuaacacagugaaaccccgucucuacuaaaaauacaaaaaaauuagccagguaugguggcaggcacuucuagucucagcuacuugggaggcugaggcaggagaauggcgugaaccugggaggcggagcuugcagugagcggagaucgugccaccgcacuccagcgugggugacagaacgagacucugucucaaaaaaaaaaaaaaaaacaauagaagaaaaccaaacaacaaaaaaaacucaacaaacguaacuuagcguaucaacuggccagagaagaaaaaucauauaauagcaacagauacagaaaagcacugacaaaaucccacacucauuuaugaguagaaacucucagcaaacuaggaauagaugaaacuucgucaacucgauaccaaaaaaucuacaaaaaaaccuacagcuaacaugacaucauacucaauggagagaaacuggaugcuuuaagaucaguguaguauaguaggcugacuaaugaucucccaaagauaucaggucuuaacuuuuaaaacaugaaaauguuaccuucuuugaaagaaaggacuuuguagcuguaacuaaauuaagaauuuuaaggugagaagauuacccuaaguuaucugagugggccuuaaugcuaucaaucauaaauauccuuauaagguagaggcaaaggugaaauaacacagacucaucaagaagccagugugaccaggaacacagagaucacugucacacccacacccacaacccaaagaauauauggagcuaccagaagcugucaaggaauggauuucccuccacagcuucugugggaguacggcccugcugacaccuagauuuuagacuucuggcuuucagaacugucagggaagaaauuucuauuguuugaagcuaccagucuguaauaauuugauauagcaagcuacugagaacaaggcaagauuuuccccuguuaauacuccuauucaacagcauaauggaagaccuagguaaaaguaagacaagaaaaggaaagaauauuaagaaaaagauauaacgauugggaagaagaaaauaaaacuguuuuugcucucaugauauggcugacuauguagaaaaauccuaaaaaauugacaaaacauucucuagaacaaauaagcaacugcagcaauguuucaggauaaaauuuuucuuuuauccugaaaaaaacaggauaaaauauuucuuuccaauaugccagaaaauaacaaauggaaauugaaauuagaagcacaauaucacuuauauuagcguaaaaaauaaaacacauagauguaaaaaucuaacaauauauguacaggaucuguaaggaaauauaaaaaauucugaugaaagaaauaaaaucuaaauaaacgaauagauauucuguguucauggauaggaagacuugauacuguuaucgguucuucccaacuugauuauacauucaacgcaguuucagucaaaaucccagaaaguuauucugugaauaucaaaaagcugauuguaaaguucauagagaagggcucaagauccagaauagccaauaaaauauugaagaacaaaguugaaggagugauacuacucaacuuuaagacuugcuacaaagcuacagcgaucaagacagcaugguacuggugacagaauagguaagugaaucaaaagaacagaagaggaaauccagaaauagaccaauacaaacauaaacaacuugcccuggacagaggagcaaaggcaauucaauagacaacaaauagugcuagaauaacuggacauccauaugccaaaaaaaaaaaaaggggggaucuacacacagaccuuacaccuuuuacaaaaauaaacucaaaacgcaucacagaacuaaauguaaaaugaaaaaugcaaaauguaaauccucugaaagauaacacagggaaaaauacuagauuugaguuuggcaauuuguuuauagauauaacaacaaaaaauuaucuacaaaaaaaauuuuaaauugaauuguauuaaaauuuaaaacuuuugcucuacaaaaaauacuguuaagagaaugaaaggacaaggcacagaaugguagaaaauauuaacaucauaugucauuaggggauuacaaauuaaaacaaugacauaccaguauauaccuauuaggauagcuaaauccauaagacugauaauaccaaauauuggcaagaaaguggagugaugggaacguucaugcauuguugguggaaauaaugguaaaaugguauagccacuuuggacuacaguuuuacaguuucuuauaaaucuaaacauaguuucaccacagaaugcaguaaccaaguuccuaagcauuuacucaacugaguugaaaacuaauguucacacaaaagucugcuuagggaagcuuauagaaacuuuauucauaauaaucugucuuucacaacacgagaauguauaaacaaacuguggcaaauccauacgacagaauacuagucuacaauuuuuucuuuaaaagaacucuuaugccauaaaaagguguggaggcaccuuacagacauacugccauaugacauuauggaaaagggaaaacuauagaggcaauaaagggauuacuaguuaccagggauccaauauaguuucuuagggcaauguagacuauucuauacgaaacuguaaugguggauacacgacaauaugcaucuguaaaacuccauagaaccacagaaggccaagagugaacuuuaaaguaaaguaugaacuucaguuaauauaaaugugucaauauugguucauuaacuucaguaauaaaugugccacacuaaugcaagguauuaauaguaggagacacuuggugguggggcggggaugggggaauaguggcgacacggaaggaaaauguuaugguaagucucucaacuaucugcacaauuuuucugaaaaucuaaagcuguucuaaaaaauaaaguauuuuaauuuuauuuuaaaaaguacaucuuagaaaacauaccuaggaugaucucuaggcucuggauccagaaaccccuauuucaaacaaguaggaagauucuuauggcugcuaagauaucagcaguccaugguuucaggaauacagagccccaaggugaauacaacaaccagacugaaauaagugcaguuccaagaauggagcuuaaacuggaaagacuagagagcagcuggcuagcuguuuagagguaacagauggcagaacccucaggaucaagucauccugaaugaagaaagaccuuuggagagugcacacuugaguaaauagcggccucuguucauguucuccaguaacaaagaaauaaacuaauuagauggcauucauaagcaagcuaaaauuccuuucacuggaaaucuggaaagaacugauuuaggagagcgaaaaacagggauauauacacacacacacauacacacacacauacauguuuguaguaucaggaaaugcucaacuuugcucccucaagucauccaguuccaauguuuuauauaugcuauuauaugugacaaaaucauauaauauauauuaauacauaucauuaaaaauauguaacuguuaauguagcauagguauauauuuuucacauaccauaacauuuauccuucuaaaauauguaauucaaugcuuuucaguauauucagaaaaacauguauccaucaccauuaucuaauuccaggacccaauuuuguuuuuaacacaucucaaauguagauuacaaaaaaagaauugauccacuagggauacggucuguaagaagcagccuagauuuuuuaaaaauguuuuucuucuacucuacauguaaauaagucugcauccugucaguauuuaagguuuucuuucuuucuaacaaucauguaaggcugguauuuuuuaaaguuuccacucagaagacugucuuccugaccuguaaagaaauuaaguguaaaaauguaugcaauuggacuaaauaaugaaaaagagguugagaagagugcaccgaaagagguaaaaaaaggagacuaugggccaaagguauacaauagggaaaauaaaagaaguuucuagggcacugcagaaagacaauguauucuagugauuaccuuuauuagacucuauuggaucaggagccaguucauuaaacauuaauggcaggggaaugccauccauauauuauaaauagccauuaaguugagauagacagcucugcccagggucaguaugaauuaauaaaaaaaacugaagcuggcauuucagaaucauaaaaagauagguuuaguagaaaauauucaauaagaaggaagaagaacaguauauauuacacuauuugucugaagagcaaacugaaaaugagaacaaacuuaacauaaaccuaaaaagacccuucaugaaugaaacacuuauuucucgaaaauggaugucacuuacauuuaagaaucguaacaguacaaugugugacauuggcaaaugguaaauguaaagacaaaugagguguagacguucagcuagaaauuagacaaaaugugaaugcaaacaaaauauccucacugaacacaguuccaaacauaguauguggcagcaggagaacugaaguuauuaacagauaaggucuaauuuccaauuuaucuauugaguuaauccugaaaccuaucccacuugccuguauuuacaagguaggucaucuuaguuuuaccaugaguuuucacuauuuuaagagagaaaucauguuaugaaacaugguacugauaagauacuuacauaaagagcuacacuuuuuuaauuuauuuuucucacuuucuuugcuaauuuacacccauuguuucugaguaaucugaagaaugagacauucccauuuuuuuauguaucauaauguuucuaagauaacgcauggacuuuuuaaagaauuucaugguagcaaauauuaugacucaaagucaauaugacccugguuaacaaaaaugaucaaaaacuaggaaauaaagcuaacaguagugguagcaaugguguauguggcgugucuguucaauacuguacuagaauuuuguuccccaagcccacucaaggauuauuuaauucucuaaaagaacauaucuguguuuggcuuugcuauauacauuuugauuauuguaccaccacugucaaguuauagguuaacuuguaguuuuugucuaguacgaaagaaccacugaaguuuaugguuuaauuguccugugggauacuaaucagucuuguauaaaaccuaguaauuuuauucaaauauucucccucuccaacuccuuuuuaacaaaaugucuagaaguacccagguccucaaaaugccccuggauugcacugguuucuucauuaaagacauauuaaauguugguauauauuuauucuguauuuuuauuauagucauauuaacccuuagaaaguaguauuuuucacuccaccaagcaccuguguaagauuuuuuaaaaaaauaaacauuugccaauguuuugagaggugaauuaacucaaguaaggcauaaccaguaaugccaaaaauagguuuaugccccaugaauuaucucuccaguggucugccagccacccauaaaaguacauuuuuaaguuauacuauagaaugagugagauaaauaaaaugaauaaugaacggcagacuuaaaaauuaugacauuuucuuaaucuucauaaagccugugauggauuuuucacuugucuacuuggcuaaggugaacuacagucccuccccacuuguucaaacacagaucuagaugcugcuguaaagagauuuuucaggcauaauuacagucccuaaucaguugaguuuaauuuuaggaaaucaucuugggugggccuaacuuaaccaguuugaacacuuuaaaagaagacugagaaagucuuguacuugguguuggcugccagcugagaucuuggcugagacugucagcuagaacucuauuuuuuaaauuuuauuguuuaaauugacacacagucgauguacauaguuuugagguacaugugauaauguaauacauucauauuacuuagcauugggauauccaucaccuuaaauauuugucuuuucuuuaugcuagauacauuucaauuauuuucuuccaucaacuagaacucuuauaacucacggcuagccacuccacgugauuuggcuucucucacagcauggcuguuggauuccaaagaaaagcaucccaggagaggguaaguggguguagagggggaggaagcagggguggggagcacacaccaacaugcaugaggugaaugcuauucacuccaccugcacugagugcauccuacucuauucucuauccuaguuucaacagaaggaagagaaaacagacuccaccuccugauaguguaugacaagaaucuggaacaccacaaugaacuagaaaugcagguguggccacuuuuggaaaauguaauuaugccacaacaaucuuugacuauuuuucuauuguaucauuuucauaaugguuuuuagaaacuuggaauaaauuagagucauuagcccuauguacauaauaugaguugcaaauauuuuucccucaaacaaauguauuuuuguuauucuuacguaucuuuuaucucagaauucuaagucccuuggaaguaugcaaauuuuauugaagggaauugaauuuuuaaaagaagcacuuguagaggacauuuucaauauuagugcuaucaguuaaguaauuuacaguaacucuuaugguacccaaucuuucucucacagugauauuuacaaguuuaaacauuuuuuaucucaaacagaguggccucugaauuuuccuccuaacaaggagcuuaaucuacuauagcaaccauaaugaaaauguuauuuaaaaaucagacaagagcaacagggaaagucgguguuugcuauuuaaauuguuuuuguaucaaugggcuuagaacacuguggagcuauaucauuuuauucaguuuucuuucauuuuaaugucacugaaaggucaagcaauaauccagagaucaauuuaccaucccaugcacauugcuucccuccaauuugggaauauaaauucaaauguaagauggucuucacccaagcucuucccugcaaaaaaaaguuaaggccucagauauuuuuauaucuacagagcagagaaggcuuuacuucaaauaaaugcuguugcaauuagccugaugacccuucuuuugccuuuuaauauuuugauauuagcagguucuacuuuuccuccugaugccgaaaaaaccaugucauguuaacaaauuccuuaaauguugaacucagucagaucaucuauaaaaugcaacaauaucaucucccuaccuaucuguuaaguuuauuaugaagacaaaguaaaauuuccauuuuuuuuucagacagagucuugcucugucacccaggcuggagugcaguggcaagaucuugccucacugcagccucugccucccagguucaagcaauucuccugccucagccuccccaguagcugggauuacaggugugcgccaccacacccggcuaauuuuuguauuuuuaguagagacgggcuuucaccauguuagccaggcuggucucaaacuccuggccucaggugaccugcuggccucagccucccaaagugcugggauuacaggcaugagccaccacacccagccaaaauuucugucuacuucugacauuagacugcugagaguacuacauauaugacaguuuauuaguauugcuuuuaauacuuagaacacuguuugagacacauauuaagugcuuaauaaauuuuaccugguguuuuugugauaugcuuuauuuuauuuaagaauuuaaggggaucaaguguggaaagagaagaccuaccaucucaucaucaaguauuaugugcauauagcaugagaggaagagagaagaaaaauggggagacaaagaaggaaaaggaaaagaaaggauucaggguucucugauuaucucugugcagguaagcugagggaaacugcacacacuucaucagcaccaguggguucccauccagccucuuucauuuacuacugauaugaccuugggaaagauacauaaccccucuguaucaguuaucuauugcuacuugacaaauuaaccccuaaaauucagggcuucaaaccaccauaaauauuuaguaucuuauacagguucugcaggucaugaaguuugaagcugauuagcugagugguucugacucaaggucucugggaaacuggagucacaacacccaccagguugggaauaaucugcagacuuggcugaagcugaagcauccaccucagguucacuuacaaggcuggaaguuggcgcuggcuguuggaaagaaacuuuauuccuugcuagaggaagcucuccauaaagcuguuuaaguguucucacaaaauggugacuagcuuuucccaaaaugaguaagauuuuaugaccuagacucugaagacgcacacuguugcuuucacuguauucuacuggucaaagagauaacauaauacaaggugggaggagaugucacuaggaggagaauuuuaaaagguaaggaucacuggaagccaccuggaaggcuggcuaccgugcccucaaagucucugauccagcaucuauaaaaugagaauaauaaugacuucuaccucacaauguugguggaaagauuaaaugacaccauguauucaaagugacugugguccagcacuugcuccacgaauugcaaaccuccuuaaucauucuguuuucuagguucuggcacaguguguguguguguguguguguguguguguguguguguggaggggggugugggugugugcacgcacacaugccuggguccauuuggccaccugaugaagucuguguacaacuuccaaaaaucauacuuuuaaaaaaaaguacauaggauuaugagaauacagauuauacuagaacauagccaugaaaauauuuuaaaauauauguaauacacuaauauuuguuucuuuauuaagacauuauacaaugaaacccaauggaagcuuuaacaacuauaucuucaaaggaaugauaagcacaaauguuuugggauacauauaauaacugaaauaugauuagacaguaucugugauuucuauuggugagaaagucacaaguacugccaaugccaccguggucuuuugccuauauucacacuugaaagaaaggcuaaaaucuacucagagguuaguguaagugaagauaucauuuuuuuaauccaaguuuaaaguuuucauaaacacucuccacaaacccaaugggguucaccggacccuggacuaaacuuaauuuacuuuaaaagaaagaggaggaaagaagaauaagaagaccauucuaguauuuaauauucucuacaaauaauuuucuuccuauuaaauuuccuacuguacacaggaacaucuguucuccaugguucucucauuucaaaaugaucacucauuucauuggacauauaccuacauaauacuuucauuuaaacauauuuuaaugaaucuuuagaccuagauaaauggauuuacagaagugcuacauuaaaaggccauuuuaaguuugggaucgaaaggaccuuuaauuuauagcuccagaaaauauccauuccauggcucaaagauccuuguggauuauaaaagaggaaacgacuaacagaaaaggaauuauucaccacauuauuaaacaugacaaaaagcuucugaauuggagcuuaaaacgggcuauuuaagauuccagcaaucccuaggacuuuggcaacaaaaauguucaaaagccuuuuauaguugcugucagauuucuguaaagcauuugagauuccugugaacuuauuuauauaacaagcuaaaaccugaagcugacuugaaagucuuucuauucuaauuauguagaaauggaaaugccuagaaaugauguuccguguucucccaagaauauccucuugaaauggugguuucagaaccggguauuuagaagaaggaaugagaguguagcugcuaugguuuauuacacggaaccauucagcagauauacaaacuauaguuuagcaaaguggcuucaaagaacugccauuuaguuauucucucugcagcagcacauucuaaaugacuguucauauuguucccuccuggcccacuacagugguuuauuucugaagcucuauaguucauguguaaucauguagcaaaguaauucacgauauaaugacccaccaggaucucagcugauugugguucuuaucacaauacuguuucugaugcuaugcguggcuuuccaaagccaacuuuuuaaccucuuaugcuucagcauuccaauuugacaccaggccccucuguguuccgagaagucagcacauacccuaagcuagaaaugcuaggagauauuccaacagaaaaaauaagauggguuuugggaaagaguacugugcuugacagcuucuaaaauggcuccuaauaagcccaccaccuccugcuauucacacccuuauguaaucuucucucacuuugaaugugggcuggaccuaguuauuuccuuuuaacaaauagaaaugugauuuguuuauaaaugacugugacuucauccuuuucacccuuucucugcccucuuccugcuugaugagacaaggcaagcugaccuauggagagccucauguggcagagaacugagaccaacagucaacaacccuagaagaacugaguccugccaacaaccgugugagugaaucuggaaguggaaugucucuaauccugacaauaagauauugacaccaacagcagagauguuaaaacauguagggucucagaccuuaucaaggaaaggucuagaaaaggaauaugaaaccauuuuuuucuaguuccaaagccugugcuucauucacugcauuacacugugucuccaaaugaguccuguuccaaauacugaauuggguuuugccuguuuggaaguuggaacucauuucccuagagauaaaauggcauaacugaaauuaacagagaucugacacaauagcagagaggggaagacagaggacuuggggugggagggcucacaaagguggcugugccaagaacuccugagucuuagcagucugauccaggcagcucaugggggcuggaggagugaaguccaaaggcuggacugagaaaaucacuuccugauuugaguuagcuuuuacuugauacuaggaucuuuguggauuaauuaauuaaaaaucuccagaugagacuaaagcggccucauugucugggaugauaaucagguucauugucucacagcugaggaaaucaaggcugcagacacacaaggagugagguuaaauggggaaguuuaauaggccaaagaaagagaauagcucucugcuggggagagggguucuggaaaaauggguugccgguccacagggaaauacaggggguuuuauagauaccuggugaggaggcagagucugauuuacauagggugaaagacuaguuggaccaggugugccauuuguauagggcaugaaaaaccgguuaggacuagguuugccauuugcauaggaugcaaauuucuggucgccuccacccuaaucuuuuauuaugcugucacguccucuaucugagcugugccauguugcccguuucuuuacuguacauaugguaacaacaaaaaaagggaagauggagccuccaugucggacaugccugggccccagguagcccuuuucuguuagcacagcugccagcauuccccugugcaagcuuccagcuugcuuauuuauguuuucagcucgauuuuucaggcugcucuuugguaggaaaaaaauaauuucuugggaugcuuuucauuagaaagaaaauucugcugagaacucuuuuacccuuacuaucugcuuaaauaauuucuuuccacuuccugugucaaaauuauccauauuuagagugagccuuaaauccaaugacugguaucuuuaugagagaaaggacugggagauuugggcacagugacccagaggaaaagaucacauggaaagagaggaaagauuggagccagagugccacagccuaggaauaucaggagccacuagaagcucgaagaggcaaggaaguaugcuccccugaagacuucccauggagucuggcccuguccauaucuugauuucagauuuuuggccuccagaacugugagaugauagauuccggugauuuuuaagccaccaaguuugugauaauuuggcacagcagcccuuagaaaugacuaccaacaccagugauacuaauauucaacuagacgugagagccaccacuugaagcuguggcgccaaccuugccaggugaacuguuauugagcucaagguagggcccagguggaaaucacuagcaaugagaacaccagcugcaauaaucaccagaaaaccaccuucaucuucaaaacaaaauauuaaaaacccacuguguuaaaaagucuuuuuuuaagcaaggcuguugugagacgcuucgaaauaguugaauauaaaccaagaccuauauuauacuguagucggauaucaucucaggauuagcauacugugagcaaauccucaacacguugggaguuccccuuccccuuccagauaaaaguugaaaagccugagaaaaucagggguguccuccuaacuuggauguuagcugccguccauuucucuugagguuuuccuuucuuucuuuaacuuuuacaaccaaauauuuauaguuaguccugcucuaagaaagccuuagaagccaggauaagagcauauaauacucagaacaaaacugugugaaacagccauauuauucuaucugugacuugauaauuagauguaacuaaauugccggccaagauaucccauacccaagcaauuauagacaccaacuaacgaagacaggaaaucaaagaaugaaagcugaaugccaucaguggacauaucagaaaacaucaagaaaagcuuucuaugaagaaaaaaagugugcaacucuuuuaaagaaagccuagucauaaaaugaaauugaaauguguauuuuuuuguuuuauuggcuuuauuucaaauggcuauuauuaaaucccugauagucaauuaaaaaacauucaccaaacuagaaaucugcugaaguauacauguauaagcaugccuaaauauauuacaaacuauugaauugaaacauuaaaacauucuccauagcaacacuaaaucaaacugauauuucauuuugguuccccugaugccaauacauauaguacauuaaacccacagcuuucagagcauaaaaaugucuuugaaaacauacguaaucuagagaugauguucaaauauaguauaauauacaccuugguuuauaguuauuauuucuuucccaagauuacauuucuaugagaaagaagaggagccuaaauaugauauagggucauuaauuuuaaugaugaaaacagaaauuuugacuuugccaguucugaccauuggggaaucugugcccauaguaauagauuacucaugucuuacuugcacuuuucccaaaaaucucaagucaaagaccacagaauuuauacgcuagaaaauauaagaaaaaagggcacagaagcuaaacaagaaaagaagaggaaaaauauuccaguuauggcuucaaagucacuaauuuccauggaaggagauuaagcguauacuuuaucgaccuucucugccagcaaacaacguuuuauucaugucacuuaauggggaaggaggucagguacagaucugaaggucaccuaacuauaugcuuucuuccacaguauuauagggcauagggaaagagccuaaaauaugccugcugguuggaauugaaaaugaaacggucccuuguuuaaugccauaaaaaguauccugagaaaguguagcucuuaggcuuuuccucuccgaggauuuagggaaaaucaacagugcccacuggacaaaaccacuuuagauaaagaggaauggcaaauuuaagggcucacaaaauguacuuaaaaguuuagaaauugggcuuucaaauuauaccagucaaguuuuacaugaauuaaguccuauuuugagcuaggaugcaucauuaugggagguaaaccaaaaucuuaaaaaauauauuaguuuagaaugagaacugugccucaggaggugccauggaauucacuaggagguaaaccuacugcaaauuacauuuuaaaaagcaaucucagcaauauauucuucucuaaaaccacaaauucauuuugaaucaauauuuguuaugaguccuuuucaacauuuuuccaggagcaacacagcacugugucuucaggggucgaagagggaaucuacaggacuuaaaaaagcauagggagugaauauggggucauagcuucugucauuguugaaaagagaugccaguaaguucuaugcauuaaaacagaccacgcaaagcacaucugauggaauaagauaaauaacauaacagauucacucuugcauguccaagcguacuucugagauggugaaaugcauuugaugcacugaaacaugaaaccaucaaaaucuacagcuggaagggaccucagagaugaaucauuugaaagcccuccagaggaacccagguuccaggaaauaugaagaacgugaccaaggucacaaguuagcuggcagcagaacuugcaccagaauacugaucuaauuuuauuauauacacuuuuaguuucuaaacaccaagaggcaugaauuuacaaacaaugaguacagccacaugcugugccuaaaauaacaauuacaaaaguaaaccuacagccucaguuaaauuacuuaccuguguuuuucccccaccauacagaacauuaccauucgcacaaaggucccucauguugccccuuucuggccacauuaauuugcucccgcccucacuccucuaaccauccuuaaucacugccaaccacucaucuguucuccauuucuauacuuuugucauuuuaaggauguuauauaaauggaaucauacaacauauaaccuuuugaaauuggcuuuuuacgcucagugaaguucucuggagauuaagcuguauguaucaauaguucaucugaaugcagaauagccuccgugguauggauguaccacaguucauuuaacuauucaccugcagaaggacaucuggauugcuucuaguuuuuggccauuaugaauaaagcugcuaggaacauuuguguaacgguuuuuguguggauccaaguuuuuguguuucuuggauaaaugaccaugaucacaaaugcuggguugucucaguccgcuugugucgcuauaaaggaauacaugaguagccaggucaguggcacaggccuguagucccagcuacucagaaggcugaggugaaaagaucuguugagcccaggaguuugaggcuacagugggcuaugauuacaccugugaauagccacugcacuccacccugggcaacacagaaaaagaaaucucuuaaaaaauagauauaaaggaagaccugaaacuggguaacuuacaaagaaaaaagguuuauuuggcucacgguucugcaggguuuacaagcagcaugaugcuaacaucugcuucugaugagaaccucaggaagcucccacucauagcugaaggagaaggggagccagcauguagagaucacauacauggcgagacaggaagcaagagagaggguaaaggugccagguaguuuuugagcaaccagcucucagggaaaugcuccaggaacuaagagugagaaguugcucauugcuacccggacagcacuaagccauucaugagggaucugccaccaugacccaaacaccucccauuaggccccaucucuaacaguggggaucaaauuuugacgugaggauuggaggcuauucaaacuguaguagguuguaaggcaguuauauguuuaguuuuuaagaaacuacuaaacugucuaucaagcgugacuguaucauuuuacauucuuaccagcaaagaugcaaaagcaguuuaauagagaaaggauagcuuuuccaacaaauggugcuaacgcagcugggcauacauaggaaggagggugauaugguuuggcuguguccccacccaaaucucaucuugaauuguagcucccaugauucccacguguugugggagggaccaggugggagauaauuaaaucacggggguaguuucccucauacuguucuugugauagugaagaagucucacaagaucugaugguuuuauaaggaguuuccccuuucgcuuggcucauucuuucucaccuccuuucauguaagaugugccuuucaccuucugccaugauuguguggccuccccagccacguggaacugugaguccauuaaaccucuuuuucuuuauaaauuaccaaucuucgguauguucuuaucagcagugugaaauggacuaauauagaggggaaggggggaaggaggaggggaaagaagaggaggaacagggaagcaagaagaacuuucacauaaaccucacaacuugaauaaaaaucaacacgaaaggaaucauuuuccccgcaucuucaccagcauuuaguguugucaccacuugucacucucauagaugugcagcgauaucucaacgugguuuuauuuagcauuuuccuuagaguuaaugauguagaacaucuuuuuguguguuuaucaguuaaauggcuguccaugucuuuugcccauuuuccaaaugguuugucuuuuuuguuguuguugaguuuugcgaguucauuauaaauguuagauaauagcccuguuuuggauaugugguuuucaaauauuuacucccagucugcagcuugucuuuuuagccucuuagcagagucuuucagagagaaauuuuuuaaauuuugaaguuaaacuaaucaauuuuuccuuuuauggcucaugcauuugaugccaaguccaagaacccuuugccuagacauagaucccaaugacuuuuuccucugcuaguuucuaaaaguuuuauuuucuaaaaguguuacauuaauguucaugagacauuuugaaugaauuuugugcaaggugugagguauagguuaauuuuuuuuccuaacuguacaauuuguugaaaagucuauucuuucucuaacugaauugcuuuuuuauuuuugcaaaaaaaaaaaaaaaaagaccagugggcauauuuguguaggucuguuucuggguucucuauucuguugcauuuaucuaugugucuauacuucugucaaugacacauggucauauaaauauuacaaguauguaagucuugaaacuggaugauagacuaauuccuaccaccuuauucuuuuucaaaucuguuuuagcuauucuaguuccugugccuuuacauaugaauuucaggauaaucuugucuauaucuacuaaaaauuguugcugauauuuucauaagaauuauauuaaaacucuguaucaacuugggagaacugacauauuuacuaugaugaaucuucuaaccugugagaauaugucucuccauuuauugagaucaucuuugcuuucucucaucagcauucuguaguuuucaccauacaaauucuauacauuuuuugauagauuuucauguauuuauuuuuguguguguguaaaaggugcuguauuuuuuauuugguaucuaucuguugauugcuaauauaaauaaacauaguugguuucuauaugcuggucuaauauccuggggccuuucugaacucaucuauuauuucuaggauuuuuuaaaaagauuccuuagacuuuucuagguaugacuuacaaggaagucaccugcaaaaaaaaggcuaguuuuacugcuuccuuucuaaucuguaugucuuuuauuuccuuuccuuggcucacugugcuggcaagaucaauaaugaaaguauuaaaaguaucagaacuugcguagggggcauaaaauacuaaaguguuuuccuacucucacacacuacucaacacuucucacaccagauucuccaacagacgcuaacuggguauccuagaauucaauucaguucacacauuaucuacccagagauauugucagauccaacagguuagggguucagucccacaagacagcucccacuuuggaugucaguuguguaccccaggcugugaagugugguucugacuggccagcuauaaaucaggauuccuacaaccuccucuucauguucaagaaauuugguagaguggcucacaggacucagggaaaugcuuuacuuaugcagauauacaaccagauggaagagauggagaggacaagguaugugggaaggaguguagaccuucccucucugggaaggugcccucucuacgagcaccacccuccaggcaucaucacacguucuguaagcuggaaggucuccaaauccuguccuuuucagguguuuaugaagcuucauuucuuaugcaugauugauuacagcauuggcuacugaugaucauccagaccuucagacccucuccccucccuagagucaggagauaaggcucaaaguucugaugcuuauaccacauaguugguucuccuagcaaccaguccccauucugaggcuaucuaggggccccagccaccaguuaucauauuagcauuaaaaaacacucuuaucuccagagauuucacaaguuuuaggaauugugcacccggaaccaggggcagaggccaaauauguuuauuauaucaaaauaucacaaaaguauucgaucuuccaacacuguguugaauaguagcggugagagucaccaucuuugacuuuuucccaaccguaaagaaaagcauucagucuuucaauguuaaguauguuacuuuuuugcagauauucuuuaucaauuugaaaacauucucuuccuuuuauaguguucuguuuuuaucacaaagugguauuaaauuucaccacaugcuuuuucugugggaauugauaugaucaugucauuuuucuuucuuagccugcuaauguguaugaaauuagauaauuuaaacuuaaaauaagucaacuuaaagcuguuagagcuuuaaaucauucugaaccuugagagguggcucugcagccugagucaaguggcaugcagcugcaacuucuggcuuuuuucuuguaaauaauuaagaagaccaagcagugccagggacaggacccccucagaucauuacccuuucucacagaguaauaaaguaaucuuccuuugaauguagcaauccauaaccaaucaaauuacuguggcaugugcacuggucuugcauggaaaauguuguaauccugcuggaacuucucugucccugccuauguaaaugaaaccucaacagcaccaaauugggcugcugauccauuuguguagagucagccgugacgauccucaagcucugcacuaggauaaacuccacauuuaaucguauucuuugaaccucauuauuuacgguugacaugcgguagauuccauugcugauuuucaaauaaacccuacuugaucaugauguauacuucucuuuauacauugcugaauucaauuugcuaacauuuuguuaagaaauuuugacaucucugucuaugaaggauguuggucugcaggguuuuuccuacuauuuucauuuggggcaauacaacuucaaaaauuaaaaaauaaaugaauauucuuccuucaucugagagugucuugauuucccuuucauauuugaaagacauuuucacuagacauagaauucuaaguugacaguuauuuucuuucaguauggaaaaaauaugaugccacuuuugccugccugggaaacauuggcuuuauuacuacugggcaggggagaaaguccuaauugucuauaaugccucuucugguaucaccccugaguggaggaaaagguacuucucuacuguugguagaggugaaaauccaggcuccccauguggacucguuaccacccacuggauaugagaauucuggcucucuacuuggcuuucuguaauaccaaccugacaaggaggcuggaguggcucauuacaucccagugacgauaguaguuuuggcucccacuuggccuuugcuguuggagguaggaguagguaggccacacguuuuucaauguguguaugugugguguuuagcuggaguaguacagauauuaucuaaaaauuuucucuauauugcuagacugccccuuucccaguccuucaccuacagugagcaggcuuucgcuguaaccuuuccuuuugucugugcccucugucagcuaaggguuacuagcuucuuuaguuccagggcugggauagcuaaggcaaaaacaacgucuagggaauucacuaccauauuguuucuugugucuccaggucucuagcugaucugacuucucuccaccucucagaauauuuuuaguuuugucuuauauacaauauucaggauuuuuuacuuguccuaaaugagaggaagaggaaaaaguacaccuuuuuccuagaagugaaaguccccuuguuuuacuuuuucaaaaaaacuaaaaucuuucucuugacuguuaucacaacagauccuaucaaagaagagaaauuaagaccaaaaaaaguguaacugagggauaguaagagaauauucacagcuuuacuugagaagaaaaaaggaaggguuacaaaguggggaggauuagagucaaaagacucaaguucuaauggaaagauggucagcuacuagccuugcaucucuaaauaucacuuaaauauucaggcagccccauauuuuguuuuguuuuguuuuuuccuguaagauggggaugauaucaccgaggugcccuuccacaguuguggucguauaagaugagauaggaaaugggauggugcuuugucaauuuucagucaagauauaaauaaagggcauguuauugcacuccgaugauaaacucccugccuacuucccacuugcuccaacaaaacccaguuguuuccaguuuguccuguguuucagcauugauccagcaacuauugauccaugugcacaaacuagaaauaugggaggcauuuuggauaccucugacucccccuauuccccaccagucaaaauaagaauaucacaguccugauguucuccuuccagauagcucucagauccaucugcuucacuccaucagcccuagauccagcccccauucucuuuuaccuguacuguaauagucaucucccaaguuucccugcuuccaaacucaucucuaaaaagcagcuagaucaucuuucaagcacccaaagcaucucucccgaguccauucuagauucccccggaucccuagaguucccauuugggcuucccguuucucaggagacuuaucuguucauuuauuuaaaaaacugaaacgguuuucucuuauuuauccuaaaauaaaauuuugaccugaaaguaugauuuuaaaacacuuuaauaccuuuauagucaacaaguaaauaauauuucauaauaggaaaauaauuaugugacaugucauauuggcauugcuucauaaggucaagggaaaagcuggacauauaaacuagagauaguguguuucaccauagccuuauguacguauuacuaaagaaugaaaacaucagccauaacuugcaaaucugcauuaugacucaugaaacaaguacacuguaucucgccaagcuauaauuacugacuaaaccuaaacuucuuuaucacaaacucauucagccucaugugcucaacccauacacauaaacucuguucuagaaacugccuaguugaucaauucugacccagaucuacuaggaccauuucauggcuaguucuagcucccaaaaccuucuccuacccuucuccaguuccuuuugacauaccccccaguuucccugguguugguucaccuuugcaacagcaagcucauaacaugacuuagaaucuaaaaauuguucugauacucuuuaacggguuuuagcaaaauaagugauuaggauaaacauugaaaauuuuacaccuaauuuuaacaguuacuaauauuacuucuaguuagaggagaaggacuacagaguagggagcaggguguagaagcacagauuacucuuauuuuucuguaaggacugaaguucaaacaauaaaaaugcacucauacauuuccucagaaauuuuaaaaacacacauuaaaugcuaaauauacauccugucaauuaaaaacuguaagaguaaccuuauaaaaggaaaaaaaaguuugcucucgggagaugauuaaauacccauauugacuaaauauauuuaaagugguuaugauucaaugucagacuaauauuuuugccucuacuuuaauugcuuuuuaaaaagaaguaucaggagguuccaauuagaaauuuaacugaaggccacuuugaaucaauaugcugugggaauuaaaugaugcuguuuuuauguuuuccuuuuugaagauauuggucauucuuuuuuuaaauuuuuaucucuaagaguucaaggaaagcuugguuuuuauugguaaggcaagaaaugcagcuucugacuaaauguuuauaucuucagugugggaugcccuucucccuuucucuccuccuggcauauuuaaucaacagaauauucacagaucuuuuaccuccuacaacaggccuacuccaacccugcauaauuucuccuaucuuagggccucugacauuuaucccgaaaaagacaacuaaauacuugauucuauguuuuaccauauuucuuuucuuccuccacaucucacuuuuuauuuuuagaaaaugccucuaaugcaauuuagugaucaucacagugccuaggacauugcuuggaacuaaauaacuauuuaaaagaaaaaacaaauaugguugauuaguauaagcaacuacuuugcagaacuuugaaaugugacuucccauuucaaagguugucuuucguauuccccagucuuccaacaaucauauuucacugacgucuaacacauauaccugauuugagaauauucugaggcugagcuccuuuaucaaaguuaauugguagaaagugucacucaccagaaaauuccaucuaauugaaaacuggacugaaauggcuaggcucaaaugggggcugaucuaaauuucucaucaagcaucacuuuaagguaucuuagacaagacugccuugagcuguaaaaagcuuugaugccaucagccuuacaccaggaucaaaaucaauuuucaacuuuuauugaaagcuuuguuaauaaguuucuccccuguucgucacaguuaugaaaaaccuuuaauauuuuuguugcaugggaauaaagcuaggaaggauguaaauuucagacaaauuggagguacauuuuaaaaauauugucaucgagacugacaacugccaaaccuggaaaccacuuucucccacaucaaacacacccugaaguaauggugaauucaaauugauaugcaagccugugacagaggcuaucagaagaaacuauuucuuuucaccucuaaaauacaauucacuaagcaugacauccaaauuccuauugucauaggcauuuucacugguuuagaagaagacugcaggacggcuaauguguuuucguucucagauaaggcuaauggguuucagcucucuugccaguuugauugccaaaugcugccugugacacaguaaagaauuuugaaguugcucauggacuuuguggaggagaguaacacagucuaucagcaacauuuaccaguauggcaaagcagcauucacuaaugaaucugagcccucucccguugcuggacccauggaagaccauuuccagagccuucagugcagcuggacagggccacaugaccaguucugucccacaggcugugaucaguguugaugugugccgcuucacagcccauaugugauuuucuaugcuucucaucccugaagccuugagauaaaggugccauaagacagcaguagacaaucgugcugagccaccccuuggaggugagcuguccuggagcaucaccuagaaccuccgcaggcuuugcaaggaugagaaauacucccaguugguuaagccacugugauuuucauauuguuuguuauugcauuauaacccaacccacucugacuucuacacacagcucucagaugagggacuggagacaggagugcccagcacuuagaggauuacagauuaauaguaaggaacacugguuccucuuacauuuaagacacccacaacaucaugaugcauuucccuccaaugagaugggaauucuuguacccuugcacagcuugcuuucauuuugaugacuacuaauugugaccugcaccuuggcucuugcuugucuccuuuauuccuucucuccuucuuuacguagacacacagauguucuagagcaugccugauauaucacacuaauacauuuauuaaguaucccuuugaaaagcaaaaugaaacauuacaauuucuguggcucuuuuaaaugccugugaacacacuagcacauuacauuuuuaaguauuucagucaaggggucacuuggguuagccuacauuuuggcaaguaaaucaacaauugcugccaauugcaucagaaagauuccuuuacuuuuagcagaucucuaccaggagaaaaggagcaaauguauuggcuuauuggagcaaaugaccaccacaccucaggaacaaaagcuuauacuuucacauugcuuacuagaugccaggaaacacucuaugagcuuuacugguaucaaugaauuuaauccucccaacaaccuuagaggucauggccacauuuacuccuauuuuacagaugagacaagugugugaguuuacaugcuuacaaaaagcacuuaucuuuuaucaucauaaaauagaguuuuuagauaaaacauaggauaagcaguuaaucuuuagauaaauaauaaaacaguuuuaguauaugugccauauauugcaugggacauacuuauucuaaacuguuuuuuacauuuaucugaaauucaaauucagcugggucccuguacuccuauuugcuaacucugggaacucuaaauuagaagcuggauuuaaaauuucaucaauucucaguaucuaacuuuauuaagcaaccaagcuaagcugauuguacaucucuaucaaacaaaguuaaagacaaguuuuuauuaaaaucucugaaucuaaucuacuauaaaaauaaaaugccaagaagauuuuuacuacaaaaauuugcuuuugcuuuccuacuacccagucuguggcaauugagaaggauacagacauugaauguagauucuguccguugucacauuuuauaucuaaauuggugaaaauccuaccacucgugucuguaagccauucacuuuguuuggauugggggcugggguuugcaagaaaacacagaauauuccuuuuuguucuuuuuuuuuaaacuuuuauaacaugggaccuguuaagacagaagcaugaauauucuaggucaggcagagaugaaaggacauaauaaauaggaaacacugcucucccaauguauccugaagaaguccuugucaaucauuuccaguaaagugaauaaaaaaugcuuaccauggcaagagcauacacugaguuugauguaguggggacaaaucauaaaauagguguagggugaggccaaauuuuaaaaucuaagguaccuuggaauaauauacuuccagagauucucaauaacagcauuuuaaauucuucuucucucuuccagguucuguuucaugcagggccaugaguuacugccaacaaguuaauaucuacucucggcuguugauucaacccaaacacugugcaucuccaaucuccauccaucaagggcuucaaaacaauguguuuaucuuucuacuuguugugaauauuaauaaauuaagaucuuuaaacugucuaggaagaaguaagaaauaacugccaagagcuuggguacagaugagguauuuacauacauuagagaaguaccauuaacaguaaguaauggugcuuuuacauucucagaaugcagugcaauagacugucgauuuguuuugaaggugucugcagucauaacacguaucucaugcuaaauggauacuuagcaauuuuuaauaauuuuaaacugaugugcuauuuaaugguuuggugauaacgcacaguuuuaugaagacgguuuuugaauuuggaauuuuuauugaacuugauuaaauuuaaugagacugcaucacuuacauucuaccuuaauucuuaauguuuauaaaggucacaacaacuaauuuuaaaaguuguauuuuagaaaagcaaauucugucaguuaaugacuauacaauuuaaaccauaauuccaagauuuucuaaagcuagccuacauguaguacugugguaugucuucaugagggguauuaaagcguaaaagucuaagacauaucacuguugugaaggaaaacaaauaggagaauuuuauuaacuccagauucuuuugacuuugucugacuuuugauuagaacuagaguacgcaaaacucagcagacuaugguaaagaggauuuacgucaacucaacuucccaagaaguuaaaauuaaaaacauaucuccccuaagucaauacaucccgcauuauuucacuggugacuuuagucccaauuuguuugaggaaacuaaagguaaaagagaaaacaaauuugcuuugaaggagucaaggcuauguggaauagaaaucucugcaaaaauacuuaacccagucuguagccuuuccaugaagcaaagaaaacguaaaacagauuuuggggcauucugacacgaauuacuaagauaucacuuauaugccuguuuuuagacugagaggcuccucaauuccuuuuucuuucugucugcgucauuuccaucaggaacaacuguucaacccuuacuuguagaucuucauaaugauucuugacaauacacgugcaaaauuaaaaugggucucuuugcacugcuugcaguauggcaagagaguuuacaaggcaauaauucuaaauauaaaauaaaaaacaaacacauuacaugauuuuacaaauuuaagggaauguguagaaggaguacuaaucacacuuggcauguuuaaaaauacacuuggugcucgucagugcucaaagaguacagucauaucguuugaauuaucaauaauaauaaaaucauggaggauugaucgugagaguguuuuccuucaucuuagccacaguaauaagaccucuaugcugcacuucuuuuauaauuaggcaaaaaucugacagaaauccugugaaggcagagguaguuauuucuguguauucuuuagacuuccacauuaagaaaaccaugcccccuuuugacaugacuaucucuuucuuccccacacaacaaaacugagaacauaaaauuauggacacaacugggcagcuaaaugcagacacgcugacugcaauaaggcucucaucucacagaggaggaggcaguacagcacucugucuccaguaaaacaucuccucaaaaacuucaaacuuucuuaacaucuacagagaagucuuaacagaaaagucaguaaauucgccugccacacaccaucuugucauuugaccuuugauuucuauaguucagcacucccuaauuccaauagacaagauucaaagaaaugucuguaauacuucaucugcccgaaggaagacagugagauaauauccacacaagucuugaacuuuuaaaauccauucucacugauacaggggaauaugaacuggaagaaggauugaaugccaugcuugaguuuuuaccaucaaauaaaaucuucaguguguuguuugacaaugauauuuacuuugaguguguuuuaaaaaaugacaccugcuacaaauaucauggaucuguauauccuugaugucucacaggucauaaaacagcaagggcaaauauuuuaugagcuacauugcauuguuguuuuguucccaggaaaagagguauuuucucaaauacuaagagaccagucuauuccuggggucagcugaagccaguguugacccuggacaaacacugggagagagcuguuucccuacuaugaugaucccuggagcucagaugcugucugugcccagacccucaaggcaaccauggccaagguagagaaggugaggacacugcucugagacacaugugguucggcacacacguguacugugauaauuguugcuaaugaugcugacaguagccaacauuuaccaagggaucacuaugcagugagcacugugcacagugccuuaugugcugacucacugaauccucauaaugucauuuggagguaaguacuaucagcaacacuacuucgcagauaagaggaaaacaacggacaguaaucgugcugcacagcagcaaucuugggaguugaacuugauaaauccaugcauuuauuaagcucaagucacccauauaaggagucagacuucagucagucucagcuccaccuuuacuauaaccuuggccaaguuacuuaaccucacaaagccucaguuucuucauuugucacauauggaugacaguauuacuugccuuacagaaaagucaucucaaacuuggaaagaggcgauugagcuuacugcauuccuucaguguagaguucccacuauugggccugacuuucuguuuacaggguuaacugacaacucucaggagagggaauaauuaguaugggcuguuacagaccaggaggacaucauccuuucuguaucuaacccaacacucuaccaaauugcacguauagguauagguauagguguauguguauauauauauauauauauauauauauauauaugccucucaaaugcucuuuggacugacuuuaacguuacauuggguccccccccaacaauuagugagcugaacaaaaucuugauguguucauuuuauauuugcaugagagcaugaauuugccuuucugccaacugucugaacacaacauuguuuuaagaauugagauaaugcauaugaaauguucagcauaggaccuggguuaccgaugauucacuaaaugucaucuaucacaucacuccuauaaucaucucuauaacugaucaccaaaaguauacuauuuaaaacuuuuaaugugaggaaugguuguuucuauuuacucauauucaaauacaaacagagaguauuuaaucacuaacugugagaauagcucugaaauuauauacuguuauccacagcuggggccacuuuaaaaucuggccuagagagugauuaucucacacaucacacacccaguacgaaaauggaguuuuuaagauauccacuuucuaggcugcuuggagccuuagugccgucaccucugguaaacaggauucauuagagugauaauugacaguuguuucccuuucuaagugauugcucuguaguuccauuauguucugucagggaagugcuagcaauuaauuaccaauaaacuaaacaccagcucugcuugcagcggaagguuuggaaccauuuaucuuggggguugagggagguguuugggagaggggaaaauccaccucaccaaauacauaaagugcuguguaaaaaccuuauuacaaggguggguggggaugguuagaggcucugggaggacaagagacccccauuuccacuucugacacuuugguauauuaaaagaaaaaaaccucaaaccagugguccaaaaaguaugguccauuuuaacauaggcuacuuugaacacuaaaaaaaauacacugcagaaugauuaugacagucccaagaugacgacaaaacuuuuuguuuaagccaaaagcauagcaaggaaauacucaaguggugugacagaggacuuuuuaccuucuauuaaagauuuucugugcauuccuucuacuggaaauaauauauaaacuccaaauugaggcuuuuugugaaacccugagauccaaggguuugagcuuccucuccucaguaagccaacagacucugaggucagauucuucugcaaaccaucugagauccuauaccauaguugcuugcuuccuuuccuguuuaacuuuuuuuuucaauauagaaccaugugguggcuuuuuauauagauccuggggauacauccucgcagcucuccaacuuccucuaucagcucaagucgcucccacagccacaauggucucuggguucccuagauucucacuacauauuacuuacuauaauuuuuaaaauauacuuaaucacacgugcuuucaguccacuucacauucgagugucucauuucauaagacuguagcuccuugaggacaaggacacgucuucacaggguaauuaacaauuacugagcaccugccugcugucuggaaucaggucaugcaggcagagcaggcaggcaagaaagcaaguaaacaaaggcaaccuuuauuuacuucucccacauuucucugccgugggaaaggcaagucaaagcugaaagaaaaaccaaaauggauuucauggauuucaggucuccacagagcccaugaccuguuauuugaaggcuuuugacccaccaguauguccaaacaucuguugacaucugccucucuguucugugguguuuuucaagggaugcuagguguucuucaaggucaaaagggaauggugcucucuuaaagaaacuggugcugaaaagaauaaggguuuaguuaccuggggcaagaaguagaacaagaauuggguggaggucaagaaaagccuaaggccaagugagaaagaccaacagaagcaaaggagacagacaaucaaugauaaauuucccccacccuaggccuaggggucaguacugauaaaagaggaacagaccaaaaaggcacaggugcaggaggugaccaguccaagccucuccaguuggcuucugagagagcuaacagcuacuggggaaaacuggagccuccaguccaaccuaaccuggccuuaaaaggcacaacccccaagacaaaagcacucuacguauuccugaaacacacaaggacacagauuagaggaaagaaagaaaacaaagggcucauuuacaaaugaaauuuguaauugaaauuauuuugaaauuuauuucaaacuuaucuacaugguccaagaauuagaugaguacaggggacaacuguguaugccccagauucacugguuauuauauuuuuccccaucugccuaucauuugugcacuuucuugcuugcuuucucucuguauacacacuauuuuuuccugcuuccuuugaaaauaaauugcauuuagcgcauacuucuuaaaacuaaaacuaaagauauucuuuuccaccccaguacaguuacuaauuucaguaaauggagcauugguacaauauuauauccaguccacugucuucuguuucucaauuuugucaauuaacccaacgucaucccuuuuggcaucuuccccucuuuaauauaaaauccaguauaggaucuuauuuaguguuccuaacucuuaagucuccuuuaaccucaaacauuacuuugucuuucuguuuucuuuuuuaacaguacaccuccaugccccaaaccccucuaccccaacguguguguguguguguguguuucauuuuguuuaaauagaacuauuccucauuuggggguucucugcuguguccuugaguuuagauucagguuguauauucuggacccaaguaccauauugguuaugcuucucaggguacugcaucaggagacacacacauaucucuuugcucaugaauggugaugugaauucugaucacaggucaagauguugucugguuucuucacuauauggcuacuguguuuuuccaaacacaagacugcuuaauauucugaguguauauuaggcaggcaaagaaucuagcucauuauauuuuaguuauacacuaacaaaguacgcacauuuauaaaagcuuacaguuguauuuuguuugucuaaaauaaugacacauuaggaccaaugcauaauugcucacucuguguugucuaccauucugagcuauaagcuuuuauuaugcaaaggcugugguuugugagcuaucauuuguaugggcuccuucaggcccucucaauaaaaugacacauacaacaaccaauaaacaugcccuuuucuuaaacauggucgggguggacuuucacauuucauagagcaucucagggcuguucaagcuaacagauauuugaaaucaauuaguccaacccacacauuuuuacaguugagaaaaucaagaccuaaggaagaaaaaaacgacuugccuaagguaauacaguauaauaguucuuuauaaacugaauuauaaaaucaauuuagugggccgugaccagcauguuuuaaacugaaauacaauuuuuaaaaaaaucugaguacuuagcauacagcaaggguaaacacuguuuggugaaaccuuuaauuauauauguguaggaguauagaugcucuccuguacuaaugggauaaaaaaaucuuuuuuuuaagauggggguagcccaggcuggagugcaguggcauggucauagcucacuauaaccucaaacaccugggcucaagcaauccuccugccuuagccuccugaguaacuagaauuauaggcauacaccaucaugccuggcugauuuuuuuuaaaaauuuuuuuguacagacaaggucucacuauguugccuaggcuggucucgaacuccugagcacaagugauccuccuugccuuggccccccaaagugccaggaccuuagccaugagccaccucacccagccacaaaauguauuucuuacugaauucugugguuaaaauccuuuaaagaacuccauuagaacuaacccaaaaccaguggucauucuaccaggaaaguguuuuugcaaaguuuagugugaaaacaaauaaagguugaaaugcagcuucugauuuaacaguucugguauggaccugagauucugcauuuccaauagguuccuaggggagaucuaagcugcuccugccagccuaucaacuaccuuugagaaguaugauuaaaaaacacugcaucugagggaggaccuacuuuauuuuuaacaacgccucccugaaguagguacuauguauauacauacguauauacacacacacaauuuuuuugcuaacaauuugaauaggaacaacuaauucuugaaaauguuuaaaaauaacaaaacaaaaccuuccacaaagaaucaccucaauucacuacagagaaaaugugcuaauugugaugguaauaagagcgcugguauuuacugguguucacaaugacacgcaugagaccgagugcauccauaacccaguugauucagguugauaugauuucccccagauuacagaugaagaaacagacccaaauuaguuuauuuucuccaaggucaucuugcuugagaguggagggacacagauuagcauccagccaauuaauuccuaaggccauacuccuaucauacucacugacucacagauguauguuauccacacaccuaugcacaugcucuaaacauuacauaugauauaaauacauauuuagauacgugcauuagcaccuuggcauacacuuuuauaaacacucuacaauauucaggagucagggaucacaagaggaaacuaauauguaaaaacccaguucucuaaaauuaggugccuucucaaguaggucaagcaaccgcauuuauauugucuacauuaaagggaucucuugaaaacagucacauuagcagaauacaggggcugagugagcaggcuggcaggggaggagugugagcaggcuaacgacuagagcuacaaacaagauuccaucaccuauaacuuagauuucaugugguauauuuaguucaaacccugucacuuuauacaaauagguugucacguaaagugcaaacaacucucuuuugacaaagugauacugcuguggugcuggguugauggcuuuauauuccacaaagcuuuuuaagugacaaaugauagcugagucuugaaaauauggugauaugaaaugacugcauaaauccuuucaggcuucccggggggagcaaaagcauagcauuuugcacauuaauuaaaaaagaaaaucugagaggaugagguuagaucuuucuaaucuugacucugugcaaacggacuuugaaguuacuggcacaaaauugagagauggccccagaaaagucuucaaaugagauguacaauguuguuuaaagaucaggcucaagugcugcucuuggcccaaaugaggccaggcaagggugcaauaauuaucucugcuagagacuguuggugcacuggcguugaaaucuuuugauauguuggauaaugcagauuuugugugcacacauugcuuucccaagcugucuacaucagugucauguucaaaugaagccgaauaguuuaaaaggcucgcuuucacacuggcuuuauuuagcuugcauaaacauuuucccuucaaucucauauaaagucuugcugcguaaaugcagcuguccugcucuugugucuuaauacagaucuuuacaaagaggccuguugggcaacauauuucugguagaugauuaauaagagauauaggauuucuuuuaaaaaaaaucaugcucugacuacagagggcaaauucauuacccauaaaucaaaaggaguaagggauuucaguaguaucagaagccuuaucuggcuucaaucugacaguuaacuguaggccgugaaugauuaaauaaaagucuaaguucacccgagccuggauaaaauaaaacucaaagcccagaaacuucaaauaaaauaagaaaaaaucauaauuuuucaccucaaaaggaaacugagaagagaaguaugaugugacagaaacuaugauuucaaauggaggguuucuuuuguuguuuguuuuucagaacuagacucacauuuuacaaaaggcucccuacccauaaggaagaaaguuuugagaguaaugagguugaucugaacuguuaaaaacuuucuaacugagauauagcaacauaugguguggcagaauaaaaauggccacaaaaucuuuaacauuccuuccauccagaagugaggggucuauguuccuucucccugaguaagguggggccacugaguauuuucacuaagagaauucagcagaggcugggugcgguggcucaugccuguaaucccagcacuuuaggaggccaaugcagcaggaucacucgagucccaaguucaagaauagccugggcaacacagugagagccugucucuauuuuaaaauuuaaaauaauaauaauaaaagaauucagcagaacuuacuaugcccaggccucaagaaacuggcauuucucuucaaacacuagcuuucaaauccugaauugcucuaagauaagaagucugccacccugaggcuaccauauuaugaggaagcccaagacagcauguggcgagagaaagggaaagaugcccacccaaccuccagcuaucugagucaucccagcugaggcuccagacauuaaugaacugcaguaagcuauucauccuaaugcccugugggaaucucucacccacaaccuugggagacauaauaauaauaaauugucuucagcuauuguguuauggaguaguuuguuacacagcaacagauagccagaacauacaauaaaaugggcuaaucuuaaguguauagcucugcucuuuugcauauguauacacacgaguaaccaccaccuaggucauaagacauguuuccagaagccucucucugacccuacccagacauuucccucaauaaacauccccauccuacccccacacaaauaagaaaccaguauccuagcuucuauuaugauagacaaguuuugucaguucuugaauuucauguguaggaaaucacauagaagguacgcucuagcauccagcuucuuccguucaacauacuaucugugaaauucaucacugcugcugcacagggcaguagaugguauguuuucauugcucugaaguguugcauuuuguaaguauacuacaauuauccauucugcugcugcugauggauauuugguugcuuccaguuuggggcuuuuaugaauaaagcuguuaugaacauucucauacaucuuccugguggacaaaugcacucauuucucuuggguauauaccuagaaguaaaguugcuggaucgcagggcagugcacucauuugguaaaguauuaguucauauuccaacuacucaaagaauugcucaucugggccacguuaucauuguuuucuccccuauaacuagcaaauauugaggcaaaaucaugcugcauuaaauuaagcaauuuaugauuuguccuuccauauugaccuuuccugacuaacuacacaauaguauuguucucaaugaugucuacugucaugaacaugacauuguucuuggaaaaauccuaucaggcaaagucaaccucuaaaauagcauuguaauaaauaugcagaaaugucacuuuuugcauuagcccaaagguuuuguauagcuuaaggauacaugcaguaagcuaacuauaaaaauagaaacuugacaguggggauguaugugugugucaaaauaauauuacucuuucuggguguauggcagaaaaaaugacacuacauccaccagcaugauuuuuauagaucugccucuuugccagaugucaccuuuuauaaacugcuuuauaaaaacaugacaguauaagugcaauaguguguuuauugcuugauaaacuuuaguaauaaacuuaggauagguugaaaauuaaagccuuagagccuauucauuaagcauuuaggacaagugaguaagcaaaaaaugcaaacuauuaaauccuaaauguaugcagaucaagccacuagcagcaagcacuauuucucaaucaguaugucuuauggaaauaucugccaguuuccuugucauugagcuaaaugcauuacagccacaucuaaagcaugccauuugcauugcuacaaauuugaaugaaauccagaauguuacaacugccacaggcucacucaaaacagauuaagucuuuuucaaaacuguucuguaacuuagcacagcauauuuuacauauggcaaaccaugguuccaacaacuacuuuucugaaaagacuugaaaagacuuuaaggaauuucuuaaaauaauuucauagcacacacucaauauuuugauuacugauggauuauacacagcaauguaguguggucugaggacuuuggauuaccugcagagcuuguuaaauagagcgauccuguaguccuuuccuaaucgauugaaauaaaaucucuggaacaagggacccaagaacuaggauuuuauuaaguaauuccaaaugauccuuauucacaauaaaauguguuaaccauagcuauacaguaaucuaauaaaaagaaacuuuacaggaaaguauauuggcccagaagggugucauuuuaagugaauaauguauucuuacauucuuagguucaaacuguuacucaacauuauauuuuuaaaaauucaaauggcuuauauuaguucauauuccuuuuuuuucuuguaguuauguaugaacacccacaaaauaaaaucuacuuaagaacuuuugaaaaucaaucccuauaacaagugcauauauaacuaaauuuuccugaugauucuauucauccuggacugacaauuguuaucuuuguaauugauaaaugaaaaaagcaguaaaauaaaacaaucccuuuaccaaauggucuauuagaauuccucugaugcucaucacauuuuuccacugcuuacuauucacccccagaucucauaaaauauuucaguaguuaacuacagcaaagcuacuaacaugcaguuuguguuggguggauccucacaaaagugaugcuaauauauuggaaauauauauacauauaucauuauauauaauuauauauaucauuauauaaucauauaauauguaauuauauauguguguguguguguguguauauauauauauauauaauauuuuccccauuaacaaaucagugugccaacaugacaacaaguaggagagacugucaaagcuucacaguugcuacagaacucuaguacugggaaguacuaguucaaaauuccauucugggcaaguuuuucuucuuuuuuuuuuuuuuuauuuugagacagggucucacucuguugcugaggcuguaguacaguggugcagucuuugcucacugcaaccuccaccuccuagguucaaguaauucuccugccuuagccucccuaguagcugggacuacaggugcaugucaccacacccagacaauuuuuauauuuuuugguagaaacgggguuuugccauguuggccaggcuggucucaaaccccucaccucaagugauccaccugccucggccucccaaagugcugggauuacaggcaugagccaccaugccccgccccauucugggcaucuuaaacaaaagcaaaaacaaaaaacccugaacacaucaugguauaaugcagugauaaagcaauguagggcuuuucuggacauuaaaauguuugaaaauaagcaccaagaaaaaaaucacauuaaggagcaaaaauuacaguaacugcuugccuuuuucuuuggacaucaaaagaaagaacuaacaaaaggaaagucuugcucgauuucugaucauuuuauuuaucuuauugugaaagaaacaacacugaaucaagagugaaauagaaaucaaccaaaugaaaugacagcaaaaguugcaaagaaaggcaucuggggggugaaaaaauaaauguuccuucacagaaagaaaccaguuguuuaaaaacaaaacagaacaaaacaaaaacuuacaaaaacacagaaauaggucaagcaaauucuacccaaaucccucuuccuuugggccuugucacaacaaguaaaccucaucagaggggucaagaccacaaugacugacauccugaucaugugaugugauggacagagaacuugacuccgagucagcagaaucguauaguccaguuugacuucaauacucauuaauucaccuuuuaaaaguuucugacucucugcauucauuuuugauugcugcuguaacaaguuaucacaaacugagugguuaaaaauaauacaaauauauuaucuuacaguucuggaagccagaaguacaaaaucaguuucacugagcuaaagucaaguuguuggcaggcugauucuuucuagagauucggaaggaagaauggauuuccaucuuuuccagcuucuaguggcugccuauacuccuugguuuguaguucuuucccucaucuccaaagugcauccuccaguuuccgccucuguugucacauggccugcucucugauucugaccuuccuccugccuuccucuucuuacaaagacacuaugacuacccugcacccacccacuuuauccaggauaacuuccccaucuuaagauucuuaaccugaucacaucugcaaagucccuuuugccacauaagguaacauucacagguaccaggaauuaggacauggacauacuugggggccaucacucagccuaccauaaucucuuuggauuuucuucuuaauacuaguucauucuuuguucauuuacucauccacccacccacucacccaucacccucacucuacaggaguuggccacagcuucccgacuaguauggcagaacaaaacgguguguuguaaaccuucaaaggaucugcugacaaguucugaucaauauguauaauugauuuuugcugcaacagaguacacauucugacagggugauguuuuuaagggaaaaaaaaaaaacaacgaacagaguagaugauggaacgguauauagauugggauaacugacugccaguaaaagggcagagacauugauucacauuaaggugggaccaaagaaauguaucagguuuucuggaaugugcagaacuguguuuacaggaagauacagaaauuugucucaugagcacauagaaguccgugaccagaacagcaaacagcccaacucaaacagcagcacagccacaaugaaaccgcacaaauaaagugaucaccguggaagcuuccagagacacugaggggggcuguuucuccccagcagugguugcacuguaauuaccauaguucguuugggguugccgacuuuuggucuuuucaugccaggauggacuccugguucugaggguagaaucaucuuucuuuaauuucaugggaagggguaggguaggugccuacacaaaacaggguuuuaucaggaagaaaaacaggaaaacgaccuaagaggaugcacaauagcagcucucacaaaaccgcagucacugggggcucuuucaguaccucaauuuaaagcgcuccguaggaugacaacuuauaucuuaauuucucccacacaaaaucccucuaaggugaguuucuuuaggcaccauccagaccacauuuuaaguuacaccauuuaaaauaaacuuuuuaaauucagagaaaacuauccaaguacguugacacucuuacguuguuuauguauaaaaacaauuacaacguuaagcuuccucuucauuucaaauuuguuuauucuuacauaagcuucuagacaaaagcauacucucugaaggaaaacuggggcagauggggguggcgcaggauagcggcagcguuauugugacuagguggugguuaagaaaauauuuucaagacaacaaccugaaaaucaggcuuaagugccagaaguaaaccaaaaagaagcaauagcaagugacaaaaauggcuaacuggagaggaaaaaaaauaggauuucaauuaaaucauaaacgauggcuaauaaagugcguuuuaacagcuguaacgcuaaacauaaugcaucuuacucuguuuuaauucaaauauuaauccuuguccaaucacuguaaugggagaaaaaugguaugcucugaaugucacauucgaauuggguagcaauuaucuuccugguaucaaugucagacauucacauaaaucuuuaaaaaaugauaaacuuacccaaaaacauccaaucaaauaaaaugaaaagauuucuauaaaacuugugcuauaauuuauuuaaaauuacaaguaacauaagaaagauggauaauuacaauuagggagauauaaauuugaaauggaggaacauauuaauauuuuaaucuuucugauaauucuuuaaaauuaccuaauauuuuuauaucagcaaauauugccucaaggacucaauugaaacccaaaucguaaugaucacuauuuaacuaauuuauuaaauaaaacauguucaauuguacacuaaaucaaaugacauggccaucauaauggcagagcuacaaauuuuaaugagacugaagaaaacaguaaaaggucuuugaaccuguuauccaugugaucacagauaccgaaaacaugcuuguuucucuccuuuguggaggcucagggacuccccaacucuaagcaacaguuauaauaauauuuacuacgugcuucccacccugcgaagaauggacaggcaguaucucauuacauucugacagcaggccagguacaguggcucaugccugcaauuccaguacucugggaggcuggggcaggcagaucacuugagcucaggaguucaagaucagccugggcaacauggugaauccccaucucuaaaauacaaaaaauagccaggcgugguggcauacaccuguagucucagcuacucaguaggcugagacaggaguauuguuugaacuccggaggucaagucugcagagagccacaacugcaccacuguacuccagccuggugacagaucaagacuaggucucaaaaaaccaaaaaaaauucuuauagccaccuaaaagguuaucuucacuuaagagaugcauaaucaggcauugagggguuacaaaacuugcacaagaucccagaacuaaggggcagaggaacuccaaagccuguaggagaacugcugaaaucugaggaucuccucucucuguauauauuuaaaauaugauuucugucucagucuauugaagcugcucuaucaaaaugccuuaaauugggugauguauaaauaauagaaauuuauuuuucacaguucuggaggcugagaagcccaagaugaaggugcuggcagcuucagagccuggugagggcuugcucucugcuuuaagauggcgccuucuugaagcaucuucagugguagaaggggcaaggaagcucccuccaaccuccuuuaagagggugcuaaucccauucaugagggcagagcccucgugacuuaaucacuucccagaagguccuaccucuuaauagaaucauguuggguauuagguuccaacauauaacuuuuggaagaacacaaacauucagaccuuagcaauauucauccaugcuucucaacucucauuuuacagcagaauuucccauggaauuuucaagaaacacauuuguccagguacagcccauagaaauaccgugggcccaacagcuuauuuucauuaugcuuuucugggcaauuaugaugccugcucaauguguggaacuccugcucuguguauuucaggagauccuggaguauauuagcacuaaaaugucucuuuuucuaauaguaguacaucacauugguuuuauaaauacuuauaauacaugacauacuacaaugugaaggugguuuugcaugugucaucacaugugacaucccauuaacuuaccaagagucacagggaaagacuuguuauuauacccaauuacaguuugagucaauaggcacaaaugaauuaucaacuuuuugaccuuggaggccaucuccaacuuuauauuacauaauccuuuugcuuuauuaacaagaagucuaagguccagagagauucacugacuuuuacagguucacccaguugguaaauaagggcaccggacaagaaaaacaagaauucagcucccacaacugauaugauguguuauuuguaacaccucacccagaaugucuccagccaccuuucuuugaaaccugcacuugcacuguuaaacugggaaaagauuaauaaguacaaucguaugaucacauggguagucacaacacuguaaucugagaaauaaucauuauagaugauaaagaaagagguagaggaggaaguacuauuuuugugcccuugauuaucacauuacaaagacagaaacugcgacgacuauaaaagaugaucagaggaaaugauaucccaaauuugaaccgucugaauuaugaaaaaaauacaauguuuaacuagaauguucccuaaacaugucacacuuugaauaaaaggagcagaaggacuguauagaagacuggcaacaaagacauacaggaaauguaagauucacuauuuagguaugaguuuagauuuuuuuguauggaaguagagcauucuccccacccuuucuccuacuuccaacuuccugcaaaaauccuacacagaggcaaaauauauaaaaugucuuaaaaccaaauuguuaaggcccugucuccuccuacuggggcccaaaguaccuccucccucaaggggacgcagggcucccaggacaccaccgggaaucacuguuucacauucaugaaauacguagucagugaugauaucuacauaacgucaagcgucuaagugcuugacuaaauuuucccauuauuuucacuuugccaacuacauggauaauaaagaaaaaaaugagaauuuuaaagcuaaaagacuccuacuggccaauuuugaguacuuccugaggaugagacacuuuccacauaagccgguuagagagaucucagugagccagugucccaacagaacauggaaaaugaagcccagggaggucauacaaccugguauaugguacaacaucgcccugcaggcuggaaacaaggccaggucacacugagguuuccagacuccacagggagaggaggaaauccuagggagcagauccccaucuguguugaucuucaugauuuugcucacaucccugugccuccuguacuaucauuccggucugucuucuuuacaucugcucaguuccuccuuaaauuacuuugacuuaaauggaaacauucuaucuguaccauaaauggaaaaccaguaucacuugccacagauagacagcuaacccuguuaaccuugaaacaaaaggauauuaaacuguagccggaagggaucccugccugaggcucugagccuggggccugcccacgcuuuguuauaaggaagauuagcaaauacuagaaaggugagaaagcuucccccuggcuaaugagaaggguugaaagaaaugaaagggaauaacuucccaagcuugccagaaacaccaagguagggcaguuuuuuuuaacccugcuuugaggucuagaauccuuuguugaaaugaaaucuuauuaacaauagaagcaauaaugaugaugcugauaagaaacagcugguuguauuaggauacaccaggcauucaaauacaaguaaacucaguacuuagaaguauuaacucauuuacuccucauuaacaaacuugugagacacagaaaggucaaguaaugggccccaaaucucucugcuaguaacagccaaaacccugguccuauaaccccagagucccuguuuuuaaugaccacccagacugccccucaagauuccaguuacuaaggccgggcgcgauggcucacgccuguaaucccagaacuuuggaggcugaggcuggugaaucaugaggucaggagauggagaccauccuggcuaacauggugaaacccugucucuacuaaaaauacaaaaaaauuagccgggcgugguggcgggugccuauagucccagcugcucgggaugcugaggcagaagaauggccugaacccaggaggcggagcuugcagugagccaagaucgccaagccugggugacagagcgagacuccaucagaaaaaaaaaaaaaagaauuccaguuacuagcaacugacaauagaguugugguugaaaagggauuaaggagcuaaaguguuaugcuaagcaugguuaugaacaaaaggcagaaaaagaacaaaugcguccacuauauggcuugauuugauuacuugaaaauuauucauuuguuuuacucuuuagcucuuugcuuccuuuaagguaaucacuuuuaacccucuucucauauuacuuggcugaugauauaccuugguguacuguuuucuuuauuugaacaaauaugguuacugugccaguaccuucaacagauucaaaucuuuuuaaggguaaaaaggcuuuucuauuuuucuuagacuacaaauaaugacuaaaguaauucaaugauaaugagcauucuagauauuucugaagguuucugaaggucacacaaaggugacuguuucuacugugcuaauauaucccuggaauuuucauucuuaauauuuuccaaagagcaggucaacacuucacagcaaaaaaacagagugaaagagaaaacaauuuuuuucauauuauucauauauguuuuuaauagaugauuaaagaagaaaaacauacccuggaaauguagaaauaugaagccaugcuacauauuuuuauaauuauguuuuauugcguucuguuaacuggccagaggguuuuuaaaaugccaaaagauuccaaauuaaauuaccauuauuaagccccuuaagccucauauugaguuuagacugucacuaaaaacuuuugauaaauuaaauaauaugcaguaugaguauuagaguuugaaauguuuaaaaguuucuuuacacaucugucagcauaaccuaagacauaaaauggcuuacauacauuuuuuucaaugauaguguuuuguuuucaauuuguuuuuuagaaauguaauuaaugaaagcuacagagcaauaaucuagcaucuagaaaugccuucagaguuggguuuuuaaacucuucucuaaauuuauucuguugcuaaaaauacauucauuacauuuuuaaucuaacagguuuuagugaauaaaacaaugauguagauauaaagcuaaauuucuacaguacaagacauuucaaacaucauaaaccaaggcaaaagaggauuuacaauacagagucaaacuacaauggacacuucagaauaaaauucagucaguguccucugcccugccagcagggcauuuacuguaguggagaggaccaggaaggagauucgcuuuauaggauaaucauguuauguuaugcuuuuauugaaugcacuuacauuuuggacuacacaauuguucuugaaauguuuccaaauguguguaaucaugaccgacgugauggcagggaucuacuuaauuuccgcauucaaaggggaacaugaugcaaauacuaucaagcgagggcacuuccugucauauaacacagaagagauaagaacuugaccaugagcuggcaauaaauucaucaacauccuaaaccagcagucaguccccaaccuuucugguaccagaaacugguuucauggaagacaauuuuuccacagauggggguggaguggggcuggcagggggguggugaugguuucaggaugauucaagugcauuacauuuauugugcauuuuauuuauauuauuauuacauuguaauauauaaugaaauaauucuacaacucaccauaauguagaaucaaugggaguccugagcuuguauucuugugacuagcuggucccaucugggggugaugggagacagugacagaucaucaggcauuagguucucauaaggagcgggcaaccuagaucccucccaugugcaauucacaauaggguucacauuccuaugagaaucuaauccugccgcuaaucucacaggaggcagagcucaggcaguaaugggagugaugggggagcggcuguaaagacagaugaagcuuugcucaauugcccacugcucacuuguugcuguguggccagguuccuaacaggccauggacugguccaugacgcaggggcuggggaccccuguccuaaaccauguuugcuucugcccccucacccuuucccagagugaaugguaauuacuguguacgauauuuaaaaaauggacgauguccccuuaacaguauuuucugccugaguccagagcuacuaguaguagugacugcugacuaaaggaugaagcuggaguaaaaccuuuccugugcugugacccacaucuccccauugcugaagaagagaaauguaaaaaugcuuucuggaagaagaauuucacaagguuauguuuucccucagcuuuccaugaucacaguaaucgaaaaauaacacucuuaguuuacagauuucaauuuggcaguaucuggcaauguuaauuauauaaaugagaagagagagauaagaggugggaaacaggaagugaaugccaggaaaaugaggauccaggucuccuccucauggaggucguccccaggcuuccugcaccagugacagcaccugccaaccacaacauuuccuaggcuucuucccugauuuauuuucucccuagagcuuaccccucuauaacacagucuauguuucauauuccaucuucuucaucagcuucuuuaucccccacaacaaaaugugcuccaccagggaagggguuugaaguuguuuuguucacugcuguguccccaggacuggaugacagaggaugcccaccuuauuuaccaauauauucccagcaucuaguccaagggucugucacccuuuucaguaaagugucagagauuagcuauuuuaggcuuugcaagccauacaaucucugcugugcagcuacuuagcucugacaccguagagcaaaaacagccauagccaauaaauauauaaauaaacgggcauggcuauguucuaacaaaacauuauuuacaaaaacagccagaggaccagauguggcccagagcuauaguugccaacuccauuguagaccaugucuugcauauggugugugcuaaauauuuaauauuaugaaugaaugugauaacuccaaaccagccaacccuccuauuuaucauuccagaacaaagaagacucucauaaaagacaaccacuaccagauguuuuaagguaacagguauuaaaagcagaauggguaaguaaaacauagaguuuguccucagugacuggagauggucucugcuguccugacuaaaugaccuauauuagggucccagugggaaccuaauucaauucagaugguucaaaugaagagacucuaauaaaaggcuuauuaauggaggggcuggcaggcgaaggaaacaagaagggagguggaggcacucagacaagagcaagagcaggaggucauggcaucccucaaagggcaaggggaggccacagugaucccagagcccugugagagcuaaaacauggaggaaggacuaucaaugucaaauguaaugcucacucaaucagggaagaagcaagaaagagaaccccaacuuccuucugcuccaguccucugauuuucagccuagccaccaugcuugucaaucccagauccaauccaacuguaagggagcacaggcaauguagucuauuggaaaaguuggaaagggcaggcacugaacacagaguaaggcaggaaugagcagagacagggaucuagaugagaguggcagacugagcaacuaacacauggaucaauuaagaucaaaacaaaaucauuguauuaguucauuuucauacugcuaugaagaaacaccugagaauggguacuuuauaagaaaaagagguuuaauggacucacacuuccacauggcuggagaggccuuacaaucauggaggaaggcgaaggaagaguaaaggcaugucugacaugacagcaagcaagagagcgugugcucgggaacugcccuuuauaaaaccauuggaucuugugagacuuacuaacuaacaggagaacagcauaggaaaaaccugcccccaugauucaauuaccucccaccaggucccucucacuacaccuggggauuaugggaauuacaggauagauuugggggggacacagccaaaccauaucaaucauccuacugaguacagaaaugaaaacuucagauuccauacacuugacauagauuacauaaaagaccaccaauaauaagauugugccccaccuguauacaaugagcuguuccaagccaaaaaugugucuugauuaaugcuguggucuuuaccaggagcaguuuucccacccaggucacagucuucacaaauuggaagcagcauuaccucuagaguaagcaauaaaugaaaauggugccuuuaauuucaaauuauaagguaacacacugauggauaaccauagcaugauuagucgauucaggaccucaauacacaauagaagaauccauccauuaucugcucaaaguaauucuuucaucccagcaacuuuaacaacaacccaggaaaauuacugucccuuagcaaagccuuuugaauuucauauggauuuaauuaguuaacugccaucucaaggaugagaaccaugacaaauaguuguucuuuucaaauuagaagaauagacuguucaaugagcaauauugauguuuccccucaccuauuuauacaagagauuuucuacuuuuuuuuuucuaauuuagcuaaccauuuuaacauuuaucgaagcuuuugugaucacuguucucuagcugaguguucuagccauuagccauuagcuuuaaaaaacagcugaaagcagccucccuguguacagaaaauaccguguuccucacuagagaccccuggcaaucugaaccacuacuagaggauucuaacaagacauucuuuaccaguggacagaaaagcaaauagagaauauuguucaaugaacaaugcaacuacuaaucauaacagugcuguaucuuaaccuguagucaugaaccuaacccagcugcuugaggcaagcagaccccucuuucuuuuuaacuguggaacaaucuauagcaugggaaauggguuaagauuuggaaaagaaguuaggugaguaacuagcagcagaaagccaagcaccguaagacucuaccuauuccaucugcauuccugccuuuucucaaaaagaucucaaagcagaaagaagcaaucagaacaaagccagucagcucugguagcuugcucuuaccucuauucuagcuacaugucaccuccugugagacccucugccccuccagacaguuuaagaaacuucucagaagacuagacacacacuuuguggcuacuagugaacaauuuauauguguguuuauauuucuacagaacuuugaaaaagacuugcaucuauaugguaaguaaaugcuccugauguagaaaaaagacaaacaggaaagacaaaaccauuuuauuugguaucaucaaauuaaaaauuaauugccccauauguucaaauaauaacuuauagccgauugugguaauccaacauauuggauguuggcuuucaugaucucaccaauacauuuagcaaauggcuguggaaucuggcaauaaaauauuuccagucucuaagucuucuugauaauucacucuguguuuuacaaacaacugggcucccgggauucuaagcacaucacucagacugacagagcaaguauuccagacaauugguuccuggagggucaagacagcaaugcucgaucaggauucaaacgggucauaaacccuucauggaucucucucaaguggguggugaugucucccuagggcugcucaucauuugcugcuacagucaagcacuugucauuauagacaaacaccccaucagucuuagguccucauccagcagagucuuacugccaccgguggagacaaccaccgguauaaagaaauccaaacaaaaauucggcaugugugcccauccaggcaugacuguucacugugcauuucacuucuacgucugcacuuucagcauggccacgaaacucagcaccuguuuaucugccaugauuucaggcauccagauuguucuggaaccauauauaucaaaagcucuaaaacaccaaacccguuucuagaaauuuauccuaaggaaauaauuggacaaaugccuaaaagauguauguacaaggugguucccugcuguguucuuuacagaagugaaagacuggaaaugcaucaaucucaguuugguugucuacagaacgggauugcaaaaucugauuuacacguguuacaauuacaucuugucaccuaaugccaggagcagacuauauauggcuuuaagcuaaaggaacaucaaagucaugagugccuuggaaaacagagacaggagugugcauauuuuaaagcagaagcucccaaccacagucuuguucacaucccucaguucuuugaaaggcagccagaccuccauuucuaagggacaaaugugaccacaaccucucccuuuucaagauucuuccaaggcuuccuccugucaccagaauccccugcauaucuuagcguggaguugaaggucuugugcaaucuuaaguccaacucaccuacugccacuuuucuccucaccuacacuaugcucuagacacucuggauuucaugaaguacccuuaccuccaggccuguguacaugauguucauccauucugccuggaaugccuuucuuuacucauccaucagcuuagcuagccuccuaguuucuugcaccucucagugcccuuuccugauuuuuuuuuccauucuuuccauggguggauauagguuccccucuccccacaugucccuaagugccaaguuucauguuuccucuauacauuauaacugcccuuuucauaucucuuucccaucagaccuuagucaccuuggggucaggaacuuuggcuuauucauguuuuagaugacaaagaacacaauuuuaggcaaucucuaacucugcccucaugccugcccuagguugggaagacuugguagcuucuuugucacuccaauucuuuaacauagaaauauacucgguccggguaugguggcuugcgccuguaaucccagcacuuugggaggcugagguggguggaucaccugaggucaggaauucaagaccagccugaccaacauggagaaaccucguaucugcuaaaaauacaaaauuagcugggcgugguggcgcaugccuguaaucccagcuacuugggaggcugagguaggagaaucacuugaacccaggagguggaaguuguggugagccgagauugcgccguugcacuccagccugggcaacaagagcaaaacucugucucggaaaaaaaaaaaaagagagaaaagaaaagaaauauacucuacugacacuccaggaagcaugcccuaagaucuguaccucaugauucucccacauuauuaagguacaauuguccugaaugcacuuguccuuccucaccauuucuguguaccauguacacaaaaaugagggguguauccaacaagggagcugcaaacuagaacaagugccacuagauucuuucauuaaugcuaauuaaauaucuauucuauacuagguacuguccuuagcucuuuacauauauuaauuuauuugguauucacagcuaccccagaagcaauguccuacuauuaaccucauuugagauaucagaaaaugguaugagagagguuaagaaaauuuucuacuaucucaaaacuccuaaaugauaaagccagaaguugaacccagguagccuggcugcagcaucuguggcacugcugccuuuccaaccuacccaagaugacugagccuccuggccugaucaaggagguaugcuuggcuauagaguaucugcucagacacuagaguaucuacgauggaggaaaauucgagcagacaguaucaucacagaaagaaacugauuaugaaugaagaacgagcuaggugucaaauggacaugcagcaacagaaauagacaaacuagcuggaucauucuuuuccccagagggcugugggaucuaggaauggguguuaaccaucacacuacuucugaaucucauauacacagguggaaccugugggaaccuccaaaagacugauuuucccucuuaaugcuauuauucugucccuagaugugaaaaggcaacuauuuuggggagaaucguuuucaacaauaugaggcuuuauauaaccagcuucuacucuucugagccaucccuuccuugauuucccccaccacuccaucccuaucacaaccaagaauuuguucuccagaaacaaagaugacagaaaucaaguuagggacauagagaugcuaucacagccaacucagaggaagauuuuugcccucccuuaucucaaaaccugcauuggccgacauugugucugcuccuagacaccacuuaacgaaagacuuuaaaaacuuuaggaacaauuuauuuaaagaaaacuccauuuccaguauacuaugacuguauuccaagguaauaaaguauaaaugagaacaaggaacaagcuaauaaacugaaaugaaggcugcauuucaauaacaagguuugggagccauuuaccagccacguguaucucacucucaugacuuauaacauuggcugaauuacuuaacagaaaugaaagcgcauauugcuucuguuauccaaugcugaacaaugugacauuugcuucagagcacuuguaucuaaucgauacauaaugcuaaaugugauuuaaaaucaauuuaauugugcucuugcucucccaugagucaagggggaaacaaagguaucauuugagauaugaaaccauuaggcuauuucccaaagaaaucauagaucccuugcuucuaauggagcccaagaaguagauacaguuaguuuacacuaaaaacuccacaugugaaaaacaguauugcugaaacaguuaagauacugugcccuaaaaggcauauuugaacuguuuuuuuuuuugaauuacaaaccaauugaacuuuuaaaaacuucuuuauuuguugugaccuuucuacaaauuauagcaaauuuaaaaagaaaaaauauaauuaagaaaaaaacauaauauugcaugucauauauauacuuacuuuccuagauuacauacuuuuaaaauaucuguauuccuacauauugaaaccaaccaaauugucccauagagcuaauguguaugauuuauuuuaauaaacauagaaauugauucucccagucuuaaaacaugagaaaguuauguuugucuuuucugaguuccuuucucaagaaaccaaccgucaggccucccagauaggaucaaggagcugaaacucaccagauuacuguauuuggacaaugagaugucagaucccucacccaucaugauugccuaacagaccaccugcuuccuguugaucaacuucucucccuuaccccucccuaauuccuguuuuccuacacaugguuacauuucuucucugccuacauaaaccccucauuuuagucagugagagagauggguuugacacugacuucccaucuccucaguuacagcaugugauuaaagccuucuuccuuggcaauacuuguugucucagugacuggcuuucuaugaaacaaauggaaggaccuagacugaaccccugguguuucaguaaccauguaauauuuucuauuauauuguuucucugaaaauaauuguauaguuauaugcugagccaauccugaguguguacaaagauuuggacuuggagucacuucuagcauccaucugccugaccaacaguuacugaguccccaguuggcacaagguuguauuacuuauacucaaggaaaugaggcucagaccaauuuuaaaggagcaaauucaggacucaacuaauaauacaagagucucuagacuuuacuuuauaugaggauguuuaaacaauccaaaacagucaguaaguuccaccugaauugcaguacuuggguugagugucucacuuuuaaaaacugauguauuggccagcacagugacucacaccuguaaucccugcacuuugggaggccaaggcagguggaucaucgaggucaggagcucgagaccagcauggccaacacagugaaaugccaucucuaacaaaaauacaaaauauuagccaggugggguugugugugccuguaaucccagcuacaugggaggcugagaaaggaaaauugcuuaaacccaggaagcagagguugcagugagcugagaccacgccacugcccuccagacugggcgacgccugggcgacagagagagacuccaucucaagaacaaaaccaacaaacaaaaaaacuauauauugauuaaacgaacuaucugugauuaauguacagccuguguguauuuuuuuucuaccugcauucaagaaauuguauggcuauaguauauaagaaacagaaucuuuuuaaauuauuuuccuaacaacaacugaaaauagucccauacaauguacccaacaaaacuuccuuuuucaaaauuugcuuuaaauggacaaaauuauguaauagugaaguaaacuuuuauuaaaaagaccaaauuacuaguugaaguuaauugggauaggguuguuuuauaacacuauaacaaggacauucacacaagauaaucucugauuuguaaaggaaaaaauaaaguaguucacaggaaaauagucaauuuuauggcucuuguguuuaaauagagggaagaaugucaaaauuccuauaaacuuaaaauuuaaaauaucuucagaaguugccacaacuuaaaaaaaacuugaauugcaccaaaaauaucuagaaaaauuuuaagcaguaaguauauucuuauaaacauccccauauuauuguaccuugucuucccccuugaccaagguuuuagacuaaauucaguugacaacagguaacauagcugauaaacugaagaucucugcuuggcauuugauaguucaucauuuacaugggcaaacaacccacauaaauucaaacacuaugauucaaacauacagauucaaacacuaugccaggaaugagcaucuacaguguaugcgguucaggaggguaaccaaucaccacacaucaucauuggguacuugauacaggguuagcccaaaucgggugcuguguuagauauguccuggauuucaaagacucagcacacacacacacaaaaaaguaacacaaaaaccucuuguuuuuauauugaccacauuuuaaaauuuauuagauauauuggguuggauaaacuauauuaaauuaauuaugccuguuucucuuuacuuaaauguaagaauuacuuuggugaccuacuuucuauuagacagugcugguaaagaacuuaaaaaaaaugguaugcuccaaguuaccacuaagaaaaauuuuuaaaaauacauuaaauuaccaauuacauuuuuuucucagaugaaacaugcauauguuaacacagaacauauucugacagaucugacagaaaacaugaaaaagugugcuuucuaucauaaugauuauuuuucagauaacaacagcuguuggccuguacaagcaagaagcuguuuuuccacauacuaccaaguauuagcauucaaucaugaaagaaaacuaauucuccaugggcucucuccacaugcuuuacaucagcagcaagcugugcacuccuauguaaucugaaaagccgaaccaaguuggggcugcuucuuggcucacugcuuugccacuucucucuaauauggcaaauacaaagcacucacauuuugcugauucagaaguaaaugaaacauucaagaccugcacaaaaacccugaccaaaaggaagucucagacaggugagcgccauuuuggcucuucuuuaguuacaaaggagauuaaaaguaaucagucucuugaaugccuaugaaaagagugguuaaaagucagcuguuaaagaauggcuuuauucuagaacacuugaacauagcccaaauuuuggaacuugaaaauaguuuaaaguucccuuauaaauuucaagaucucauuuaucacauuuugugcucaagaaucaccucagcugccaaaaucuaaauagaucugugcuauccaauaugguagccaccagccacacauggcuauuuaaauuaacaaaacuuuaguuaauaaaaauuggaaauucagguccucauuguccaugaccacauguggcuacuggcauaguagacagaacaguggagaacauuuccagcacugcagaaaguuccguuagacagcauugaauuagauaauaacauacaguaaguuagcaauucagaaaacuuaaagagagaagcaaauagggcagaggaaggcaugugacuagaaugcagacuaagacuauuuaaaaaaacucacugcaguugcauuaugucaaaguaagcaaaaaaaaaaaaaaaaguucuuugucaguuugaugaguguaucuguuaugcuugaagauguagacagagagaaaauaaaaucaguggacagaaauuucauuuauauauacugguuacguacuugccacgaccacacacaaacuacaacacagaccaaaauucauuacugaugaauuaugguuuugcuuuucuacaagacggagguaagcuuggcaacauuuauucuugggcuaaguucacaauugagacaacaauucuuuccuuaaugugauaaauuaugcugcucuacauuagggaaugcauacuuuuuuaucgaaagguaggaaaaaucgcaaggugugccuucucuauuuuuuuuuuccgcccacuaggaagacaugaaguucuaucagggaguuaaaacaguuaaauaaugguuaaaagccugcuucuggaaucugaaaaacucgguuucguggcuuuacuacuuucuagcuauguaagcauguguucugacugucuccucaucucuaaaauuuaaaugaaguaaugccugaauaauucuugguacacaccauuucuaauuaaagggaugcuuaaugaugcaaucauucuuccuuugcugcuaauuacuaauuuugaaauacauguuauguuuugucaugacacauacaaauaagcauaacuuaagugacaaaaccauaaaccuauggcaaaaauaccacagaccacucauaucccucagaggcuuucaugguggacaaguuagccgugcugucucguacaccccacugcacugaguugcuuugauaaacugaguuaugauccugggagagaguacugaaauaagacagacacacuaaaggcuucugggaaaccacaugacauacagguguaccugggguuuccauaaagcccagagauggcagagaaagacucuugggggacuggaaugucugaaaaucccauaaagaaaacaguuugcauuccuggucacuggguacaaucaaacucaggaaguacuuuguaugggcaccgaaguguauccuggaauacacagucacacauuacuaucaagccugggcauuuuuaccaguucgaaaaaucgaacacccaaguuuccauuuguaagguaauuuuucaaauaauguuucuuuucgaauuuuuuuucccauuuauguagagaccuugagagaagugucauaccugagaugcagcaggggacaggauggaaugcguuuucuagagaaucuuccauaaagggaagcauacauauauucugcaucacuaagauuaaucagaagaaauugcucaaauuccaccacauuccacuuuaagacuauagcuuucccauuaaucgcuacuagcccgaagaccuguccaaugcuauaacaguguaugauaaagcauauauaccugauuuuucacaaucaucuauaccacaaaaacucuauuccuguaaaucaucuaauuauuuagagauccuauuuauuuauuuacuuauuuauuugagacagggucucacuguggcgcccagacucgagugcagcggcaugaucuccaccaggccuuggcuucucaaaguucugugauuauaggcaugcgccaccaugucuaugucuggucccaguauuuuauuuacauccauaguauauaugucagauuguuucuuauaccuagaauugauagaaauccuuuaucacaugcugccuuccaaaaaagaguucaaaaagcaugguuaccacauaaagacuugcaguuacuagaccacuuagauguugccugagaaagauagagcacaugugguuuucugcaugguaugacauaucugaacagcaccagugaauacagaagaccauggcacauaauggugguacugugauggggaauaaacugccuauuuauuuauuagagcacauaaauuaccaacugauacgcaaaacaccaacugcaaauuaagccuucccucagaauuaaagagaaaagaggcuggggaauggaaagaaucagaugggccugccucaaaccucagcgcacuacuuaauagcugcaugaccucaguuuccuuaacccugaaauagacauaacaaggccuccuuuacagacuuaguguaaaggaggggacccacagaagauaccaucuggcauauaguuuguaaaacuuuacauuugcuauuucuguuauguauuuaugaauauacacauauaauuuuaugauaucuauugcuauaauauaugcaauauguaaguauguaugcacauaugcauauguguguuuauauauaaaaugagugauuuuugcucuuugaucuucaaauauuuucuuuggaugucaauuuuucuuuccuuuuuuuucuuucuugauuuggaucucaggauccaaaaguaaacuaacuuuccuaaaccucuucaguauuaaagagagauucauuuugagccagcacacuauauuucuaguccauaucugaauccauaucugaaacaaagaccacgucuaaaaguaauacucuuauuucuaauucucaccuaacacacccauggaagauaagaaaauuaacuuaccaggcagcaguaacuucuuggaauucuaugcucacacuuugcucagcacacauaggcguucuguugacaguuggcucucaacaccucaaguacgugucagagggacgcgagccgaucaguuuacccaagcuccuuacuuauucucauuuacccucuagaauuuuauuuccugccucagaaagaagaaucccaucugccagaaggaaauauuuguagccaacaugacaaaaguggaaucccuauuuuguaacagcugugaaucaaaacacuagugacugaaauuaacuacaucgugcuucggaacagaugugugcacagaaaccaacucaagcucugguguuccugggcaccauguguaaaucauccacagacaacacggugggccauguucucaccuuguugcuaugcacgcucauuuuuaauguucuccugaaccauugcagacuuugagauuuuuuuuuaaaggcuuagaaucuuuauuuccaaaagaggagauucugaaaguugccaaucacucacuggaagaccuaacuaaacagauggguuuugacaccucugguuugauuuuaaaugcaaacaugucaaauuaugcucuggcacagguucuucugccucaaaauuuuauggagggguguuuaauuuuuuuuaaguuuucuucucugaacucaguuguuccaccauuagcaauuaaggcaauaaaggacuuauuacagaaacagugauaugauugcuguauuuuaaugcagcagccuuaaguaauugaaaaucauuacuaaaaacuuuaggaaauaaauuucaagaacagacaucugcaaaugaaguugaagguaaggucacauuuuuauauaaauaggaagcgagaagaaaaacauauggcuuucuuuggugacucuucccauaaucaacauacauguauuaucuccuacaaccgaauuagaaguaagugguacauugccucugaucacuguucuugggagcccauggcagacaaugguaauccacugcagcccuuccaccauccaugcccuucagaugcaaaagacuugacuagcugcucugaacagauacaaaucaagggaggacuugaacuucagacaaguaacuauaugguuagaaagauuaaauauacacaaauguaaucacuugagaacauuuuaagcaacaugucagaauaugcaagacgaugggcugcaggauaauuaauuauugagaauauacaguugacccuugaacaacacagguuuuaacugugaguguccacuuauaugaggaggacuuuuuucuuuuuuugagacagagucucacucuguugcccaggcugcagugcaguggcgucaucuuggcucaccacaaccuuugccucccagguucaagugauucucuugccucagccuaccaaauaucugggaccaugccuggcuaauuuuuguauuuuuaguagagaugggguuucacuauguaggccaggcuggucucuaacuccugaccuugugaugcgcccaucucagccucccaaagugcuggauuacaggugugagccacugcacccggccuauaugagaauuuuuuuuaaaugaaacauggauuaauaguauagcauuggggaauaugauaccuccauauuuggauggcugacuuuugguaucugcagauccacagagccaaaugcgggacuugaguauucacggauuuuguuauacgaugaguauauccuugaguacacagaaggaugacugcguucucauuccaccguggggguguguuguuuugagcuggauauauccacacagcacuuuaguuuguaagguauaccuauauuaagccucaucguugcauguauuauuuuguaauaauauguugaauuuauaauuuuaaaggguuaaauaaccaguacaguuuaaaaauugaguaaauaaaaacugagaaauuaaaaucuguucaaauaagcacugcauuuaaaacccauagauacacaaacucuacagaagccuggagaaccaggcccacguggagacaaaggcaggauugaaugagaaaaauguguuucuaucacaaaucauaauuacuuguagaaaaucuuuuuacugcguucuaagcucuguugggauccaugccuugaagguaacacaccauugguugcuuuuuccugcucucccucuugauuuuuuuuuuaauagacugaagguaggaaaugcuauaugcuuaucucugagaagaugccucuauguagucucucugcuuuauaauuagcaacagucuuucccaaauucuacacuuagauugacuuccaacuuaacagauguuacagugaauuucuuuuuucuuuuugugucuucauggguauuuuagugcgagguaaccaaaggcuguguguaaggcuaccagggaaauauucgcaccgccugggucagaacccuguacguggcaugggucuuaguaaucuugcagaauuuuguuccuuaguucagccaaaacgagguucuugucacaugaccagcgaggauuagaaacguggacacauugaaggguaagggaauuggaauuuauugggugaaaaagaaaaaagaaaaaaaacucucagcaaagcaagaggggauccugcuaacaggccaucaccucacacauugaauuccaagccauacacaggaccugaagaugccaggcuccuccccacugcacaggaggugaacuuccccuggcuucacccuguucucccaauaaugugagggugggucagagauucuccaggacccuccuuuuaucugcauccugcaucuaucaguaaguaguuauugaauacacaauugcaugagcaauguuuaaggagcagagagagcucuuugcauagcauaucaggcagcugaucacucaauaggauuuaaaagucacugaauagacugcuagguuccauaguguggcagauauaacacagggucugagauucucauccuagguuuaugaauguuuuguguuuggacaccaaauucugauuuuaaaaagauuacugugauaaaaccuauuuaacauaaaauuuaccauuuuaauguuuaaauauacaguuugugucuuuaaauacauucacauuauugugaagcuuuuaauagauugaauauucuucucuucugaucaacagcaagaugauuuacauaauucuguaaaacuaugaguuggcccauucccucaaguaaagcaugaagacuuaaaagcaacauggaacacagaaagagaaaaaacuuugagcccaacaagauuuuggcuuugaaagagaaguaagauguuuaacuaagacucaauggaaggaaaaauauugucuggagauacugaaaguugagaauuauaaagagugauuacaaaugcagaagguaaaaguauuggagcaaaaauuggaaaucugcucacauuuacuggcuuuuuaagcaaguucuaucauagaggaucucucauccaaccuucccaaggaauuugucaucacucuaauccacagcuaauuuuggcacagaaauuauauuaguaaacucagccauauugucuucucacaugaagacaggacugauguccucuaaauaaaaaauuagagucuauagcgauuuguuuacaauaacaacugauaguuacaccccagggaucuucuuuuugcauauccugguuuuuaauaaugaauuauaccuucuauacauucuuucaaaauguaaaucaauauacuaaaaaaacuacagaauaagucaacauaaauugcccugugugagggugccuaguagaccaauacuaauauuuuggaggagauuucuacuuuguagaaucuacugagauucugaaagcugccugcaauucugcaaguguagggaaugggggaagagacagggcagaggaaugaagcaauggacuuaucuaaucaaaagccugauuaaaacacucccuagcagucucuaagauagaacuauagggaggcagcaggcaaucaaaaggaagagguccagcuauuuaaguauagcucauaucuauucacuccguuguuugauuagauuuuuaccuguaccaagucuauguagguaugaugaagaaaggugguguauuaaagaugaggaaaggugguguauuaaauauuccuaacaccacuuuccccagauaugcuacuaauaccaccccaaauuuuccacuacgcuuugccaucaugcccuuugaaaccuaauuaauaauguuucauuuuuaagaugauagucuaggcugcaauuuuaaauugguaagacuaauaucacuaucuauaguagaauaccucuuuccuccacccacauucugaugcacuguggauacaucuguccacaacaagagauuaaaccaucccuuucugucuuuacuucuccuuuaaaagcccuggacugucuuaauuuuugacagaaacuaacuucuuucccaacagugguggacuacuagaauuccaugaagcaugcuuuugguggcucauguuguaaaaaucauguaucacuuucucuugugaccugucaucaaaugugacauaauuuaaugcaacagcuccaauuuuaaggauggcauuuugcacuuugcuuucaaacucuaugacuacaguuauccaacagaagcuggccgaccucaguggaacagacggggaucuguuaacagguugccaacuuuaaauuacugcugaguagcuuagcauaucucuagaauaauuccuuuaaaaaguaauuaaucauuauuucaaaaaggucuucagugaaguguauuuucuauauuuuacugauggguagcauuugauuggaaacagcuaauacuucuccauucucugucuugcauuuacauuuuuacuguuuucaauauugcuguuuuuguuugaugacaacuagggacaacucagggagcagacugagaugcguccaacaaagagaauaugaauagcaaucuagaagagugaacauuaggcagcuaaugcauagaaauacuuguauuuuguaucuauuuucuccauauuucaacugaagauucuugccucauguuggaaacagauugagaaaagucacucgugucaguacuacagagaacacauuccaugagcccauaucuucagcaauguguuugcauccuagaaauuauuucagauuaugcucucucuugaggccauaaaaggcaaacacuggaggaggaacagugaggagaaacuacauaaauagcuacaggcuguauuuuagagacgccuccaaacuuguuagaagauaacguguugacuuuuaggguuugucaggaaaguuaauaaagcuagauuuauaaguaucuuucaagauuuuuuuuucuaauugaaaaauaagccacacgaaaacuguauucuaacacucuuuggaaacugguaucaaaucaguccaucacccacuucaaagaauuuuauuagccaagauaucauaaaagucuacauuuuaagauuuuuucuuuuuaucauaaaaaauuucaaagacauagaaugauauaaugaaucauuuauaccuccacuaucacucacaaaacuauuuaaaaacaaaucccagauguuacuuaaggcaaugucauuagcaaauuucccuuuguauaaacacuauaaauugcuuuaaaguaaacuuuaugaaaaucauaugcuuuauuuaagauuaggaacauccuaaucccuuuuccccauacuucacaaauuuuaaaucauuugugucauacugguaaugaacaaauuacuaaguguguacaacagagaugauauauguuguccuccuauuagggacauccaguacguguccaugacaaguauuccccuggaucuuacuacaggucccuguugaagcugggcagggccucacagugaguuccaacacagcacaccagguaacacuaacucaucaauuagagacagcaugagaacuacugaccuuccuggucuacagcuuacugucaaggaaucucauagccaggaauaagcuucuuuaccaauuccugcuauuguuaaauaccuacaaucacacuguucaacuaggaggagaacuaaguauucaugauggcuuggaccuauguggauacucuccuugcuuuucaagcucacagagaauggauaaauuauuagauuucagaaaaccaauuguagacuagaacgagaaccuagaaugaucuaccaaauccaguuugugacuaaaagauggcauuguuuccauugucaaaaucaugaaaguagacuaucgucucaagauagaaacaccaucuuuaccuuccauuauggaccuuuuaauaggaacacagugcuaaauuccuaaauuacaacaguuuauugaaucuugaaugacaucaguaguaagaccuaccauuauuuuaugcacuuuaagaaagaaaaugucuuuuugaaaacuaugacaugcuaucaauuauaagaaacaccugguuucacaguuacuaacauauuuguauauacacacagaugcauucuauuaauuuguauuuaagcuaacauuucuuacuugaagaugcauugguaauuuauugauaggaaaaucacuuccacaacuaaggauaguuuuucaccuuuguugcucugcaaagcuuggucuuaucuauucuuccuuuuaagauuucauuuccaccaucaaucccaagggcaacugguuuaacguaauagagaaaguccuggcuagggaagcagaguguguucccugccaacauuugcccaugucugcgcccaaauacacagugacuccuuagagaguccucacgcaauguccaucaauuaauauuuuuauuauuagagaggcuagugcucuuuacagcauuggaaaccuagaaauucuaccagcuuagccagcuuuugcuaccuauaagaguaguggaaaaauaacaacaugguaaggauaucuuucuguuuucacugaucugaagucacaagccuauaaaaccauucaauuauaaaugugaaaauaaauaaugcuaauaaugacagcucuugucaacuggacaugcccaaagcagacuggagccagauaugugcacugagggaaguggguggagccacagggaauuugcaccuuacccaggggaggagccugugcucuucagcucaucuguguggccuggaaucgaucuaugagaugaggaccuguuagcaggaaucccccacgcuuugcugagaguuuguuuucuuuuuuccuuuucgccaaauaaauuccauuccccucauccuucaaacugucuccaugccuaacuuuuccugguggugugacaagaacccaguuuuagcugaacuaaggaacaaagcucugcaacaguugcaacuaaauugcauuaaaacaagaugugcaagaugaguuuugagaccuacauccuuuuauuaaggcagaaaaauucaaguccauaaugaagucaauaugaaaaggaccugaauuuagguuucuguagcaauccauuuuauggauguugcuuucuuagaaauuuuauguuuuaaaauagauuuuuaaaauuuauuaccuuaaagauuuuuuccuguagaucauauggacacuuaauuucuucuaucaggcguaucaucuagaaauauaaugcuuacaugggaaauauauuaucuuaugauuugauaaaaaauagauggaguugcaaauauacuuuuaugauauucuugaauuuuuuuuuuccaaugcaaagauucccaaucugccuaccaacugaacuguuuuggucgugaaacauuaccuucucgguaugugguaugccuaucagcagaaaaguaguaaagaagaauagacuaacuuuaguuauuacauuugcauugucuacaaagccauuuacuuaauggaugagucucauuagcaguccaaccacaauauaaagaauacaaugauguguuucauagguucauuaaaauaauauuucaaaggagucauuagaauaaaagaagcugaaguuucaacagacaguaaguugucugcaaauaaaugagauggaaccaacauguuuucaaguaaguuaagagacauguuuacaaauacauuacagccauuaaaaaaggaagcaucaacuuagcaagugcuggggggacgauuacucaugcaauuuacuaaaacaaaacuguaacacucucacaucaauaguuauuguagaugcaaacgccuguagguacaggaaaaugugucuuaagaaggaaaauucauucuacagccccgagaugauucuccacuuggaagcaaaauugaaaacauucaauccugucuucagaucaccacugguuugggggggggggggguuuguuuuuuguuuuguuuuguuuuguacacacuuuuguguuauuugccccaaaccccaagcaugccuaucuuuucauuuuuuuuugagacaaagucucgcucuuguugcccaggcuggagugcaauagcacgaucuuggcucacugcaaccucccccuccuggguucaagcgauucuccugccucagccucccaaguagcugggauuacaggcgcccaccaccaugcccggcuaauuuuugcauuuuuacuaaagacgagguuucaccauguuggccaggcuggucucaaacuccucaccucaguugauccacccuccuuagccucccaaaguucugggauuacaggugugagccaccacaccuggccuacccuuucauuuuaaaaagaaauucaugguaaauuaguaacaugaauaauccuguaagggcaaaaaguauacugaaaaaaaaauugugucuauuuguaauuaucuaaccacaccuaagaauugacaaauguuuguuuaacaaaucaauggaugaauaaaugaaugaaaaaagcaauuacuuagcaaaggagaguuuuuagauuagguuguuaauuauugcugcuuuaucaauuuuuaaacccaguauuuccaccuguaagcaaaauaauaaacagcuuguauauauguucaauaauguugaaaucuuuucacaaauagcagugucaaauuuuuuuuaaccaagaucauagaguuuauauuaaaacuaaggauuuuauuuuuggguuuuuuuuucacaaagaaaauuaacauguagaacaaaauaaaaaccacuaaaggaauagagauugccauuuauuuauuaacuuuccuuuuuugaaagagcuuagauuuauaauucuaagaaauacaagguaagacacacacauguguaaguauaccugggacuuggcaauaagucacaggcaccuagaccacagcucuuguggcagagagcaaaaauggccccauguaauuugcaaugucuucccacucugcauccugacucaccuuuggaugcuuggcuuagccauguaacuugacuuggccaaugugauaucagcaaauggacuuggaaagagacuugaaaaggcuuuguguauuucucuuugugcucuuccuauuugccaucagcauuagaacaugccagggauagccugcuggcggauacaaaauauuuagagcggagcuaagucauucagccaagaacagccuagaucauugcccagccagcuaacccugacaugugauugaacuuagccaaccucagcacauuugccuaggugaccccagcugauuguagguauaagagaaauaaacauguguaguauggcacuacuugacauccaacagauucacauauaagcuuuguacuuugcaguaagauuauucuccaaauagaacaucagguugcauaaaaucaaaguaguacuggguuuuauuaaaguaacuaauaaaaaauuauucauuuucuauuuuuuaaaagagaaaagacaaaauuaaauuuguaugcacagucugaauuuugaagugcuggaagcuuacucaacaauacaucuacugcugaauucagcucacaagccaccaagugucaaccucuguucuagguacugagaagauuccaugauuucaagcuguuuacggauuuugugagaaggacagacacauagugcauuacauaaaagaaauuaaaacuauuaugucuuaaugcuuaccacguggacgaauauaaacaauuuggauuuccagauguuuucuggaaugcuugcuauuuugccuaaaagguaauaaucagaccaaucccuacaauuaaggaguuuacucucuauuuuuuaaauauauaauugauaagcaaacauauuccaaaagauucauuguaagucuaaguuuuucagaagguacuaaacuccaaaaauauacaagccuccaaagauaaacuguuuauuaauaaacguauauauaaggacuucagcaaacauagcuuccugagaaaaagcaauucaaagaucaauauuuccuuuuaaauuuuacacaacuuggacaaaauuuucuaaagaaaucacaauuuuaaaaauguuggaaagccaguuccauugcugaauucauaagguaacuuaccguaaaucauauaugauuaucauauuuauaacuaacaucacauagccccuuccagacugucaacuccaugaggguaaaaccuaguuauguugacaucuguuuucucaagcaguuagaauuuccugauucauucucuugucuaucuggcuggaacagcuaaaauuaaggcaguggagaucauuaguuugauaaaacaauagaagacaauugguauugguguaggagccacucaccagaaaugcuguaaguaaugacuagguucugcagaaauaaaauuaacagauuauuacaguacacacucccauaccuacaucaggagugaaaggaucaagcaccacaguuaaaauaauaaugucaguugcaacuggggaacugaggguccuggagacucccaacucagaugccugaagaagccagggcagguauaguaagcaagcagggaaaacuugguaauaguguacauguguacuuggcuucugaguagugggagauggcacugaacuggcaagcccauaucccaacuaaaaguggguuucagcuacuaaucucuaaccaauauuugccauguagaaggguagagcuccaaacucccaugauuuuauauauacauauuaaauggaaccacaaauagcaauuucuacauauuaucuccaaaauuguacguaacgucacaauuuuuaaaaccauuauguagaacaaauaagacacauguuuaagcauuugugcuuucccaaagaugaugucaccuuuguuccugguccaggaagcuaaaaacaaguaagaggugacuuccucccauuucuucucccuccuuccucccuguauuccaccaacagugcuacuuaaaguauggcuauggaauauugccacuccaaaaccuauuuuuuucuuuuuuggucuaagauaagcgugaugaacagguaaacuccaugauccagcccccuguauucaugcucuuguguguaaucuccucucuugagugugaacagugucagugauuugcuuccaaccaaaagaaaugcaaagaugauagaauguuacugcuaugauuauguuauguaaaacuccaucuugcuagcaaacucacucgagagucucucucccuuguuggcuuugaagaagcaaacugucaugaauccuacagccacaaagaaacgaagucugucaacaaccugagggagcuuggaaguagaucccuucccagucaagcagcugaugagaccacagccccagccaaaagcuauauugcagccugguaggacacugaagcaaaaaaaagccauuaacccaugucugaacuucugacucacaugaacuaugagauaauaaagguguguuaucuuagcaccacuaaauuuggaguaauuuguuauauagcgacagcaaacuaauacaaggggccuaccccuuaauguuaauuaacuguaucacuaggcacauuguuuaguuugacugauauuuauuuuuuguaauaguacuuucucaaugaaggaagcaauacauugaauuacacucagacgcaagccaccucaucucacagcagcccaauaccuugaguucuacaguugaugggcauaguggaaagagaggucugguguaacuuuauaugcagaaaaugagaaaggcacauuuucuuccuuugacuuauaauuuugucuaaugauauaugcaacagagguagucaagagcagggucagggaaauggagacuauggugaaggaguuauuaccuguaauacuucuaaguugcaucauaaaaauuugcuaucacuacagauaaaagcaaaggaugagcuaacugauaauaccuguaaaaugcugcaaacaccaccaugauguggugaggaaagcaagauaaacauuccuauagaauccuccuauuacuacuugcccuggggccuugugaaaaucuagagaaucuaauagucuaguacucagcucgcaaggaaaccagucagucaucuuugucauucucugcucauaucuuauuuccuaacacaacaaaaucacuuauagacccaugcagaaaccaugcccuuccuucucaguccuagaccuggcuaaccccugugcccucuaaagauuuaauuagcuagcucuuacccugaagaagccuucuuugauaaguuuguuccuccuuauagcuugcuaacauccugugcaaucuccaucauuucacuucuugcccuguaucguaauuagcucuuccggugacugucuuauccacuggaguaauuaauugcuacuuaagauaagaaaccauggcucucauuuuuguauuuccagcacugaggagcaugccuugcucauagaaggcccucaauaaauacuaagugcagagaaaauaagugaguuauuuuacuagaggcugcauaagagccaagagaagcaacuuaauuaugaggcaacaauaagcuuggaugaugcagacaaaaauaugcuaggagauuuuaagcacucagucugucaguggugagccuaaaacagguuccuuuaaagguaaaagauucauacaaaacaauacgaaacuaagaauuguacaacucaacacauguuaaaauugaaagaaauaucacagguacucacuauacccagaugucaaauucuuucauaucuugcuucaagcagcauguguauauuaacucauauuuaauacaaaaagcuaugcuuuuucuaaaagcauuucuuuuuuaaaauuuuuuuuuaagagauggagucuuacucugucauucaggcuaaaguacaguggugcaaugacagcuuaccgcagccuucaacuccuagguucaugugauccuccggccucaggcuacugaguagcugagauugcaguuguccaccaccacagucagguaauuuuuuaaaauuuuuauucauacuuuuagaggaagggucuugcuauguugccuaggcugaucucaaacuccuagcuucaagugauccucccaaccucagccucacaggucacuggguuuacaggcucaaugcaccauaccugaccuaaaagcauuucuuaucagaguccuacuuacccaguuuugucaggugccaggaaauaggggagcucuuaccuaggagcucccucuggucagaguggccucgcauucucagugugggggauucaguccuacauuuauaccucccuuggagaucaauuccuuaaagcaaaacagguggcucacuggauggcauucacuuucaguugaucaauugauuuguuuggagaucaguucuuaacauuuauuucaacaguuuaacaagauaaauuugaaaucauuuuuccuaaaaaaauuucaaggugaucuuaauauuauuuuaccaacuucaacuaugaccccuucuucagacuuaaccuaauuccuucugaaagccaaaaauucagacccauuuaccaugaagcugaauccuccacugcuucucuaacuaccucuuccaucggcccuaaaacauuaaaaaaaguggggugcugcuucucuuuuucuguaagaugcccaggccugguugguaaaaguuuaacugcuuaggugauuauuaugcacuauacaaaguauacuacauaucaagugcucugcccaguagagggucuacuaaaaaggcuuaagagugaaaacugccaaagggaauuucuuaccuucccucagggcacacagaaccugaaccucaguaccagguguucccuacaucuccuucugcuggugagucuaaaccugaauuacucuucuuugucuaaucaauuuagacaacaaauuaagcaugaauacugcuuggcauaguagccuuaaucaaacaaaaaagugagauuuuuuauuuuuuuaaacaucuaugcaaacauagagcuuuuguuagaaaaaguuacaaauuaauaacauuaaauaaagccaacucuuuagaaaugauacagaauagccaauucccagaaguauuugaguggcugaaaaacaaaucuguaaaaaagucaaucucaagcaaaaaucaaguuaaaaugagacagacacacuuucaaaauugcaguaauuuuuaaaaauuuauaagaaguguguaaagaaguugacauucauacaguccuguucagcugauagcuuuuuuagagagaaauuugguaauaugaccccaaaaccuuaacaaauuuuauauauuuauccuaucuauucuacuucuuagaacucuaaggaaacaagaagagauggccagagacuuauguaguaggauuuuucuaucacgaugaugggcuggagaauccaaaugucucacgauaaaaaaguggcaauauaaaaaaugguaugugauacaauagacuccuaugcuauaauuaauuuuuaugacauaugacaugcuuguaacauauuaaaugaaaaauggcaccaaaauuguuuaaaauacaauuauuuuauuuuuaaagcauacauaaacucauaguaaaaaaguaugcacauuaauaguauuagucauuaccugugaaaggcagacugauuagugacuuacuuuauuauuccuauccuuauuuuaaacuuuuccaacccauauauguggcccaucagauuuguaaaaaugaaaauccaaggcauaggauuugaaggcauacauuccuauacccugcuaaaaacagacucaguuuaguaucuccuuagguucugauauaagaugauucucgaaaaagccccaagccaacccagucugaagaaacagauacagaguaguuaucagaacaagaauucaaugccaguuaagucaccuuucccaaauuuaauucuaauaauaaguccguguuaaaaagcaaagguucaaauauuuuaguguuauugagaggauuagcucacugcugagagugaauauaaaaaacaauucuauaucaaagccaacuaauucaaucuuauuuuuaaaugucaccaaauauggcuucucucaaaguacgccgguccaauugguaauaucugauggcugauucugcuuaacucuacuaaauauaaaccauuaucuuagggaaucaguaguauacuuuauucuuguuauucuuuaguauuuuguuagggaucauaaaauuggacuugacuuugaggacaggacuggcuaagccagggcaguuaguccuauggaccuuuucacuccgggagucugugacuacuuauccuuaaacauuuccaguaaauuuauguuuuaguuaucaaucaguuaucuguaaacuagaacuuuaaagaauccuaaaacauaaaucuuuuuaauccucaaugauuuagacucucuacauuuuuaaauaauucagucaaacaaaagaaggguaaauuagucauuuugugugucagauaaaacacacaugcauacacagaauaaauguuuuuuguucucaaaggauuuuguuguaaccuccacucgucauguaacacuggaacaaaauaguuaggcuaauuacccaaaauuaaguuccacuucucgauuuacaagcuuuccauuuuauucuagcaauucuuagcugucauggacucagaaaauuauuacugccaucaauuggaagauuguuuuagugguacagauggcuguccuuuuauaggccaacuuaaugacuucuucuuaucuaaucugucaucuguuauuuaguugucauuaugaacuuuuuggguugcauaucaauccauuuuccauguuuacuaaacagauggcuuuauuugagaaaaaaaaaagcaaagcaagaaaaugacauugcaugauuaaaaaauuucaaaaggcugcauacaauuuuuaauguuccuaaaugaaaugaaaaauugcuauuaaaaaaacuaaauuugaagucaaagugaaauagauuuuaaaacucaauggacaugcaaagaaacaaucagcagcagcuaucuacaaauagaacaaauuacuuccaaaacagcaauagguuauucuuccaguuuuugucacaaauuuuuuuuuaaauuuaucuugacaaauagaugacaaaugucaacgaaguaacucuucaauucagaagcucuuuauguuguaauucacagguguaccuccuuugucuaguauuuguaaccuuauuuagagaguagguaaugacauaaauacuuccauuuagugaaaauuguuccuuaucuuugucuccuuaugaugauuuuguuuaaucacugggucauuaucaaaucaacacccaaacucaagaagcguaagggaaauuguaaagggcuuguaucaaugaguucagagauccaaaaauaauaacuggcacugugccaugaaagaacacuguaguucacacuguaccagagaaagaacuugacaauuauuagaaacuaaaauacauaaucaugaaauaauuuuauguuacauuuaugagugguauuuaaaauuguguuuguucaggaaggauauuuaccaagucuugggauuugcuguaucagccuauaacaacgcugcaaaaguaaccgagcagagccuucugaaacaguuucccaugccauacuaagcacauccuccauuguagaacagauugaguucaacugugguuuuuuuacuugcccaaguucaaggcuccugagcacaacaaaaccaacaaugaggaagagcaugaucgcauaauuuuuuauguucuucagacaauguaggagaacuuaaaauggacagccaauuuuucaaaaaggacaaauuauuugaaggauuucuuuucuuauaugauaaccacaguaaaauguaagacuaguguagguaauuguccugccacuccauucuaagcugugagugaaaguacuccaucagcuuaaugagaacaccgugaaauauaaaacaucuauuucaauacaaguuauugagaagcuuuaacaggcuuucgggagaagcuaccaaaagaaaaccgaauaccagauacuugauuugagacugacaaaaaucuucuauucuuuccuacggaaaauuaaacaaaaugggcuauuauauagcaggaagacagagacaaaaaaaaaaaaaaaaaaaaaaaaaaacggaagaaagaguaaauuguaugaaucagaaacuuggaauaauaauucuaccucaaauacuucucuuaggucuucugcucacaucuuucaggcagagaacaucuauuugaugccaaauguguggcuagaacugggccaggugcuuuacaugucauagaucaauaccaaacaacuagugaaaucagcacaaauucaaccaaugaagcucuuaaaacaauaaggugaaaaaccacauuguugaggagagccauacaauacagucagguucuaguucaaauuacguuucuuuccuugagaucuucugguccaugauauguuuugaucugucuaaaauauuauguaggcauucucaagugauuaagaaacuccggauuguuucaaauaaucaggucuuccccaggcaaacacuggagaucacuuguuuuuuguuuguuuguuuguuucugagauggaguuuuucugugucgcgcaggcugguaugcaguggcauaaucuuggcucacugcaaccucugccuuccagguucaagcucaagcgauucuccugccucggccucuugaguagcugggauuacaggcacccauucuugaguagcugggauuacaggcacccaucaccacaccuggcuaauuuuuuguauuuuuaguagagacaggguuucgcuauguuggucagacuggucucaaacucccaacuucaggugauccaccugccucagccucccaaagugcuggaauuacaggcaugagccaccacgcccggcccaauaucacuuucaaugggucccaacacauuaaaugaugauuucuugacaaaguuuuacacacuacuuaaggaucaauugacaucaacccuaacucaaagccaggaagcuuaauccaacaugaaaauauucuguggauguuguacuuaggcauauuauucucuguaguauauacuuucauauugauacacauauuuaacauauugcaaagcauauuuuaaaagcauugaucuauguucuacugguaauuuucacaacgcuuaaucacauggccaucauagucuuugcauaagacuaccuuguuguucaagaaugguuuuagcauuccauccuucuccaucauacuggcucagaggugagaacugaccuucucccaguagauaaaagacucucauaauuguauuauguacagcagcaucagcaucaccugggaacauguuagaaguucgaacuauagaccuccaacccaaaccucuggaaucaaaacucaggagauaggccuuagcaauuuguguuuuauuauauccuccagcugucuggagaaccacauaaguuuugagaaagaaggcaaugcaccuuaucauucuucaaggcaaaguucacuucacuuagcuugguauucuucacugcaccuagcacccucaacauaacaagcacuuaauacauauuugugacauaaaauagauuaaaauauucuaaagacagaacucauuuuagagaacaauccuuuccagccacuauuuggagauuuugauacuagagauguauuuggcugagaaguuuccuuuccuuaaccuauugcuagguucugugaacuugccaugaauugaaaccaaggauggacuacagucagaaugaaggaagaugaggaagaaaaaagcaaagaagaaaacaaaaccacucuauuccuucugaauuuggcacaaagaucucagguguuccuuauauucuuaagacguaaaucacaaugaauuaugaucauugagcaaauauuacugugagccuaggucaaaaagcuaaggucauaguguucugacauaaacaaaaucagcuuuauuucagaaagagcauagugaaaggcuaauaaacauugcuaaguaaagaaggggcugauaacacagauacaacaugguaggucuauacuuucuagugcuuauccauuucucugccagccccugcauuuauggcacaucaaucaaaagucuugguuuuggagccaggugaacuggguuauaaucuggcucaggucuucacuaguuguaggucuuuggggaaauuauucuucuccuuucugacugucuucaucuauaaaauggaguaauaaugguaacuaacucauagaauugauggaagauuuauauuaaauaauguguguuguaaaugcucaauaaaugguagauuguuuuucuuugucuauaggagguguugagggcuuguagucuacuuguucaagcaacaggacauaaaacaaaagcucauuaagucagaugugguaucccaucagcacuugcccagcacugagaauacagcagguauuccagaagugugagccaaaucacaugcauuauaccacaguacaaagaaaccuuccccaagagucaugguugagaauuacacagcagagauuuuccacaucacagaacagaguagacuggcuugacuucaugauauuuggauacaaaacugagaaaauuagauuuccaaaauauauuauuacuugaauaugaaaauaucuuuuuuuuuuuuuuuuuuuuuugagauggagccucgcucuaucgccaagcuggaguacaguggugugaucuuggcucaaugcaaccuccgccuccuggguucaagcgauucuccugccucagccucccaaguagcugagauuacaggugugugccaccauguccagcuaauuuuuguauuuucaguagagacaggguuucaccauguuggccaggauggucucaaucucuugaccucgugauccacccgccuuggccgcccaaagugcugggauuacaggcgugagccacugugcccggccugaauaucaaaauaucuuuuucgaauucugugacagcccaugaccccuucaccagagcaagccaaacaccacuuguuuucgccaaagagacaggagcaaaagguucugguauuuaucaucugggcuuuaucuuuuucuggauagauuaugaaauuccaguguauuccagacagguccauuuucauggaaccaaccacugucuucccuaaaagcauaacagcaucacaggcaaaggucccaagauaauagaauuuuauauaucaggcuggcuuucuaagagaagucaauaaaauccaacaaugaugggaaaugcaggauguagcagagauccuuaaaagcaauuagcagagagcagggaugaaaagcaauuaugcaaacacuagaacacuaggacauucaagacuuuuuuuuuuuuuuucuuuuuuuuuuuuucauucuguaaggaaaggacagaucccugcuuuggaaaaagaauacaaaugugcagguuugaaaguuccccauuaggugcaucuaccauuucuauuauauucaaauacuaagcuuuuuaggacuuauauuaaacuccauaaucuuaauauuuaugaccacaacuuaacaauuaaucaaacuauuaaacacuaaaagagucaaaggcugaguauggguggggcaagaaaauuuuuuuuuuugagauggagucucacucugaaacaaucuugaaaagccuccagaagguacaaauuugcuggcacuauaaaagacaaaggcaacuuaaggagguucaaggaaaaaggaaaauaaugcuaagaaagagaaaacaugagagaaggcacuggggccaauaaugcacagaguucagauacuaaauagugaagugauccauucagccuagaagaauguuaugguagaauggaaaaaugcaagucuuugacucugagagcccuggguuuuaauucugucuuucugugaccuuggguaaggcauauaacuucacugagauucacucugagcacccacaaaaugagggcaacaauagcuauccuaugaaauagguaacuaauaaauagcagcaauauuuaauaggcaugcaaauucuuuucucuucccuucaccaagucauaauaaaccuguucuuuaauucaaaaucaauauggccaaagccaaauucacaacaucuucucacaagcuucccuucucaaacagccugucuuaucaaucgagccaccaugucuccacugacccaggcuuggaaugucugacugauagcugccucaacuucaccuucaaaacaaaugucugcucaaguuauaucccuccaacacgauucauuuugaccucuuuaucccuguuuugucaaccacaacccaaaucuaagucugaauuauugaaaaagccuuccguccgacccaugugauuccuacuuuucuccccacaaauucauauaccucccacugcuuagcuuaucuauuucgaauacugguguaauacauccuggugauggcucccuguuuccuacuacucagugauauauucauccguucauccaauaaacaguuacuggauauccaccaaauaccaaguacugggcuauguauuggaggugcaaaaaugagcaagucaugccuuugaaaguccaguggggagaaguaaacagauagauuauaauacaaugcuauaaagaagagaugaaacuagaaauucgcuuuauagguugaacgagacaaaaucucagaucagagauggugcuguauuggaacagcaucucaagagaggagagguguuugucaggcaaaaaaauggaaaagggcacuauucuuuuucaaaggcacguacacaaaaaaauccuguguuuuauaaguaaaagacacccccaccaacuguagaggagguugaauggauuucuugcagcagugaguguguaaaugagugacuagcuaggaugcaagacuccccuccuuugaccaagcaaguaaacaaaggauggauucuucauagaagaugcaauggcaacaggugacaaguuucuuugggcaacuacugagucaguuauguagguaaagggguagagauucaagaaucaaacaaacaaaagacaacaaaagcaauacaauauuucagacacagaaccccacuggccagagagagagacagauuuuaccccucaaugacagugaacacagaacuuagaccauuugaaauaaaaguucuuaccauaucucuccugacucguacaaacaccaaagggcaauaguaaaggaggauaaaucuuuuugagggaagugagcuguacuaucucauaucucacgggaauccauucaugagaaagucaaauccagaagucuguuccacuucagcucucauuuacaaaaaaaguuuucuccuuccuuucuuaaaucaagugacacaagucaacucaagaugugcagcaucacaucgucacucaaccaaacugugcacacaucuucugccaugggugucaccaaucuuaaaucucaguguuuaauacugagauuuaaaaaaaaauaauuuuauugugugcauuugaaguuuauagcaugauguuauagaauauauauagauagugaaaugguuacuaagugaaccaaauuaacauaucaucucacaugguuauuucuuguguaugacaagagcagcuaaagucuacuuccuuaaaaaaaucccuaauacaauacaauuuuauuaacuccaguccucacauuauacauuuuagaucuuuaaacuuaguaauccuauauaucugcugguugauauugagauacaauacuuagaagcuaaaagcuuaucaaacaugaaggcuuuucuguucggauuuuuuuuuggagaggguuaacaaaauguguuguuuuaauuucauuuucagaacaaauuaauuuaucucaccacacuuuuuguuucuagcaagcaugacaccacuagguaugagcugugugcuuauuguggauaaggacaguguguuaguuaccucuuuaucccaucacagugucugccacuuaagcauucagcaaauuaaaucaucaacaugagaaacaugagauacauuuuuaucauguacaugagauacauguccuguauuuuuaucaccuacgugaacagagcugaacaccucaccuauucaauaguaacuccaauuuuauuaacuuucccuugacucauuuucuucaucaauaaaacguggaucagauugccuuccuuauagaguuauagugagggauaaacaggguacaguauacaaaaagucaaaugagucuucaauaaacggcagacaaaucccaaacaaaaagaggggcaaaaaggcccgugucagagaaaucagaaguuaaaucaccauaacaaugaccauaagcagcagagaacuucagaagguauccccagccuuuuggaaauguccuuuaauuucuucauguuggguaaaucuagcaauugaaaaggaaagacgcuguuaaguucaaauguggauguucauuauaggagcugaaugagagacagguaaaaguuuccagggaagaaaaaggcaguaugcaacaaagaguuggguaucaaaaaauaaaaauaaaaagaggugcagaaaacaagcuccuuuucuucucuaaauucguggugcuccuauccaggucggcaaccccacaucaguccuuaccauugcucuacccaguuuguguccccacugaaucacuccccagcuccaagugacgugugugugugccuaugaaguuuuaaggaaaaauuaccuauaauuuugcuugaucuuugugaaucucuguagcaacacggaaaacugcuuaacuuuucaaaacaaaucuaaucaccuuaucauucuuuuauuucaaguaauggcuacaauguauugagcacauaacuaagcacuguaugccagacacuguauuaauugcuuuauauggaucucauuuauucccacaacucugacuuguauacugccgcuaucccuguuuuacaggugaguaaaccuggagauguggagugguuacaucauuuuuccaagguuauacagcuagaaaauaagugguagcuagaacuugagcccacugaauuuuaauggugucacuguaaagccucugcgcuguguaucuccuguccccaucacuccccacucugcuccacugugcucuguaccccaggagucuggccuccgugaacuccaacaagcuucccuggccccccuggccccccuggcuucagugaguuugugugauagacuccaggcaggagaugagaaggagggaagaacaguucaggauauuuauuccucuugguccuuccuggaaggucaccucagucuagcuuccucaaaggacggucaccauccucuaaaggcaggcucuucuccacacuucuguccuuugagguucccacaacugcuaccuccccuugucccuaggucaagggguggucacagcucugccguuacucaucccaguaacucaugcagucacuauaacaucaucugugguuucccugcacccagcccacaacuuuguaaacagucccauuguaaauauacucuuuaauauaugcugauuugaauguaccaucuggucccucuuggaacucugauacagccuuucuaauaaugccuuuggucuaggaauaacaaaauaauuguucuccagucauuccaugcuuuucuacaccucuguguguguguacuccaugcugcuuucaagugaaaugcucuucaccacuuuuucugcuggaaaauucuaacuccuccuuuauaacuuaugaaggcaguuauuuuauucaaaccuccuuugacccccuccuugccaugggcaaaauaaugggcuuuuucuaucauacucuguaagcaccuacaacuuagacaauacauuauacuguauacaugugagacuggcaaaaucucagcaugcaccacuguaccugguaugcaguagguaaaacaaaugaucacugaaggcuugaaugaauauauugcuguuacauauauucuuuauucuguucuacccaggaaauuaaugucacaggcauuccauugagcaacacagaaggcuauauguguacaugcugguucauucuaugugccaauuugacugagcuaagagaugcccagauaacugauaaacauuauuucuguguguaucagugaggguguuuccagaagagaauagcauuugaauuggugaacugaguacaacagauauccuuuccuaauauggaugggcaucauuuaaucaacugaagggcugaaagaacaaaaagguagaggaagggaaaauucacucucucugcuugagcugaaacauucaccuucuccugcuuuuggacacuggcacuccugguucuuggaccuugggccuaauuagauuaaaucauaccauaggcuuucuugguuauccagcuuucagagaauagaucaugagacuucucggccuccuuaaguacaugaaacaauuucauauauauguuuguauguauguaucuaucugaauauauauauauauauucuauugguucuguucucucucauauauuauuacauauaaacagaacauuauauauauaauacuaagaccuauauauacaguauauauuauauauguauuuaauacuauauuauauauaauacuaagaccacuaaaauugggaucuuucuggaaaaucaaaauucaacauaaauuuauuauuucuuuguaaaaaugcauauggaggagagggaaggcaaguuaaccagauauacuuugaauguaagguuacauguucccuuuaaucacuugauuuacugaaaaaauacaugcuuaaaccuuugaaaaaggaaaguuguuuuucaguaguucauuauauacucacugaguuuuaaauucuaucacaauucacguuuuaaaauagaucuuaacaccacacauauuuacauuaaaauaguaacugagucauacuuaccuaaauagccuaaugacucauuaaaacaacuuucuuuucuguuaagucauauuucuuccuucauaauucaguucucauaacucauuaguuauuuccaaagaaggauguaucacagucauagaccacuucuguucuuagaacuuaggaagccaucucuuucagaucaaaauaucuaaaauuucuaugaaaauuuucaaugauuuaacaucaguguuacgucuuaagauuuauuauuaagacaugguuucucagaaagucaacuccuggucuaguguuuuuaaaugauuugacucugaauguucaguaacuuuaguuagcucucaauugauuucauuauggaacauuuuucuuccucucaugaaaauacguaacaacaaaauauaccugauuaacaaacagcuugauccaugcagcauguaacauucauagaugcuaaugccucuuugaagcauacuuaguauuuagaaaucauuuugccuucauugaaugaccaaacaacugguguucaaaauaaaauauaugccugacuauaauaauauggcaaguacauauuugucaguaauggguauugcuuugcaugauuuauuuuuguuuucagaaaaugaguccucgagaaauccuacaaaucacuuuccuugcauagaacugaauuuugguaaaaggaaaaaggcgcuauguucagucccuccgccuuuuugagauggagucucacucugucacccaggcuggagugcaguggugcaaucucagcucaaugcaaccucugccuccuggguucaagcgauucuccugccucagccucaugaguaguagagauaggguuucaccauguuggccaggcugcucucaaacuccugaccucaagggauccgccugccuuggccucccaaagugcugggauuauaggcaugaggcacagugcccagccugcuaaccccuuuucacaugccaucucauuugacccuugcuauguuuugaauauccccuccaaaauucauacugaaauuuaauuacaggaggugggaccucuaacagugauuagguuauggugcucuacccucaugaauggauuaaugcuguuaccacuuaucaugggaguauguuagugauguugggaauggcuauguuauaaaagcaagcuuucucucacauucucuugcccuucugccguccgcuccccugccaugagauuaaccucaccagaugcugacaucauggucuuggacuuugcagcuuccagaaucaugagcuguauaaaucucuuuucuuuauaaauuacccagacugugguauuguuuuacaacagcagaaaauggacuaagacaauccuauagacagcaacccuaccaaagucagaaaggcuaagggacuagcugaggcucugauuccuaaucccauguccuucccauuaaaucauuuugucaacuuauauagguugaggcuauaccuaugcuaagugaaaauauccaucugauagauucaacuugagauucuacuuugccccauuauauuuguucucugaggagagugaagaagaagaaaaggagagguuuuuguguuaggccauuaucaaugagacucaucaauacucaacuaaucuauaaaaugagcucaaccuuccccuaagaauacuaaauacucauagauaaugggcuggcccuuugauuuuaauucucagaggaucaguguuuuuaauguuuuaucauuaguuccuuucaauuaagucagguaauaaugcugccuggacauucaaacccaaaugaauggcuucaauuaucccagggucuauuucucaaucaggagccaaggcccugggaccaaauagcuaacacuccucaaaguaccucuagauuauuuucugaaaagaauucaaagauuauuacauuuuagugaauuuucuagagaaugcacuguuuuuauuaaacgggaguuuuugcuaauuuugcuccuuucuaaagauguuggaaagucuaagaaaacucuuacucaaaaacgaggaagugggaaaaucucaaacuaaacccucucagauuauguucuuacucaaaauacauuugauguauuugaaacacuugaugccuuuaugaacaaauuugccuugauuuauuaugcaaagucauaauuagcuauuuuaauucauuaacugcuuguuuuuaaaaaauauccaauuuuuaaaaacaacaaagcaaaaguuacaugguaugaccuauagagguuuuacaguggaugaauuuuaacaaauguauacacacauacaaagcucuaaucaaguuaucgaauauuucuaccacucuaggaaguucuccagugcucaccugcagucaagcuccaccacuuucauggaaacugcuguucugauuucuaucaccaaaaauaaguucugccuguucuuuaaaucaauauaaaguauguacacuuugguguugaacuucuuucaacuauuuagagaaguccaccaugcacuuacagguauuagaaauuuuucuucuuauaggugaaguaucuuuuauuccaugaaaugaaaauccaacauuuuaucuaugcuuuugauggacuaucggauuauuuccaguuuagaaucuuuacaaguaaagugacuaugaacauuuguguagcaaaacuucuguggauacauacuuuccuuuuguagggguaaauaccaggaaauggaacuguaaaaucauaaaacauaucuuuuuaaaaaaaaaaaaaaaaagaaacugaggaacuguuuuccaaagugauuguaccauuucauacucccacuagcuauguuuaugcauuucuguuauuccaucaucuuauucacuggauguuuuaauuuuagcucuucaaguggaucuacagugguaucucauuccuguuuugaaugugcacuuucaugauaaauaaugauauugaacaccuuuuaauggacuuauuggcauuugaaaaaacauauauauaaauauauuuauuucuuugggcacucuguugaaauauuucaccuuuuauguugccuuaaauuggguuauuaugaagcauuuuagaaauauauauacauauauacacacacauauguucugcauacaugucuuuugucagauauauauauuucaaguauuuuccuccagucuguagcuugccuuuuuauuuucucaacugggucuuuugauaaucagaagguuuuuauuuuaaugaaguucaauuuauuaacuuauuuuuucuuuuauagcuagugcuuuuugugugcucuuuaagaaaucucugccugagacuguaagauauuuuuucucuaauuuguuauagaacuucuacaguuuuugcauuuauauuuaaguguguaauacaucucaaaauaguucuuuuucuuagucuuuuuuuuccuguuuagauaauuucuauugauauggcucaaaguucacugaccuuuuagcaugcagagacuaguuggcuguuaacuccauucaguauauuucaaucauggcacuuuucuuuucucuuuguuuuuuuuuccugagaccgcucacucugucacccaggcuggagggcaguggcauguucagaacucacugcagugucagccucccaggcucaagcaauccucccaccucagccuccugaguagcucaaaucacaggugugcaccaacacgccuugcuaauuuuuuuauuuuuuguagagggggucucucaccauguugcccaggcuggucuugaauucuaggaucaaacaauccucccaccucagccucacacagugcuggaauuagaggcaugagccaccacacccagccauggcacuuuuugauccuagaauuucuauuugauuuuuauagcaguuuuuagguaagauucuucaucuguucuugaacagcauccauguuuuccuuuaaguucuuuaacaauauuauuauagcuaugguaacucuaauaucuuggucaucuuccaucuguuuccagugacugcuuguuuucuucauuaguugucuucuucacuuguauaauaauuaugaaugauauaucccaaggugucuggauuaucuuuucuucccuuaacauauugaguauuuuuguggcaguuaaauuauuggcagauucucuugauccuuucacgcuugcuuuuauacucuguuagagugggccuauuugguuuuauucuucauuuuagauugugauucuccuaagguaggucuccuucuauagccccaacugagcuucuaggcuguuaagcaagaccuucuacacuggcugcgacaggacuccaauaucucucagcauugugugaccuucagugccucuguuaagcauucaguucugcagaaggcacccucuacugugucuuacagagucccacucugugaauauacagccuagccacuggccaauggcacacaaggaacccucauuaaaccaauacaaagacaaguucaacaguauuuuacagaaaaucuuuuaagccaaagagaaaaacagucaugauuaacuauguuggcaauaauuuuaagguacauaaaaaaagauauuuguaacauaucuguauuauccuaauagacaaaaguauccgcuauaggaguacaugauucgcugccuauguccgagagcuuugaaucucaauuccucacaccuggugccauuuuacucauaauauguaaaaggaagagcugcuagaaaaacuuacgucaccuguguuaaguuuauagauauacacuugaauuaacaauauuuuuggccaagauucauaaauacacuuuauguuuuaugaagcccaauucaguuagaacuugaggucaagcaaagaaaucaaguguaagagcugacauaaaaacagguuuccuuuucaauacacuuucagcuaucuuagaaauuaacuguucggaguguuuuucuauucauacuccagaaccucucgcccaauaaaauuaucuccucccagggcuuucacuagugucaauucacuaaagaugcccgugucaacauuucaaggucgcgccuccucaagaguuuaaauauucaucuagauauccaccuugaauucaaaaaccccacaacagaauuccuucucuuguucccgcaaaaaucuguaccucuuccugaaucugcauucuggcugcacuauguaccuagucaccgagagguggacuuauaccccucuucucuuucacccuuucaucugucugaugcaucacuaagccccaagagcuuccuccuuuaauuauaucugaaguuugucccucuguuuccaucucugcucuaaugcaauuuuuuaaaaaucacucacucuauucccacagccuucaaacuggucucuucccuccuauccauucacaacacagcuucuaagugcucuucuuaaaauacucauuugauaacauaguuuccuguuuuaaaauguacuaaguauucccacacaucucuagaaaaaaguucacauugcuuuugugccucucacugccuuuuaauucgcuucucuaauaauuuacauccuaguugcccagcuacaccaaaccaguugaaauugcuuggacgugucauaugguuucagaaccuaagccguuugcacaaggcaaaccauccacaugcucauccuugggucucagaucaaacaugaacaccugagacagaagacucugguuuuucugaccgcuguguuguuccaaucuguuuauuuuacuggacucuauuugaaaugauccauuuguccucuauuagacuguaaauucccuauguggagggagcauaacaaauauaucuuuauucuccugugucuagcacaaugcuucaccauauuugcaauaaaucaguguaaauguaauugggauauccaccaccuuaaauauucaucuuuuuuaugcuacaaccauuuuaauuauuaaauauuuucuucuagcuuuuuuuuuuaagagauggggucugggcuggagugcaguggcuauucacaggcgacaucauaacucacggcaaacuugaacuccuggguucaagugauccuccugccucugccucccaaguagcugagaauacaagcucaugccacugaaccuggcucucaaguagucgguuuuuaacuaaaaauauuuacagguuacuacaaggcucuucuuuuuauuuuucaaucuuacuggaaugaaaagcaauaacuucuaacauuagaguuaucauucugcucuaugauguaacuuagaaaauauaauaaaacugcaaaucuauuuccaaagcacauuuaaaaaauacccccagauagcugagcauucauaaauugauuuuauggucauuugcaaagguagcaggacauuggggaaguaaagagagagagcaaugauugauuauuugagaaguuaaccucauuuuagcagauuuuugugggguuuuuuuuuuuuuuuuagcucaaaauguuuaucuaacagauaaaucaaauggagcuuucuguacauaccucauuacaauucuaauuuauuuucccaacagaaucuucacaauuauguaaaaauuggcacgguccugcuagugacacuuccuauucuuucauaccauaaagccugagcuuauaaacaagcugcagagagaggcauuuucauuacauacaucacugcauuguggcgguaucuccagaauggcuuaaaugcaucauguacuuuuacccaaauggucucugaacaagaguguuggaagagaugucaguucuugggcccugacaauguuguuuccuagccuaaaaagucugagaaauguggaauauuccuaccuccuucugugagaagucagaaaaugaagagacguauucaucuuuaagccaaccuuccaaauuuaccugagcauagagcaccaccccuucaccaccacccucuuuucuuuccuuuggaaauucuuauuaacauucuauaggacaucauuggaagguuaaucugauuguggcacauccauaauuuggcuauuuagaacauuauguuuaaaaacagaguuaaugucaugagucugucugcuuaucucuaucucauuguauuuuccgcuuaucuuccugguuucuuuuucuuccugaaucuccaacacaugcccacacuuggauuuuaaauuauugguccaagacaaaaagagucaugaguacaaguucgggccgaucuacuucaaugaacaaacaaucgaaagcucuuuacuuccugauggcaaaaauauauaaaauuagugacaucuacuucaguaugcauuaaccucuuuuuaaaaagcugccuccuuuaucuuccauucucaauuugcuuuaggaugucuuuuauuucuuccuuaucuauggcuccuacuuucucacagacuuuuuuuuuaaaauguauuuggaggcugauaugaucaguguacuuccucugaaauuaaaguuucuuuugauauugaguucaguauauucagaguggaaaucaaaugacuuaggcugguuacaaagauuuaaguuaauagagaugaauuuaauccacuggugguguguucauaaucaaaugaaggacucauuucuguucuagagccuaccaaauaaaaaugucaaaauaauuggauuaaaaucauaugaaauuuauuuauuuauucaacaaauauuaaauguuuuuaugugccagacaauauugggugauggacauacugauguuaacacugagacccuaccuugccuucaacagccucuaguuuagcagagaaggcacacauuaauucuguauuugugugugccaugaucugauuguaauugugauaaaugucaugggagagaugauagggcugauacagcccaguccuuggguggggaggcuggguaaggauagggucagagaaggaugaccugagaaagugacguugaagcuaagauauaaagaauuugaaaauggcuugguaaaguucuagauaaaugaaacagcaucaaaugcgaagguugccacauuugagaugagagcaggucagugugguugcaguacagagagcaaggcacgauagugugagacuaggcagagaauaagcagagccaccaucauaggagcucagaggccaucuuaggacaucagaacuuucuguuaaaaacaaugggaagccaagaaagguuuuuaaagcaggaaauggacaugaucagguugaguguauaagccgucucccuagcucaguggagaaagcagacucaucuuggugguaguagggagaccagcaauuguccccaaaauguccagucacuacuggcaaaagcaccccuaaaaaacauacaauugaggaaugcaaggugcaacuucauuagaagccccucggcuuacaacgucuaucuaaccagaaugccauucuuaaaucgcuccuauuccuauuucaaacuucugguucaaacagcucuaguagccauggaagaaaagauuaaaggcagaaagacugguagcagaaaagccaauaaggagguuuuagccuaggcacuugguucuggugguucaggaaguagagaaaagucaauuaaaacaagcuacacagaaggcggaaucucuaguauguggugaaucugguuauugcaauuacuacauguaucuuuuuaaaaaaguaaugguuuugguuccucuugaaauuuacaugacacuggaauauccucauuucucugaauuauuuuucuuacauauaacacauauaugacauuugaccuugucagaugcuuaaaacagaagaauuaagccaagaaauauuucuaucaaucucaagucuuuuaggaaccuaacuaaaggagaauuaauaguuuaauuauaaacaauucuuuccugaucauuuuaaaagacccacugagaaugugugccaggcaaaauagucuaguuuuaguuacuuuuugcaaccuaaaguaagaagucucuauuuuuuuaaacaauauuugaugacuuagggugauccagaauuaauuuccuccgcugcuaaugcaauucuguaaguuuuuacucaauucuacucugcaucauuaaacaggacuaaaagcuuuacauuuagggaagcauaucacuuggaaaaaaaacacguuaaugugaauuauaacaacaaacuuuggagacuaaaggcaugacuaguaggaucuuccaccccagauuuuuuauaugcuaagaaaaugaagaaagaagcacacacacauacuagauuaccuacaacacggccucuuaggcaaagcauugacauuuauguagaaggacuucaagcguggagcuagagaauaugcauauucaaguaauaauuugauuuuaaaaccugugcagcccgaagucaagaucaaauugcauacucaauuuuuccaccaacauuuagaauauuuucucaacguugagacgugauaauaguuguguggcuguguguuuuuuaaaaagucuauuaaguagaagagacugcuaaucacugaaccagcccuugcaguuuucuuugcugcucuacagucaguuaacaggauauuacaaaauaaauuaagaauaagaaacaggccaaguuaaugcacaugauaaagaguugagucagggaagguuucugcaauauuuggagccugaaaggagagacucuaaggguagcagugguguaugauaaugagaagagggagagaaaaaugguaaaauacuuuaugcucuucaagaaucauuccuuuugcuccuuuugaaaaaaaaaaaacaaaaacaaaaaacaaaaaaaacacuuucacgguagcaauuuuuaaaugcuuuucaauaauugugagugccagauucaugauucuguauaggaacaucuuaauguaacauccuuaaguagaaacccaguagaacuugguuuuguaucauuacaucaauauugaaaguauagccugggugugguggcucacaccuguaauccuagcacuuuggaaggcugaggugggaggaucaccugaguucaggaguucgagacuacccugggcaacaaggaaaaaccccaucucuacuuuaaaaaaaaaaaaaaaaauuagccagauguggugguguacaccaguaaccccagcuauucaggaggcugaggcacaagaaucucuugaacccaagaggcagagguugcagugagcagagaucacgccacugcacuccagccugggugacacggugagugagacucugucucaaaaaauauauauugaaaguauaaauacuacuauaccauuuuaaaguacacauacauagaggaguagcaauaccauucugugaagacaacugguuaguuguaguuacuuucauauucuggagcugucuucugccuggacuauucuccccucaaucacaaauuuucacugggucagugccugcucagauaucauaucuaggcuuaaucaacuguucuguagaaagaccuucccagauccuauagaugcaaugcugucaaacagagcucucuacaacgauaaaaauguuccagauguguguugcccaauaugguagucaugagccacaugugaccacugagcaccugaaauaugguagugugccugaggaagugaacauuuaauuuuauuccuuuuuaauuaauucaaauuuaaauuaaauuuaaauagcuacacgugguuagugguuuccaugcagaagcagaagaagacagcuccuguucuucuauuucauucauauucuguguguccccuuguaggacuuggcauauuugcaguuacauaguguuuaaaauuauuuguuuaauguccaucuuucccacuaaauuauugagauuuuaaguagaguaacuaggucugucuugaucccacaaaagcccaugcuugacaccacaagcccccaugcuugacacauagugucuauucaaagagcugcugacuuaccauuuaaauaaagcuuuuaauuaucuuaaacauauaauaucagauauuaauaaguugguuaagugaauaccaaagguucauguuagaagacuggaauacuguuuacaaggugugaacuuucuggaaaaguccagaaaaugccaccagaaauuauaaaaaucagugguaaaaugugguugccacagauuuuucauaaacacaaacauacauacacacacacauucucaaaacacagcugccuucagcaaaagagucuucuauuuugcucuaaaaucuguugugguugugaaaaugaugacacuucucugcaaaagaaaaauuucaaugcaaaacaaacucacaauuuagcucaggauguaugaaaaaguugacacaaagaagcuguccuuuccugguuuaaaugacacauuuuaucuuuagauuuugguagcuaauuuuuaaaaaaauccuuuaaaacguauuaccuuuuccagggacaaaugcucuauaauguuauucucugccaucuuugaaaaugaaauaaacauuuauuaaaauaauaccauacacgacauagauauuuuuaauacccccauuggaaaugguggcauagagaaguggacaguguguauaaagcuacgaauuccagagaacacugguuauaauucagugggaaauacaguuaguuugucauuguuuggcugauuuguucauccauccauuuaucucucucuccauauguaauguuuauccuuucuuacuuuacuaaaauaauaucuuucaucaugaaacucacaguaugcuaggaaaguugaaaaaauacacaggugacugaaauauaagccccuaaagaaagcuguguucaggagaggcauagaguucauccuuggaggagccauuuauaugaaaacaguucuguuuacaugcaacagagaaagccauuaagcuuuuuuuuuuuuuuuuaauggaguuuugcucugucccaggccggagugcaguggugcgaucucggcgaugccucagccuccugaauagcugggacuacaggcacgcaccaacacgcccagcuaauuuuuguuuuaguagagacgggguuucaccauauuggccaggauggucucaaucucuugaccuugugauccucccgccucagccucccaaagugcugggauuacaggccugauccaccaugcccagccaagaauucuuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucgugauccacccgccucggccucccaaagugcugggauuacaggcgugagccaccgcgcccggcccagccaagaauucuuaagaaaauauccuagugagagccuuucuuuuuaauccugaaaugcaucugauugaggacacaggguuuagggagggggcacaaaggaaaacugaacaguacauauguguugcauaaauucauggacuaaugauuaggacaauuaaugaaugguuuaaauauguuagacgaaagcucauuuuguaauguucugaaacacaugaagcaaugugagagacuauuauuuuguuuguuuguuuguuuguuuuuugagacagagucucacccugucucccaggcuggagugcaguggcgcgaucacggcucacugcgagcuccaccuccuggguucacgccauuuucccgccucagccucccgaguagcugggacuacagacgccugccacuaugcccggcuaauuuuuuguauuuuuaguagagacgggguuucaccauucacaggaugaucucgaucuccugaccucgugauccgcccgccucagccucccgagacuauucuuaaaaacgcccauaguuuccacacaaacaggcugauuaugaagagugacagaaaagccaacaauuguaacguuugccuaaauuuucuucagguauguuccugguuuuucaggaggcacucugccuugcagauagagcuuacaaaccaagaccaucaggguacauguggcacuuucauuuuucuucucagaguagaucuagagacauuuaaauuaaucauuuggagguugaaauaccaauuccuugguauuucaaagauaaugugccaaguccuauuaucauuuagcaauaauuuaaggaaaggaaguaucuuucaaaaguacagaacaaccuacacagauuuaacaugucaaacuaauaugauaaaauuauuuugcuacuaugguaauuucaagaugggugugacauuuugcuuuuuugucuucuaaaaaaugaaaaaugucuuugaaucuuguuagcaaugccugaccuucagacacacuggccaugccagggaugcagaguucacagugauuacuccuacauguaccugggcccaaaggccaagccuaggagguucauuucauuaucauaaaguaaggugaaaaaagaucaaacguggauucaaaaaaaauaaagcacuaacaaggaggagaauauagcccguugcaagcacuacaaucaaguaggugguacacauccccaguccuugaagaauugcucaugugcccugucuaaaacugguuuuguagacucugacuuuugucuuugguugcacaaugaugaagaaucaauuuuaucccagaccagugaaaaugagagcacauuacuacuaugaggagaaccgcuaaagguuaauuggguuuuagauacuuagcccuaauuguucaagauuuuaucauaauaucaauuucugcauuaaugcaaggcacccugaggccauaugaaauagauuucauucuaaauuuaaauacauccuuccauccaaaaagagaagcauucuucccagauaauucccacaaucagaauccaacuuccuagaugaaauaggucaaauuaaccaaaccucccccaaaauauugcuuucagucagugaugacugacauaauuaucuaguuaauccuaauacuuagauacuuaauguagauaaucugaaacauuaauuaaauaugaaaauacguuacaugauuuuuccugggaacuauauuuuaguaacacuaacacuucuguuuaagaaguuagagauaguuuucuuuccauaacuggaacauugaguacuguugguucaacaggaacaaguuugguaugccauuuauuucgguauucagagcaggucauuaccaaaaugaaaauuaccuuaaguauuguuaagccauuagggcacaguuuuguauaaucagacaacaucuuaauagauacuccuauuuauugucacaauaaaccaucuguuaaguuuuagagauccauuuuugaaaaaaggagauaccuaguuuucagaacaccugguauaggaaacucuuaauuuacaaaauaaaugaaauugagggagacugaugugcguugcaaaagaauaccuagguugaagaaaaaacaaaacaccuaccuaaauauucuuugaccaguaguaucucuagggcuucuguguuucaauuuacaauuuuguuuaacauauaaccuuuaagguauucaaaaacaacagcaucaauaauaauagcuaaaauuuagacaggagguuaugugauccauucacuauucuagaaacuuuacauuuauuaucucacuuaagccucacagcaauccuaaaagguaagugcugauauaguuuggauguuugucccuuucaaauuucauauuaaaaugugauccccaaaguuggagguggggccugguaggagguuuuaggucauggggguagaucuguaaugaauagcuuggagcccuccccaugguaaugaguggguucucacuguuaguucacacaagaggcuggcuguuuaaagaagcuugucccuugucacucucacugccucuugccaugggaucucccagcuccccuuuugccuucugccaugauacuaaguuuccucuggccucugcagaagcugaacagauguuggugccaugcuuguacacccugcagaaccaugaaccaaacaaaccucuuuucauuauaaauuaccuaguuucagauauuccuuuauagcaacauaauuggucuaacacagucagugucguuauuuucauuuuacagcgaggauacugagacucacaguaacuucugaagguuguacaaccuuaugggaaaaagaggguacagauuuuaaaagcaauggauuaaaaugaguacugcugugaauaucuacaugucuccguacacguccaaguuuaguugucucacugcaugaguauuuuccaucuuuucagaccuauauuaaaaaugcaagccaaauaucgauuauuaucauuaccaguuucuaacaccccugagcauuuugacccgguaaggcaaagaugaauauuucuuagaccauuuuauccaucauagguuauucuaccagugaauagcugucugauaucuuggucucaacaugacuagaggcuuuacaagcauuuauaaaucccaguaauaguacaucuucuugaguggcugccugguuccacuaugcgaacaucauggcaaccgcguaacaaaaaagccacacagaguguuccuaguacuuacugauaugaccaagaccuuguagccuuugaaacuccaugauuuuuaacauaaccaaaaaguucaugaauaagagcuuggugcuucaugucacauauaaaugauuuuauauuacccauauauuguauucccgcgauuagccccaaagaugccuccccaauuuagcagaaguauauugcuuaggagggaacauacaaacaaaacaggcugggcacgguggcucacaccuguaaucccagcacuuugggaggcugaggugggcagaucaccugaggucaggaguuugagaccagccucgccagcauguugaaacccuaucucuacuaaaaauacaaaaguuagcugggcaugguggugggcaccuguaaucccagcuacauggggggcuaaggcaggagaauugcuugaaccugggaaguggagauugcaaugagccgagaccgugccauugcacuccagccugggcaacaagagcaaaacuccaucucaaaaaaaaaaagaaaagaaaagaaaagaaaagaucauuagacauaaaacaacaaaaaaaagcacauauaaagcuguucuauugcucagauaauauuucaaagaacaggaaagagaacauauuuaaaaguauauaucugcauugacugccaaucucucuuucgauaguagagaugacuauguuugauauuaagcuucuguaaaucaggcuuuccuacuuuaacuuucuaguaucaacugguauauacaaucauuacucuuucuuuccuuuuuuguuuuuuuucuccuauccucuacauggauagacuagaggcuuaauagugugaugauaauggcucuguaacucuguaacucuggguauggcguguucagaacacccacaguaaacaaucccaaauccaaacaugugucucagaaaaugugucucaaaggccuagugcugugcuguccaauaugguaggugguaacuacaaguagguauuuacauuaaaauuaaauaaauuaaaaauuccauuccuuagccacauuucaaguguucaguagccacauauggcuuaauagcuacuauacuagcacaaauaugguuccauuggacaguggcuagccuagaguaacauuuucuaacuuaccaccuugaccaggguuuaaaucaagaccagccaauggauugugccucacauguacaccuacuuaauuuuaauuggcauccuggaguagaaaaaaaguacaguguuuggaauagacaucucuugcggacauagaauugcggaguggugcccacauacaccaaacauggcucauaagaacuugcauuagcagcaguauaaaacuacaaaauacuaaaaaugcaacaagagugccacaucucauaaauuacacgugucuuuccacgugccauuucaaaauaagccaugagcgaaguguuuuucuucaggcauacagaguuaaauaaaguccugaauacgauccguaaucacaaucugggucuaaucugagacaauucaucuucuuauucauuaaaccagaaaacuuguaugaauugguaauacaaguaacaccgauaauuuuuuuaaauguccauuuuaccuacaugugaaccugauacucugaaaaucacuguugauucuugucaaguaaacaacuaugccacugauaaagcuccauucuugaguccauauuauucccugauagaacccaauaaucuaaucagagguuuuuuuacccccacuuaggaauuguuuuuuggauacugugacuccaauagggcuuucauuaacuaaaaagaacuguauacaacauaucaaaugcagcaucuggucuagucugaauuucuaaaugacaagcacagcaugcauuuggaauuacauagagaacgagaaaucagaccucuaucauuagcaaucuuuuuccccaaacacugcuuccacuucaugcuucaacaccuuuaccuuccacagaccucuugguaaugucacgacuagcuugucaaaucaaauucagcagcacacaagcaucuguauuaauacuuuugcauuuucauucacuaggaaaaaacaaacucuacuuaguaggcagauuagccauuaucuacuguaacucuaaaccaucugaguuacauuacuaaaaugaauuggcauugaaaacagagcgacagaaauguuuaccgauagaaaaauauguagggaaugggaguuucuuuugcgcuuacuugccagugacuuccuaaagcuguaaugaggucaaaauaagcugguuuauuucaucugugaccacugggugagaucucauuuuauaauggccuuaauaauuugccacuuaugauuacgauaauaacaauauuuuuuaaaaucacuggaaacuuuaauuagguauuuccaaaucgcuagggguuauuaaccaagggucaauuuugcucccccaacccccacccagaaauauuuggcaaugucuacugauauuuuugguucucauaauuggaggugagagugcuacuggcaucuaguggguacagaacagggauucugcuaaauauacuucaaugcacuggaaaacuuccugcaacaaagaauuaucccacccaaaaugucaacaacgccaaggugaaaaaaccaugcccuaaagcuacauaugaucacuaucauuuaaaugauuauuccaggacuucuauggacaugagcuacugaaaaaaaaaaaucauuuugucuuucacagaugucaagcuuaaccaaguccaugugaccauuuagagaguuaggagguacaucuacuauaaaaauagcauuuuucaacagaggcuauuuuguuauuuguuucauccuuauucauccugucucucuaaacaacagcaaaauuuuuaacccaucaucaaccuuuaaauacuguugggucaaguucucacugucaaaaaagacauauuaauugcaaaaaagcaaaaacaugaccaucuuuacagugcuaaaucacuucuggaaaauguuuaugucaaaaaucagcuuaaauuuuuggagauaggacaggcgcagguggcccaugccuguaaucccagcacuuugggaggccgagguggguggaucacgaggucaggagaucaagaccaucuuggccaucauggugaaaccccgucgcuacuaaaauacaaaaaauuagacgaguguggugcugcgugccuauaaucccagcuacuugggaggcugaggcaggggaaucacuugaacccgggaggcaaagguuguggugagcugagaucacaccacugcacuccagccuggugacagaccaagacuccgucuuaaaaaaaaaaaaaaaaauuggagauaauuuuuaauagagacuauuacuaaucuaauaauaacuuccauaauaucuuaaguuucacaacagagaugaugauauaaaguagaauuaaguggcagccuaauuauuaaugauguucuuugccuuugagauaauccaguuauacacuuuaaagguuugguaucuuuagccccaugcgaggagagagucguauguuuuucuuucucucacacacacuccaggaaaggaaaagcaagcacaguaguuaaccccugauaguuuauuagucauucuugcuuugucgcuuuauuaccacgaaacuggucagucauggacauaaacaaaacgugcaaggauaaggcaggcuuucacucacauaaaaacugccaagggccaaccccauugugaaucacuacagaaaaucauuacaaaaucuuaaaacaacaacaacaacaacaaaaacccagcacuuugaaucauaguaucucuucaacagauacacuacaaaacuuuaucagaaacacuaugugagagaugaacagagcuaggagguauuuucacauuaguaaaaaaaaaaaaaaaaaaaucucagaaaucauuuauauaaaaaccuauugugagaagucuaaauuuacguucaaugccuucccuuucuuucgcucuauacaguuuuaaaauauguucauuuuguucuaacugcacaguaauaggcauggccuucuaagcagaaaaaauauauuauggcaaggaaaaaugaagagauacguugcuaacacaacagacuuuuguuaaacaauuaagaggaaaaaaaugcauacaauauagcauuugcuauauaaccauaaccucucccauuccuggugucccacucugaauucuacuugauucaacaacuuaagaugcaauggaaauaauaaugucuauuccagcagauuaaaaaauacaaggcagcaguaaauguuaugaccaccagcuaaugggcuaugguggagaagcauccacuguggauuaagcucucaaguacucaauaacuuuuaaaaaugccuuaaaucacccacaaaaugcaguauacauggcuuuguguauacaacuguuaaguguacaaauauacaucaggugcaggaaaucaaaagcagccuuugugaaaacuuaguuuuauaguacuuauuacuacaaacuagacauaaaggugcugaauaaaauaauuaagaaaaaggaaauagcaacuuugaacaaucuuauaaaucauuuuauauaaguuaguuauccuuagaguauguauacuauaauucugaguuaaauauuuauauaauacaauuuuuguaacugaaacaggaucucacuuugucauccagucuagagugcaguugcacgaucauggccuacugcagccuugaucucccaggcucaaaggauccuccugccucaucuaccugaguagcugggaauaaaggcaugcaccgccauacccagugaauuuuuuuuucugguagagauggugucuuacuacauugccuagacuggucuugaacuccugaacucaauggauccuccugccucagccuccccaaaugcuggaaugacauaugugagccacugugccugguccauauaagauuuuagaguauuacucuaagagauuaacccuacccuggggaaucgaugucaaaaguugggaauaucuuuccuaggugaaauaauagaaauaacgaacucuuuagagcugacuauguagcaggugcuucugagugccauacccaggguaacugauccauggguuacauuagaggaaauugaagcauaaggcaaguaaguaacuuggccagagcugcagagcaaccauguggcagaaccaagauuucaagauuugagccccggcagugugguuccauagacgcuacucacuggucucuucugccucuggaagacucucuccuucccugccuucuugucaccccuccucccacccacugacuaccacuguacagcgagggucuuaagccagagauccuaugagccgcaaccaccaucugugagcugcacauuuuuugaggaauuaccuuuccggcagcacauuugagggauucaaggacuuagaacaacaugaaacaauucaacaauaaugacaaggcaaugacuaucgaagugcagcuucaccucacaauaucuauaaaaacauccaugguuauugcaccauccacuuguuccucuuccuguacucuugucauuguuucaauagaaaccgcugacuacccugacugcucucauauauacccagaggacaagguuugagcaucuucugguaaacagcaaucuuucuucaugcuggcaugaccucacacuccacuucuugccucuucucuaaacaauuucuucuguuguauacacuacuauaaucauagcacacaugggucaaaaucacuagucuaaucucaguacucuaccugcaaaagagcaguaccuaacaaagaaaccaaccuacacucucauuugugaagggccuacugugugugcguuccagacgauaugugguaggugcugaccacuuuacaugcaucaacugaccuuuaaacagaacuauguccacuauagcguaaacacaaugagggcucagaguggacaagcaacuggugguccacaauuccauagccuguuaggguuaaagcugggauucuaaucuggucugcucuugaaaguccccacuugguaauauuucucuuucucugccuuugccuaaggaaauucuauuuauucuuuuuuuuuuuuggagugcaacagcgcuaucucagcucacugcaaccucuacuucccagguucaagcgauucuccugccucagccuccugaguagcugggauuacaggugccugccaccacaccuagcuaauuuuuuuguauuuuuaguuagagacaggguuucacaaugucagcuaggcuggucuggaacucccgaccucaagugauccacccaccuuggccucccaaagugcugggauuacaggugugagccaccgugcccagccaacuuauucuuuaaugucucccacacuaaucugcauucucccugcaggcagggaccaugcuuuguucaccucuguuucuauuauacuuccuaaggaauggacacuuaaaacuucccgaacugaucaaaauaaaugugagaggacagugccuagcaucuaacaggcuccuuggugguugcggucuaaguggacauguacaggugggauuacucgaauucuaagaauggcuggauuuaacacaagucaaaagcauuuggaaacaauaaucaucauccugaauucccaauucucuccccccucaccuuucugccucugcucuaccccuucuucuccaacccuaugucucagucugucuguuucuccacucucuugacuucucucucugucccucucacaccauuauugucaccacaggccuuugaagcgacuauacccucaaacacaccauacuuaucuuccacaaucacaucugaaauauuuuggcuauaguuugcuuaugguuuguuuggccuugcugagucucauguugaaaucugaucccuaauguuggaguuaaggcucgaugacagguguuugggucccaggggcggaucccacagagaugguuuggugcuauucucaaaggagugagcccucccucuuaguuccuucagaacuggugguuaaaaggagccugacaccucccacccuucucugucuugccaugugaucugcacauaccaguucuccuuccccuccugccaugagcagaagcuuccugaggcccuaccagaagcagauauuguugcuaugcuucuuguacagcuugcagaacaaugagccgaauaaaccccuuucuuauaaauuaccuagucucagguauucuuuuacagcacacaaauggacuaagacaauuucuaaccacaucugagauaaaauuaacccccuaaauaagcacacaaaugguauugauaugaugaauaacucaccucaaauguacuucagauagccuucugcacaaggcacgucucuugaguuaacaaacccuagccaggcaugguggcucaugcccauaaucccagcacuuugggaagcugaggcaggcagacugcuugaguccaggaguacgagaccugucugggcaacauggaaaaaccccaucucuacagaaaaaauacaacaauuagcagggccugguggucacaugccuguagacccagcuacucaggagacugaggugacaggaucauaagcccaggagguggagguugcaaugagcagcgaucaugccacuacacuccagccugggugauagagacccaaucuccaaacaaaacgaaaccaccacacaagaccuaaaccugauauccagaucugagaagacagaaaauauuuucaaaucucucacauauauaugcauucauacauugcuacuuacuuuccucuuuguguguuacugaugucuucaaguaaucacacagcucucugcacaugccagcucuuguguuccaaguuuccaugcagcaucucauggaauugccucaacaacuccagggcuagggacuacugucaucuguaucuaacagacaaggaggcugugguacagagggcucguaaaguuagcacaguggagaaggcagguugcuacucagacauccauuccuagagcccacauucuuagaacacacagccugucugucccuccagcaccacccugccuacuuuuagucauccuggugucgucuggcuguaaguuccugagaauuacccuaguugcuaauguacuggaauggcaucuuccuuauuaaaggcacucaauuuagcaaugcauuugcauucccugauugguuuuccauauaagugguucacaaaauauggucccucugcaccacuugggagugucuuagaaauguguauucucaggcuuuaucccagacuuguuauguuagaaacucuggagcaagggccuaccugccugugauuucauaagcccuccagguaauucugaugcaugcugaagugugaggcuuacuacccugcaugauauuuauggcaaguuuuagguaacggugccuuugaacacuaacuuucagaaauagaagauagaaaaugugcaguaaggcaucuugcuucaguaacacccaagggcacauucugucuacaguuccucacucugucaucuguccucacacguaggcuuucugcuuauacacuccaaauuacaacuaccuaacagcuucuaaaaugagugucuggcuuggaagauuuuuaaaugcuaucagagaaugucuguuucaggauuuaacuuguccagugcaaagaagugaggcugggccacaagugacccaucacuucaccuguaagagcaaauuaauuaccccucaacauaaguguuauauuuaugugccaaguauggucgauaaugaggucuuuaccguguagccauauuucaagccauuguucacuuaaguaaacacauuuuaaucacugucauuuuauuauuuauucuugagucuacuauacaccugucagaacauuuuguguuugacuaacugucaucuccuuguaucuuuccugcaucauauauaaaccacuguccaccuccacauuuuucccucuuacugaagucaagcacuacacaaguucauggggacuuagaggcaagugugacggcugaccaccccaauaguuugcaaagccuuucaucugcuccucugaaaacgcuuuucacacauuccuuccauauaucucucugcugcaaucucucuguugcaaaacuguuguugaugaagugacauuuaucuaagcauugucacuuugaauaauaccaaagaaagaaaaugaaaaucaauguaauugcaagcuaucaaccucaaauuuuauucacuuguuuuaaauuugucaaaugaaaauaauuuguuuaucugaguaacaauauauggguaucaguauauggauaacaauuuuuaaagcuugauuucaaauuuggauuuuuaauauuaaaaagaugaaaaauuuuuaguccaauuuucccuagagaacucuaacaauagucauguacuguauaacauuucaauaaugacagauuacauagaugacaguggucccuuaagauuguaauggagcuaaaaaaaaaaaaaaaaaaaaaaaaaaaaaaaacccguacccucuaguauuuauuacaagguacuuuuaacgauuauuuuagagucuacuucuucuauuuauaaaagagaaauaaaaauguaaaacggccucaggcaaguccuucaggaguugcuccagaagaaggcguuguuaucacagaagaugacaguuccaugccuguuacugucccuaaagaccuuccagugggacaagauguggagguggaagacagugauauugaugauccugaccuggcgcacgccuaggcuaauguguguguuugugucuuagucuauaacaaaaaacuuuaaaaagaaaaaaaacaaaaucuaauauuuaaaaauaaaaaaauacacuaaagauauaaagauagaaaauauuuguacauagcuguacaauguguuuuaagcuaaauguuauuacaagagugucagaaagcuaaaaaaaaaauuuaaguuuauaaaguaaaaaagcuacaauaagcugggcacaguggcucaugccuguaaucccagcaauuugggaggcugaaucgggaggaucacuugaggccaggaguuugagaccagccuggccaacauggugaaaccuuguguguauguguguacuacaaauauaaaaauuagccagguguggugggacaugccuguggucccagcuucucaugaggcugaaggacgagaauugcuugaacccaggaggaagagguugcagugagcugagaucacaccacugcacuccagccugggcgacagagugagaccgucugacaaaacaaaacaaaaaacaaacaaacaaacaaacaaaaacaaaaaagaacaagcuauaauaagcugagauuauugaagaaagaaaaauauguuuaaaauuuauuuuuguuuauuuauuuucuuuuuuagagacaaggucuugcccugcaagcccaggcuggucuuaagcucccagccucaagcaauccuccuucuucaucaauguuuuuaaacaaauuuagcauagccuaaguguaucauguuuauaaagucuacagaggcauacaguaauaucuuagcccuucacaugcacucaucacuuauguacugacucauccugagcaacuuccagucuaagcuccauccaugguaagugcccuguacaggucuaccauuuuuuacuucuuauacuguauuuuaacuguaccuuuucuacguuuagauacacaaauacuuaccauuguguuacagcugcauauaauauucaguacaauaacaugcugugcagguauguauagccuacaugugcaguagguuacacccaucuagauuuguguaaguaacuaugauguucauacaaugaugaaaucaccuaaggacacacuuagcacaauauauccccuucaucaagcgauggaugacuguauucauaaaaaucuggauauugaggggcugccugauaaugcauuauuauauguauuaaaaugugucuugagccaaaugcuaauuaacucuuggcuggugccuuuccuuaauguuucuuucuucuuuuuuucuuuuuuuaauucugauuacucuuugggacaaaaagguggugcugaaacaagauaucauuuaugaucaacucaauacagagauuacuuaauauuuaucacauuaugcagaggcuucaauaaguucaucaaaauauauguuccaaaauccuaugcauagauuucaaacuuuucuuccaucaaaauaaauucauacuaacuuguuguaacaugucugaguaggaucuaguuugaggcacuaagaagauuaagacaucaguuugaaaagaucccguaucagagcaacaugaauaacaugaauucugcuaauguugaggcaagaacaugcaucaaauuuauggcgaagcuuggauggaagaaugguaaagucgcugaugcuuuacaagaagcuuaugggggcaaugcccaaaauaaaccagcaauuuacaaauggauaauucauuauaagaauaaaugacaccaugucgaauaugaagccuacaguggcagaccaucaacaucaauuuccaaggaaaaaauucaccuuguucaugcuuuaacugaagaggaagaaggacugaugauuaacagcagaaacaggcaacaucguagacaucucaacugguucaucuugcaccauucugacugaaaaacuaaagcugaacauacuuuccacucagugggugccaaaacuguugcacacagaucagcugcagacaagagcuuucuacugaaauuuuaaccaagugagauuaauguccugaagcauuccucagaagaauuauaacaggagauggaaccugguuuuacccgcaugauccugaagauaaagcauaauuauagcaguggcuaccaagagguggaaauggguggggcccaguaaaaccaaagguggacuggucacaaguaaaagucauggaaacaguuuuuugguaugcucaagacauuuugcuuguugacuuucuggagggccaaagaaugauaacaucuuauuaugagagucuuucgggaaagguggcugaagcuuuagcggagaaacagcuagggaagcuucaucagaaagcaccucuccaccaugacaaugcuccuguucauucuucucauuaaaugaggacaauuuugugagaguuuugauggaaaaucauuagauauccacuuuacagucccgauuuggccccuucugacuuuuuucauuuccuaauuuuaaaaagucuguaaagggcacucauuuuucuucaguuaauaauguaaucaagauugcauugacccccaauucuuuagggauggacuaaauggcugguauuauugcuuacaaaagcaucuuaaacuucauggaguuuauguugaggaaauaaagauuuuuuuugagaaaaaauuuaucuuucaauucuauuuuccacaaacuuuuugaaguccucuuguacuauccucaaacuuugugcacuaauugaaaaaauauauauauuuuuguaaaauuauuuauaauguuacauauauaauauauaauuuuacauauaacuuauguauauaauuauauauaaauuugcauguaauuuuuacauauauacacuucuacaaaggaaauaagugaggaccaauuuuuucuaaguggcuuaggaaaagcugaccaaauaaaagauccuuccucacacacuguggaguccuuccauugaagaauguggacaacacacuccauagcagaagucaaaacugguggcugcucuccaucauauuuuauuucuuccuacguuuuuuuuauuuaaauaaauugucaacuuuaaaaauucaagaucuuacaucuaaauaucuggauuuccauuaccucauggaaaaaaugaggccucuggcaaccaugaacucuuauccccacauggcaacgauugcaugguacuaaauaauaaugccaccuaugccaggcuuggauucucuucacuccaguaaguucucugucuggcuccugugggccucugcauuugccacccugcucugcguucaguaauaacugcaagagaguucuuuuguucccagcuuggauugauccaggaagaugucuaaagaaagcuggaccaagagcaaacucuggagaauggacgggaaagaaaaugaguaggaggggaaaagaagagucucucaggauaggcuuaugguguaagcaaagccucaggggugagggucaggguaugggggaaggauguguaagauagaguaaaacacugaauguacugguuugacugggucagagguguaggaaugggaauagcaggugaaaaacuucagaaaauucauugaagagagacugaggagagccuugagggcuaauccaaggaguuucugagacauucucuaaauuacaguucuuaacuuucuauugagaaacagaucaacccacucucuaugcaauuucagguaagcuaaaugcccacuuaaagcuuaggcagcaugcccugccucuccuuacuuuccauucuuuaaaucaaaaaacaguaccuacaaauguuauguuaaucugggagcaacaugcccaaaaucaaaaggacugaacaugcccaaaaucaagaggacugaaagcaggaagaaugcuuuggcacagaaggggaaaggaugaagcggcaguggagagccaugguuaaggacacagguaccugccuggguucacauccugaacugaguauaugcaccauggucuucugaagguuacuuauuaucucugagccucaguuuuuucaucuccaauggaggaaauacuaguaccuacauuaaaggucugcugugagaauuaagugaguugauacauauuauauauguuuagaauaguuccuggcacaaaguaaggucuccacgaacauuaacugugcugcugucagcaucacuaccacuguuaccacuaucaucaucacuuaaaaaacugcauuaaguccagaaggauaguggcugagaguucaucugcagccguggccauaaaaauagaaguaaauacaugacaaagaaguugugaaggaagacuauauaggacuugguaacugcagaaauguggggaaaagagcuauacagaaguauuuaaagaucacugcaugaaucugaagcuagaugauacaauaaaauaacauggacaaaggucaaaaagaauguggcuuuuggagaagucacauuuaagaugaaagcagaggacugcagugggacuauucagaaguaguugaaacggcagaaauagaauugaguagaaaggucaggcuagaugcagauuugacagcugguggugcuuugugaagcugauaauuucugcaaggcaaggggaugaggaacacagauaagccauaucaucaugaucauuguuuuuagauaccacugccuggacacuuucuauguucuaggagcuguccugagcauuuuauauggacugucucauuaagccaugauuaucuccccauuuuauagaugcagacacugaggauuagaaaguuuaaaauccuuguucaaaggcacccagcuuuuaggcgguaugaauuaaaaaguggaauccauagccuucacucuuaaucauuuacuauauuccuuuccacaguaaaagaaaagugagauguaaggaaagggaauaaucuaagaagucgagagacaaaagcgaaugagucaugccucugaggaagaagguaacgaguuuaugagcuagauagagagucuuccaaaggcuaauuugugcuucaugaauagagaaagguuuuuaaaaggaagaaagaaaggggccuaaaagggaaggaguuacauuugaucagucaaauacuagacaagaaaguaauucccaagaucaaauuccaauuucaguuugaaugcaggacaaguggcaggguuucauuugcuuggcaucaccaaagaaauggauaccagaauucugauuugacauucauuuacaauagaauuuugcaauuaucaauugccauuuuuccagcuuggacaggguuauuaacuuuuucuuggaaggugauuagugcuuagauuccauccuuaaaaagacacagacuacagagguaccuguccgguggugguaaauaaugucaacuccacaacaauggcuacaaacaccacaucacagaucaccacaccaacagcuaacacaccaagccuucuaccuaccaggcaccacacuagcuggggcugauaccgcacuugcuacccagaacuacccccaugugacagguauugucacucgccaguucagucuaccucuggugccuacugucuggcccucuuguugauauuuggguaagucuccuagaauuugaaacuuccauuuacucccucaaaaaauaaagaacggauuauguuuugauagcuacugcagcuuuauauaguugaugcacacucuguguauguucuccgucacucacauauagggaucuagagaaaacagcuauauaacguuaggggaaggaguaaauccccuuguuuucugauaaguuuaugagcgagugacaaaaaggaaaaucuuucuugugcuucagaaugagacagcgaugaaaaacaaaaccacuucugugcagggugaaacaaacauuauugccaaggccauuuuugauugggaaaugaacagaagauuaaaucauaguggcuaagugaaagaaaccagacacaaaaaguuaauauauuguacgauuccauuuauaugaaauaccuaaaauagauaaacccauggagauagaacacagauuaaugcuuaucaugggcuggaguggaugggagaaugaggagaaacugcuuaauagguaagagguuuuacuuugggaauguuuuggaacuauauaaaggugguagcugcacaacauuaucaguguacuaaaucuaacagaauuguucacuuaaaaugauuaauuuucuauuaugugaauuacaucucaauaacuuauuucaaaaugaaaaaauagaaaguuuaaauucaaggauacauauaaagaauuuuuuuuugcuuuuuccccagaacauuuaaagaaucacuauaaaaaggaaacuuuauccuccucauaucuaaguuuaauuugggaggaugugggaaggggcuuuauuauuacuguuacuucuuugcuuuucauuguccacaaaaucacauauaggaaugcaccaggcaaucaagcauuuucucuaccugggcuguagccacugauguaaacuacauagaaaauguauuauacagauaagcaaauucuucacugugaagguaguauucucucuacucaaaaguuuucaaagaauaaacugcaacuguagaaaagaaggguaacuuuuaaauuaauuuagaagcagagcucagcuugcccuuugcauuagcucagguucuuugaccaaaagacacaaagucagcauuagacaccuaggagauuacugggggaggaaagcaggguaggaaggaagaacuuccagaccaugaugcuaaugcuugugaagcagaggaagagauaggagguuugggaagaaggagucuuaggcuccaggguacuuccaagagaggucuggcaggccaacuaggaguccuugagcccauguuccagugagaaagucucacauguaaaaggaaggagucuaugcuaacagcucauucacugacuauaggaaguuuggacuugccaugagacagcaguggaucaaggauagcaguagcugaguucuucagccaguuaugcucccacaacaagagaccucaguggcccauuuuuauggugccacaucagccuacugauagcgacaggaggcggccaaaugccuaggcauauaaaggcagguccccagugcaaccccacuuccaagcugaaaacaguuuaaagccugaaaaccaagcuacagguuaaaugcuuggacuggauugagaacuugucuuccuguuuggcacacuuuccucugauugauccucaccuuucaccuauuuuacauauaccuacccuuuccuaauuaguugucuacacugccacgcccaccuuugaguagcgucuuugcuuuaaccuuuuuugcauacucacagaccaaucagcacacacucccuuuacugagcccauaaaagccacagccucagccauauuagagaauuuucccacuuucggguaggggaaccgcuccccacauccccucuuugcugagagcuuucuuuucacuuaaugaauucuacucuacuaacucuccaguguccacgagccuaauuccuccugguugugagacaagaacucggaccuagcugaacuaaggagcaaaaaacccugcaucacuauuuuucaaagucucuacuauagaucuggcaguacauuaacucucuuucuccuguagcuaugaggaaugggaagcugugguuaucggaaaccugaaaauaauaccuacuuuuauuuuaagcaagaguuucugcaacuucucuccugaaaaucuuugagguauaaugcuagaaagggagaggaaauaaaagacucauaaaggacaaugccaguguccaugcucuaagaaaaauuucagccagcaagaaacuaacuagaugagaaaguaauaaucguguguguaacccaaaaagggcaaaucugauccugccuaucaagugugacaguuuauuaacauugauuggaaauuuaacaaauacacagggucagucacauagguauuaaugccacacccacccuccacaaucaguuauaagccuguucuguuaaagcaguaugaauacuuuauaaucuguauucaucaguuuugcagaauuguaauguuugucugaaaucuagggugauacuuaguaaauuacacacuuaauauguuagaaaauauuaauguuaccauauuacccaauaauccaaauuuuguggaaggaauaagguaccuggaaggaaucuauuugauuucauaggaguuaagaaaauaauauauauaccacauagguggaaaaaaaaucuauguuuugggaaaaacugacaaacucuggauguguuacaagaaaauguuuuaaaaauaauaaaaaaaauuuauguaugcauauacacauguaaucuuaaaaauaaggaauaaaagguggaaagucuauacauaagaaugaaauuuuauuauauauugaaaagcaaguacugugauuaauagacuuuuuugaaagaugcuaacauaaccuauuuuugggccagauaaucagucucuuuuagaauaaaaugugcuuucuaucagcuuuuuggucacuguaacaauaauuugcuggccaagaacuaaauaaguggcuuaaaguacaucugaagguauuuauaaccuauaaaaaguuuccucuuaucaucauaucugcuuuauuaacuucaaggguuuuucugcagaaguucucucauuuucuuuuugcacugggauuuuguccuucauaguucuaaaagaaauaucccauuuucucccuuucuuaacccucaggauagaagaaguaguaucuucucacagugugugaagacucauucucccaaaagaugagcacaaaggaauagaugcugagaauaucaaugccugugacauuugcugucucccauaaugacugccaugggaggacuugggaagcggacugcaaucugaucucaagucuucugacucacacucuauuuuggacugcuuuugucuuggaucuggaguauagaaacaccuauuucguggucgguaggcaguuuaacaaucacauacacaaugaagcaaucagaaaggugagcaggugaauauucucuuucagaggauaaauuacuuuuucuaggaaaaugauuauuggcugacaaugaggugguaauuuacuucccucuagacuauaauaaacaaaaauacaaaguaggacaccauuuucaacagcugugugggugauuauaaucaccuuuuagccuugaaacuagucccuaucucauuagcuaugauacauaauuuuuuaaaaaaucaugccuucaaaaagaaaagguuuucuguggcugaguuaggcuagcuguccauagugccaccuauuaccaaacuuuacagaggaugagauuucuuuuaaguaaacccugcuucugaauucagaguauccucuugcucccagccuccaggaacuagucugaggcagucaguucuauuacaggaagaggacacaagaggugcauuauguaaguuagcaaugacuaagccgggugcucuauggggauggcaguacucuggauagugaaauaagugcucuuuuagguaggauugcuuuaguuggucuuugaguuacuuaagagccaagccuagagcagaagagguugcaacagaaugugacaugaguuggaaucuguagaacaggaauucaggaguugucccuagauacuauagcaggguaagaaauggaagcggagagcacaucauggagacauggagaacagaggaggugaaagaagcccuguaaugugaagcacgggauggaggacccuggcagcagccuggggccugcagaggaaaaagcuccaagaggagcuccauauaagaggguggccaaguucguggcaucagacuuuccacuggaaauggauuccugcuuuguccuauaauuacccucuuaucucuauaccuccaggaaaagaauguucuaacaauguugguguuagaaacaccaaccuuggguuaguagagcacuggggcuuguagggauauguaagaaacaucugcuggucaccaaggggaagagcugagcagaggugcuggcaugcacacagaagcaggaauccagagcaagagauggcagaagagcacaacagaaacucacacgugucugaaagugcugggguagacaguuggucuccccaugguaagcaggaucacaccauuugcacuuagaucauuagagaagcugaaaagacugaggaacuuagggaguacgaaaucucucuaagugaaaucucagugcgaaaucucagugagaggauuuuguuagucuaaauucaaagucucuaaaaaacaaaauugaauuagcugccaacauuuaaaagugagaucauuuuauuuuucuuaauccaaauucuuugguuaaaaaaaaaaauuagacaaccugaaaauguuaggcuuaaauuccuuagugcugcauagaaauuggugccuuuacagagaacaguucaaaacagaccuaccaccuagaucaauuuaaucauugauacggcuggccugccccuggagacacccaauucugcagccccugguagcaccugauuuaaaggaucuauccaugacuaaagacauuaucuaugcauuuguaaagguuauuuuugcuuugcuuguagugauugcucagaagauuuuuagugaauuccuuaguuauguacuuugaagugaaauccaaguuucaccuccauauacaugugaucuccaaagugguuucaugcucaugaaagacagcugugcugguuauuccucauuuuccaccagaugcauucucuuuccuuccugaucugcauccugggaaguuauuuccuguguaccugccagacucacugauccucugacuuacuguuagguucggccagugagaauuaucugcaacagaauggaggccaggagagaagagaagauggguauugacucacugucaugguucuauaacccuccacccccacaacucccauugugaccccuuggauaaggucagcucuuauguggcucugauaacacaugaucccuucuagguuuagaggugaugccagcuucccuccacuguuaguccccggugcuuccccaccccauguaguuuccuuaacccuaucuauaccuuauaaguaaucccauuacuaaaauaccucccauuaaaucugauuauacaaucuguuuccuccuggaccccugacuauaagucaaauuugaacauuccaaauucugguacaaaagcaguuggacagaaaagauaaaaggaaauagaguaaauuucaaaugagucuugaaaacaauuuggacaagcauaaucuugcagauugguccuuacaagcccuacuugccuuaaucagauaccucaacaguugaguguucugggucauuucuucucugaagccuuucauuucaugcguaauuagaaacaugccagucuguaaugauggcagccuuuaaaauggucagucugucacuuccauggcccuaacuccagacacaaaaugcaugcuugauuacuaagagucuuauuaaggggcuauuguuucccccaucccugccagcuccuccuaccuccugaucuuuaucaucuugcauucuacuuaaagaaggauuuaaagagaaaaaaagaaaaucucauagacacucacaucagauuguauuaauaagcaagguaaacuacaucugggcuugucacucacaguuuuucuuuuccucucuaaaucuaagaauaacaugcagucaguugcaaaacagggagcaaguuuuccaaagagcacgugggugggagaagccaaccaugaaguaaauuccaacaucaacagucugguuggauuccacuguggcccccacuaauuuucccaacuuuuugggccaugaaauuuauuauuaucaacuccagguauaguuauaauccuugguaaaacuccucucagaccuggcagauaguguccuuuaaagaguacacuaauucuaaaaacugcuuauuucuauauugacugagauaggaaaaaauagccuucauuuucacaagugauucacucuaaucauuuaauaccuauuacugcaacaacaugcaccagauuucugacagacaccuguuugcaaauuaucuaaguuucagagcagaaagccugguuuagaaauacaauaccaucuguaauaaaguagcacuagcacucaucuggacuauuuuggacuaaaaauaguccaaaaaugaaacacaauagaauuuuaguuucuugaggauugggaauaucagucacuguauagucauugcuucaagaacaguacccaguacauaguagaugcucaauccacauuuacugaaauaaaaagaaugccuuaauagcccacugucuuggcagacuuuaccuacucucauuccagcacuuggaacaauuaccuacuuucaaggaccaccuuuguacagucaugcucaugcccagaacaaaauucuuauuucacagagauaccaauagugcaaaacaaagguuuugacugguucucugcuuuagcauaugaauaauacacucuagucuacagagaagauaauggaagccaauaguccaagcguucaagugguacuuacuucauuuaaaaguaaaagcccgggauagacaaagacagaaaaagcagcauugaaauaaccugugugagaaagcagaauuuuaacaacagagcugggcaaaggaaaaagcaauuaguagguuugucuucaugcagcuucaagaguacugguuguuaaaauuaucuuaggagcugguggugcuuggauuuccuuucaacagacccugaacuaugcagugcuuaaccuccuuuucugagaacuauccagggacaccaaauaggaauggaugugcacaucgcugcugucagggcucagaaagauaauacccaaaaugaaggccucagaaacaaaagacucuuggaccuucuccagcccuccucucucuagccucuaauuuucuccccauaggccagccacaaaaccuaaaaauauuauucuaaucccuaccaccuuccugcauaauaacuggccaugaagaaacuaucugaccuaccuugcuuaauuauaggucauuagacccccauuccagaaagcguccugccccauacccagaagcaaggaaugcugcugagaggcaaagaugaaugcagacacaccuugcuggguuuucucagucuaccaggauuagaucacauuuuuuguccaaucauauuucuauauggcucucuguacuuuguugagcccaaguacaaaauuggacaauuuccccuguaucuuugggucaucauucugaaggcucccaugucauguaaaauuaugaucaaauaaauuuguaugccuuuucuucuauucaucugccucuugucaguguuuucagcaauccuucauagagugaagggaucguguauuaggauucucuaaaaggacagaacuuugcaaacccccagcuuuucugcguggcagauaggaaauugaaaguacaucugcuugguugcuguccacaaccaaucagacugauugugggccaagucugccuuugcacagaagugcaacuuuguaaauucacuuuagcuucugauugguugcuuuccacaaccaaugagaauacuuucguuuucaaaaaaucccuacuuuuuuugcgucauucuuuccuugcuuuguguguuuugucuaauucuuuguucaaaaugccaagaaccuggacacacuccaccaguaacaagaacaauggagaagguucaaaaugucagauuuuaaacaaaaauuucgaggcuauuuauuaccuagaaaaacaaacaaaaaugugcaguuuaaacaaacccaaaaagagacagagaaucuauuauuucaggucacugaguauguacuacucaguugucucgggaugugacaguagcuaagacccucuuucugaccuagagaaaaauccuucauucuucaaaauaagguuugaagucacuuccucuagguaggcuuccauaaaccuagucagaugcucauucacaggacuuuuacagauagcucuuugauccucucuccaccauagaacuuguauuacacugcucuuacauuugauucuaaugagacuauaggcuucaaaagaacuaggaccacaccugucuuuugaauucccagcccugcaacagggcuugguuuauaggaacacugaaagaauagccuuuggauuuguugaauguaaguuuuuaaagucagggaccaggcuuuacacagcccauaauacaagcucaguauuggagauguuuccaguauuauggguccuaacucaccaagacagaaggaaagaccucacuuuuccaaguucccauucagcaagggcaaggaaggaguaggaagcaauacaggaauucaguuucugaacgaucauuaaaagaaggauguccagguugcagcagcagcagaaauccuauaauauauuuuuguuuuucuucucaaaugagcuagaaaauugguucucaaacuggugauuuuguccuccacucccaucccacugauggccacaggaggcagccaaaugccuaggaagaugggauagggguagguaccagguggaaccccacuuccaagccaaagacaguuuaaagccugaaagccuagcuacaaguuaaauccucggacuggacugagaauuugucuucccauuuggcacacuuuccucugacugaacccacccuucaccuauuuaacauauagcuacccuuuccuaauugguuuucuaaauugucaugcccaccuuugaguggugucuucacuuuaaccuuuuuugcuuacucacacaccacucagcaugcacuccccauucugaguccauaaaaggucccagacccagauacaugggggacuuucccgccuucugguagggggaccacccgcaugaccccucuccacugaaagcuguuucaaugcucaaugaaauucuucucugaccuccucacccuucaauguucagugcauccucauucuucuugggaauaggacaagaacuugggaaccagugugcaagccagacuuggcccaggugggcugacugggcagggcgcccccuguggcagguagagugccccaagagaagccuccuacaucgcuagccagagguccccaacuggcaaagagaccaagaaaaauccugcauaccaccaaacaucuagcaaaguugggagacauuuugggcuaucacaacuaggagggugcuacaggcaucuacugaguagagggcagggauugugcuaagcauucugcaauguacacagcagcccccaacgacaucaacugugcuaugcuugagaaacccucagcuagacaacucuuuguugucugcagcuaaaaaugaccaaucuccuuucuaagcuccaauuuucccauuggaaucauggcaacaauaaucaaccacuucuuauauguuaaguggugaggcuuaagauaacaaauguaaaauucauagaguauagccuggcacauaacugcucaauuauuauuagauauuuguaguaaucauuauuauaauaaaagccgcaugucugcacauaauauggagguaucagguacuaugcuaaacaucuuuuaaaaagcugauauuauauaugcuccaccacucaaaacaugcuugguaaaagaauaaauguugacauaugcuugcuuauuaaaugauuaugugcauaaggcaaauauaaaggacauaaaaguguuuaucagggcacaauacuaaaaacaauaaauuaaauuccuuuuauuccauuaagaaugcuuuucucuaagaaguuccugauccugagaaccaggcaaucuuacaugcaaacucaaagcuguuuuaucccucucuucagacaaaauacaaucaaacaaggcguggcugaaaccuauuacugcuagccuggcagaccacuggagccaaugcugccacuaauucuguccugcuauaugcaggaaagcgaaagagacacacggcacuucagagaaaucaauuuccuuuauuagcuuccuuucuuuaucguuugcuuucacuguauguuuuguggaucaaguuaaucauuuucauguaaagaucaaucuuaauauggacuuucauuugaaaguuguugucagauuuuguggagaagccaaauucuagagaaggauggugggggguggugugggguggggugggguauacaccugacuuuuguuguuuccagcagcccaaccauuccaugaauuuuugguaauaguaucccaaaaccuucuucccuaauguuggcaacuguuuaguucagaugugucguagccaaaauugggcacauuucccaauucaggccaauuagauauuucucccuaaauucugaaucuugacuaaaauaaacagaagacugaaaagaacugaaaauuauuucuuuaaaucgugguguccuuauaagacuguucaguagcacuugcuaugcauaaaccccaaucuacucugcuuucugucaauucucaagucucauucuccuauauccuuuagucuauauagugaacuacucaaagccugccaauaauuuuuuuuuuuuuuuuuuuuuuuuuuugcuuaagcuaaauagaaucuacuuuuguuugcuuauaaucaaggcaaugcuaacuguuacugguaaaaacacuguaacacacuacugacaaucauggaucuggagccaggauaugauauuucuguuucucuuuuauuuagucauuuauuuaauccaccuugugcuucgguugcuaagucugugaaggaaaaaaugucggaaaagccuaccaauuacagaugccuaguagguccagaggguugcuauuacaguuucuuauucaucaauucaccccaaaagauaaguaauugaaucuuuuuuaauccccugagauuuaucuagcucacccacuuguuaaggaggaugcauguaacuucugaguuaagaaauauaggcaaguuuagauaauauucaaugggaauaggauaugcaaauguacauacuauauuuuuuaaauuuuauuuauuuuuauuuauuguugcccaagcuggagugcaguggcaugaucucagcucacugcaacccccgccuccacaguucaagcgauccuccuaucucggccucccaaauagcugggauuacaagugugugccaccaggccuggcuaaauuuuuuguauuuuuagucgagacaggguuucaccauguugaccaggcuggccucaaauuccugaccucaaaugaucugcccaccuugggcucccaaaguguugggauuacaaaugugagccacugcaccugacccaaauguacauauuuauguguaaauaaacacacauaaauuuuucaaauaggagccccuacauuucucuucccuuugaugaacuguugaacccuaauaaaaugaagaguaucacacaaccauuacuggaaccuguuaaagccacuaacagagaaagucauauuucaaguaucaguugcauacuaaacgaaggcucuaccaaugacagcacaugccucauuuuaaagcuaucugagaaaauuuuccucaagucuuuucaaccagcacucaccauguaacuuuugaaaacauaggucaguuuauauguguguaacacacaggcacauuaauucuauaaacauucuuuucaaggaagcugccuggacaagugcuagguuguaacggcccacuggacuaaccacccugcacgugcugcccaguuucaacacacuuccucagccgagacuugagaugcaaauugaggguaaacucagcuuccaggcauagacuugaacauuuaaugccaacaaagucccauugucagaccccuccugcaacuccuaauccacauaugucuauccggcauccacuaggacaacuaccugcguccacaacauuaacaugauguggacaccccagaaguccacuaaaacccaguggggcaaggaaugacuguacuagaaaugugugaaaacaaugagauuugagggucuuuacugaucaaugauagaggaugaggaaaaagaagaaaggaaaaagaucagugaaugucucaagaagacaaaaauaaaggagauuaggagagacaaucagggagagaaaagaaauguugacgguuaagaggagaaauaauugacaacagaaaaugaaggucagucaucugggccaaguguaucauuuacuuaucaacuugguauuuccuaagaucuaaugugauaggagauacuacagaaauuagaaugaaauaugacuuuaauauugauuaaguucuauccuggcacuugcccucaaaggaaagaucaauuaccauaaucagggaauagacuuuuuuaaaaacaaaaaacaaaagccauaauuccaguggcuuuccugagagaauuuaugaguauugccauagauuaaagaauggauauccuccagcagaugacagcaaaaaauucuguagcacagaguuuagggacucgagucuggagucagacucgggggcucaaacgccaacuuugcagcuuaagaguugggugacuccugcaaguuccuuacuauuuauuugauccucagucuccuucucagcaaaacaggagaguacagauuucauuggauucuuguaaauacugaauaugauaguguauguuacaaaaguaaaucauaagcccaaaguucuuuuacuuggccuugauuaaaauuauaauuaaagcauuggcuauuagguucagagcauuuagggguaaacuucuaagcaaagaaacuguuaacccaagcacuacugaaaacauaaauccuggaguaaucauaacccuuuguuuagagagaagaaagaaaaggucuaaagacuauuuaaaguaaagugaaauuugagaccaaucuguggaguucguguucuuguaaagcugaauauaggcaucauuugguuuaccagagcuggcaaugaucuaucgcacaaauugaaagauuuacuuuaacugugaaucuguaaccuuggacucuggauauuuauagcuguaaugagaaauuacauuuguuagaauguuuguauuaacuuuuuuccccacaggaacuugguuugccaacuaaccuuguaauaaccauagacuaagaugucagugaucuaguuacaguuuacucaagccauuugaaaagcugaacauuuucuugcugaaaguaauacaucuaaagucauacuucccugagagaauaagucauuuuggaguuaaucaagaaagggacagauuaucaucaaaauacaaugcaaaaaucucaauuuuucacaacaaugcaauucauucagcaaaucucaauacucccaugcuacacgaaccuucuuuagauuuucuccuggguguaucuuugaaggagcaugaggaauauuugcuauggcucaaaaaccagauaugcauuccaucuguuuaaaagcuuauaggguauuauagaugaagcaagcuucuaaauucaaccuuaaauaaugggaaaaucgaacaaaaacaacacccuaacagauuuauuuuaauaauucuggcaagaaguacaaaucuaaggaaacagaagcaaaauacaggauaauucagaauacuaagaaccugcuauuguuuaacugaaagcauagguaaaaguuacaaaaagugaugccacguuuugaugcugcuuacuggcugcaucuagagagaggcaaggagguaucaggcauuucugccaaagcuaggugagguauuaaccacugagaagauaauaggaauagaugagcaaguuauccagaugguacaagauggcagguaauguauggauaauugcaagccucuccggaguuaaggguacuaaagaaaagaaagucuaugucuaaagaggagaaaagaagacagacaagcugguuacauuggagauuuuuauuuauaagacugacacagguuaauuucauucccaucaagcaauuauuaauaaauucucacaagguuuuaucguggauaaaagaauuguaauacgugauuuuaaauauuuuaauugccaaaaauaaauuuccaaaguauucacagcauuuuuuuacuuugaaaaguaauuagcauaagcaaauaacaccuccugggugacuacuuaacauauauacuggcuacuauucaugaaauuguauuuaaaaugcagagucaaauuuccauauguaagauaaacaguauauucuucauuucauuuuuaaaaauauaagagauuaauuagcuaaauaauuucccuggaaaacuauuaaguaggacagaggauucaagacccuaaaauuaauuuuucaaauguuaagagguuuauacauccaagcucacuuccauucucauauugcuuauuuaaugacuuccugcaaacacagacaccacagcccaagaucuuucucuuuccuauauggaguaauaagacagagaacuuaaaguuuuggucuuugcaaaauauguguacuuucuucuugaccauuaauucuugagcccugaggcagauagaaaaauuggaguagugugccaaaugucaauguaaaggagacaaauuugacaggagauggagaagcauuaaccccuuauaccuauauaucuaaaaugguauguuauauauguuaaauacacauaaaggauuucugucugcaccaucauagaacgaucuaagauucaagcacccaaaauuacaugauacugaugccaguauucuuuacauauuagaaaaaucuugaacuaguucuuaaaucugaugacuugggucuccccagucuguucaauaagacauuuugacuccuauuaagaagaaacacucuucuuauuucaacuuggaaauuaacaaagaaaacagcauucauuguagggaaaaauggcacauuauuuuuuauaaccuccucuuacuugaguagaaaaauaauccacuuaaugugucuagaagggcaguaacccuacauuaggggagaacagacucccagggaaaaagccauuuacaaaacauugaggaacugccaaacguuguaggguucauacagccacagcuaauuacuauguauauuguauuucuggaccuacuggcaauauauuggcugaucuuucuggauugugucuucucagcugaacguuguuuauuucccacaucaugcaaaugacagggaggauguuggucuauuuugugauuggcaggguaaaaacuuaaaauuguguuuuagauuaggucacaaaaaagugugccagaugguuguuaacaaaaaagaaaaugcuuucaacaaaccucacauguuguauaaucuuggacaaaauacaaaagauguaaauguccugccacaaauauauuggagcuggauccaccugacaaugcugaaauaucuaguagaaacaauucccaaagagguaugaaucugacuuuucucucuagaaaaacugcuggaugacuucuuagaaaaguuaagucagaacccauguuuuuuuaaaaaaucauuuuucagugguaccuuuguauuuauugucuacucuaguauuuucucuugccugggguggggggaaacauuuuuucaccuguauuaucuucagagaagauaauacaccugcaguguuuuagcuuggaaaguuuuaaaaaguaaacaggacaugguggcacauaccuguagucucaacuacuuaggaagcugaagcaugaggauggcuugagccuaggaguuucagucuagcgugggcaacauagugagacucccaucucuaaagguaaguagauacauagguaaauaaaacaaaggcaguauauuuucauuuccuuaauaaaaaucuugaggaaggugggggaaaaggcauguacuagcuugcguuccucauaguccauuagcagauaauuuucucaauaguguaugaggacaaaaauaaauaaauaagaccaguuucacauuuaggucccuagagauucacaaucaucaucucccuucugucugccaggauuuaaauuuuauuuuuaauguggccucucuuacgcauuucccucucucugcagauuuccuagucucucccaagauaacuggaauuguacucaguauuagucaagugagagugccauuuauugaccaccgaagaaaagccagguacucugcagaucucacuucauuccucauagccauaccaggagguagcccauuugcagaugggcaaacuguaacucaagguuucucaccuaggaagggacugagcagagucucaaacugauaugguuuggcucuguguccccaccuaaaucucauuuugaauuguaauuuccccauguggagggagagaccuguaauccccaugugucaaaggagggaaguaauuggauuauggggguggguuucccccaugcugcucuugugaucauaaguaaguuaucaggagaucuggugguuuuauaagugguaguuuuuccuguuugcacaugcuuucucucaccugccaccauguaagaugugccugcuuccccuuccaccaugauuguaaguucccugaggccuccccagccaugcagaacugugagucaauuaagcccuuuuucuuuacagauuacacagucucgggcaguucuucauagcagugugaaaauggacuaacacacaaaccuagaucuaacucucagacauguuguugauguugacagaagguaaaagaguccauaccaaaugaacauucuuuuagcuacauacagcaauuaauuuucaccagcccuugagaaaagauuugaagcacuagucagaaggaaaauuuauuaaauagaagggaaagacaucaaagaguuaauaaauucagaaacuguacaacugagccagguguugaacagaggacuagacauggaguuagggugaguaagagggagagagagagggagagaaacacuaagaaaagaaaggcagagaaccaugcaacgacuucccugauuuuaacaaugaaaguagcucagaacauaggaguuacuuggccaauagaguuaaaggucuuacuuaagaaguaccaugcaaauuccauuucugguugccagacccugauauaccacauguucauuucucaauaagugcauguuagguaaauugaccacugucucuucugaaauggaaaugucuauagugguaaaggcauugccauuggauuugaaagcugcaaagcaaguugacugcagggaacucuguguguguguguguguguguguauguguauguggcuuguaaauuauucuuuuaaacugcuuacaaauuagcugugaaacugguaguauguaguuguccaugucaauaacaaaaaagcaaacacacaaaaaaugcagaucagaagaaacauaaccucagucacuucauauuaacagaccauucacucauccauuuguuuaaauauuuauuuaauaacuaccacaugcuacgcacugugcuacauguuaggggauauauuggugaauaaaauaguuaugguuuuagcaauuacaaagcuuacaaucuagucagaaaaacagacaaaauucaaguacaacagaaauaacuauguaacuacaaauugugauagaauaugaaggaaauaaaugaggcacaaugauaaagacuggaaugauaggcggguggaugacagagaaaugcauuuacauacagugguuaggaaacgccuuuaugaauccaaauucuaggaucuagauggagcucuaacuuaaacauauauuggaaucacauggagggcuuguuaaacuagauugcugagccccacccaccaaagugucugauucaguaguucuggagucaggcagauaacuugcauuucuaguaaguucccaggugaugcugaugucaccgaacuaggaagcacacuuugcagaauuaccggacuagagcauagugcaggagacagaaaggggccugagcugagguuggaagaguaggcagggaagcucuagauacccugacacaugcucagugacaauaucagugccaaauucagaaccugucuaggacuuggagugagucuaaugaucaagacaacuaugaccacuacuguuaucuuugccaaaggaaggaccucuauuacucccucuucuaagcuaagaaccugaaagcaaauuuaucaaggaauacaaagaaccaacucuaaaaucaaacaauauuuuuuacaaagcauugcuauauuaacacaguaucuaccauccaaagaaccugauguuaucagagcauauuuaauagagaagauaaaagagaucaaaagguggcaucugccuucaaacauagagcguucugaggauuacggcaaggaaggcauuucuguuaauaguagaagaugugagcaugcaauuauuguaagaaugaucuaaauuauaaguaaagaagauacccuugaccucaucugguuugaaacauuuaacuggcuuccaaaggaagauaaucuuuauuaguauuugaaaaguuagauagaaagcuaccagaauuuugauaguuucguagcucucaacuuuagucuucccccaaaucauuugggagcuuguuaaugguguagauuaccagagccauccucagaguuucugauggaaucagaugaagugaggcccgggaaugugcacuuuaauaggcauccucaggcauucugaugcugguagauuaaggaccacaguuugagaaauaccuaguuaaggcaugguacccuguaaauggcaaaacccagauggauaaucucuuauggauuuugauagagauaauugaaguuuuacuaugugccagguacugcugggcacuucuuaaaaguacucccuuuaguuuuuaacaauuuaaaaaaauaauacucaagugaugagaaaaugggauucagcaaagcaacuugucuguaguugaucauguaccaaauaauuuauagagccagaauguaaacugaggguuucugacuccaauaauacauuuauuucaaugauacugagcucaugauugcuaaccuuugugaagcuacgacaaucauuaaacgauuuccuggcaaccacagcuucuccuaaaagcauuaugugauuuggccuuuuaaaauaaagagaaacagaguguaaucauaucuugagacucugaaaaauccuuagaugucuaaaaauauucacaggugcuggacaaccaaguauaugaaucaauaagagaaucccuaacuuaaagucuuguccacugauauuacacuggacauaucuauccaacaucaagcucagagacagaauguuuagcagugaaggguagaaacugaagacaaacgccugaguuaaaaaaaaaaaaaaaagucucuaucauggauuagcuaugugaaaguggguaaaugauuugauuucucugagccucacuuuccucaucuauaaaauaauaauaauuacuuugggauuuuuauauaagauauuauuauauaauacuauuauauauuauuauuacauacaauauaauuauauauaacauauuaauuccauuaauuauaauuauaguguaaaauauauuauauauaauagcuuacauauuuuugaaucauuuggcauaguaccuaccacacaguuguucaauacauguuaucuuaauucuuauuaaauuauuacuuuuaagaggcaugugaugcaguuaauaaaauaguggaaaaaacauaaaggcccaauaaacauaacaagauggccaaucuaaucagaauuuugaaaaggcaaauaauuaaauaaauaaaucagcaaaauaucacaaaauuccccauaagaucauaaaaaagucaauauucauaggauaaaaauauuggugaagaagaggagaaauagguauucucucucauaaaccauaaauugauacaaccaauaaaagggcauuugacaguuuguuaaaaaaauuguuuuaaaugcugugauacagaaauccuauuuuuuccuauugauucuacacucaguagaacagauuucgguaaccuuuuccuguaaagggacaaagaguaaauauuuuagaguuugugaaacuuuuuacagucugucaugauaacucaagucuaccacaauugugugaaagcagucccagacaaugcauacaugaauuagcuuggcuguguuuuaauaaaauuuuauuuauggacacugaaaguugaauuuuaucuaauuuucuggugucaaauauucauaucgugauuuuuuuucaaccacuuaaaaauguaaaaacauuucuuagcuugcaggcuguaacaaaacagcagcaggcaugauuuggcuuagcagcuagcuguaguuauuaacugcuaccuuagagugauaccuacucaugugcacaaggaggcauggacaaagacauuuacuguagcguuaaaaaucugagaacaggccgggugcggcagcugaugccuguaaucccagcacuuugggaggccgaggcgggaggaucacgaggucaggagagcgagaccauccuggcuaacaugguaaaaccccgucucuacuaaaaaaauacaaaaaaauuagccgggcgugguggcaggcgccuguagucccagcuacucgggaggcugaggcaggagaauggcaugaaccugggaggcggagcuugcagugagccgagaucgcaccacugcacuccagccuggucgacagagggagacuccaucucagaaagaaaaaaaaaaaaaaaaauuugagaacaacuauuagaucaucaauagagaaauggcuaaaaaaguguggcuacauccauaaucuggaauauuauguuauucuaugcuaauacuauguuagcaaaaagaauaauuuaucacauacaauuguaagagauacucaagaaacuucauggugaaaaagcaaguugcaacuguucaguaaaaaugcaagcuaugcucggacuuagagguuuuaguacuugcaccauuauggcagugaaaaaauucguuagagaaugaggucggucacuuuugguucaucauucugugaucacagaacacaguggguccauuugcugagacggagccauuugcuguucauaaauguuuggauuugucuuucaacaacuagcugacaaaggcauaggcuuaaaugagaaaagaggcaaagaaaauauaauagaaaaacucaaagaacacauaauuaaaagcacuugggggacuccugaacagauuccuacuguguuuuuauacugaaugucaucauucucaaugaucaggaggcagaugacagcaucaagacaauauggugucaagucacauuucagaauguucccggggcucugaucagcauuagccugacuaaccagaucagagaagaaaguggucacagcaaauacccugucucaguucauuacucaacaccuguuaacugugauuaacggcccuggcuaauuauguguuaagagcaucucaggcuguaauggaucccagaggucugcaaacuugacuucauuuacauguuugucuccuuucagaaggucucagccaaacauggccgaaaucucccgagcauuuuaugaacucccaugucaucaacucagaguuucaaauacaccagggucuuccuagaaaggacaacgaaugucugagauguacauuuguuucacagauaaagcaggcaagguuuagauuuuauggcacauaaaugggccucuuguugcaauuaauauuauaaaaggcugcuaaucugugugcauuaaacuaauuguuacauuuugugaucucggcuaaaagacuaaacuguauuuagauggcagaaugcacuaaaaccucgcuuuaugucucaaacuaaaacugcaaaagucagaaaucaaaaaggcuucagagaagcuuuuugucuacucauuuuuaguuuuaaaaauauguauuaacauuaauuuuacauaauuaugucaugcuauauucauacauuaaauauuaauacauauacaaaccuauauauauguaucugaauguguguauauauauauauauauauauauauauauauauauauauauauauauauacguguauacacacacaccacagacgauuagacagcccuuaccaagguauuuuucuugcuuuucuuaaaugguauugaaccuaacucuuccuacaguuaacugaaagucaacuaauuaacaucccucccaacuuuuuuuuuuuuuuuuuuuuuuaguagaggagcagagcuggcagcagacauuaaauccuucuucauucuuauuugcuuagucuagcaaaguaaugagaaaaaaguaaauccacuaacaauugugugugauggaauauuaugcaacaucuaguauucaugcuacugcacuccagcauggggaacaaagugagacugucaaaaaaaaauauauugaaugucuacauguacugauauggaaagacaucuaugacauaugaaguggaaaaaaucaagcugcugaacauuagauagcauauuaugaugcaaauaaaugugcuauaauagcccaacuccacauaugugcaucuuuagauuccuguauacacaagaaaggaucugaaaacauauagaauuacaaggucuuacaagcaaucugguucugccuuuuuuagcccgaaugggaaguaccuaucccaaaugaccuucaucaucuucacaacuagaaagagauuuucauggucccuucuacccaguaacagcagagcacagugguuuggaacaugugccgugcagucaggcaagugugccucaaaucauaucuaccacuuacuggccaagucaucuuagacaaguuacuacauuuuccaguacuucugcuguuuucucauuugcacaacagugcccgucucauaaaguuucgugaggguugugauuuaauagccguauagcacaugccuuagcaagugucgucaacacucaccucucuaucauucuuagcuaguacuuucuucaucuugccucaguuauuauuugaaaugugcuuguuuccuuagucauuacauuuucuaauuugccaaauguuaaacaagggcaagaguuggcacuuucugugucucucugcuuccucccaccaccacuguaagccccaaauaaaauaauuguuuuuuacauuucugaaagcuuuucacucuguuacaaaucaaggggcuccaacaugcccuuguuucuaacaauucucaaugcaguuuaaugcuaggggugaggugggcucauugacuuuugcucuuggcugacauuuccauuagcacaugugugguguguauuuuccuccaguauucuuuuugcuaagaguuccgucuuucucuaauuucuuacuuuuaauugucuuuucuuauugaucuauaaguugcugucacuuugaugaaaccuaagggcuucaagcacaucucugcuauuuacuagcuggaaucuuuaaaaagguaucaauuagguucaguuucuuaauggguaaaaugggcauaauaucaucuauacuuuuucuucguuuugaaauaaauuuggcuuuuaccacuuagagaauucaugucaauuuuagaaaaacaaagaccaaaaaaugaaauaaacaaagauaaaaccauucauaaucccacuacagaugucaaaagucuauucuacauccuucuaguccuuauaaauguacauaacuaaagguucugggucaaggggucuagacaauucugaaucuugcuuuauuucuuauucucucuucccagaccacucaaaauguuaagucugauguguuuuaauugaauaccuuucauugugcguaaauauacaccuaaaaucacaaauauaaaggcuuuuuuacugaaggccaucaugcuuugcauauuuccuguaacuugcuuugcuaacuuuacaauauaucaugugcaaucauccauagcagauauacauucuaauucuuaaugaccuaauaaucauccauagcauguauaacacaguucauucaacuagucucaagugaucaaaauucuuuguuuucauuuuuuugccacugugaacaaugcugcaauaaauaauuuuguauauauauuuuuaucuauacagaauaauucacaaagagauuacuguguuaaaggcuauguguauuuuuuuuauuuaaaaugauacagccaaacugcuaagcaauauauauagcuccuagcauuucuccacauucuaacagcauuggaugucauauauuauuaaguugugccuacaucccaggggaaaaaaaucuaucuuauuuuacuuagcaauucucugagauuaacuuuuccuuuuuacuggcuauuucucucuggcaaacugcucauucauaaucauugcccaguuuucaugugguucacuuucaaaaaacuugcauggagugucuugguauuuaaaugguuuaaguauugguuugucauguguguuauaaaugcugcuucaccuagcucaguguuugcauuugcuuacuguccaacacacauaaugaaagucuguuuaggaaaauacaugcuuucauacaucuuuguuucuggcuugccuuccaucucuccaccccacaucguauuaccaucauuucucuuccuggccucucuugcuuucaaauucuaacuuucucgucuuuaucuccuccucaccaguuaucacaauuaccucuguaaagaacuaagauuucucccacuacuuuuuuuuuuuuuuuuucuaaagagagaauaaagcuuuggccgaagacaguuuugaugagauggcuagaaaaacugcuuuucuucauuggcauuuuggaaauauugcucagugguuugggacccauuuauuucuacugccucuauccaucuuugcuuuauggcuugacuucugcugcuuuaacuccacauucuguuuugcuccacuucaacuguuuagcugccagguuuggucugguuucacugauuuacuguaucuaaucucauucccucccuggauucugaaccccauccuagaaaaggcacuuccagcucacagacucgcauguuuaucgauugaaauuuaguucaaucgauaaacauuuuagcauacuuggguucaauuccaauagcacagauguuuucagaucauuucagauggugagacccagaaauuuuaauuauuuuuccaaacacugcuaaaaacugacauuaaauuucauccaugaacugaaaacauuuuuacuaggagaaaaucaugaugcugauauaugcaauuaugcuauaaaguauuauuuuauuuuguuagguauuccauuuaauacuauagaaguauuaugauauuuauuacauaaagcauuauuauaauaaaaucucaguaccacccagaaaaauuaaagguuugaccuuaacuuucuccaauuuuucccuauuaauaucaauuugcuuuucuuguuaagaaaauauuaagguggaaaacuugaaacaggacauucuguucuauuauuuuuauguugagaauugggaaaauacagcuuuuguuguauagaaugugguauguaugugaugaguauggaaaaugcauacuuccaacggaagcagagagacuuguucaggggccauugcaaaacuccacuggcaaggcgcuaucagccugcagcaagguuguagaggcaaagguaaaagauuagagauugauuuuuagagggugagcuaaaaggacauauuggagagcucuuaggcagugugagggcauauucugacaucuuaaaugccucugcauuuuaaaauuucugaccagcugucaauuuuguccaucaaaaucucagccugguuauccuugcuuauaagcagcagauuuuuugagugcccccauaugacuccagguuucaaauguuugcuuuaucguaugucccaaaguccaaauacuggagagucauauggaaauauuccaaagauuugcacacagaagugugacacauaaggugagaacagccaauaaagcuguuagguauaagcaguugugcaaaagaaucaguuguauagccagcccugcaaugcuuggaaucaagcagcauggacacaaagugucuauguguacccaaacagggcauagacuucaaugcuuuuuccuuucaugacuagucuaagguuuuugaagcucuucucauaccuuaucacauuuuacauaccuaaaaagaaucaauauuuucuuguucuuuacaacauucuuuuuuguuguuguuauugcuauuguugaaggacaaucaauucugauuuacauaaacucaaggguaacuuaaaaagacaguugcaguaacuaagauugaagcuggcaugccuuucccgagugagguguuagacauaaaaauggcuuucauuucguaauggagaaaaaagacuuaagucucugggacacaccacucuucuccccuaaucucuuccacaaauagcagccugggugaucuuuuuguaaugaaaauucuaucacaaacuccaaauauuaaaacuuucucauggcuuuccaucaucuuaagaaugagauccaaauucuucaaccuaguuuaaaugguucuaugccagggcucuccaacucugguagacccaacccuccuuaauacaaauauuuuguauuacccucuucacucuccugagaugaaaucuacucuuaagauacucuaccuacacuuguauuuuuaaaaauguuauaauaucuuaacuuuaauacuaaaaagaaauauuagaaugggacagaauaugguuauagaaguucucauuccccuagacauacccaacggaacaggcagccucaauugccaccagcagccucucauggcaaagcgagggaccagccucaagugaauuaagcacuauagaugguagaguagagagacagaauucagguccuugaguagaguagaguauagaugguagaguagagagacaaagagaauucagauuucacugcacuggugaaucaaccaacccugaagcccacauuacauucagacuuuuuaaugauccaaaacaaauuccuuucacaguugaacuuucuacaauggguuuucugaguaugacauaaaacauuauaaccaacauacccagucaaaaacagagcgugagaaacagugcuuucucaacagcuugucuaaagcaugcuuauauaauuaucaggagaauaugugaaaauuagugagguuuuuuucugauugauaugaaugagauaucuuagacuucauagagaugauguguuuaaagaacagccuaaacuaaauguuuaguaauguuuccccuaauaauucuuaaaguuuaagaaugacauuuucuaauuucuuauguauuaaggucuaacauacuucucaggcauuuaaggcaauggcgcaauaauauucaaaaauuguuaaagcuacucaccccaacuccuucuaccaguccuggugcagcuaaguaaugcagcugaccauuagcacaccugaaacuaccacacuaauguggcuuuucagggcaggaugaggaaauacagugccccuagcuaacuucuugcagcaaauauuuguuucaauuuuuuaaguguaguuuuccuaauaccauaacaaaaucauuucccccaccuuuucucuucauucuuucccaaaaguaauacagcuacuaaaacacugauaguauaacaauuuauguuguacuucuuucugcuuuuauccuagauuauaauuguacuacaguaacuauagugauaaagguaaacacuuacauggaaccauuuguguagcaggucuuuauuccaagcacuuugaaaacauuaacuccuuuaacccuauaauaucccuacaauggugauuacuacuuuuauuuuacugaugagaacacugauuuuacugaugagaacgcugaaguucagagagguuaaaucacuuggcccaaaguuacacagcuguaagccaagguuugaacagaaggucagugcucuuagccacuagacuacccugcgucucaauacagagagcagucuggggaaaauacuggcuaauaucggagaacauguuuugagauuauuagaaaaugaacucacauacaucucaaagcucuuagauacagggagauaaagacugcuuuucaaagagaaacaaaaguaaacaaaauguauuucuugaagagcuuacaaagcuaaagucagaaaugcaucuccacucuguccugucuggucaucuuuaaacuucuacauccuaaagcuuugguuuccaaucagucacaaucucuugugcucugaugcacuccacacacucacucacacaugcauugugcauuucacacccacacacacacaaacaugcccaaaauacauggaagaaagauaaaauuagcugucuucucuuuguuguugaucaaauguagcugaagagucagcaggggauaaauaucuugaugcuuaccucagguacaagugcuuugaagaagaacauagaagagcaacuuuuaauguagcauugugaaaagaaaaaaaaaugcuauaaaauccaacccccauuguggggugucauuucuaacaaugagguuuguuuucuuuaucuguagugcauauagaugaucaaacaaaaauaacugauccacaggcucugaaguuuuuaucaguagucaccuucugcauggauuaauaaaucaaaaagggauuuuaauccuaucuucccuuuaacauuauggcacauacuuuugcaauaagcguggggcaaauugggagccuuucugagacacagguaggcaaguaaaaaccacauuagcugaacgugccuuccuaggugguagaaacacauggaucaagggaggaugguugcaacacaucccuaucaggaacccacugcaacuaucugaagcacccuccuacaggaggggaugggaaaugucauccugcaguggaagugaauacagggcugacuauucagauggaaauggccacuuggcucaauuaugaacugugguuggcacuaauagagaagcaaugauuuuguuuaauucuuuacaaagacaaaaauuaaaaaccagaaggagauaaagccaagaccacugccaaagaugaucuuucucuccaauguucaguaaauucuacucaacuccaugauucucucccacccugggccuccaucauucaaaugugaaaucauuaccuggauggugaaguaaucuguacacuaaacccuuaugauacacaauuuaacuauauagccaaccugcacauguaccccugaaccuagcaguuaaaaaaagaaaaugaagauuuuaacacaacccaaagggccaacagggaagcaucccuuuuuuccuuauagaaaauaguucucagaacuaugauguauucauccacuuuuuaaaagugaaaaauuuuauaaagcaagaaacuccucaaaaaggucacagauuuaucaugauguuaaaagucauaaaaauuauaguuacaggcuaaguaguuaaaucagaauuacacaccacccaauuaauuuuauaaucaauagagauuaaaggaaaugaggaaguaaaguaaaugauaggaucccagcuuaaaucaaaucaauauauauuuauugauagccaucccauauaagaugccaugaagaaggaaaaguguuauggaaauauguccuugucucugagcagcucaccaccuggcuggggaauugauauguaauaugcagagaauuuaugugcacagcaauaacaauacaaggggugucacaaggccucacacaagucaugaccaacagaaccauguagaaaagagcauuuguauuaaugcaauggucaagagccugggcuccagagccagacuuccuggauuugaaucucaacucuaccacuuauaagcucauugaccuuggacuaguuaugagucuuucagcaggaauaaaauagaaccugacucacaugaugauuguaaaaauuaagugagugaauacuugccaagugcuugcaaauaaggccuggcauacaauaauugccauggaaguauuaaaugggcaaaauacaauugaaagaagagaaagaucuccauugcucuaaagucucccaaaguccuaggacgguuuaagcagugacggaugauaucauguucauuuuccccuucccacgaauucccucccuacugcuacaaacauucuuaggucuagaccauacuaaagauuaaaaaugauaaauagucucuacuuuguaaacucccuguaaaaaauguuagacucuucuacauaugcaucuauuuaucacugcucacauucauucauucccuuauagcucaaaaccugacuccaaccccuaccauucuacagaaagcacuacaaaaacccuaaaaucuaaauccaacucccauuucuccuuagucaacacccucucuagaacauuacaaauuauucaccguuugaucaucacaauuuucuacuuccuaggcucugucauugccaucagaauuuuggcuucgagaaguaaggacugcucuuccucauaccuacaucucuuggcaugcaguagcauguucaauuaaauugcuuuacuagacagugcucucuacgacuuuuggucagcagacuucugagaugucccucaagauucuugccucugguauauguaacccauauaauuccucccucuuaaguaugggcaacacuuggguaagacggaguacacuucugugacuagguuauguuauacaacaaagguaaggggauuucucggauguaauuaggaugccaaaaucaauugacuuugaguuaaucaaaagggaaauuaucuugggugggccugaccuauucaggugagccauuuuaaggggcugaggcuuuuuuuucuuccuaaaggaagaaauaauucaaagccuaaaagaaauucuacugcuggccaugaaggagaaagcucucaaguugugagagggcuucaagagauagccauguggcggagaccugagagcagcuucuaggagcugagaaugaacgcugcgcaguagccgaaagauaaugggugccccaguccuacaaucacaaggaaacagauucugccaacaggagacagcucggaacuggguauuucccuagucaagcaagccuccagauaagagcacagucaacugacaccuugauuucagccuuccaggaccuuuagcugaggaccccagcuaaaauaugccauguuccagccuaaauauuccagcccaugaaaauggugagacaauaaauuucuguggcuuuaagccacuacauuugugguaauguauuacacagcaauagcaaucucccguacccucugccuucccucugucuuuuccucuggcuguuuuuucuugauccaacaccuaaauguggguuaauuuuuccuggaauuucuucuuucucaacacucuccaaagugauuaugccuaauugaguuacuuuaauaaccaucuauaugugauuauugcuagauuuuuagacugcucuucucucuuaagucauguccuauuuuuccuacugccugcuggucaauuccaugugggcacuaccaaacuccucauuugauaucucccaaaucuaccuuauuauugccccaucuaccucuugcucaauaucucucccuccuagcugggccaguccuguuaaugucuucuccauccucccaaucauuuaguuuguaaacaucacuaggacauucuuccucuccuguuuccauuagaaccaauaauuggccaacuccuguuuuaacaaguuuauauucaaggcuucuuuucuauucccaauagguacuagguuggccuuuuucuuccuaauuuauuaaaaccuuaguucaaaaucucuaaguauuuacaaguaggucuuccaaaguuaaugaaauuggcacaaccccaagagggcucucaaaguccaauacauguaaguuuccaaucucagcucugccacuuaauugcaaugaccuaaucauauuuuuaauaucuuugggucucaguuuccucauucaauuauuggagaagguaacaucuaucucacagggcuauuguauuacauguaaaggaauccaaucaaugauaacuguucgaauuauuaccuggaaucguggcaauaggacccauuucccugucaaucggacuugaaagcuuaacaaggccuucaauucuucuuccuauaucccuuuacugaaccaucaggguaaacugaaucaauguccuacuugguagcuucaucagagcacguuuugagucugcauccagauuguuaacucuuggaaaacauuagcaauauugcuuguuuauccuucuuucugugaacacugacuaccacauucagcaauaaacauugauaaagaaacugaagaguuguuaaaauggaaacuugacagcauaaaggaaaaaggacaaagaagcaagugacagggguaaaugcaauugguaggcugcaucuuagcuaaacucaaagugaagcaaugaugccccagcaggcuaagguuacucuuaaugagaaagucccuugggacauaaaugucaucacugagaucugaucuucuucuaggacaguuagaauuuucuuacgggagagaggcagauacuaguguuguucaccucaucacaugcaacccaaagaaaauacccaauaugaaugggauucuuuugaacaaagggaaagaauaaaaauaauuggauaugcuugacaacuuucaguuacucugcuuggccuuaagguguuaagaguugaaaaucuagcuuuuaccuagugcagcugaaaaucucucuauauaaugcaaaacuucaaaccaccuuaccaaagagaggacagcacugagaccuaguuaucucuuaggaaacuucgcaggcuauuacuuugaguacaaaacaaugacacaacuuuauuuccugccaaacacugaggguacgacauucauaaaaauuuuggucuaguuuaugaaaaauaaaccaggaggcaucaguuaaaacucuuauaaauaccuucuuuaagugauuuuaaaagauuucacugauuucuuccacuuaucaauaguaaugaaauaaaaaaaaguccuagaaaugguuacgcuuuggacaagauuugaguaagacauuaaaaaauucuauuggaagacugucccagaaaggagcaagagcuaaauauggagacaaaauucaaagaaacccaagcaaaaagaaggaaggaagucaggaggaauuuccugaacaggcacaacaacuucagacccaugagggaugggaaaacaaaagaaguucuagauggccuuaccagcuagagaacaagcaaacccuggcaagagccuccccaggcagcagguuuaacauggcccggcccuguuuaaggguaucuaucacacagugauagaugaugcucuaauaaggcucugcagggugauggagggaacccauaaacccaaugugguugggaugaggauggaacaauaaagaagagagaauaaaagguuacuaguuguugagaacccuacauguaauuuuauguauaauaguugacuuuauccccacaacaacuuucuaaaauaucaauauacucacuguauagguguggaagcauagguacuaagaggcuaagugaggagguggaagaagucauuggugagcaagcauuuccauucuuuccuaaacaccuauggaagaagcauaccucccugccuucacuguuggacuuggucaugugacucgcaugaaaaggcaacagaagaccauguaccagcuuaagcccgugccuuaagaaguuucugcuuguaccucugggagauacugacugacuggagaagaacauacacuuuccaggcaaacacaaagccaugaucauggcaccaaaaugagacauauggggcagagccgucuucugaccugcagauuugcaguauuaaaaagaugcccucagcugcucuguggagcugugaggauacaaugagacuguugcauuccacuggagaauagagcgaguaaccaguuuacucaagugucuaaaagugauuuuuucacuaaguaccucuuacuagcacuuaacacugugucuaaaacacaguagccauuuucugaacaaacauuaccuuuuuucuuccacagagaggaagaaccacagaaguauaauacagaaacccacuucugacuuccaccucaaaauucuaaauauaguaccuuuaugaggugucuuacuucugagccaacuugauucuuacacagccuaucccauuuuguucugguucauugugggucuaagggcaauauuuuuuuuucugccauaaacugcuuucuugcacuguuacuuuuacaaaucacauuagcuaaaaauacugcauuuuauucucuuauaucauucucucucuaaggcaggauacuucacucuucacuguauuuuuauaacucucaucugguauuuuuuuaugucuguuuucugcacuuaucuccaucaaguuuagauaacagucaccaacuucuugaugacucuaagcuuuuacugaacuuugggagauuacaucuauguaagguucgauguacucuacuaauuaaagaucucuuucuauugcuuccagcaguuuucauuccuugagauuaagccaauaguugcaaggguggugagauucagggcagugauaauucucaacuacucuaaagcaagauugcuccuuuuucucaguccugguuuugggccaggugcgguggcucacaccugcaaccccagcacuuugggaggccaaagugggcagauuacuugaggucaacaguucaagaccagccuggacaacauggugaaacccugucucuacuaaaaauacaaaaauuagccagccauuguggugcgcaccuauggucuaaacuacuugggagcugagacagaagaauagcuugaacucuggaggcagaggcugcagugagcugagaucgcaccacugcacucuagccuggaugacaaagcaagauuccaucucaaaagaaaaaaaaaaaaaagaaugaccauuaacuucauucuaucccuuacaugcaacauucuugcuccaucauuucuuuuuaugauguuggccuaaugauuuaguauuuaaguuuucuuuacaaacuggauaacaauuaacaauuuuauagcaaagcaggggcucucccaacucagaaccacugcucgcucacucuuauccguagaaucaauucaggaugcuuaguguagcugucgcuggcuguuucacugaccuaucucuugccgacagcucccucaaaacuaucuccccaccucccacacauacuugaaagggaacuaauguuuaugcuuucaauauuauuuaaguauauauuuuaauuauuucaaaucauuuaguauuuuacuggugaaggacgaaggcucaaguucuaucuuguccucggcuacacaugcaguaaaugacaaagccaucuuaccaaagucgggagucugcauuuccuaagcaccucacugacauccugcaacuuggcuuacaaacuucccucagcucaaaacgccucucaaacacccccuucuggugagcacuuacagacucucucauguccagcucagagucuucucuuaguagcuuuuuauggccacccugagacaaaauuaacuguugccccauguguguauccguggucuccugcauaguuuuauuagaggaaacaugcaaauacacuauuccucugcucaccccacugaccuacagcuccuuggcaguagggcuuuuauuuuuguuugcuuggguuuuuguucugagacagggucuuacucugucacccaggcuagagugcaguagcgcaaucuuggcucacugcaaccuccgccucccagacucaaguaauccucccaccucagccuccugaguagcugggacuacagguacaugccaccaugcccagcuaauuuuuguauuuuuuguagagauaagguuucaucauguugcccaggcuggucuugaacuccugagcucaagcgaugcaccugccuuggccucccaaaguacugggauuagaggcaugagccaccaugccuagucugggccuuuauuuuuaauucucaggacugacuauaguuuuugacacauuguaggcacucaacauucaacauccaauaaaugaguguuggaccuaaucuagauagcuacuacaauuauuaaugaaaaggaaagagcucugagggaacaugcuuccauccauaugcgucaucuauaauauacugauagugauaaaaacugaguguauagugaaaccgugguaaauauaucacuauauagcauuuuuaucuuaacacagagguucuuuuaaaagcuucugaggauggcuuaucaguacuucauaagcaagagacuacuagcaugcaggcaauuuacaaauaaacauaauucuaauuuucacagcuaaacaauugagaagggucauaggauccuuaaaaacuguuuaugaaaaauagcuccugccucaaauagcucacauggaucuacugggggaagcauuggugacaggaguaaaauuaacauguugccaaccuaccaaugugcuuuucuuggauguugucaccuauuaacaucaaaucaccuauacuuguuuauauuugauuaugguuuuugaaaacacauuuuuguguuuguuuuuuacuuauaagauuaaaacacaucaaaacauuugcuagaagaauugucuuuuuuuuuuuuacugugauaacacuuaagauacauacucuuaagaaaauuuuaagugcacuagauaauauuguuaacuguacacacauuacacagaucaucucuagaacuaauaguucaucuuccauaacaaacuuuauaucugucagacagaaacucucuauucaucccugcccccaucacuauccccugguaaugaccauucuacuuuuuugaauuugacuguuuuagauuucucauauaaguggaaucaugcacuucugugacugguuaauaucaucugacaugaugaccuucagguucaucuacauuaucuccuaugacaaggugaauaauguucauauauauauaugugggggguguacuauacauguauaucacauuuucuuuauauauccaucuguggaaggacauuuagguuguuuauguauuuuaacuauuaugaauaaugcugcaaugaacaugagagugcuaauauccuuugagauacugauuuuaauucuuuaaaauacucagaagugguauugcuagaucaugggguaaaucuauuuucaaaauuuuagaaaucuccauacaguuuucuauaaucauugcaucguuuuauuuucccaccaacuguuuagaaggauuccaauuucuucauacacuuaccagcacuuggguuuuggguuugcuuuugugacaacagcccauccuaacaggugugagguguccucucacugcgguucugauucacaguucccugaugauuaguaauggugaacaucauuucauauaccuguuggcuauuagcauguuucuuuggagaaauuucuauuuaaguccuuuugcucauuuuguaaccaaguugaguggauuuuuuuggcuauugaguuauaggaauuccuuacauauuuugcauauuagaugcaucagauguaugguucauuuuuucuccuauuccauagguggcuuuuccacucuguugacuguuuccuuugcugugcagaagcauuucagugugagguaguuucaauugucuauuuuuggugccugugauuucgguguccuauccaagaaauuauugccuagacaaauguuaaggagauuuccccauuuccuucuacagacguuauagauucagguuuuacuucuaaaucuuuguuucacuuugagcuuauuuuuauguaccacagaauacauuaaaauuggacccuuuuauuauaccauauucaaccaauuacuuuaaugacagugggugguuacuguauaccuugucuguaccguuucucucaaaauuugcauuucccuuugggaaucuuuugcaguuacaucccacuaucuaccucucagcauuuagaaaauaaauauuuucucuuccaaaucacuauugacagcaaaaucucaaaguaaauccauaugugaauagucacuuuuaaagaauaggcaaguuaaauacucagcaggaauaaaaaguacaacucugucuuucucuuucugacacauuuucuucccugcuuuccuccuucauccugugagaugagggauggcaggguugcauaggggauacauuugagguuuacaucaaucucacacagcagggugagaaugaucacacuauccuagucccccaccaggaccucuggaguaaugucacauuuccuugccacugaaaaugcuaccugauguacauuaccuugucucuauuucagguuuuaauaacaaauucaaacugucuuuucaaaccauuuucuuaaaugucuugacagacugguacuaguguuaccguagauaaaugccugcuuuauaccaaagagauaucagaauaauuucucuucaauuuccuccugcauuuugccuaauuauuuugaaacauuuuacaguauauuccuuggucccauuaaauuaaaauaucucuuucauucuuuacccauugcugcccacccaccaaaucauaguuucuacucuuuggguugucauuuuggaaauaacaucuuacuaacuacaacauucauaguuaaaccaaagaaaacagguaucauuuguaacaguguuuuuucuccacuguggcauguaucaaagaucuucuuuuuugguuuauuuuacauugucuccaaacaaauaaaucuaaaguuaaaauacaaaguauccuuaucagaccaccccuuaucagccacuucacagcaaagaugacugugugcugggccagcagcaggccauuagcaugcacagccuuuucucuuugauuugugcugaaauguaggcuauccaguucauacuagccuucagccaaagcccugugggaaguaacugcaaaccauaaacuuccaguccuuuacagacauuuguaauagaaaaaguaugcaaauagagccaccaacauuacuagggagucuaacuuuuaaaugacuuaguguuauuggacuugauuuguaaaugaaaaauucagauaugauggcaaggcuguuuuuaacaacucuccugaugugauugaggaguugauguacuauuggggaauuauauacuuuauaacguaauaaaaaugauuuuuuuuuuuaccagcaacuugauuuaugaagaauggugcacacgucugcugaaauaucaaaguaaacuuugguuacauuggcgaggaagcuaaaaggcuaauaccuccagggcacauaaaagcuuaggccuucuuuugguuucuuuucagggugaagauaaaugccagauugaguuacuuuguuuuuuaauacuuaaaucuaagacuuuaauaacuuuuauauuguaaguuaagggguacaugugcagguuucuuacacagguaaacaugugucauggggguuuguuguacagauuauuucaucacccagguauuaagccuaguacucauuaguuacuuuuccugaucgucucccuccucucacacuccguguucugacaacaggccccaguguguguuguuccccucuauguguccauguguucucaucauuuagcucccacuuacaggugaaaacguauaguauuugguuuucuguuccugcauucguuugcuaaggauaauggccuccagcuccauccuuaucccugcaaaggacaugaucuuguucucuuuuauggcugcauaguauuccauguguauauguaccacauuuuuucuuuuuucuuuucuuuuugagauggaguuucgcucugucauccagacuggaaugcaguagcacgaucuuggcucagcucacugcaaccucugccuccugggcucaagcaauucuucugccucagcuucccaaguagcuggaauuacagguaugcgccaccacauccagcuaauuuuuguaauuuuaguagagaugggagauuucaccauguuggccaggauggucucagacuccugaccucaagugauccacccaccucggccucccaaagcacuagaauuacaggugugagccaccacacccagccaguaccacauuuucuuuauccaguuuaucaaugauaggcauucagauugaguaacuuuuauucaacaauuuuucacaaguauaugcagugugcccaucaugccagccacuguccuaggugcugaggacacagcagugaauaaaacagaccaacagaagcucuaggcuuuuauauguccuagacauauuagccuuuuaguuucuucaccaauguaaaggaaauguuuacuuugauauuucagcagauguguacaccauucuucauaaaucaaguuguugguuuaaaaaaucauuuuuuauuaaaucaugaauguaaugucuguggccauacagacaaaaaacgcugccuucauggagucuauauucuaagcaacauacgcugcucaucuucacagaucugagccaaaagagguuucuuuuuauuucuaaggcauuaauauuaacucaggucaaauuuuauucauuuuuuacaaaguauggauuuuuaaaaugaaucaucauuagaaaauguuuaccuaaugucuaggaaaaacauuauuggucugagguucuuuuaacuacccaucuacuucacaaaauguuuugcugugaauuaaacuacacagccuacaggaaaagauaaaauccaaguauaaauaaaguaaagaacagcaccuaacaagcaccucguauuuuguacuuuccuauuugauuugauuauguuuucaaucucuucccccuguucacaggagaggccaacuaaaaccuaaaguuuaguacaacuuucuggaaauucugcaaaguggcaaacaaacugagaaaaucguaugccuuaaaaacccaucacugauguucuugaucaauaguuggcauaaauaaaucguagacaugugggcaagacugcuggagccaggcaaggauuuuucuuaauguggacagugaugucacugaggcagagagaaggaaggcauauuuacaauaaaagggagugauuauacaauacauuaaaaccauaaauaaauacuccauuaaguuauaaaauucucucuauauguucuuaggaggccuuccugucaggcacuuaacuuagagaaaagcaaguaaagcuccauuuaucauucauuuagccaaaacuugcugaauccugcucuaugcccgccaugacacaucaucaucacuacuguguauuaagaguuuacuacauccuaugcacugugcucagagauuacaugcaucaucucauuccagcaaugaucaacccuauaagcuggguguucuuuuuaauaaucauuauauagauuagguaaacgauacucagguuguguuauuuaucuguggucacauggcaauuaaauaaucagaugucauaugaggguauguaguucuaagauauaaauucauauuuauguuacuaaauaaaggccuucucaugcaaaacaaucaacaucuaaauucaggggaaauccagaccuauauucuaaaaauauggaguuaauagguguuuggcugacauacuuuaagauauucucuaccccaugcaccaaaaucaugacuagucacuugaauuaauagauaucuacacacuucaacaacagcuaccuagaauaauguaucaugguaauuuacauuuuuuaaaauuaagauacaguaugauuguauaaacauauguaaacuuucauauagucauauuauauaaaaagauucuauauaauuacaugaggcaggauaaguagucaaggaaguaaucauguccuugggauauggcaacuguggcaaccguacagucaaaacaauaagccccagcauuugcaccguaguccagcucacucaagcaaagcuaucuccaguagggaacuuccccuggagggagcaugcacaugugauuucaccuguccucagacugacccugugcugaugauaauagugaaaaacacaccgauggguggagauuuaagaugcuaaugagacauguggcacauggacaagcauguacagcuacugcacaugugcguccagacgaccacccagaacaugcuuacuaguaacacugcuuuccaccuccuuaugaauaaucauguaaaacuccccaaaacucccuauugccagucuuugcugucucauccuuacaagcagcccacccugaauucucugucucucaggguguacugucuauuccgcacuuaacuuucaaaauaugcuuuucuuuugcaguaaaugacucugugcugcauauccuuugcugugucuuguuuaauuucuuuuaaacuaagaagaacugaggucucacaacagccuucaaaaauuacacacuguuaacuuaaauaacaacuugacaguucaaauuuaaagagaacuauuccuguuuaauaaucaauccccuuuuuacuaagacaaugggaaaauaacauucaugcugaucaccaacuaaccacauuguuggguuaaaucaaaccucugcaauuccuuugagaacauaaugauguccgugguacccagaacaccaaaauugccuagacuaccuucuagaacacuguacaaucuaguuccaucaccucaguuguauguuuaccaggaaaauaucaauucccaaacccaucauacuuuuaguguauuuacaugauuuaagaauauaagagacugaugaaauaugcggaagaaaauagagccauugcuuccauuacuuuuuucgaaagaugagauaaaucgaauuggugagagugauuggcuuuauauuagauggagaaaucuuuacaaggugagaaagaugauuacaaaagcccagaagaacugugccuuagacugcuuugcaggcauccaaguuuuuacuccacuuugaaggaaucaucacuggugcacaguggguaacauuuauuugagaaaguagaggugagacuccaaccagucaauucauauuuaaggaggucuagaaccaagaauuaccaaacagaugcacauuauaauguccuaaaaacauuuaaauagcauuuuuauuucuugguaaagcaacauuuguugcucuagccaagaguuucaaucaacugacaaacuagaaguccuaacugauuugaauaaagggcuucuacugugcucugugcaaagccuuggguagcuagaggcaagauucucuagcaacacaagcucuacccaccccgguuacccacuucagaacccugcuuuuaguuuuggguacggccucgaaggauuacaggugaucagauggaugacauccugagucaucagucagugauuccuggucucagucagugauuccuccaggcacaucucccuucugauacuccuaaauaccagaacagcagccugggaaaagagcaaguaacacucacuucucucugggcaucaugugucucccaacccuugagugucaagaaucacucuuuucuaaacucccaggcuccucaaagagcagaagugcaggcauauaucauuuuagaacggaaggaauauuccagacuugcugcucaagaaacaaaagaugcaagugucuuugggcuuguucaaaaguacaccccuucuuucuuugugcugugggcaagagaugcacaugccagucuaaaugaaccacugcuguguuuauguucaugcugcguuccaucauguuuccaauccuuuacucuuucucaccauuuacugagguacucucaccccuacuucacaucgacagccccacagcuggucauccucagucacagucuugccaguucuaagccaaccuagcccccagagucucauuuuauaugcacaacagagguaggcgcauuguccauuagcaagucaaagacuucuuaaaucacugaaugguuccuaggcuucuuggaaugauuucaggaacaacuugcugcccuugguccacuucucuucccuauccaaauuucaaacaaguaacugguaucuucccagucaucaguucccaagacuagacuuuucucccaaucagggaaauugggcuuguuacauuuccaugacaugucauucugagugcccuguuacccgucucuaucuggaagaugguauauaaaugaaaucauuuacacagugccauucuaauuuugaaaggaauuguaggcaugucaaauagggcucauaccaaauaauaacauucuaaauaauaagagaggccaccaauugagguauaauauguaccagguccuacgccuguaacuuuaccugcacuaucauuuaauucgcucagcaauccuauaaaguacuauugauaucuuaccaugaggaaccucagcguuaaaaacuugcccaaagucacaggucauguaaacucauuuaugucaaauuuccaauccaaacuauauaacccaaagacuccccaaagguaaccaaacagauaaaauuuauauaaauccaaaguuuuuuucuugccugucuuucugcaauauucaguggggcaauaaaucucuggaaucugucauuucaguauauuuuuaauaaaguagacucuuucacacacucuccuggaaccucucuccaguugcucagcuuggaggaacucaaccaaaguacaaauaacauagggcaauaagugauacuuagaauuuaagaugcuuuggguuuuauguuggcauacgauucugauacucuaccaaauuacaacccagcaagagaaauguauuaugaacuugugugauauaauaacaaguuaaaaagagucauccuuucuuggaaaucagcauguucaccccuuuuguuuuugcuuuuguucuuagaacuugcugcuguaccucuugcaaagucccauaagguagaaccaggugauaucacuaucuuuaccugauacaggagacagaaaagaauuuaaaaaaaaggccauuuuacacagaagggaccuaauucugaaugauucaccaauauucgaugaaucacugaugagcuauaccuuugcccucuucagauuccuucuuggcuguacuaccaguaaguuugaccaugucaaugcagggaguuuacucacauaacuguacaaguuucuaaaaaugucuagcaauaaauauauuauucuuggaaguuauguucucgggaaaaagaggugucuccacuuacuuaacaaugaaguagcucacugaaucauuuaaauagugggcugaagaaaacaacaaaaucuuuaaaaaacaauuuaucaucucaaacuucuccuugaacaacuguuucuuuuuuauuuaccuuagagaauaggcaaaggaaaauaaaaucacuuaacacauagagaacucaagauagagacacaccuuuagaaagagucacauacaaacugguuaguaaauuaggcuauugucuuauaaaaguuguuguaaaucuuaggccaauacauucuugaagaauugauauuugaugcaucuguagguauuuauauauauauauauauauauuuguauuuauauauauauauuuauauauauaaaaauauauauauauuuauauguauaaaaauauauauauauauauauauauauauauauaucaggucauuuuuccucccgcucauucuuuuuuuaguuguguuuuuuuuuuuuuaauuuuaagagacaaggacucgcucugucacccaggcuggaguacaguggcaugaucauggcucacugcagccucaaacuccugggcucaaguaauccuccugccuuagucuuucauauaccugggacuacaggugcaugcuaccaugccugacuaauuuuuuuaacuuauuguagaaaugggaucucacuguguucccugugauggucuugaacuucugggcucaagcgauccuccugccucagccucccaaagcacugggauugcaggcauaagccaccaugcccagcccuggucacucugaaaggaaugucauucucuuuuuugaaaagagaugugauuucauuauaaugccuaauuguuuugccacauaccuaagguuccugauucauccuccuaagugacaaagacuuuuuacauagaaucaaaagaacuucugguggugggaagauggucuauagaaaagaaaaacuccccccaugccuauguccugaaugguauugccuagguuuucuucuaggguuuuuaugguuuaagaucuaacauuuaagucuuuaauccaucuugaauuaauuuuuguauaagguguaaggaagggauccaguuucagcuuucuacauauggcuagccaguuuucccagcaccauuuguuaaauagggaauccuuuccccauuucuuguuuaugucagguuugccuaagaucagauaguuguagaugugugguauuauuucugagggcucuguccugucccauuggucuauaucucuguuuugguaacaguaccaugcuguuuugguuacuguagccuuguaguauaguuugaagucagguagugugaugccucuagcuuuguucuuuuggcucaggauugacuuggcaaugcgggcucuuuuuuggucccauaagaacuuuaaaguaauuuuuuccaauucugugaagaaagucauugguagcuugauggggauggcauugaaucuguaaauuaccuugggcaguauggccauuuucaugauauugauucuuccuacccaugagcauggaauguucuuccauuuguuuguauccucuuuuauuucauugagcagugguguguaguucuccuugaagagguccuucacaucccuuguaaguuggauuccuagguauuuuauucucuuugaagcaauugugaaugggaguucacucaugauuuggcucucuguuuaucuguuacugguguauaagaaugcuugugauuuuuguacauugauuuuguauccugagacuuugcugaaguugccuaucagcuuaaggagauuuugggcugagacgaugggguuuucuagauauacaaucaugucaucugcaaacagugacaauuugacuuccucuuuuccuaacugaauacccuuuacuucuuucuccugcugauugcccuggccagaacuuccaacacuauguugaauaggaguggugagagaggacaucucugucuugugccaguuuucaaagggaaugcuuccaguuuuugcccauucaguaugauauuggcuguggguuugucauaaacagcuuuuauuauuuugagauacaucccaucaauaccuaauuuauugagaguuuuuagcaugaagggcuguugaauuuuaucaaaggccuuuucugcauguauugagauaauuaugugguuuuugucuuugguucucuucauaugauggauuacauuuauugauuugcauauguugaaccagccuugcaucccagggaugaagcccacuugaucaugguggauaagcuuuuugaugugcugcuggauucaguuugccaguauuuuauugaggauuuuugcaucgauguucaucagggauacuggucuaaaauucucuuuuuuuguugugucucugccaggcuuugguaucaggaugaugccggccucauacuucaugucuaaaacaccaaaagcaauggcaacaaaagccaaaauugacaaaugggauccaauuaaacuaaagagcuucugcacagcaaaagaaacuaccaucagagugaacaggcaaccuacagaaugggagaaaauuuuugcaaucuacucaucugacaaagggcuaauauccagaaucuacaaugaacucaaacaaauuuacaagaaaaaaacaaagaaucccaucaaaaacugggugaaggauaugaacagacacuucucaaaagaagacauuuaugcagccaaaagacacaugaaaaaaaugcuuaucaucacuugccaucagagaaaugcaaaucaaaaccacagugagauaccaucucacaccaguuagaauggugaucauuaaaaagucaggaaacaacaggugcuggagaggauguggagaaauaggaacacuuuuacauuguuggugggaauguaaacuacuucaaccacuguggaagucaguguggcgguuccucagggaucuagaacuagaaauaccauuugacccagccaucccauuacuggguauauauccaaaggauuauaaaucaugcugcuauaaagacacgugcacacguauguuuauugcggcacuacucacaauagcaaagacuuggaaccaacccaaauguccaucaaugauagacuggauuaagaaaauguggcauauauauaccauggaauacuaugcagccauaaaaaaaugaugaguucauguccuuuguagggauguggaugaaacuagaaaccaucauucucagcaaacuaucacaaggacaaaaaaccaaacaccgcauguucucacucauagcugggaauugaacaaugagaacaccuggacacaggaaagggaacaucacacaccggggucuguuguuggguggggggagugggagagauagcauuaggagauauaccuaaugcugaaugacgaguuaaugggugcagcacaccaacauggcacauguauacauauguaacaaacccgcacauugugcacauguacccuagaacuuaaaguauaauaaaaaaaaauuuuaaaaaaaaagaaagaaaagaaaaacucugacuccauugucuugaaacuuuguuuuugccaucuaauuccuuaggcacaauuuucuggcugaggagaaacugcccaaagacccuaguuccguuagauugaaaagcgaugaaaggaacagugcaauguuuucuugauggggcacuauggccucaccacagauguggcuuaguuaccugagcccuaccugguaacuccauguggauuaccauaaguacucuaaaauaugguaaucaaauacuaaugcacguaaguauugcuuggaaaacagaguaagacaguuuccccggcccuaucuccagagauucugauucacuaggucuggguggggcucaugaauuugcauuucaaauaaacucacagaugaugccaaaugcuagccugaggaccacauuuugagaaucacucuagaggacugggauuccaaagcacucaggguaaccuguaucacagacuguaucuaaaauguuguucuuggauuacaguggucuguagcuuuaagaagcaauuaugauacguuucuuaccaaaggucaucaaagaaagcacacugcugugauggcaagcuauccacuuuuauaaaaagaagaagaagaagaaaaaaaaaagaaacaaaguaauggcucuucucuuggaacugagagaaagcugacucugguuuacgaaggccuaucucauuccugaucguuuaucauuugagagaggugugaacagucuaugucaaaaaugcucauucaacauucccaggaagccacucacagggcugaauguaauuuuacuuaagccugucugaacuugcuuuucuuauuuuucccccuguagacacacgauuuucuuucuuuguaagaaagaauucaaagacaaagacacagaugugauuucaccaaacuagcaaacuuuaaagcaaaaaaaaaaaaaucauccauuucuguuuauagcaagacucccuguuaucccucuacucaucuuccuaugcagagagaaaaugugaaacuguaauagccacucuucaagacugauuaaauaaaaaucauucaaaagccuguguugauaacauauuccuaucuuuugugugcaaauccauauuguguuucuuggaagaccuaauauccuagaaaaaauagaccugcuucuuacugaaaagcagcaguuggaaacugaaaugccuacaguacaaguaguaacaaaauuaauggaccaagccaggagugaagcaagggaggguaggagggacaauggaguucuugagaguccuggcauuacugggagaacugcaacuaauuagcuucagaaaaaaauccaauucugauaaugccaauuggggcaucauugagauucuuuccauuuuuuguuuguuucucuugguccucuuucuugaugugucugaggauuuuaaguagaauuacagaagcugugaaugcagaauuauagagacucugcaugaugguaucucccaccaaagaagguucauccuacucucuggcagccagucugaaauggggcguuacuuucauccaauuuggaauugaguugacucaaagcugguuaguguuuugaaagaugugguccaccucugguuuacacacacuccauaggugugguuuaaggccugugggguacacuaguacaccugucauucguggaugugcaacucuacuuauuuuaaccucagcccuaggagacuaucaaaaacacacacaguggcucacaccugugaucccaacacuuugcaccaagguaggaaaauggcuugaagccaggaguucaagaccagucuggucaacauagcaagacccugucuccacaaaauacuuaaaauauuagccagguaugcucaugcacacuuauaguacaagcuauucaggaggcugaggugggaggacugcuugagcccaggaguuugagguugcagugagcuaugaucauucuacugcaauccagccugggcagcagagcaagacccuaucucauuaaaauaauaauaauaauaauaauaauaauaauaauaauaauaauaaaaagccuucagguauaaaucuacccaaggcacccaucuucucucuuaggucuugguuccucugaauccuggcugcuuuggcagacccaaacuucuaugcuugucucuucagccuuaugagaucaccaaaaauuauguugcccacaagguaugauuuucuagcugccuguuuucucaacugcuccuugagccaaaacccagcaaauucccugaagggaaaagcagccuguggacucccggcucagcacucuauaguucccugauuucugggucucuugguugucuuggcaguucuuuguuaucuucaaauuagguuuacauguggcuuuucuauuguuuucaaagaaacaucaguuugucacaagccacucuaauuuagccaaaagcagaaguccucagguuaauuuaauagaguaauaauauaauuacuuccccaagaaauaauguuuuuauucugaauaugagguuaaauucaaauuuaaacuuaauccauauguuacauaggaauuauuuuguuaagaauuagcuucaaauaugauaauacacauauucuauuccaaacaacaugacaacucauucuuaguucaaugaucucuuuuaagacagauauaucaagcaauuuuuguaaucugucagcaggccucaaagaaacuucaaauaaccauaaaucaguguuaucauuuggaguacuugagaugcucuagauaaauauuugaugguagauggacacuaggcagaggaauaguuucaucuaauacaauaauaaaaaaaaucacaagacacccacuaguaaguuuaucagggagcaagauggagaauguugcugacagaauaccacuccugcagcugccaguaauaauucacccuugaagcaaagagauggagauuuaaauggggacacuauccaacuuaagccuuucuguagaauauaguguccuagaugaagacguauguaguaaagaugggggaaaugaccaaauuauucgauuaccauguguuaccuccaacugggacuuccaauauuccugaaaauucaccugcagaagaaaguaaaagagaaacaacaaauucucaccaugaaaugauuuugaaugcuauuucagaauauuacccuguuagaucaucucaucaaugaauucaggggcccucuauuauguagguagcucaagaacguagcagaagccuuggaagggacuguccaugguggauacugaccucaauugcucucggauuauaacggacuauagcaguggaucucuugagagggcuuuagucucuuccuuaacaugcuuuuaucccagggugggauuacuaagaucaaaugcccaggcauucaaaugauggagauguagaaugguaucaaguuuggcacacauccuaaccaauuaauugguuuucauaauuaucaaguguuaagauggagucaaaaaaaaucacacaaaaaaacuuaggucuaaaagcaaacaaaaaauaauuuuagcuaugugugcaguaucaagugguaucaacugauguccaaaaaauaaaaagaagagcauuuucuguaugugguaggcacugugccaaggauauuacauaaaaucugcucaucuucacaguaacucugaauuaaauaccgucauaauccucauucuuacggauaaggaaaaugaagcagagaguggguaaguaauuuagucaagguaguaagcagagagagacaaccugaacuagcucucuggaugcaacauugaaagcucuuaaccgcauugcuuuacuggccuccuggacagcauugaucauuuucccugcacuuuaagaauguaacuacggauuauggacacgugccuuuccuagcuauucuuaaauucugagcuuaauauaaaauuaaugacauccugggagccaugauucuucccuacuacaucucacuaagaacaugguuuaugaaaucuuuauagcuaguugaaauguguuuacuaagucuugccaggaagcucauuuuauagggauaucacacacaggcaauauaaauuccuauggggcuaagaagccuucauuccaaccagugcuuuuccuccaaguaauucgguagguuuggaaaaugaagcaucuggucugcucuuuuccacaaguuucuaagcuugaauaaagaucacucacuugauacagaaaggguuggaaaaauuccagaucuggccucugaagguuacuucccagaaugcggcuguuaacuaccuauuacuguuuagaccaaguaucuuugagagggaaaaacucgcuuugauugccuagguacuucaagcugcaaaucugcauuucagugaacaacuacuaaguaagcagacaggaaagagaaccagugccccggucuguaugcaacaucuuguucuagccuuuugugccgaaaagcuaugcaacugugagaaagucacacuguaagccucagcuuccuucucaauaaacugaagaugaugaugauguucuuauaaagguagcguaagugaaagcacuuagaaguuauucaaauaugacaucauaugcgcauacacacacacacacacacacauaugcaguaauguggcacuuaauaauggagcuauguucugggaaaugcauuguuaggcuauuuuauugugccaacaucacaaacuguacuuacacaaaccuagauggugcagccuacuacauacccaggcuauaugguauagccuauugcuccuccuagauacaaacauguauagcauguuauuguacugaauacuguagguaauuguaacacacuggcaaguauuuguguaucaaaacauaaaaaagauacuauaaaaauauggcacaaaagguagcuggcguggugacucaggccuguaaucccagcacuuugggaggccgaggugggugcaucacaaggucaagagaucaagaccauccuggccaauauggugaaaccccaucucuacuaaaaauacgaaaauuagcuaggucugguggcacacgccuguagucccagcuacucaggaggcugaggcaggagaaucacuugaaacugggaggcagagguugcaauaaaccgagaucggggcacugcacuccagccuggcgacagagcuagacucugucaaaaaaaaaaaaaaaaaaaaaaaggcauaaaagguagaaaaugaaaaugguagaccuauauagagcacuuaacaugaaugaagcuuacgggacuagaaauuguucugggugagccagugagggaguggugagugaaugugaagaucuaggauauuauuguaaacuacuguagacuuuaauaagcacuguacccuuaagguuacacuaaauuuauuaaaaaauaaaguauuaauaauugcacuaugacauuacaaugucuacgucaacacugggcaauaggaauuuuucaacuccauuauaaucuuauggggccacugucauauaugugguucacuguugacugaaauguuuuaugguacauaaauauauauauauguguauauauccccaagauauaaauauguauauauaucucuaagagcugagcugugcauauuauccagguccuguauagaacuguauagaacuaugcaagugacaaagcagaaaagaauaaacagaaaaaguccauuaagccacuccagaggaagugaguuugagaggggaugcuggauuuucauaaugagagaaagauaaugcagagcaggaagagagauuuuaaaaaaugaggagcugcaggucagcuacagaaguggguuccagagaguuccaguaaugccagcacuggguuaaguggggaauuuggggaugaaauaacagcagacaaugccucacuuauuaauggaaaaucauuugauauagaaaaguugugugcaaggagccauaaaccaaaaacaccaacaaaaaccauguuuucaagaaggaaccugcuuguaacgagccagugaagguauauaccaauuuaagaauuagguacuagugacuucgaauuauuuaacagccagguccauauagagaauaaauaguagacuauuuuucucauaugggcuauuuaagugagagauauaagcagauaaaacuucuuaauuaauugcuuucaauaguuuagaguuagaauagguauuuucaauuuguauaaugaaaacuuguuuuuaggaguucuugggccaacgaagaaggcaaucgcaacauuaacauaguuugaauuaaacaucgguaaaacaacaacuaaugaaaagcccaauauguuuuucuuacuacuugaaaaaauauuuuuacuuuauuuuuuuuaaccauuuuaucaaaugguuaucaggggcccagugcuccugaagucaauaaccaagguucagaaaucuuuacccuuuugcuuuuugggaaacguccuaagccacgaaaaccaacuugccguugcauaucauaaggcccaccuccagccuuccugguucccuguguuauaaaucuucaccuuuucucccucuucuuucagaccuucuucauuucugaacauccccccacuucaauaacccgaauaaacucaucuccuuaauggacugguacaucuugucuuugacauauuuaacuguuacaagaauuccagaaaacugauacuagaaaaaaaugaaaccauauaguacauacacuuuuggugcuauuuuccagaaguuguaugaaugcaaaaucucagguaaacaaaauuucauaaaggauauuaaauaucaguugauuauacuagugccacaaucccaagaaagaauauaaguaucuacggaaaaucucauuuugcacaaagauaacuuaguacaacuaaaacuaguucaacuuuuuuagaaaaaacauuaagcaaguaaaccugacucuccaacuaugagaagcauuccaaacugagcaugaccccauagguagcacugggagauugcauaaggaccagaagguuucuagcaauaugggaaaaaaagaaaaucacagcuuuagcaaaggaacaaaguccuaacuaugaagaugacuuaaagauacaauccuuaggcccacaugggacccugaggccacccacuuccaaauuugagacucccuuaaucucaaauccgagccacaauucagugggccuaacuccaauugaugucucaagacuuguaauuuucuacaaguuuauugcuuucccucugagcaaauaaacauaccacacuuuauuucuauacuucugugagauuucucauauaaauaaaugcccaaaucuugggaggagaaauacuguaaccacauaucuucauuucaggcccugcauaaaucaauuuacagugcaacucuaagguaaaaaaaugcagcaauagcagccacacucaauaauaaaaucacacuaauuuggacuaauaauuaguaaccuacuuccugagcacugcaccaagcgauucauaugcuuuaucucauuucaguaucaggaaaacccuaugaagugguuuaaaguggccccauuugacagaugugaaagguuaggaccagagaggcuuuacuguguacccaagaugacuaaauuauuggaaaguaagugguaacauaguaauuauuaagaaaggauucaacaugcaucaccguuauagucaaaagacauuggaauuuacaugagaccaauagaaugugaccaaauaaagauauuuaaaugaccaguuuaaugaauucaaaacaaugauuaguaauuaacacaucaaucuuugaaugucaauggauaauucuaaagugcugcagcuugcuugaaaagugccuucucucaagcugauuaaauauucucuccaaaaaucuuguuuacauuauuaauuugcucaauaaccccugucuucagagaaguguaaaccucuagcuggucccugaagaguuagcacauauuuuuaauuaaaauggucuugaaucaauugaguuauuauuuuuccagguuauauuacuaacaauauuaacuccaaauaagauagauuaaaaaacaagguacauugaaaguaugcaaauguaagugucuucaacaaugaaauaucuaaaguucauauaaagaccugacuccaaauuaugaaaaauggaaaauuagucauuucuguaguguacacgaaugauuugcaacagcaaagaauguaaggaugugucaaaaguuuacaaguucaaaguacaaaaugaacacuuccuuuaggaaaugcuaaaacaaaauuaaauaccauuagaaagauuuugacacuuugcucuuuuaugagccaaauuacaguaacagaguugggaauauaaugaugcaauuauacgcugucaugaacaguuuaauuauuuuaugccugagcagauuuuuuuuuuuuuuaacucaagugcccuauacaacuuccacaccugaaugcuucuaacuuggcuuugccauuuucugacucuauuuaauuuucuggggacacagaaggaugguccuuacuuuaaaaaaugguucuaucaaaauucauucucuucacuuuuaagcucuuaaaggcgagguaacaguuuuucagcauacacucuccagagggcuaaacucauucauucauucuuuccaaugcuccaaugccuccgccaggccaggcaccaggcuaggaugcaacauagauagaugugggaagucaagggagaugacugacaaacgaggaaaaugaaaaucaacaggaaguuguaaaacauaaaggcagcuaugggucaugucuaugccuucagguuucaccaucaguccuguuuuaaauccuagcccugacucuauguaaguauuucagcucuaaguuaaucucuucaccaccuggaaaaugggggccaugaagaucucucccucacaaguugugagguucaaaugagaugacgaugcaaaucuggcacauaguauaugcccagugaauaucagcagcuaccgaaugauaauaauuguauuuuuauuacuuuuuguauuaucauaagugucacaauaagcuauauaaagcaugcuaauaagaacacugaggaaaagcaauaaaucuuccuggaguagcucauuccgaacagacaaaaguuucaggggagagagggagauaaugcugaguaaugggucuucaaucucuaugagaaaaaaaaauaaccuaagcauuguucaagagaagaugccauguucauuuaaaugacuauuucaucuuaagaaagcagucugagcuacuaaucaaaccagaacccuagccaugcugaugaugaucauuaaugucaucauccauaaauucauuugcugugucacaucuugguguaggaauacucauuuguuacaguuaugucuucaguuugaugugaagagaaagcaaccauaaagcaacuucaaggaagcuccuccaaauaauuaaaauucugaagcauuccucaagccaaaagcagaucagacccucacugagggcacuuucuauuaaauaagcaggcugcuauuuguuguucuugcagcacaaguccuugagcucacaaaucccacagcaccaaaagucauuauuuuuuaaccaaacuuuuuuuuuuuuuuucuugagacagagccucacucugucacccaggcuggagugcacucgcaugaucucggcucacugcaaccuccaccuccuggguucaagcaauucuccugccucagccucucgaguagcugggacuacaggcaccugccaccacacccggcuaauuuuugguauuuuuaguagagaugggguuucaccguguuagccaggauggucucaaucuccugaccucgugauccacuugccuuagccucucaaagugcugggauuauaggugugagccaccacgcucagccuuaaccuaacuuuuaaaguccuaaauauaucuucuuaauaaaagggccaccauuucuugugcacaucuggagcccuuucugggcacuagucacugugcaaaaguuguuacacacauaaccucauuucccacaauccuucccaggagacacuacuuauccaggguuguaaagauaaggaaacugaggcacagagauuuuuaagucacuuacgcaaguuuuaccauaacaaacuuggguauuacccaaguuuaauauuaccauaauaaacccaaguuuacuaucaaacagcagagcucugauaugaacccaacuuugaacucaaugucuuuagugacuauauuauaguaugaguaccuugagaauauauauauuuuaaauuuccuuauuuuuaaaaaacaauacucaaauucaaaauacaaauuaagauggggugggugagguagggugaggggagugaauggaugaaagaagggaaaggaaggcaaauuauccagccacuacagucagauguuaaaguagaauucagauaucaaccccaaucggguuggguuuucauuaugaucagacaagacucuucuugaccaaagacugaacucaauuucuagucaaugucuuagauaacaagggcccucauccauuauuagacuuugaggucuuuucccuccaucauugagcuucagcucagcaaucuuacggccauuuacaaggugacugaugagccuucaucauaaaacaagaugaaagcaacuugccuacaugcacgucuucaaaaccaaccaaaugaaccaauuacagaacaaaaccaguuuagugugaggaucaaaaugugauaauguuuuguugagcacagagauaggcacauaguggguugcuuguuuauuugcuuuaguaugaauaauaauuauuauggauauuaucaggauuccuaaaaagagucauuuaacuauuaugggaacaauauaauauacuagaugcccuuuccucaagguuaugcaaccuacaugggaaaauaacuaaaacaaaugaguagcuucugcaauuaaggauccugagaaugacuucccugcuugauuugugguaguagcugcaugcccaaauggaggaaaauuauuugaauaaacauuggucaguggggagaagugaguuuuaggacuaggcugcuuucagagaaauucaucaagaggaaaaaaauacauaauuuuaagaagucaaagccuauuauuagaaaaauauguucaccaaaugcagcucuaauaccuuuagcaaugagauaaacugagucuagcaagugguuggacucauaaugauucgauuucuuuaacuagcccauuaauccaaaagauggccaauccacguucaugaagacacugccagugagcuagaauaucugaaagaguuggcauaaaaagcuccaccacaugcaauuaauccacaucugaucacaugccccugaauaaugucagcccacagauggguuuguacacacaagauacaguguugccuuuaaauauucacaaauauuuuuaaaguauaacuuuuuaaaaaacauauaugacucagaaagaacagaaggguugcacaacucccagauaucugaaaugaugguuaccgacaaaucuucacugaugcuaaagaacauuuauuucacaccuacucugccacauucacucccacacacuuccccaaaccagaauugaauuguuacuucacuuucaugcugacuucagacauaauugucacuucugcaaggucacacuuuggggaacacuauguaccuucuuaaauacaacauuaauuauggaacuaaccuauuuagucucuugcccuaaagacuucagcauuuaacucgacuuccccauaguuuacuguaucauagcaauuaaguuaauggcagcagcagcagcagagaaucuuuuaaccccuaaugggcuuguuccucugauuagacuagaucaaagaagcugcagcuauuuggaggcagauuagagaggcuucuuuuuuacugauaucagcacugaagaguggaagaucauguguguguugacaucuuacccaaauccauccaugacaguuuacacugaaguuauucuuaaugaagacuuuuaauacaucaagacuauauggaucaggaggcaugaaagcacccuuacauucaaagagaauaaaauaccuaggaauccaauuuacaagagaggugaaggaccucuucaaggagaacuacaaaccacugcucaaugaaauaaaagaggauacaaacaaauggaagaacauuccaugcucauggguaggaagaaucaauaucaugaaaauggccauacugcccaagguaauuuauagauucaaugccauccccaucaagauacuaaggacuuucuucacagaauuggaaaaaacuacuuuaaaguucauauggaaccaaaacagagcccguauugccaagucaauccuaagccaaaagaacaaagcuggaggcaucacacuaccugacuucaaacaauacuacaaggcuacaguaaccaaaacagcaugguacugguaccaaaacagagauauagaccaauggaacagaacagagcccucagaaauaaugucacauaucuacaaccaccugaucuuugacaaaccugacaaaaacaagaaauggggaaaggauucccuauuuaauaaauggugcugggaaaaccggcuagccauguguagaaagcugaaacuggaucccuuccuuacaccuuauacaaaaaugaauucaagauggauuaaagacuuaaauguuagaccuaaaaccauaaaaacccuagaagaaaaccuaggcaauaccauucaggacauaggcaugggcaaggacuucaugucuaaagcaccaaaagcaauggcaacaaaagccaaaauugacaaaugggauccaauuaaacuaaagagcuucugcacagcaaaagaaucuaccaucagagugaacaggcaaccuacagaaugggagaaaauuuuugcaaucuacucaucugacaaagggcuaauauccagaaucuacaaugaacucaaacaaauuuacaagaaaaaaaacaaagaaucccaucaaaaacugggcgaaggauaugaacagacacuucucaaaagaagacauuuaugcagccaaaagacacgugaaaaaacgcucaucaucacuggccaucagagaaaugcaaaucaaaaccacaaugagauaccaucucacaccaguuagaauggugaucauuaaaaagucaggaaacaacaggugcuggagaggauguggagaaauaggaacacuuuuacacuguugguaggaauguaaacuacuucaaccauuguggaagucaguguggcgguuccucagggauccagaacuagaaauaccauuugacccagccaucccauuacuggguauauacccaaaggauuauaaaucaugcugcuauaaagacacaugcacacguauguuuauugcggcacuacucacacuagcaaagacuuggaaccaacccaaauguccaucaaugauagacuggauuaagaaaauguggcacauauacaccauggaauacuaugcagccauaaaaaugaugaguucauguccuuuguagggacauggaugaagguggaaacaucauucucagcaaacuauggcaaggacaaaaaaccaaacaccgcauguucucacucauaggugggaauugaacuaugagaacacauugacacaggaaagggaacaucacacaccacacacaggggcuuguugugggguggggggaggggggagggauagcauuaggagauauaccuaauguuaaaugaugaguuaaugggugcagcacaccaacauggcacauguauacauauguaacuaaccugcauguugugcacauguacccuaaaacuuaaaguguaauaauaauaauaauaauaaaagaaaucaccguuauauauuucaggcaaagguacccaguagcuuuagguuuuuaugcccaucugcuuucucaacacaccuugaccgccaacucuagaugucaaaagcugauacaggagucauacaucauucaauuacguucuucaugauaugggggcuaugugcauucuacuauauauauuuuuaaagacauggucucacucugucgcccaggcuggagugcaguggcacaaaucacggcucacugcagccuugaacuccuaggcucaagggauccucccaccuuagccucccaagcaagcugggacuacaaauguacaccaccacaccuggcuaauuugucuuauuuuuuuuuuuuuagaaacaaagucucacuaugcugcuagggcugguuucgagcuccugggcucaagcgauccuccuaccuuguucucccaaagugcugggauuacaagcaugagccacagugcccagcccauuuuuaucguugguggaaagaaaagcauuuuuuauaauguguuuagaugucauacucaauucuagcuucaucaaaaucacuuggagcuuuuacauuaauguuuaaaauacaagcuacaucccagagcuagugaauuaguauauuuuaaggguugagccagaaauuuauaguuuaccaaaguuuccaaggugauucuaauaaugaccuaguuccagaaaucacugguauaugccauaaugcaaagguauaaagauaguauacaccaaguaaauaaaugucaaagaucaauuaacuaaaacaaagaguggguugggaaaaaugagacugccugagacuaaaaucucauucuccaucagcuauuaagguagauaaauuacagcaccucuuugaguuucaaugcccucacuuucaaaauggggcaguaauagcuaccacagauacauagguacaacgcgcuuagcagugguuugaaaccacaauaagcugccaaaaagcauggcucauuuugcuuuuuaaccagauucuagaucuucuaaacaauaaagcugauuauaaagacauuuuccacaaaauagccuuuuuccucuccuucaaugcuuuucacuuaauacuguacuucuugcaaagucaguaggcugagcaugaacaaauuaaaauuaaaagcugaauuacuuaauuaauuuuaaggcacucucaguucauuaacagcauuccugcaaguuaaaaaacaagaaaacacauggaaugauuguaaaccgcaucccaauuucagaaauguucaaauauauugggguuggggaggugagcagggcaaucuacugccauaucaaacccaaaagcuucucuuaaaaaggcuauguacauguauaugcccaccagacaagauguccuucucucauguugcaaucagcaacccaaaaguccuguaaaauagccaaaggucaaaauaguucagaaaacacuacuucuuauaguccuccucuccacaacccucuuuucagaaguucguaacuggcauauucacauaucaaaaaaucugaaauuaagaaaugucuucaacaaauaugucuaucaaacuugucuugaacuuuccucacuuaccuuucggggggcaaaucugaugaggacuuauuuugggaaacauuaaaauuagggaaagucuuuugguuauacuuauuaggaaaaucauuguccaaguguccugucuugccagaaugagagguuuauaaggaaagaaguuccacggcuuuggacuaauaaccaaccaugggaaucacagcuuccuuccaagggaaauaacaccuuuuuuuaaaauuugcuuuuauauugguuaaaaaaaaaagaaccaugaggaaacaucaagaaccaauauuacuucuuuggaaaaacuuuuuggggauauugcuaaggauuuauauugcauaauucaacuaaacgaauuuuuuaguuuuaaaaaaucccaauaauauuauaaaccuagaaacuguuuauucagauccaccuugguaaaauaaauacauucaauaaacacagaauacagacagcuuuaauuuuuuacaugugggucaggaggauccaucucucccaaaacauguaucaccccacaugugcugugauuuacaauccucaaagcauuaaaguuuaauuugugaaucuacuguuucagauucauuggaauucugauccaauagucacucuaaaauagaugcaggcuggaagacaauucucuacauuuuaaagccagauggcccauaacagcuaaauauuuuuucuuuccuuguucagaauauaauucauguuggaaguagugaaucaacuuaaguacguacaaauuuaagggaaccuuagucaucagucccaaacuuaggaaucuauuuaaaggaaauauauuuuaagguuaaguuuaaaaaauaacaaaagagaauaccauauguaacaacccuggcacagaacacuuucuuuaagaaaacucccuuaacguuaacggcaaaaaaauacucuucccauuucacuaugguaacuaauaaaaauuuuuucuucacacugaaaaauaaaaucuuuauuuaaucuaauucuguaagugccaaaaacucugauuauuuuaucaaguuauuaaauauguuauucaguagugagccuuauugauuuuccuuuugauuagaaaaauuaccaaaaaaauccagcucuacaguucauaaccugagaaugguagaaacccaagacguagagcacauuaugcaacacucuuaaacaaaucugccucuugggaucucucuccuuuuauagaaagagacucuccagcagccccuagagacauucccauacuaagugagucagcuaaauaaaauuaagcaacuaauaaaacaauaugucaucuuguucucauugucauaauuaaaauccuuuuucuuuaagaugaaagguggcagcuauagaguagccuucaaaaucauaggcuaugccgaagcaggaucuucucuccaacgcuguacagacaacgcagcugucccugacaucaccacuugaaauuauucccuauuugauauuuuugacauuaaaaggcugaagucuuuuuucuucugcaaguuacuuccaugcuugcuuauuaagcauuccaaguuggucucucacccaauagccuuagaaagcagaccaucauuauuuagggcaaagguuuccagaggcagucagaggcaggauaaggaugggggaucccaaacaagccaugcucuuuccuaagcaaagcaccucuauuuugaauguguuugauacacugagcuuccaaauaagauugaaauugauuuuaaaaaaagggaacccccgccccccuuuaagccagguaaaaacuauaaccaucccugucaagagcguuacaugaaucuguaaauccuaugacagacuaccgguugaaaccgagguugaagucuucaguucgccugacucagugcugguacacaguaaaaacuaacacugaaugggugccccacagugagugaggcauuucagcaggaccggggggauguuaugcaacaaaaacaguuauagcccuugucugccuggaguucacaaucuaauggaaggaugaucauuacaucaaauauuaaagagagcuaccaugcaguaagcccauucuagacaucagcugccguucuaauaucaacucauuuacucuccaccacaccuuuaagaaugagguacagugaucacuccccuuuuacagaggagccacugaggcacagaguuggcaagguugcuaaguggccaaguuugguuugaagccaacgguauggcuugagugcccauggcucaaccacucaacccuaccuccucucccaaacacuguaagaacccaaaugucaaaugcaccuagggcaaguccucgacagaaaggcauggggugugaaaagaauguauaauuagaggaucugaccaaggcagggagaacaccacugaggaauuaaugcaggagcugagagcggaaagcaggguagugaagagaggagggaagagcaucgagguaggagcaaaagcaagagauccgccaggauaaagggcuuggagagcaggaggacuagaauucagcccaucaggacagagaacauaggaggguggcaaacaggagguuauggccccaggcggacaaggaaagacaggaaggugccaaccaugcuggaccgggcuaagacagcuggggagccacugagggcaugcugcagggagaucacugggcuaauacuugugaguccaaaagacuuuucuggcuguaucuacacagucauggcacaguccucccaauaggcaggccgacacaaaaccaacccugcucuguaucacuccauguauuccuggucauauugucacagccugaugugcacugaccaccucugugcugugccacacugagggagcagcugcuccagcuaauuucuacccaacauucaccaccuggaggcaaugcauuggcuccucaggcuuuagcauggcaagggaacuucacaaauaagaaaguuuaaaaaugauguuacucucuucaaaaucuuuucuucauuuguagguggcagaaggcaacagauauaucacaucauugaguaccaugggacauguguucacacuuuaaaguacuuagguguuauuucauguaaauguugagaaggaaaaaaaaauccuguuuuucuugucucuugggaaucagcuuugguuuucugaagaaauaguucacaaaucuaaggaaaaugauauaucuauacuuauuucccuaaagagaacauaauuuuucuucuuuugguugauaaggauuuaauugcauuuagaaggauuuaaucacauaaggcuaaccaaugaaacacuaacugugggcagaacucuguuucaguuggcccuauuggcccuaaaaugucauugauagugacuaaauauacacauuacuccucucccccgccauccuuucuccuccuuccauuucuccuucucagaacagagaaauaaaacgucuaggaaacccaucauuuacuggggaaaggaaggggacguguaacauuucaaacuguaauaaggcaugaacuugccaagcuguccaugugggagguuauagcaugcccagagaaguugcccagaaaauagacaugguuuccaaucaaaaaaacuuagaccaguugaaacucuggcuuugggcaauuuacuuaacuucucugggcaucaguguuaacuuauguaaaauggagacaaucacaauauguaccuuacccuguugugguaagauuaaauaauuggcacagggccugacacaauaaagguuaaugauagcagcuguuaauuauuauccacgaaucaguuuaacuuuaagaaaauaacaacuacuuuggccauucuagcaaguguguggcaaagagggauaacagaagcuccuuuuguggaagaacauguaauuugcccuuuauuugcacaguuuggaaucaucaucauaacauccuaauaugccuugaaauccugugaaaaaacagaaguaaacaaguaaaaccaccauagcaacacuauggcagaacugaguucacuaaaagaucuugucucuugcucaaaaggcuugacucaaggaaaagaacuagguauuucuagguuccccugcauucauuuuuuuaaaaaauuguuguggguacauauaagauauguuguagguacauuuaugggguacaagggauauuuugaugcaggaauacaauacauaauaaucacguaggguaaaugggauauacaucaucucaagcauuuauccuuuguguuacaaacaauccuaucauauuuuuaagcuauuuuaaaauguacaacaaauuacuguugacuguagucacccuguuaugcuaucaaauacuagaucuuauacaucauauguaacaacaucuguguaugcauuaaccaucucccccuccccaacuacccuucccagcuucugguaacaauccuucuacucucucuuuccgugagcucaguuguuuuaaauuuuuaguucucacaaagaagugagaacaugugauguuugucuuucugugccuggcuuauuucacuuaacacaaugaccuccaguuccauccagguuguugcaaaugacaagauaucauucuuuuuuauagcugaauaguacuccauuguguauauguaucauauuuucuuuauccauuccucuguuagggacacuuagguugcuuccaaaucuuggcuagugugaacaaugcugcaauaaacacggggguacagauagcucuucaauacacugauuuccuuucuuuuggguauauaccuagcagcgaguuugcuggaucauaugguagcucuuuagucuuuugaguaaccuccaaacuguccuccacagugguuguacuaauuuacauucccaccaacaauguaugagaguucacuuuucucaacguccucuccagcacuuguuauugccugucuuuugcauaucuuuucauuauuuuguguccucuucaauaagccauuuuaacugggauauuacuguaguuuugauuugcauuucucugaugaucaguuauguugagaaccuuuucauauauuugccauuuguauguuucuuuugagaaaugucuauccagaucucugcucauuuuuuaaucagauuauuagauuuuuuuuccuauggaauuguuugagcuccuuauauauuuugguuauuaaccccuugucagaugaauaguuugcaaauauuuucucccauucugugaguugucucuucaaauugcuuucaaauuugcucuucaaauuuguuuacuuugcuaugcagaagcuuuuuaacuuaagcuaucccauuuguccauuuuugcuuugguuaacuguguuuguaggguauuacucaagaaaucuuugccaagaccaauguccuggagaguucccccagugucuucuuguagaaguuucauaguuugaggucuuauauuuaagucuuuaauccauuuugauuugauuuuuguauauggcaagagauaggggucuaguuuuauucuucugcauauagauauucaguuuucccagcaccacuuacugaagagauuguguuuuccucaaugcauauucuuggcaacuuuguugaaaaugaguuugcuguagauguauggauuuauuucuggguccucuauaguguuccauuggucuaugugucuguuuuuaugccaguaccaugcuguuuugguuacuauaucucuguaguauaauuugaagucagauaaugugauuccuccaguacuuuuugcucaggauagcuuuagcuauucugggucuuuugugguauuauguaaaugcuaagauuauuuuuuucuauuuucaugaagaaugucauugguauuuuuauauggauugcauugaaucugcagauugcuuuggauagaaugggcauuuuaacaguauugauucuuccaaaccaugaacauggaauaucuuuccauuuaucuuguguccucuucaauuuuuuacaucaauguuuuauagauuucacuguggacaucuuucacuucucugguuaaguuuauuccuagguaguugauuuguaguuauuguaaauggaauuacuuucuugaauuauuuuucagauuguccacuguuggcauauaaaaaugcuacugauuuuuguauguugauuuuuauaucuugcaacuguacucaauuuguuuaucaguucuaauaguuuuuugguagagucuuuagauuuuuccaaauauaagaucguaucaucugcaaacaaggauaauuugacauccaacuuggauacccuuuauaucuuucucuugucugauuucucuagcuaugacuuccaguacuauguugaauaacaguggugaaagugagcauguuugucucauuucagauuguagggagaaaaccuucagguguuuccccuucacuauauuagcugugggucugucauauauggcuuuuauugugucaagguauguuccuucuauacacaguuucuguggguuuuuaaucaugaaaggauguugaauuuuaugaaaugcuuuuucagcaaaaauugaaauaaucauaucguuuuuguccuuguguucauaugauguaucauugauugauuugcauauguugaaccauccuugcguaacuggaauaaaucccgcuuggucaugauaaaugcuuuuuuuaauguguugcugaauucaguuuguuaguauuuuguugaggauuuuugcaucuauauucaucaggguuacuugccugcaguuuuuuuuuuuuuuuuuuaaugugccuuugucugguuuuuguaucagggugauacuagccuccuagaaugaaucugcaaguauuccuuccucaucaguuuuaugaaacaguuugaguagcauugguauuagugguucuuuacgcauuugcuaaaauucagcaguuaagccaucaaaucuagcgcuuuucuuugcugagcgacuucauuauggcauugaucucauuacuucgucuguucagguuuugcauuucuuagugguucaaucuugguagguugugugugucuagaaacauauccauuucuucuagguuuuccaauuuauugguauauaguagcucacaguaucuucuaaugaucuuugaauuucuaugauaucaauuguaaugucuccuuuuucaucucuaauuuuauuugggucuucucuuuuuuucugaagauuugucaauuugauuucuuuuuucaaaaaaacaacuuuuuguuucauuuaccuuuuguauuuuuucauuucaauuucauuuauuucugcucugaucuuuauuuuuccuucuacuaauuuugggucugguuuucacuugcuuuucuaguuguuuaaaauguaucauuaguuuuucuacuuuuugauguaggcaauuacuacuauaaacuuuccucugaauacugcuuucaccauaucucauagguuuugauacauugcguuuccauuuucauuuguuucaauauauuuuuaaaauuuucuuaauuuuuucauugacccacuggucauucagaagcauauuguuuaauuuccauguguuuguauaauuuccaaaauuucagcuguuauugauuucuaauuuuauuccaugguggucagagaagauauuugacauaauuuuuaaaaaaauguuuuaagauuuguuuuguggccugaaauauggucuuuccucgagaaugauccaugagcugaagaauguguacucugcagccauuggauaaaauguucuguaaaugucuauuagguccauuuggucuguacugcagauuaaguaagauguuugcugacuuucugucuggaugauauuuccaaugcugacagugggugaagucuccagcuauuauuguauuggggucuuaucuaauaauaacuuuacauaacauauaugagugcuccaguguugggugcauauauauuuacaauuguuauaucucuugcugaauugaccccuuugucauauaaugaccuucuuugucucuuaccauaguuuuugucuugaaggcuauuuugucugauauaagcauagcuccuccugcucuuuuugguuucuauuuucaugcaacaucuucuuccauaucucuuuauuuuuagucuaugugugucuuuauauuauaggcgaaguguguucuugcaggcaacagaucauugcagcuaguuuuauuuauccauucagccacucuacaucuuucgauuagaguuuaguccauuuacauucaauguuauuauugaugaauaggauuuacuccugcuauuuuguuauuuguuuucugguuguuuuguagucuucucuuucuucuuucauuccuuccugucuuccuuuuaaugaaggugauuuucucaagugauauguuuuuauugcuugcuuuuuuauuuuuucuagaucuguuuuaaguuuuugcuuugaguguacugugaggcuugcaaauaacaucuuguaacccauuauauuaaacagaugacaacacugauugcauaaacaauuaaacuaauaaaaacacuauacuuuucauaccccugcuuuuuaacuuuuuguuguuucuguuuauaucauacuaucuaugucuugaaaaguugugguuauuauuuuugauagauucauuguuuagucuuuccacucaagauaugaguaguuuacauacuacaauaguguuaugauauucuuuauuuuucuguguacuuacuauuaccaguaaguuuucuacuuucagauaguuuuuuauuacucauuaacauccuuuucuuucagauugaagaaagaauccuuuagcauuucuugcaggauaguucugguguuuuguuugucugggaaagucuuuauuucuccuaaauauacauguuugaaggauauuuucacuggauauacuauuguagguuagaagauuuuuuuuccuugaguacuuuaaauauguaauaucacucucuccuggcuuguaagauuuccacugaaacaucugcugccauacauuuuggagaucuuuguuauuucuuuucucuugcugcuuuuaggauccuuucuuuaucuuugaccuuugggaguucauuaaaugccaugagauagucuuauuuggguuaaaucugcuuaguguucuauuaccuuccuguacuuaaauauugauaucuuucucuagguuuuggaaguuuucuguuaucccuuugaauuaacuuuucucucucucucucugccuccucuuuaaggccaauaacucuuagauugcccuuuugaggcuauuuuguagauucugcaggcaugcuucauuguuuuguauucuuuucucuuuugucuccucugacuguguauuuucaaacagcuugucuucaagcucacuaauucuuuguuuugcuuauuucugcuauuaacagacucugaugcauucuucaguaggccagcugcauuuuucagcuccagaaucucugcuugauucuuuauaucucccucucuucauuagauuugucuaauacaacucugaacuccuucucuguguuaucuuggauuccacugagcuucuucaaaacagcuauuuugaauucccuuucugaaagcucacauaucucucucucucuccaggauuggcuacaggugacuuaguuuggugaggucauguuuuucuggaaggucuugaugcuuuggguguuugucagugucuggguuuugaagaguuagguauucacuguagucuuuucagucugggcuuguuucugccuauccuugggaaggcuuuccagguauuugaagggacauggguguagucaucuaaguuuuuggucacuuuacccguuucuacuuuaggggugccccaagcccaauaacacuguggcuauugcaggcuuguacagauaccaccgugguggucuuggguaacuuccagaagaauucccuggauuaccaggcagagacucuuguucucaucccuuacuucccuccaaacagaugaaaucugucucugucucucugucucucuccccucuccucucucuuucuuucucucucucucucucucucuccagagcugccugaagcugugggaggggugacacaagcacuccuguggccaccgccacugggacuauauugggucagaaaugaagccagccuaacacugggucucacccaaggccuacaacaauuacugccuggcuaccaccuauguuaacucaagucccaaggguucugcaauaaguauaugggaaauccugccaggcuuguguccuucccuucagggcaguaaguucucucuggcucuggucagguccagagauguuuucugggagucacggccuggaguugggaaauuuagaaaucuacuuggugcucuauucuaccgcagcuaagcuggcacccaaaccauaagacaaaguccuuucugcccuucccucuccuuuccucaagcagaggaaucucucugaccaccacugcuccgggcacauggagaguauugccuggcuaccaaugacauucacucgagguccaagggcucuucagugagcuuguggugaaugcugccaguccugagucucucuccucagggaaguugucuuuccucuggcccaggacagguccaggaaugucauucaggagccaaauccugaaaucagagauccuaggagcccacuugauccucugccauacuguggccaaacugguacccaagcggcaagauaaaguccucuuuacuuuucccucucuuuuccucaagcagaagggaucucucccuguagccaccacagcugggaaugugcuguucacaacugaagccagcagggcucugagucucacucaaggccugcagcaaguacugcuuggcuaucacugcugauuauucagggcccagugcucuucgguuagcaggugaugcacucugcaagaacugagucccucccuucauucaaggcagcagguucucuuccagcucaggguauguuuagaaacgcugucuggaagccaaggccuagaacagaggccucaggacucugccuggugcccuaugcuacuauggcugaacuaguauccaaguugcaaaacaauauccucuuuacucucuccucuccucuucugaaacaaagggaagaaggagcugccuggagcugugagcuguguugccuagaguuaguggggagcagcucaagcacucccuucaccagcugauaucuucuuaggucauguguaccccagguccacugguucugagcucaguacaggaccaggacuuuccuugcaguccuuguggccuagacugccuuucaaguuuauuuagaacuucagagcacuuuagccuguggugguggagcuugccggaacucagguucugaccauuggcauggacaauuugccucuggcuagggcuggucuaaaugcucccuccuugggaaccugcugaguucuuccugguguugcuuucuacugugacagggcaacacugaguuacaauacaaagucccacaaucacugcacucuccuucccccaagcacaaagauucuuucuccacgucucauggacugugcaggagaauggcggaauggugacaucaaccauucaagacugucuuuucuacccucuucagugccucuuuccuuaauauacuguuaaaaccagauacugcaaucacccaccuggucuuuuguucuuaugaagguacuuuuuuguauguacaguuguucaauuugguguuucugccggggaacaaccacugcaggcuucaauuuggccaucuugcucugucuucccccugccaccccaccccucucacauucuugaaaugaguaaaaagccuucacgcuaagcauggccauggaaucuucccauguugaacuguaagaugaacagagucauauuucaaauaaagagauuaggcugacaugaaugaucauauuuuuaauaacuuauuaaccuaauugcaugccacaauuacauagugaguuuucaucuuuuaaaucaauuuuggggugagggaugaaauacuaccuauuggguacaauguucacuauucaagugauggguacacuuaaagcccagacaucaccacuacacaauauauccacguaacguaacugcacuaguagcucucagucuacuuuuuuguuaaaaaaaaaaaagagcaaaaacaacagcaagaggaaagauauauauuuaagaaaaaagcauuucaaugaggcaaaaacaacugguucauccuuagguccuuaggcccauuuauuacuucgaacuguaugcccacuuuuuuauuuuauaaagguuugcaugucuucaaacuacaugcccaccuucauuuugcaaaguauuguacaaugcuguauuuuuuuuuuuuuuuuugagacgaagucuugcuuuguugcccaggcuggagugcaguggcgugaucucggcucacugcaagcuccacuucccagguucacgccauucuccugccucagccuaccgaguagcugggacuacaggcaccugccaccucgccgggcuaauuuuuuuguguuuguaguagagacaggguuucaucauguuagccaggauggucucgaucuccugaccucaugauccgcccgucucggccucccaaagggcugggauuacaggcaugagccauguacaaugcuguuuuaaaagcagcgcucgucuuugcugccuuucaacuuuacaugcuuugguuucucauagagaaaauaaaaauuguuuuuaauccuuaaagaacuucugacaggagagaaaaaugacuugugugucccaaagcccccaaucccaaagacaucuaagcaaaaccaaguuggggguggggguggagaauuuaaauagcaguaauuaucguaucucaauuugcaagaaaaacaaaugccucaaauaccauuauucauuuaaguuuucugacaaccugacauuuaucuccuuuagugcuauauuauagaaauguuucuuauuauauucauuuuccagagacugagaacuuuuaaaaccaaugaaaugcaugucccagaguugauccuuugcuuuaaaaaaaaguuugaaaaaggaaaagcuauuauguugauuacaaaccgaagugaguuacaguaaaugaugcaaagaaauuuugacaaauagguauaugcacuugaaagugguacuacucugcucucaagguguugcuguuaagauaugaaccaacgcugaaaacuccauauccacagauagcuggcuucuucgauaaaauucaauucaaaucaaagaguaauuaaagcacuuaauuugcaugagcacuguuccaagauuaacuaaagggcugaggggagcuggagguggggagcucaauuaagaaccuauucaacauauuucaagagagagggacaaucugaauuuaggauauggauguggaaauagaaaggggaaugugagagacauuaucaagagagaauaaauacaaugugaagagacaaccugggagaagggagaaaaauauugccaggcuuaaaauacaugacaaugaaaaggccauuaaccaauagggcuaacuacaaagguggugcuuugguggcaaaaaauuuucuuuggaaauacugauuugagguacuugcacaugaaaacuuaaccucagcugggcgcaguggcucacgccuguaauccuagcacuuugggaggcaaagguugguagauugccucagcucaggaguucgagaccagccugggcaacacagugaaaccccgucucuacuaaaauacaauaaaaauuagccaggcguggcagcaugcaccuguauagucccagcuacucaggaggccgaggcaggagaauuacuugaacccgggaggaggagguugcagugagcugagaucacgccauugcacucuggccugggugacagagcgagacuccauuuccaaaaaaaaaagaaaaaaagaaaaccuaaccucacagagaauuguaccuggagauguaugggggaaagacacauuauuuuggaaacauuuaaagaaccucauacucagaacuagaaaaaaagacaucuucauaaauucugaugcauuuuucauccuaauaccagcagugacacaaucaggacagggaaugugucugcuuacccagcaaucaaggaagaugaaggagaugaagcagacagagggcagggagggucaacccugacugcaccagcaccaaaggcuagaguuucuucugguauagcaaagccuaaauaauuuucuucauuaagcuuauuuuuucauccaugggaaaaggaacauguguucauauuacauuaacuugaaaaauucagaauuaaugaaaaaauaagccucagaaucuuaaaucaacugaauauagcaacagagaauagaugaagccccaaagggcuucugucacacucauauauaauaaaaacaccagucauguuuacaguucaauuuuauagagcuaaauugaugaguaguuuuggaguguucuagaaauucuacaauauucauuuuuuauugcaguuuuugaauuuauuaauaauuaggcaagaaaucauuaacuacauuuucaaaacaguagaaguaaagcuuaggaggcucauuuucacaaauguauuauuuucaacacaauacaauuuuuuuuuuuuuugagauggaguuucgcucuuaucacccaggcuggagugcaguggcacaaucucggcucaccacaaccucugccucccggguucaagagauucuccugccucagccucccgaguagcugggauuacaggcgccugccaccacacccagcuacuuuuguauuuuuaguagagacgagguuucuccauguugcucaggcuguucucaaacuccugaccuaaccugaucugcccaccucagccucucagagugcugggauuacaggcgugagccaccgcaccuggccaacacaauacaauuccaauuuuuaaauaguacuacuuaaaucacaaauacaacugacuguuauuaauacaaugaaccagguugaguuaucugccauuacuuacuuuagaacuuagcucaugucagaaauauacaaaauacuccuuugauauaaacagauagcuugggggaaaacgaaaaacucuuauuagaauuacuacuaguugcuguagcaacugucgaaguguuuuacuaugugccaggcacugggccagagacucuuuguucaucucuuuaaucuucacuacauuucuauaaaguagguaucuugagauguccauuguacugaaaaggagacaaagcaaagguuaggggaguuaaguaacucaguaacuuaaauguuuuucucccuuagcugaaaugaugcaugccacagguuugaaaaacauucuuucccuauucaaucauuuauuuaagugauaaacauuaaucucaacauaaacagaaaauagauugaauacugugauuauuacuuugaaaccaaagcuccaucuuuagagaaacucauacuggcaaagcaaacaaggacugaugaauuggaggugcacuugugcgcuuaaaacugcagcagcugauguaggcacuggaggggcuacaacccagggacccagguaguuugcagaaauucacaaggugcaggguaucaguuuugucaucacuuugauaccugucaacuucaugggccugggccaaucagccaacuugcucaaaccucacguuucuuucauguaaauacagguuaagcaccccuacaccaaauacccaauaucugaaaugcucccaaaucugacacuucuugagugcugagcugacgccacaaguggaaaauuccaccccugaccucaugugaugggucauaaucaaaaugcaguugcauaacacaguuuauuaagagucuccaaggggaaaaaggcccuuccaguccccuucagcguaucuuuuccacucaugcccagauuucccuacacaagcaugccacaaaguauuguguauuaugugggaaauaacacacagggaacuuggcacaagaacuggcauacaauucccgaaauaguagagcugucaucaucauuacugguuuuuauaguaacugugaccccaaagaguuaauagaagugagauaguagaaaaacugauggcugugcagucacagaaaucuuccaagucuacaucucucauugaggagauaugcaccauuugcaaaguuauuuaacguaccugagccucagugucccugaguguaaaauauaaauaaaaauauuucccugguaugagacagaaaaauagagcuaaugugucaaaaguaccacauggagagacuggaacacaggaaguuccuauuacuguuaguaugaaggcgcuuuaagaacucaaacuaggcaacagguacaggccacagggggaauaaacgcaaacguccaguuaaaaccaaauccagacauaagagaaacuuuauuugaaaaaguaacugcuauaaggggagugagacuacugcaauagggagagcucuggucaugagaugugcaaguagcucaacgauugggcagaaaggaauuuucuuuuauagggagggguaagcaaggcuagaaagaucagcugggagcacugacuagggaaagcuucuccugaaggucagcugguucucaggagggguauucaaggagaggcugcucugcaucccaaugcugaaggcauggucaaaguucaagggccuagggagcgagacacaccugacugaaguuugguugauuauuugggcacuggguauaaacaaaucagcugaccauuuauaaggcgcagaacgggaaugugaaaacucagcuucuggccuugucggagguacuuaagugagcaucauuuggucucguccuggacacccggggaaggauuuuuuuuuuuuuuaagaagccuuuuccagaagacaaagggugggggauuucuucaccuagugcuauuuuccaaaauacuuggcucagguaaagcucaacauuaccauaaacagaacaaacuauauauauauauauguaugguuuguauauguuuaaguacguauauacaguuucguuuacaugcauaugcugaauauaguucaguacuuuuaagcaaaguauuauaauaucauauucaaacaaucaccaccuuuuuuuccuacaaaaauaagcaaugaauuaaaagcaagucugucauuaacccacggugaggaaggaggaacaauuuuaacuaccugaggucuucaaaauggauuuuuuuuuuucaguucuuauucuaaugcaauuuccuggucagaaucuuuuuauacauaaccuugaauauaacaaaaaccaggaaaauggcuuguacacaaaaugaaggcuacuaagagcaugagaaaauauuucauucuuuuccuuugaucaucuacuuuucuuuugagagagaugcagagagaggauuugaguguuuaugccugccuuuggauuucuuuugcuggguuuucuauuaagucuucucugacaucauuacuagcuuaugcauacugaauguguacucucuugccaggcaucacacuaaccacacuauguaauaauuucuauagaucuccacacagcucagugagaacagugcuacuguuaaaaaguuucauauuaaugucugcauuuuagaucuacugcaaauaaucacauauuauuuuucugguagaugaauuucaugccaaaagauuaacuuaaccuuuuauauacauauguaaacaaucgguauaggcauguagauauaaacauguauagaacacaaacuugcauuugucucaggaaucagguagagaccauaguaaacauuuuuaucuuggaaggagggcagagagcucaucaucaucaauucagaaccuauaaugauuuuacccaaacuucucuaauaugauagggagcaacacuuuuucacccuguucauaguacgaaugaaaggugaauuaucuuggucuaguuugaguucugcuugcucaccccuggaaggagaaagugcauaccauagagaagcguggagauucuuugcuggguaauaggaaauuggucuucacagcagaaaauaauaauugcaacaaaaguacuaacaaaaauaauaacaacaauuagagcaacaauaaaaacuacagcauugacauacugauugcucauaauaugccaggcacuggauaagcgcccuauuucacuaccaaacauaauucuuccaauaaucagcaguaaccuuaugcaucccacuuacagaugaagaaaugagacaaaggaaguucacacagcuaccaaaauugggaaccaggaauuaaccucaggcagugugacugcacagccagggcccuuccaaacaauugguuaacuaaccugggucuuuugcuggccaauguaucggggaauaauccuagccaacaaauucaagggaaacggaaucaagcaaauaugaaugaacuucauuuacugaaaacaaaguaggcuuugauaggacuguguuaccaucucuagaccuaacuaugauuaugucauuucuuagugccucuugcggcaaagaaagugcacuuuacauaaaaaaacaauagaaugcaucuggcagaaguaugagaagaguaacgaucauggugaugguggugaugaugaugaugaugacagcuucaagagcagcaggguaaggaugccacuaaaaucaccaccauuuaugugccaggcauuaugauacagucauuacauauaaccuuuuucucccacuauauugcaugcugcuucacuuaccuuguaaaacauuuuagacauaaaaggugcuccauuuuuuugcacaaaugaacaaauacaugaaauaaaaguauguugaaggcacagaaaaaguauucauaaaagacaaacucaaaauucccaaugacacagagaguauaaucacaccacauaucaaauccaagccacauagcacagagugugcuauugaaaugaaacgcaauauaacuauugcucugggaauuacagaugggauccaguaaaagacacuguauuaauuauauuguuuuccauggaacuuuucuaagguugcccaggacagcaacacuguagaacauucaugaugaaacugucaaagaggacuagacuugaggggccuuagggagaaaagagauuugaaaauaauguacugcuugcccaugguucagacgugccuuucucugcaaguaugaucacauuauugauucucaaaggaagaaagaaaauaugacuuugucccuuaacugacaucaaaguuacaguguuaugcagugaugcccaaaagcauuugcaaauauucagaaacaaaguuuugaguguccuaggagaugacuaucauaccaauugauccaaaacacaauggucaagaggcauggaaaaccuaugguuggggagggagaggaagggucauaaauauauacagucaugcaccacguaaugacauuuuagucaauuuacuggauauaugauggugguccuauaagauuauaauguaucuggaaaauuccuauugcuuagugacauccuagcugucuuaaugacauagcacaagacauuacuuauguguuugcagugaugcugguauaaaugaaccugugcugccagucauauaaaaguauugcauauuagguacagcagggguccccaacccccuggcugcagaucagugcccaucuguggccuguuaguacagugggaggugagcagugggugagugagcauuacugccugagcucuaccuccugucagaucagagucgguauuagauucugauagaagcaugaacccuauugugaauugcacaugcgagggaucuagguugcaugcuccuuaugagaaucuaacuaaugccugaauaucugagguaaaacaguuucauuccaaaacuguccaucccccaugaccccugucuguugaauaauugucuuccaugaaaccagucccuggugccaaaaagguugggggcuacugacguaaaguacauaauacuugauaaugauaauacguggcuauacugguugauguuguauuaguccauuuucacaaugcaauaaagauauuaccagagacuggguacuuuaugaagagaagaggcuuaauugacucacaguuccacaugguuggggaggccucaggaaacuuacaaucacggcagaaggcaaagagaaagcaagguaugucucccacaguggcaggagagaaagagagagaaaaccagcaggggagaguccggagacuuaucaaauaaccacaucucaugagaacucccucacuaucaugagaacagcaugggggaaacugauccaaucaccucucuccaggucucucccucaacaucuggggauuacaauucaagaggagauuugaauggcaagacagccaaaccaaaucauuccagugcuggucccucucaaaucucauguccuuugcacauuucaaaaggcaaucaugccuucccaacaguuccccaaagucuuaacucauucuagcauuaacacaaaaguucacauccaaaaucucaucuaagacaaggcaagucccuuccacuuaggaaccuguaaacucaaaaacaaguuaguuacuuacaagauacaauggggauauacaggcauuggguaaauguucccauuacaaaugagagaaauuggccaaaacuaaggggacacaggucccaugcaaauccgaaacccagugaggcagucauuaaaucuuaaagcuccaaaaugaucuccucugacuccauggaucaaauccagggcaugcucaugcaggaagagggaucccagggccuugggcagcucuaccucucugacucugcaggguacaccccucucccccaacuccccaacggcugcuuucacagcugucguugagugucuuuggcuuuuccaggugcacagugcaagcuguugguggaucuaccauucuggggucuagaggaugguggcccucuucucacagcuccacuaggcagugccccaguggggacucuguguggggacucuguuugggggugccaaccccacauuuccccuuuguacugcccuagcagagguuuuccaugagggcucugccccugcaguagaauuccgccuggacauccaggcauuuccauacauccuuuuauaucuagguggaaauucccaaagaguuccacaagacuagagaaaaaagaaugaagaggagugaacaaaaccuccaagaaauaugggacuucauaaaaagacugaaucuacaacugauuggaguaccugaaggggaugggaagaacggaaacaagcuggaaaacacacuucaggauauuauccaggagagcuuccccaaccuagcaagacagaccaacaugcaaauucagaaaauucagagaacaccacuaagauacuccagaagaagagcaaccccaagacacauaaucaucagauucuccaagguugaaaugaaggaaagaauguuaagggcagccagagagaaaggccaggucaccaacaaagggaaucccaugagacuaacaguggaccucucagcagaaacucuacaugccagaagagacugggggccaauauucagcauucuuaaagagaagaauuuucaacccagaauuucauauccagccaaacuaaacuucauaagcauaagagaaauaaaauccuuuccagacaagcaaaugcugagggauuucaucaccaccaggccugccuugcaugagauucugaaagaagcacuaaauaaggaaaggagaaacaaguaccagcugcugcaaaaacacaccaaaauauaaagaacaauggcacuaugaagaaauugcaucaaauaguaugcaaaauaacuagauagcaucaucaugacaggaucaaauucacacauaacaauacgaaccuuaaauguaaauggguuaaaugcgccaauuaaaagacacagacuggcaaauuggauaaagagucaagacccaucagugugcuguguucaggagacccaucucacacacaaagacacaaauagacucaaaauaaaggaauggaggaaaauuuaccaagcaaauagaaagcaaaagaaagcagagcuugcaguccuagucucugacaaaacaaacuuuaaaccaacaaagaucaaaaaagacaaagaagguuauuacauaaugguaaagggaacaauugaacaaggagagcuaaguauucuaaauauguaugcaaccaauacagaagcacugagauucauaaaacaaguucuuacagaccuacaaagagacuuagacucccacacaauaauagugggagacuuuaacaccauacuguuaauauuagaucaacaagacagaaaauuaaugaggauauucaggacauaaacucagcucuggagggcucuggaucaagcggaccuaauagacagcuacagaacucccuaccccaacgcaacagaauacacauucuucucaguuccacguggcauuauucuaaaaucgaccacauaauuugaaguaaaacacuccucagcaaaugcaaaagaacugaaaucauaacagucucuaggaccacagugcaaucaaauuagaacucaugauuaagaaacucacucaaaaccacacaauuacauggaaauugaacaacaugauccugagugaauccuggguaaauaauggaauuaaggcggaaaucaagaaguucuuugaaaccaaugagaacaaagagacaacauaucagaaucuccgggacacagagugucccaguguuaagaggaaaauuuguagcacuaaaugcucacaucagaaagcuagaaagaucucaaaucaacacccuaacaucacaauuaaaagagcuagagaggcaagagaaaaaaauccaaaagccagcagaagacaagaaauaacuaagaucagagcagaacugaaggagauagagacacaaaaaacccuccaaaaauaaaauaaaugaagacaagagcugguuuucuugaaaaaaauaaaaaauagacagcaagcuagauuaauaaagaagaaaagagagaagaaucaaauacacacaauaaaaaaaugauaauagggauaucaccacugacaccacagaaauacaaacuaccauaagugaauacuauaaacaccucuaugcaaacaaacuagaaaaucuagaagaaauggauaaauucugggacacauacccccucccaagacuaaaccaggaaggaguugaauccuugaacagaccaauaauaaguucugaaauugaggcaguaauuaacagucuacugaccaaaaaaagcccaaggccacauggauucacagccaaauucuaccagagguacaaagaggaacuggugucauuccuucugaaacuauuccaaacaguugaaaagcagggacuccucccuaagucauuuuaugaagccagcaucacccugaugccaaaaccaggaggagacacagugaaaaaagaaacuguaggccaauaucccugaugagcaucaaugcgaaaauccucuguaaaauacuggcaaaccaaaucuagcagcacaucaaaaaacuuauccaccacgaucaagucagcuucauuccugggauucaauggugguucaacauacgcaacucaauaaacguaaucuaucacauaaacagaaccaaagacaaaaaccacaugauuaucucaauagaugcagaaaaagccuuugauaauauucaacaucccuucguguuaaaaacugucaauaaaguagguuuugaugggacauaucucaaaauaauaagagcuacuuaugaaaaacccauagcuaauaucauauugaauggguaaaaccuggaagcauucucuuuaaaaacugauacaaacaaggacacccucucucaccacuccuauucaacauaguauugaaaguucuggccagggcaaucaggcaagagaaagaaauaaagaguauucgcauaggaagagaggaaguuaaauugucucuguuuagagauuacaugauuuuauuuuuagaaaaccccaucaucucagcccccaaacuccuuaaacugauaagcaauuucaguaaagucucaggauacaaaaucaaugugcaaaaaucacaagcauuccuuuacaccaacaauagacaagcagagagccaaaucaugaaugaacucccauucacaauugcuacaaagagaauaaauaccuaggaaaacagcuaacaggggaugugaaggaccucuucaaggagaacuacaaaccacugcucaaggaaauaagagaaaacaaauuggacaaccuuccauccucauggauagaaggaaucaguaucaugaaaauggccauacugcccaaaguaauuuacagauucaauguuauucucaaacuacuauugacaucccucacaaaauuagaaaacacuacuuuaaauuucauauggaaucuaugaagaccucuguauagccaagacaauccuaagcaaaaagaauaaagcuggagguaucaggcuaccuggcuucaaacuauacuacaaggcuacaguaaccaaaacagcaugguacugguaucaaaacagagauauagaccaauggaacagaacagaggccucagaaauaaaaccacucaucuauaaccaucugaucuucaacaaaccugacaaaaacaagcaauggggaaaggauuucuuauucaauaaaugguucugggaaaacuggcuagccauaugcagaaaacugaaacuggaccccuuccuuacaccuuauacaaaaauuaacucaagauggauuaaagacuuaaauguaaaacccaaaacuauaaaaaccguagaacaaaaccuaggcaauaccauugggcaaagacuucaugacgaaaaugccaaaagcaauugcaacaaaggucaaaauugacaaaugggaucuaacuaaacuaaagagcuucuguacagcuaaagaaacuaucaucagagugaacaggcaaucuacagaaugggagaaaauuuuugcaaucuacgcaucugacaaaugucuaauauccagaacuuacaaggaacuuaaacaaauuuacaagaaaaaaacaaccccaucaaaaagugggcaaaggauaugaacagacauuucuuaaaaggagacauuuacauaaccaacaaacauaugaaaaaaagcucaacaucacugaucaucagagaaaugcaaaucaaaaccauaaugagauaccaucugaagucagucagaauggugaguacugaaaaaccaagaaacaacagaugcuggugaggcuguggagaaauuagaaugcuuuuacacuguuggugggaauguaaauuaauucaaccucugugggaagacaguauagugauuccucaaggaucuagaacagaaauaccacuugacccagcaaucccauuaccagguauaugcccaaaagaauauaaaucauucuacuauaaagacacaugcacacuuauguuuagugcagcgucauuuacaauagcaaagacucagaaccaacucaaaugcccaucaaugauagacuggauaaagaaaacguggugcauauacaccauggaauacuaugcagacauauaaaggaaugagaucauguccuuugcagggacauggaagaagcuggaagccaucauccucagcaaacuaacaaagaacagaaaaccaaacaccacauguucucacucauaagugggagcugaacaaugagaauacauggacacagggaggggaacaacacacaccaaggccuguuggggguggggggcaaggggagggaacuuagacaacaggucaauaggugcagcaaaccaccauggcacacguauaccuauguaacaaaccugcauguucugcacguguauccuggaaucuaaaguaaaauuuuuuuuaaauaaagaaauggacaacucucuagaaucaaacaccuugaaauuccuugaauaauuaaggacccacggauuguucaucuuuucauauacagaccccaaccuauaauuacuaauuacuaauugcagugagaucagagaaaaaauaaaugaaaagucuacuuuggagucaaagauaugguuauuucaaagaacaguuucccuaucaauagucauuugucuaagacuauauugaucagcaugaaguggcacauuauagaagacacuucugcacaccuguuacagaaaagccuccucacaaugccuauuucuacuaacuaaucuaugcuguccacucuaauaggaacugaaaaagacaccauuuccucaauuugauagaggauacaguaaauauuuacacaacacuuaaaaugagagaguauauaaacaauaauagaaaacagguaauucagggcuagaauuuccaauaaaaaauuuuauuuuguuuuuguuuuuuaauuagaggaagagaaagaucaagccauaugucagauguacuucauucuuuuuucacaaaagcauuaucuagucauaaaauagaggaucacaaaaagagcugaacugaucauaaaaagucuguauuuccugugcacuacaaacaaccauaaucccuugaacaauuccccaaagcuccuaacaucaaacauuaaucagucaguuuaggauccaucagcaaauuuaggauaccuccaaaggggccugacagguuaggcaaagaaagcauugcauaccaucaguucuuucacugauagcuaaagaucuauaggucagagaagggcaggcucugaugucuccuccauuaauuauugaagguaauauuccagaugcuaguaaaucuuaauaacuucaaauaucagcuucaaagauguacuuuugaugaacaaagccaaaacacuucuccuuaucaaaaagacauguuauaaugcauauuuuaucuuucaacggauauccucucaccaauaaacgugaucuuugauccaaaaauucuuaguaaugccacuaaaauuucucaaaacaaagucaguuuaaacgugcuucaguuaaaaccacugcccuauugcucuaaaagaaacauuacaaaaugcaacuacagacugucaauuuuucaacaacuuugggagugacuguuuagacacugucaaaugauuucuaagcaacccugccacaagcagacuggcuugcuauaaacacaagguguaggauacauaagaacuaauauuuguuaaggaauuucugugugccagacucuuggcugaucucuuuggguuugauugaaucgaauagucaucacaaucugcagaaagguuuggugacuugaucgcaagaaccuggcuaguaagggacugaguaagagacuucacuaggcaaguuaaagugcugcucuacacucccauugcugucucuguacccagcacgugggcacaaauguaagagccucgugaaggaaagcauaagcaagaacacacugagcagcucuaggaagcuccuuaagguagaaugagaaacuuacucaggcaggcuccugcaguugcacaauuaucauucuucuuaagugugauuacugcucaaagucagaaacaucaaauguggaaauauuauccaaguaggggauccauccaugaaagcaacaauugagagacuucuacauucugcucuacgacaccuggaaggcucaucuccgaagucacauucuuucaagaugguuugaacaaaaugcagaucuuuggugcagcaauuaauagguacaguuauguauacuucaacaggcugaauguaaucuaucuugaacuugccuuucaauuacuccgugcuuggagcuuccugcagugccugacuaucucaaaguugcuaacgcagggaaauaagccuaucagaaauucaaaacacuucaucaucacauuuuaaucauacaaaauaguaaguccugaguuuagcucauuccuugacaagucagagaugaugaagucuuuaaugcucaccuauuuauacagcaaucuuuccuccuaauuccgucuauccuauucuguuaucucaaagauauaaccaggugacagaguucaaguucauuaccaagagaauguauuucuccagccaaagcaaauagaauuucgaugaaacuucuaaguaccuguuauaaaugccaaguauuaaagguucuuuauucagcuauuuacaagaccaucugugaagccaacauucugugauccaaaugcagauguucuaugaaggaaggcaaggcuaaaaaagaaaauccugacaaggcccgugcagcuacuuaaagcauaaagggaagugcaauggucuuacgauuuaaauauaaaccuuuguuaaaugaugaggaaaccacagcagcagggaccugcuaaacaaucacucgacuccugugauugagcuaaaagauuauauuugagaugcucgguccaucgacauauuuacugagccccuguuauguuccuaguguguuccaggcaccauagcauuauuguaggccuggcucauguaugcugugauuugguguuuaccuucgauucugaaguuuagaaaaccucuuaacagggcuucaagauacuuuucucuuguaucugauuccaaguaacccuguauuuacucaaccaacagucacuguaggacuauucagaagucauguuaaguaaaagguggguuaccuagaagcugacagugucacuggagcggggucuugaggaucuagacauugguucugugguugcuuagaaaggucugggggccaugagggagggccuaugacagcaggguaggggauauucucagagcaauagcuauguacaauagaaauauuucaaucuuuuaauuaccagugugacuaaacagaaccucagcaguccuauguugccuaguauacauaaauauuuaaguccaagcccuauauucaggcagcucuccagcuaaauaauaugcuauagaauuaucuaacuuucucuaucaaguucaauagauugagagaaagaccaguuaucuaacagccagaaggaaaaucaagauaaaaacuugguguuaaguuuuuauguaaaacaugaaacuauaauauuuugcugaauaauuucaaugacugcaaaugaacaaaaucuauuccaccuuuuggaaucccuuuucaguuuuaauucauauauuccacacuuucugcuacagagauuuccaucaugggucaaggauugaaccagaugauguccaaugaguugggauuuccaagagagaccaugagcagugcuaaaaaguagacauuuugucacaauauuuaauaaauagcauucauuagaaaaauauuaucccccuuuaagcaaauacuauuauuauuucucucuauaauagaaacagaguucuaacauaauaguaccuauucguuuuacucagaggcaucaauccuaauuggaaauuuuuaaaaauccagcucaaguugcaauucacagagguggcaaaucuccuuuagagggcacagaaauguacauaugaucucauuuuaaaauguguguguauacuuuuuauuucugagaaagcaacaaaauccuggcuuccaauaauguccaacuuaauggagcauaacuuaaacuccuuuuaacaaaguuuaaauuuuuaaaagcccacugaauuaaagacaucaugacuaagaccaagcuggagugcucuagaaucuagcuuacaacuguuuggccuaaggagccuauagcauugacccugcauacauuaaagccaccugugcucaaguccacuuaucacucacaccugcuuacaccaugcuacugcucacuacaauaccaauaagaacaucugccugcuuuagauaaagauucucugcacaucuaaauuagaauaacaaguuuuugaacuauuauugcaaaagaaacagcagucaaugugguaauuuuuggggaucucugccuagguuucauuaggcucacccuaaugucuuuuucaguuuuggcaggagggccugugccuguuuucauagccaaaagacugccauacucacaaauggccaaaaaguaugaagaaauccuucaaguuucccaggcacugaacaggaggcuccaaaccaagucaucugcuuggaguuuuuauuacuccaaguucuguuauaaacuguaccucagugcucuucauguacgacaugacaggcaggaaaucauccuuacagcuuucacauuuaacaaggcuacuuuugaccaaaaugagcaaugaauuucaaaauacagggacauggcaaagugcuguaacucggaauuaaacaaaucaacaccaagaaacaauauucuacuagcaauucgguaaucacaggcaaagaugauaaauauccauaauguuuuuauaagccacaaacaugguuuaaucuaaucuuacacuguuuguguuuauaaagccaagacaagggugaucaucuaauauuuucauaacaucuaguagaagguaguuaaaaagauguuacauuagacaucguuacugcuucaaaauaaacucucaccuuaguuaacaaaauguguuauggguucugugcacaucuguuauagguaccacagagacacuauagcuacugaacucguaugugugcuagacauuccauuuugcuuuuuaaaaaauauauaacaaccuauuauuuauuuaccauaauuaucuccauuuuacaaaagugagaaggcuuaaauuuauuuuccccaauccaaaacuguaacuacuccagcccaggugucucuuuuaaaccucuugcuccgucuccacagacuucaacauggaggaaauucaggggauaaacuauauccaaagcagccucaaagauucaggcaguaauuucauuaucaugucuuacuugauuuguaccaaaaaaaaaaaaaaaagauuagauuucaguuucacgucuucugucucuuacuaauucagguacuaaaaacaguugguauuuacugagugcuuauuuugcucuaagcccuucacaugauuuaacaaauucccaaaacaacccuacaggguagauaguagcaucaugcuacuuugcaggugaggauacagguauaaagauguuaaguaacuugcacagguagccaauuugggccccuaacuaaggcagucuggucgaugcuuugaccuuugugcuaccuuuccucuaccucugaagacaaaagguaauugcaaaauaaaaguaugauaugcugagaagcaaauaaacuagaucugguaacccaaaaaguauauguugcacucaagcccuccuugcaguaccaaacccacaaaaccaaauggugcugaguugugcauuagaaacagguuaaaagaccuauuaaauaagcucagaucugaaagguaaacaauaagcuacugaaauaugauuuuuauuaagcaauagcaaacaagucuauuuacauuucaagaaagaaauggcaauaauucauuagcaagacaaaauagagucaaccaaaccgauguaguuucucucuccacacacccacucccuuacacacauacuagcagcccuaugaaaaacaggguuauaauagaaaugcugacacaaccaaccuuauaauguuucauacgaaaagcuacaauuauauuuucuaauuguaaacugggugaaaaaaaaaaggccaaccagaacaaaaacauaauaacuaccuagaaacaguccaucagaauucuuggauuaugaaaaaugcauauaaaacacuauuaucuucagccacagccagaagaugucagacaaucaauucauauaacaugccagcuuaauaaaaucugcauacaaaauuuaugaaugcaguaauauuccuuuauaucacaaguuauuaauggucaauuuaaugaacaucuacagcuggagugcuuucguucuguaugauauuuuaaucauuuuuagccauggauuuaaacgcauuucauuuuauaaccaucagcuagugaagauaagaaaaccuuuacacaaauaacugaaauauuugggguaggccaccaauuuugucuuuauguuguuauuuauuuccuuaaauuuuuuuuuacaacagaaacacaaugaaauguuccauuauaacaauauuugauuuaauauuuguauuuagaauaugaaaaguuugcuuaaaguagcauuacauguuuggcuagcauaaaaucuuccauuucauuucaaauaaagaacuuucuaaccucguuuaugugaaacaaucucgcucagagcuauuauccuccaaaaacuauccugguggaauguugacaucucggacauaaauauucuugaaaauuaauguguuguauuucuuaaguauccuauuuccacucacuuguucacauaaucuuuaaaaauccuauuguguucaagucuacuuuucccacagauucuuuacuaaaacuaaauuuuacuauaugaugcuuauguggaaggaacaggcaacauaacugcaagacaacaguagcuaucugaaaauacaaacauucagcauuuaaaauauugaugucuuucuguggucacaaagucaaauaauuguuucucacauuugagcauuagaauuugguauuuaaaauuacacucauccuucagaguuaauugaaagauuuggauauauaggaaaaagguuaagaaaucuaggucauaaauacuucuuaaggugcaagaauuggcuucauaaacuaguaaaugugcaauaaucacuauuaaagaaugaaagauggcauuuuuuuuuuuuuuuugagauggagucucacucuguugcccaggcuggagugcaauggugugaucucggcucacugcaaccgccaccucccagguucaagcgauucgccugccucagucucccaaguaauugagauuacaggcgcccaccaucaugccuggcuaauuuuuguauuuuuaguagagacgggguuucuccauguuggucaggcuggucuugaacuccugaccucaggugauccacccgccucucucccaaugacagcaauuuuuuaguuugacugucuauagccuuauaggacauuacaggugaaaaucaguaaaagccaugugcacaaaagauuuagugcauucaugugucuuuauucauucacucuaucuucuguugcuucacugguuccuuuugggcuuccuacuaugugccaguuaaucuuuauuugcucugggcgaguaacucccauucuuaaagaccuaauaaaacaggacacaguacauguauacccacuaauuauaaaacagcguagaauugauggauaagugccaaggagaaauacaaaucaagaauucagagaaaaugguucuuacuugucgagaaaagggcaagggaagacuuuauaaaggucaacuggaauuuagaggaguaaaagaaauaaggguauuuuuggguaaagggcacaacaugaaauugacuuaaggacaauacacacaaggacaaaaagugccuaugacgugaguuuuaaguuuaaaauacagacuuucaacaaugcuuaaaucuguagaugguaggcauuuuccaaauuccucuaauaaguagaaucagccuauauccaaggaagaucauaacucauuaaauuucauuuuaaccuuccugaaucugccuaaauuuucucaucuuaucaggcaagccaauauaugcuuacacugugagguuaaagaaaugaaccugugaagagaaccugucaaaucaaauuaucaacaagcaauagucccacuauuggggaauauauaagcugcaaugucaauuuuaaagaagugugcuuacauuugcauuuuaauuaggucacaccuucaacaucaugauauuaauuucaguuuaaugcucuauuuuauugccauuuccaaaaugacauuuuuagacauggacauaaagaaaaaaaucucuacuuuuguuuugacaacccauaaauauugcaaauugaaacaauguugaacaaaguucaauauuuggaauauucaaacgagagauacgacugugucuaaaauucuaaauacuuagaauuggauuucaaaaauauuccaagggaaaauuauuagauucucauuuaagagcauaauggaguguugaauggaacauaaaauucagguuccugugagucaccagaagcuaaauaugaauagcucagaaaaaaucauuuugguuaagacuuugcauuagaauugagacaugcuuuguaguuuuuucagaucaagagggagguagacaaauuacagaauguaucuuuguccauuaauaaaugacauauacucaaauacauaaaguuguaauaacauucacauaacaaaauucaucaaucauuuuaaaguguaaaauucaguggcauuuuguacauucacaaugucaugcaacuuucaccauaucuguuuccagaauguuuucaucaucccaaaagaaaacucuguggccauuacagccauucuacauuccccacuacccacuccuaaccccugguaccacuaaucugcuaccucuaugacuuugccaauucuggauauuucacauaaauuguaucacauaauaugcgacuuuuaguguauaguuuuaauuuuuauuuuuguagguacauaguuguauauauuuaugggguacaugacauguuuugauacagacaugcaauguguaauaaucacaucauguaaaaugggguauccauccccucaagcauuuauccuuuguguuacaaacaaucaaauuauacucuuaguuauuucaaaauguacaauuaaaucauuauugacuacagucacuccguugcgcuaucaaauacuaggucuuauucauguuuucuauuuuuuuguacucauuaaccauacccacaccucccugcccaccaccugucaacuauccuucccagcuucugguaauacuccuucuacuuacuaccucuauuaguugaauuguuucgauuuuuagauccuacaaauaagugagaacauacaguauuugucuuucuaggccugacuuauuucacuucgcagaaugaccuccaguuccauucauguuguugcaaaugacaugaucucauucuuuuuuguggauaaauaguacuccauugugauuaaguaccacauuuuuuaaauccauuccucugccgauggacacuuagguugcuuccaaaucuugacuauugugaacagugcugcaacaaacacgggagcgcagaucgcucugugauauacugacuuccuuuggguauauauccaacagugggaugucuggacuguguguuagcucuacuuuuaguuuucugaguaaccuccaaacuguucuccuuaguggcuguacuaauuuacauucccaccaacaggguacaaggguucccuuuucucuacauccccgccagcauuuguuacugucugucuuuuggauauaagccauuuuaacuggagugagaugauaucucguuguaguucugauuugcauuucuuugaugaugaaggauguugagcaccuuuucauaugccuguuagcuauuuuuaguguaugguuucuuucauaagcaaaugcuucaaguacauucuaacaaauacauucucuaauucuucuuuaagggaauacucuuaaagaagaaauggucaaguacuucauuucccaacuguuuucuauuuuucuuuucccaaaacuauuccaaaaaguuuauggggcuuuguguuuauuguuuaugagguaaacaaauaugaguuuuuacucccagauuuuuccaaauuaaaaaggcagugacaaauauccauuuaaauuaaaaauccaagccauuauugacauuggaacuugauucuacauaugcauuaaaaaaaagaccuaacagggggaaaccuacauuguguucauaacuggggauauccaacagcaucaguaugucaaauuuccauaaaugaauccauguauucaaugccauuccuuuaaaaaauuucacggccuuuucccacagaauuugacaagacggaaaaaaaucauuugaaagagucaagguaaagaacagccaaaaugugauuaaaagaaaggaaugcuugucuuucuagacauaaagauacucuuuaaucauaguaaucaaaggacuguaucauuaaagcucaaagagaccaacugaacucaguggacaggcaagaaacagauucacacauuuaugucaagaccauggggaaagaauagaauggaacacuguuuuuccauaggaagaaaaguagauucauaauuuauaucacauauaaaagauauccagaugauaucaaggcacauauggaaaagaaaacauuaauacauuagaaaaauaugaaaguacuguuaugauauuaacacugggaauauauucuuaagguacagccaaaaugcauagaccaaaaggaaauuauuaaauuucauuauacuaaacauuuuaguaucaaaggcacuauccccugucccgaccccaucacacauauggaaacccacuaagauuccaagcgagaaauaaaaaaaaguccugugauggauaugaucacaaaggauuuaaaucuagaauauauaaaaauacuaauuauugcaaaagaaaacaaugacccaauggaaaaaauuggcaaagaauacacacaagcaauugacaaaaagggacaccuguuugcauccaggagcaaacguuuuacuccacuggauaauuggagaaaugagaauuaauccaauaaugugguaccaucuuuuacccaccagaguggcaaacacuuaaaaagugugccaaugcaaacaucaugggaaacagauguuuucacccaaugcuauggaguaucaacugacacaagcacuuaauuaggacuauagaacugcucuccaauguuggagaaauguguaccuuacaacauggugauuccacugcuagguaaauauucuacagagagacucaccaguacacuaggaaacacauacaaagauauugguuuuacaucgucuuaacugagaaaaauuagaaacaaccuuuaaaaaggaauaggaaauuaauuugucuuccacucagggacuagaauacaauacaggagguaaaaaugaaagaaugagggcuucauuuauucauguagcuguaucucaaaaacaaugccgaguaaaagaaacugauuauguacagcaggacacagucaagaaaauauuaaauacaucaaacaacaugauuuccuuuuuagggauacagaugcacauuaaaaacaaauaaaaacaaaaaacaaaaaaaaacaugcaaaccuaagcagguagaaaaccuaccaacuucaggucaguaaacgccucuaaagcaguucucaaaaggggguaacuuugccucccacauguggcaauauguggagauauucuuuguuauucacaacuaggagggggcaugguauuguaucuggucgguacagguagaguugcugcuaaacacuuacagugcacaggacagcccccacaagaaaguaguuaucugguccaaaauggcaaugguuacaagguugagaaaggcagcccuaaaaacagaggaaggagaauaagaugacagguggggaagaugaaguguaucuauaacuuuucauucuaagaaaagaucugaagcauguaugaaaauauguuaaauuuuuuaagaaggacugccacauuauucuuuguacauucuuauauuugaaauaucucuuuaaucaguucaaaaauauaaaaaucauucugcaaacaaacacaguuaauuucuaaauuugaugaaaauuacauaauucuuuuauuagccuauuucuauaaauauaucuuuggaaaaacaauauucucacacucacgaucaaacguauuugcacuuuuuuucaguguuuguucuacacagagcuauaaaaggaagacuguggaagaacccaggauucauccaggaucacaggaucauuucauuauuacaguuucaggcaagaacauucuaaaaccagcucagagaaagcuaauuccguccuuuccugguuauauagcagaucauaauaauuccaggcaauucucugaagaagcugaugaucuagaacagugggcuugcaucacacaccccaucaugcuuccuuaaguacauggcuuaggaugcugauuucucccaaccucauggguuucaguaguuccuacaaacaacuuugagaucaaccagugcauaauuuuauuuuuuccuuuaguuccuuagugcagaggauggcaaacuuuuucuguaaagggcaagauaguaaauauuuugggcuuugcaggccauauggucucugucacagcuacucaucugugucacuguaacacaaaaacagccauagaggauacauaaaggaacaaauguggcuguguuccaauaaaccuuuaguuacagaaacaggcagggagcuagacuuggcuccaagccauaguuucgccaacaccaagauggacagcaaaaaugcaaccaguuuaaauacuauuuuaaauuuaaggcauuuccuccaaucuuugaaaguaaaguuuuauguauguuuuaaucaguguaaaaauuuuguacuaccaaaaaugaauuuauauaaaugaaacaauucaauaaaugaugaaaauguucauuuguuacauuuauagcauacuaacuucuuucuggaaguauguuauacccccugauuuacuaaauuauuaauuauaauuuuacuaguuuaaauuaugcuauuaaugauuccuuauaagaaaauaaacacacauauuguaucuucaacuaaggguugggaacgacaaggacagugaaauuauacucccaacacaaauaauagcuuucuauuagguuugcuauuucaccugaauaauuccuuauaaucaugaauaaugauguuauucgacaaccuaaugauaucaugguguguagcuucaauccaucugucuuugucaagaaggucaaauauuuguacuccacugcacuaggcaaaguugaacaaacaguuaaacaacaucacacaccuuaauuacuccuucaaaugaaaccagcaacuaccauuuuaccugauucuaggaccugugaaauaaaaaccuacuucaaagauauuuaaucuguauacacuuuuacaccaaauuuaagcucaacuuaaaaaaaaaauaaaagugguuaaacucaagaaaaagccccaagauuuucuaaggguauuguuaauugguuguugcuguaaaauguuuugugaauaacaaaauauuccaggaacuuuuaacaaagaucuggaauacuucauguguuaucuugacauuggcuuaaagguaagaauaaagcaauagcgugauagaugugaacuauaguuccuauaaaugcuucauaguguuugcuuugcuucgagauuccaugagugaccaaggaguugaaggggauaaaaacuccccauucacuguuucuacagagccucuacaagaccuggacccuuggggcugggggauggugaauauagcaagguaugaugugggcauacuuaaaugauuugcagcaaaauaauguuuauauuaaaaauccuguuuuccuuccuuccacccuucugcuuuuucuuaaaucucaccaaagcuuuauugcugcacaaaaaugaaguccuuagaaggccuuauuaaucugguuccagacuccuagcaucuucccacuuccucaccaugcuucacccccacaggucuucguguuuuugaaacggagucucgcucugucgcccaggcuggagggcaguggcgagaucucggcucacuuuaagcuccuccucccggguucacgcgacucuccugccucagccucccgaguagcugggacuauaagugcccgccaccgcacccggcuaauauuuuguaucuuuaguagagacgggguuucaccguggccuugaucuccugaccucgugauccgcccgccucggccucccaaaguccugggauuacaggcaugagccaccgcgcccggccucucuguguuuuuuuaaacauuauugagcaugcaaacuuguuucugccccugagccuuuguucuuguuuccuucuaccuggacuuggcugcccauugucccacaaugggcuggucccuccucguuaguucuuacagcacgugucaccggcaaagagaagacuucccuaccacucugucucaagcagucccucacucucaaucauacucuucuuuuuauuuuauucagaauagaaaaucauguuguuugugauuuauggguuuacauuuauggguuucaucuuuuaugguaaaccucugcacacaagaauaaaaguaggaucguuaucugacuauucauuauuguauaccuggggucuggcacauagcagaaacuaauuaaaugauaaauuuacauauucauucauuuacaauagacaacucugugucuaauuugaggucagcaaaugacggcccuagagccaaaccugccugauaccuauuuuuguaaauaaaguuuuauuggaacacagcccuguuugcccguuuaccaauugaugauguugcuuucacacuagaauggccuagugguguaguuacaacagagaccacauggcccagaaaagauuuacagaaaaaguuugcuagcuccuggucuacuacacaguauauguucucaaauaaauaaaauaaaguacagucauugcuuuuaaaggaguucugguccauuguguguuuuuauucaaacacuuuuagauuaaaauucuauggcccaaaagaaagcuccuuuaaaacuguaagcaucaccuagcaagaguuguauuggugcuguggcugggcacgguggcucacgccuguaaucccagcacuuuaggaggccaagguggguggaucauuugaggucaggaguuugagaccagccuggucaacaugguaaaaccccaucucuacuaaaaauacaaaaaaaauuaguagggugugguggugcaccccuguaauccuagcuacuagggaggcugaggcaggagaauugcuugaacccgggaggcagagguugcagugagccaagaucaccccacugcacuccagccugggugacagagugagcauccaucuaaaaaaaaaaaaaaaaaaaaaaaaaauuguauuggugcucuauucauuaggucagcuggcugaaaucauaaagaacuaacacagugccuggccccugguaaguacuauacaagccuugauuggcuucuuuuuggaagaaaacauuauauccgguggcuaacacagggcuuggcacauauucgguuggugcaaaaguaacugcaguuuucacaauaaaaguaauggcaaaaaccucaauugcuuuuccaucccaaccuaauagcaaguaacagucaagaucuguugaacugaauugaagugaacuugacucuuucagccagagggacuaacaggcuaaucugugaaauuagugggcaaaaaacugauucacucaccugagaacaagccauucuguaaaauaggcugagaaaccauuucucaccaacauuuuucagggaugacuugaaguaauaugauccaaggagccagauuucaauauacguuuaauguuuuuugauaacucguuguagguagccacuauuuaucuuauuugaguuacaaagauacauaaacacaaaauuuaaacaguaauuugagucacagacucccagaguugcaauacuauccccuguaauacucaguucuauagauauuuuuucuuuuaaaagauccaaacuaacccacauuuacgccagcucuuccaauuaugacuaaccgaugcauauuauuucuccaaaucuugacggucuaagcuaaugccucucacaguugacucacagauggaagucacaauuauuugggaguggcuggcuuuuuguuuugaguuccacuuccuggcuccuacgcucaacuuuugaauucagaauccuuagagugagaaaucauggcagaguccggaaucuccauuuuaacaaacacccuaggugaugcucgguccuuuagaaaucuguuauuuuagaucaagagaucauauauccacauuaagaaauaccaaguagcuaucaacuuuuggaaccacuacuuuccucuauuggaaauguaacgaagugauacuguguguuuuacuuggaguuauucauauuacuguauauuacgugcauacacaugcauauuacgcacucaguacuuguaggagugaaguacucaaagaaaagcuaaaauguggcaucuuugccauccaggcgguucuuugauaagcagcauacgcauaaaugauguaaacaaaugauacaaugacccaugacugagagaccgacgaguagacaugcaacaagauuucagagaaagaagcaaucaagggggucuagguugucagugaugugaaaaauugccuucuuuggauccaguagaggaggcaggaaguacaaaaagugauaguaguuaucacacucuagaggugucccaggaccuuguucuucucucaguuaagaccuaagaucuuagaacacaggaagaguaaagcaagaacuauggccuucuaaguuauuaaucccagcagccugggaaagauuacuaaggcuuugaaagcuggccaaaagucauugcaucucaguggucauagaggaagaccugggccaccaugaacugaaccaguaagaagccccugucuccaaggagcuguccugaaugaccuugcacggcacagcauucucuuuaucuuccuguggcaucaguaauaaaaaucauuggcuggucuccucauuugacaucuaaucaaacacuucacucggaaguuacuuuucuugcggguuuaggucuuaacccuccaaggauccugcaaaguucuagaggacagagugucagcaacucccccagugcuuagcacaauaaugucaggcaucauaaaaagaucuuguuuaaucauuugauaauuuuuuauuuauugccuaccauguaccagacauuguguuaagcacucaauagaacagacagcuagauccuaaacccaauggcagugacaaaaccgucuguagucaugagggcugacgacaacacuaugacuauaguaaaagccauuaaaaucacuuuaaauuggugaauugcacggugugugaaguauauaucaaaaaugcuauuauaaaaaaaucaaaauggcagaaaggaagauggucaagccuuagaaauucacuuggugaaagguuagaaaaaacacauccagaacuuaguuacuccuauuuagauggugacugugacacauuaguaauacuugaugguacuguagcugaauacugaauauuaagaaaauuggaaugcuucucagaagcaacaaaacaacgaaacuacauuuaugcuguauugguuaagaacauaggugucagaaucagaaaaacaugugaucaguucuagguucucuuccuuaguugugugacuuuggucaaacugcuuaccuaucugagccucaauuucuucaucaguaaaauaacuuuaaaauauaguaaugcucaauaauucuuagcuaguaaucaaauaaugcaaauuagcauaauacauucucacuuauaaaauuagcauauauuaggaaaauuauuacuauucaaugaguaguagcaaaauguuuuuccacuuugcuuuuggguacaugugaaauuuuauuguauguccacucauugagaucucaaacauuuauuaucauaacauuuacauaauuuauguguauguaccuuauccaagaaggccuaugauagcaaagaugcuaugucucaguuuucuuugaauacuucacuccuacaauuacugaguguguaugcauguaauauacaguaauauaaauaacugauaaauguaugggcacauacauuuuauauugguuguggcaugacuucuaauagugaaaguuaugaaacaaacuaaauauucaaaaccaggugaaauaauuauaguuaaucauauugaugaaauauuaugaaaccacugaaaaugaaguuaaugaauaagaaacauuaacuuuaaacaauaagaaaaaacuuacgguauuaggaucaaaagaaagggauaucauacuauauguagaguaguguuguguucuaguuuuaucuaaaacuguuuuggagaagauggaagaaaacaaaacauuuuaaaagauuaacagggauuaucucugggcaguaggauuaugagucuuuuuacuucauacuuuugugcaugaaaaaaauuaacaguauuaaauucuugcucauuuuauuuauaauaaauacaugcaguauugauuuuaagaaagagcaaauaagccuuauuuuacguaucaccagauuauaucacaaagugacguuaauuuuacuacacagauaaaugaccacauagcucaaaugaccagaaaaaaagaauugugaaguauauucucuaaauauaagcauccaaccauauugauagccaccaaugucagucacacuuaaaaagauuuuuuggccgggcagcgugccucacgccuguaaucccagcacuuugggcggccgaggcgggcagaucaugaggucaggagaucgagaccauccuggccaacauggugaaaccccgucucuacuaaaaauacaaaaauuagcugggcaugguggcacgcgccuguaaucccagcuacucgggaggcugaggcaggagaaucacuugaaccugggaguuggagguugcagugagccaagaucuccacugcacuccagccuggcgacagaacgagaccccgucucaaaaaaaaaaaaauuuuuuuuuugguucaacaaagcugcuuaguaaguaguuuaaaguuauuuauuauucuaacccaaauguuucacaucacaguaauuuguuaaauauaauuguauaacauaguaaaacgugaacugccaaauacaauauauugauugaaggagucucaugaagcuuugagagcuucagcgauaguggacaggcuguauucaaccgcagcuccaaaggagaaagugauuaacaaaauaagaaaauaauuaauucaaaagaaaauaugcuuuagaaauaugugauuuuuuaauugugagaaggauaaaauguuuccuuaaggucauguaacuguuagcuacacagguagccuuucugcccgguaguaagcccaauguggaaaugaaauuuaguagugauuuaauuuauaauuauuuuucaaaguuugaggaauaggaacaacuacauuauguucaauagucugaaagcacaaauucugaccuuuaaguucaaaguggaagucaaacugcuauacgucagcaugacaacaucaagaaaaaccaacaggucccaggggacaaggggaauaccugcuucccugcccacuaucaccccaaaaguuuugucagaacuauuuuggacauuugucaaagauguauuuuuuuuccuauuuagaucaugagcuguaaaaacagaaaaaaacaaaauaaugggcagaaaucuaucugaaacccacuacuuuuuuuccuuccuuuauuuuaauagauaaaaggcuaaaccaggucaucuaccuaaacaagacugguuccaggccucugcuauggcuaaguaguuaaggaaaugauuuuugcaauuaggauggucucauuuauauugggacuucacuacuuacuaggugggugaguguggacagcuuacuuccauaccccuaggcuucuuucagcaucuguguaaagggccauuaagucagaauuaaauaagugguagcuguuauuacuaaauauaaaagccucauagaaaagauauguuaguuauuagaaagaaaauuuucccuaaaacuucuuuuaaaacaucuuaugacaaaguuacagaaauauuuuuaagccguuuguaacuaauacagacgcacauucucucucauauuuacacuuuucaccuuugcuucccaucuggaggagaucauccuccaagguuucuuccagcauauuuuaugauaaucagacuaugaauugggaauacauauuauuugggcucuguuuuugauugcuauuuuucaugugguaaaucccagaaagcugcccaaauccccugcugauuaucuuggccaagauguugacaaacucuuagauuucugcuaucccauuggcauccauugguauugcaauggcauucuuucauccaacggacaaaaccucuuuccaaauucugacaacuucuauauuaucaucauucuucuaauguuaauaagcuugaauuugguaacauuaaccccacaguuaccaaauauggccuccucaugccaacccaccucugcuuuuuguagaagaaacuauuaggccauuuguaaaagucugguuugaugacuccucauuuuguggcaauuucauaaauaugaccaacuuuaucauuagucuuauuuucuuucaauuaaucaacaaagccaugaguaaaaugugaaaauuuaauagucuuuucccaugauuucucacagacaauauaauugagcuuuccauguuauuuuacaguucuuuuuauaugguaggcacuaaugaaggaguccacaaacacugguuacauagcacacaugguugaugucuauuuuucacaugguacuuugaggguggaggguaggugggaagggauggauguauuccauaggaucuguagcaacaaguauaaagcuaauuuuguaaacugcaacuccugaacacuggugccuuuggagaaauuauuuaucauauauuaucuauauuacagagauuguguuuggcaaauccacgguuuuagagucaguacacaaggcagauaaucauuugucugaaaaucucggacaaguguguuuacuaucuauaguagauggcaccauuuucuucacaaauauuuauucuccucuucuccuacaucgugggaggaguauacuacuuugcuuuacugauuucaagauggucaugugaugugcuuuggccaauggaucacaaguggauauaacacacggcccucccaaaggaagcuuuaaacguauguguguggucuggguuggccuucuaaccuccugcccucuaccauaggagcaaaauguuccagauaggggcugcuucuucagccugcguaaauggaaugagaagacaauggagcagacccaaagccagcugagcccagccaagaccagcagagccacagcugaccugcagauuugugaacaagaaugaaugauguuguuguaaacuaccaagauuccagguuguugccccauaaaaacugacggauauacuaucccuaagucuuaauuacuucauuuaauaaauugugauuuaguguguguaaaacauagugcugaaguuacuauagugaaaaaaaagcauauacugccccugcucucauagucuagaggaagaaaauggaaauugcaccaucauucuagcacaugugaauuacaaacaaguaaaugcuaucaaggaaagaaaugugguuccauuagaacauauaauaaaggaaaguggccaagacugagguuucaaaagagcccuucuagaagaagggauacgugaguuggcauugguagaaugaacaggaguuagcaagguaaaaagacaaugcaaaaacauuccagucaagagagaaacaacaugcaaaggccuauggcuaaaggaaacacgauuugguggaggaaugaaagaggcuaguauggcugggcaugaaagaaagagggaggccuggcauguggugagauuagagagaaagacugaagcaagaccagaggccuuuaaaggccauguuuuaaaagcuagggucuuuauccuauguacgaaaggaagcuagcaaagguuuuuuguuuuguuuuguuucauuuuguuuuuuuacaacaacaacagcagcaacaacaaaacuuguauuuuaagcucagggguacgaggguagguuaguuacauagguaaacucgugucauggcgguuuguuguacagauuauuucaucacccagguauuaagucuaguacccguuaguuauuuuuccugauccucucccuccuuccaucuuccacccucugauaagccccaguauacauuguuuccucggcccauauguccuuguguucucaucauuuaacucccacuuauaagugagaacaugugguauuugcuuuccuguuccugcauuaguuugcuaaagacaauggccuccagcuccauccauguccuuguaaaggacaugauuucauucuuuuuauggcugcauaguauuccaugguguauauguacaacauuuucuuuauccagucuaccacugaugagcauuuagguugauucuauaucuuugcuauugugaauagugcuucggugaacauaugcaugcaugugucuuuauagcagaaugacaaagguuuuucaauggggauaaaguaaggaguucuucaucaguuuguguuugauaaagcucugacugcuagcuacauggagaauguauugcagggaauguagagugaagacaauaaauaagcugagugaggaaugcugguggcuuggauuagggcacuggcauuagaaauuagagaaauagauagauuugugaaauuuaggaaguaaaaccagcaagaucagcacugugaauacaguauugcauguuagaaaaagaaggauguucuauaguacuacuauccaugaagcgauagaucuuacaauaaagaaggaaucuaagaaauaaugucucuggauuaugaauuugacuuaauuuaucaauuagguuugacuacuugaaaauaacccauaaugguagguaauuucaacucccugccaccacaguuacagguggaaacuguuauuacugaauaauggugugagcauaaaugauguuugucaaacuugugaaucuuaggaaaacucuuuggacaagugagugaauauuaauuuagacuucauuggagaguucaaguuuuuucucuuuccauauaaucuaugucaucuuuuuggaaaaggugaaaacaaaaaaauagauaauacaaaguacuucaaaaugccaaagacuacccucugagcuagcuugaauucuauuccuucuauuuauuuggaucaauucuuauccaaaucugugagauuuguauauuaugaggguguuuucuuugacaucuuaaaguucaaagauguguuucaacaaucuuuagaguagguacuuauggcaucacagcuuagcuucucaaaaagccaauuauaagacacagcuguuaccaugccaaauuccuauauauuugguuuuaaaaaaaacuaauucuacaccuggcugaugaaguaaagacgaacgugauaguauaaauguacagacacaaaucacugcuuuaagauucccucucuagacccacauaguacauaucuguggugucuaccagcuaagcuucucuuccuauauucccacccaaauucuuuugggguaccugcaacucccccauugcaagcaguccugguaggcuaucaaauaaaacaccuuaucuaccaagcaagagauccaggacaggccaaacagauggcgugcuccaggaaugugacucuuggcgauuccaaaugauaccaggacauguaugguuggagcuacaucacuucaauggcagcauccugaggagacugucauuaccgcaaccaggauacccagagcugccccaacuucuauuauuucugaggccuguuugugcuuagcuuucaaauuucagucuaugaccugcuucccauagcuuuccaaucuuguguacuauuacauaaguagaagcugauucucagauaagacaaguuguccaaaaucacacagauaauaaauagaugaauuaggauucacaucucuguuagacugaauccacauucauaaucuuaauaaauucauuauacuguuccuaugaucacaucucaaauggaauuuguaaaaagcccaguaacauuuguuuauugccuuagccuaccacuuagaaauuacaaugaaauguuaacuauaucugcuauuuugcuauucgcaagugacagaugacuuggaaagcauguccacuuuaguccucuaagcacauuuacauuuucauauugccuucacaugacauuucuguggcuacacuugcaauccagacuagucuuucauccucuguugacaaugaucuguuucauuuucagagaaaacuacccaauaagucucuuuaacguuauggauauagucuuucuaaggaauaggaagaaaauauuuuuucauugucuuacaguuuuuuuguuucaaugaauacaucacguaccugguaaagaaaccuugcuaccgucucaaccuuugccaacauuaucauucacagagauuccaaugagugauacaaacccuagcagcuucagccuacagcuuggugagguugacuacaaagagcgcccaucccagaguuacuaguacucuuauuuugccaucuuuauuuuugucucuggaaaaugaauaaaaugucagcuucaguagcaacauacuguggaauucauaaaacaaaggucagguaugaagaacacaggaaaccaaugguagcaaaaggaaacccaaugccugagcuggccaucuuggcgaguggggaaaacuagaacagcacugaaaaccaagcauaguuaagccaggauugauggguaacagcugcacuuugcaauucaccugcaauucagauccaauuucacauauucugcaagcccaaaaaaggccaauuauuguuaaguuucuauaagaguuuaaacggccaugauucauuuuuguuuuccuuuaggaauuuuaggacccccuaagaaguauucucucuucuacauaucauuucuaggccuugaauuugaauggagcaucugcugaguauaauggaccuauuuggccuuuuaucucauuuuuugugaagcuagucaaauauguauccuuccacuagggucagcaucgacuagauggacuaggaagaauuucauuagaaaaugagaucucaugggagacgauaaagaccaggcuuccaagacagagaugugaguucaagucucugguauuuacuagcugaagggcugugggcaaucauguuaccuucuugaaccugcucccccaccuccccccacacacacaauauagaaauaccuaauuuguacaauuacgaauccaaaauauuaaauuuaaauuuaagguuuuagcacaauggcacauaggaaugacuauagugccauuauuaaaaauccaguaagugcauuuaugcaccauauaauguaguauauguuguaaauucaauaguacauaauagaaucauagucucuaaccucggaggucuuacaucuaauguuaaugacaaaccaagaauaaauuccaguaagggggugaaaaguguucugaugaugggggaaaugcagguaauaaugaguagcuauuuuauuauuaaaaacguaaaacacauguacagcagaguggucaagaaucuaaacucuaucaucagaaugccuaggugugagucucaugucugcccauuacuuucagugagacuuugcauaagguuauccaucagugaaauuaaaaugauaauauuaacuaucuuaaaggguuuucacaaggauuaacagagaaaauauguaucguacugagaauggugcuggagauauacuaauccuucaauaaauauuaccuauaauuaccaccauuaugccaauuccaucaguacugagcuauacagaaauggucgacacccuucagaaugucuccuucuacacagacaaacaucgcuuuauguguuuuaagacaaucaagcuauaacuagagaaaaaucuaagguaucucuaaagacacuuucaacucagaccauuuaucuuuaaucaaaaauuuggaaauuuugauguuaaaauucugaaauuauuuugaggguacuauagggucuuagaauaaauagaagagaaaaauaaacauaaaaugagaggaagcacccccauagugcuggauuuuaauggagguaucagcaucaauccaugauuuaaaauauauguauacauauuuuccaguccuuucuaacagaagggccuagaaacaaugucaccugaguagccaugagcacacuuaaugcccagaucuugguuucuaauuaucuucuauuuaaaugaaccauauagcuaauuccagaucugaagcagggaaaguauguuaugccaggaaaugaggacagcuuauagauaaauaggguuaucucaaaagggcagagacaucugaauaaagggacuucugcugucaaauugggcaaauuuaaucaaaaugauauaauaaauggauucuaacaccuugaauuaaaagugaucucaguuuacuagaugagagagaaacagcaacagacaaaaaggggcuaaaaaaauugaggagagguaaaguucuuccuuacagaauaaugucuguaaauauauguugaaagaacgacaaaaauagaaagcuaacaucuuauauaucccauauuauaaaugacucaagccagaaucaccaacaaaugcuaaaacaaacaauuaggggaaaucuuauuguggaacaagacaugucuauuaauucaagucacagcaaaccuaggaaaagauugacugauauguagccaugguaauaaguagcauccugaaucagauuaaagucuauuuaauuggcacuuucuagucaaccaaucaguaacagcccuuuauugcuaaaagacagccagucagcaacagacucauacaucucuaagugccaauuaagcaaccugccccacuccucaccugaaucaacauguuuccacauaugucagcuuacuuacuucugaaaaucuacuuaacuccauacuuuccacuuuggucuacucagacugaacucgaccagcauaguucuccuuuacaauaaauucagcuuugucuuugaauuucagaugaauggugaacugcauuaucaccccacuauauaauaauuaaaaagaaaaaaacugugucuuuuacagugggguaaucuggcagucaucaacuaaccaaauggugaaacuuggcauugucauuagugaugccaauagccugacaggauguacugaugcagaggcaaggggacaacauaaccuauuugguguccuugccaaaaaugguuuaaaugaaccgaaucaggagaaaacaaugagauggaucaagauaguaggcuguugcaugggccauauggcuuggaaucuucaaauaauuuaaugucaugaauauccaagggaguuagacaauugauauauauuuuaaaauauuuaauaaccaaaugcaauuuauuaauuuaugaauaaccaaaagcaauuuaggaaccuugacuggaucugugucauggaggaaaaaaagccaacugagaaagcaaauugagaaaaucugaauauggaaaauaugauauuacugaacuaaugugaauuuucuugggugcaguaaaugggguuaguuguguaggaauguuuccuuauucuuggaaaaugcaagcugaauuauuuaggaguaaagcauccuaacaucugcagcagacuacuguuuguuagaggguuuggcacaaaggaagugucuacagagacacggcacagauauaucaagaugucaaaguuaaugaaucucaaugagagauaaacaggugaucacugaacuguucuuucaacuuuacugagguugaaauuuuuacauucuauuuacuuuuauucugaaucuuauauacacagaccacccauggaauuucccagguauuuuucuucagccucaauuucucacuuacaguaaaaauaaauguguuguacucuguuuuuguaagucagcucaaaacuuuauuggcagaaacagugguccaaauaagcaaaguucaaaacauuuaauaauaauuuuccccuacauaaaaaaggcaaauauuuuucaguuaaggauaacaaagauaagauucccuuuggaguuuaaaauccuccaaucuuucagcuuuguccaugucauuauccucagcaaacacacacaggaacagaaaaccaaacaccacauguucucacuuacaagagggagcugaacaaugagaacacauggacacagggaacaauacacacuggugauauggacaggaagcaggagggaagggucccuggugaggguucuacucucaagccuggacccauggccuuaaaugagaauaggcaugcuuguuuuugugcccagauguugccuuuuccaaaaccacucugaccugcccugcacccuauccugugcccauaagaaccccaaaccccacgcuccaugagcagaagagcagcagagcggcagagcagagaacaggagagaagaggagagaagugucugaacguggagaggacaagaggcagcuggacaucggagacuagguuggggagaaguuuggccagggacagccuuacuccaagggaagauuaucuucccacuccauucccuuuccagcuccccauccugcugagauccacuuucaucacccaauaaaauccucugcacacacuacccuucaauccauuugugugaccugauucuuccuggaugccagacaagaauucaggaggcacuggguguggaaacccaaaaaggcugucacacugacucuucacugagcuggcuaacacuuaagcugucuguggauggcaaggcuaaaagagcauuguaacacacuuggacgcugccauggggcaugcacagggccugcuucugcuggagagaagcagccagcaguuccaguguuccuucacuccgguucccacacccguuuccuugcacgcucccucccguggggaguggccagcagugggcugaguaaaacuagcagcuucaguuccugccagcgaaguggucaagggagcucccguuucacuggggccugucgaggagguggggagaaggagagcaucagguuaaauagcuaaugcaugcagggcuuaacaccaggugacggguugguagaugcagcaaccaccauggcacauguugaccuauguaacaaacccacacaugcugcacauguaucccagaacuuaaaguuuuaaaagauaauaaaaacaagaguuauaagugguggaacaacaacaacgacaaaaauccuccaguguuuaucauaagccauuuugccuccaaugucaguaagacaaccuagaagucucugagaggagagaaaucuuuccagauccaucaggagacacagaagucacaugaaagcguuccuacagacacaugaaaaugcuaaggguaucuuuggacacugaggacucucccaccaacagccacacugacaacagccuuuggugucucacucagaggagucccuggugggaagccaggcuguaaucugucacaagagcaugugagcagaggccaccuuacuagauaaaaugcagcugguuaccgcauucccuggagggacagugaccuccgacagacaaggugaggcaggcagacaaaacagugggcaccgcaaaugaacaggcaggcgcggaguggugccuggaggaaagccucugaccuggagccgagggagagcugcuagauaaacaagccauuauaagaggguaauauuccauccuagugugagcggaagcugggaagaaaaccaacuguaggccugauguggacugcagcuggcaggaaggcugcagagcucgguucaaggcaggagauccugccccugucccuggcacagaacacaaacagcaccacuggauguggugggaggaggaggaaggaaaaucuauacauuuacgggacgugaaaugcaagaaauugagggaauucguccaggaaggaggaaugacaccauuaauaucaguauuuaugggcuuacaagaagauaaaugcauuucaagaguagccucaccccaaagagaacuaaccacacaauuaagaucaaggcuacugucauagaccuggcucugcuuugaaaaacaagcuacaaagggaaguuugggcuuuaauuuaaaaaaaaaaaaaaaauguucacggaaauaagagaaacuuuaagaaaacuuguagaacacaaaaaucacauuagacucuucuauaauucucauaacaauagaaacuuaacaauaauggagcuuauauuugaaugcuucauauggacgagagagaguuuaagcauuuugcauauauuaacucacaugauccucacaacaauuccgcuggguagauacuauuaccgcccauuugaagcauaagguaacugaaggaaaucuagguuaaguaauucccagggcuugcucuuguaagacaacugagcuuggauucacauccaggcccucagcugcaaagcuuauauuccucagcccaugaauacugccucuggguaugcaaaaaucaccuuugccuucaggaaauaaggcucacauuuuuaagugaacacucaaguugauauaguggggaaggcggggaaggcagggaaaucuggagcugagacaaaggaguggggaaacauacuauggguucagaggaccuauccacaaaccuguuggucucuguaccucuucacgcuguugaaaaauugacuacaccgaagagcuugaauuuaugugacuauauuugcugauauuuaauuccaaguuagaacuaagaaaauucuaaaauauuuauucauuuacuuaaaauaauaaacccauauguuaauguaauauuuuaauaauauuuucuaaaacaaaaaaacuagugugaagagugacaaaucucuaaugaauggcuugauagaagauaauugcauccuuauuucugcuucuguaugcaaucuaucaugagaugucuucgcuaaagcauaggaagaaguuggccucauauagacauauaguuggaaaaggaacuacuucacaaauucugcaaaggucuuggggaccuuccggggccccaggaccacuggucuagagaaaggacucuagaguuagaccaccuggauuugaaaccuggcucugccacuuaauagcuguuuggucuagaucgauuuagcucauauuaucucauucucucaucuauaaaauggagauaccaacaguacccaccugauagguuugcucaugagugcuaaauuaauauuuaucaaaugccuagaacaaucucagagcauaaauauuauauguuagaugaauaaauaaaaugaccuggcuuugcaagaagcaucuccgccagaguaacgucucuguacugaauuguacauucugacagcugagacaaugacagggaucacuugagcgaaagugaucaauuacacccauguuauaauagggauaauuauaauaggagcuucaguaaauugagaaaucaauugagauacaaacuucgacuucaugggagcuaagaaaacauaaucauuugaaucucuacuccucugaggauggauagcaacauccuuucaaaacccuuucauguucaaagucacaucagacaggggaaauucuuuaauguaauuucuguugcauuuuggcuauaaaaacaugucgagaaguuguuaagcugacaaauuccaagguaucucuuaaugacaaaaagugggugaauaguuauaaaggcucaagaguuaauguuauuuuaggguuaaguuaaauauauuuuuaccugugcaaauuuuuaucuauuucauuuuuaaaaauugauaaaggucauucaggaggugauuugagaacacacaacuuguuguagauaucuuucuuauuuauauuauugccauauaugaugcaauacauguaaaauucuuccaucccauccuacuauaccuuucacauauucuuugacauuuuauucccuccaucaaauaugaguugucuuuuagauagcaucggaaucauaggauacuaaguagcuacuuccucugucucucuacacccaccucccuaaaacuacaggcggcugacccacugauauuacuaugaauuuuuugcucuucaucaacggucaaaggguggucuucaguccaauggccugguuaacugggaauugccauauauggcuuaucauuuuuaagaaauuacaauauugcagaaagcauuuuauaugaaaauuauauuaaacauaaucuagaauguaaaacagcaccauaacgucauauugaauauaguacauuucaugacucagaagacacauuauaguugugccacaauccccaagaucugucuuuucaauauuaccccuaugcaggaaacaugugaaacuagcaauuaauaguauaaagaccaacuuaggaguucuguaaagaaguuaguuagaaugugaaaacaccgcugugcuucuagaaccauacugcccgguucaucaugacacuccuggucucuccauuuauaaacuuggaaauaccauucuuuaccuucuucaaggguggccaggaagauacagugaauuuuuaaagcaugccuaugaaguuccaugaacuuguuggugauaguggacuagcaaaauaaaaauuagaagaaagaaaacucauucaaaaaaaaucacaagaaaauacgcacaaauauuuaaucucaggauagauuuugcauaaaagaacaggaaaaacucauaaaugaccaaguugacaaaacuaugacaaaauuucuacauguuaauaacaucuuaaagaaacugaagaggcuagggccaaaaaaggaacaauauuugcaacaaaugugacagguagaggguuaauucguaaaagaucucuaacauauuggguuuuuaaaaauaucccaauagaaaaagaagcaaagcaccuucauagguaacuuauugauaaagguaauguauauauauguuuaaaaguuaacuccacuagcaauuagauaauaaaauguaaacagugagauauguaaaaucuaucaacuuggaaaagguuaggccaaaacaaaaaaccuaauucuugaaguuuaugagauguguacccccaugcagugcuaguauacaauaacuuccgaauguucauccauuuaaacaccacauaauauuauagcaaguagugauuccaguuuaagaaauuuagcagaaacauuaccaaagauccuguaccaaaauauuuguuacacauaugucgaaaagucaguaauaacuaauaaauuauaguagauccauauggcacaauauuauaccaucguuaaaaauuucauuuauaugcaggcugggugcgcuggcucaugccuguaauccaagcacuaugggaggcagaggcaggcagauugcuugaggccaggaguuugagaccagccuggccaacauggggaaacuucgucucuacuaaaaauacaaaaauuagcugggcaugguggccuguaaucccagcuacucaagaggcugaggcaggagaauugcuugaacccaggagguggagguugcagugagcaccgagguggcaccaaugcacucuagccuggacaacagagugagacugucuaaaaaacaauuauuuuuuacauacauauuaaaacgucagaaaaaugucaacaaugaaguagguuaaaaucauguuauaaaguguuucucuuuuucaagagaaacauguaagaacaaagaaaaaaguagaaaggaauaaacugcaguuuuggcaaagguuauuucuggaaaauaagauuauagaugguuuuuauuuuguacagugggcagauauucuuaugauuagaaaaaauaaaugaaagguuuaaaaauggguuacacuugauauaaacuagacugcagcuucauagauauaauuuaaacaaaacguuuauuuagucaagcaauucauuagcugguuacugguagacugcauuaaaaacaccaaauaguuugaauauauuuacaguuggcccuugaacaauuaaggggcaagugauccuguaccacuccccaucugcauaguugaaaauucacauguaacuuaacuucccaaaacuuaacuacuaguagacuauuguugacuggaagccuuaccaauaaacacuugauuaacaaauauuuuguuuauguauuauguauuguauucuuaaaguaaacuagagaaaauauuaauauuaagaaaaccauaaggaagagaaaagacauuuacaguauuauacuauauguauugauaccauagcuugacaucaucuauuuacaagaugaaucaucugucuaaaacuguagguacauaucaaggaauuuaaccuuuucuuguaacaucauggcuuuucucugcuucuugggagcacguccagcaucacuagugacccuucauguuagucccaugguacuauuccagguuuaugguaugcaucacacacaaagaaaaaugagaaccaugagagaucacuuuuuacugugaaacaauuuacuggagugaccaucagcucagagaugauuaguguccugaggaguuuuaaacagauacucccaacacuugagcucaccccaauagcaauacaagguggcuacaaauuucuuauaguacaguauguacuauaguuaauuuuaugcauuuaugauuucauacaccaucuuuauauuucuuuauauuccucucaacugcaaguggcaccauguccagacuguguuugugugccuacguuucgauaaauuuuaggcuuguuuguguuuaugguacuaaaugauagaacagacuaguaucuacauauauuaaugacauacauuuauucuuuuuuuagauauuucuagcuaguuuuuuuucaaauugucacaaauguccaaaaaauuuuucuaauauacuuauugaaaaaaauccacagaaguggacccacacauuucaaaccugugcucuccaaggaucaacuguaauuccuuuucuccauaacauuucaguaguaucagaacuacauuaaugcuccguaccuccuguguacggauuauaucaggaggcugagcuguggaugaaagagauuuuaaaaagaaacaguagugugauuugaaacuaaauaaaagagaaacaucucgucuagagagcaugucaguccuaguccaaaccuuuccagcauguacaggcugaacacuccaaaaugaaggucuacugcuuauugcugaauuguugguagucucaaugaccccaggauugcagagaugcuucacuuucaaaaaaaaaauccauuaaaauuaguucaaagaggacacuaacaugguguuagagggucauuuuucaauguuguggguggaggagcgagacacuuagaguaacucccauuaugguuaaugagaguugagcaucuagacucaucuaaacccccugaggguuuaauuuaaaaccacuauggcaaagcaacucuaagccaugaaugaacagcagcauuuuucacacaccuaccucuucccaaguaccaaaaacaguagaaauaauaaaggugaguuuguuugguuggguuugauuuuuacuaccaugccucauagaagagaaaaaaaaaggaaaaaggcucauaucaaaugccuauaaauuuuuugguuuauuuuaaauccaggguguuauuuuaaugccauuuuuaaaugacuaauuuaaacuugagucuggguuuuuccaguugcuaugugauguucacauagaaaugcaguauuuuuuuaaauuccauuuaagcuucaguuuuacaaauuuagggcuaccauuauauaauguccauuccaagacccaugcucuugaucaaccuuaaggcaucaggauaauggacaauaaaaaaaaaauaaguauuauuauuauuuuuugaggcggaggcuugcucugucucccaggcuggagugcaauggcaugaucucggcucacugcaagcuccgccucccagauucacgccauucuccugccucaaccucccgaguagcugggacuacaggcgcccgccaccacacccagcuaauuuuuuguauuuuuaguagagacgggguuucaccguguuagccaggauggucucgaucugcugacuucgugauccgcccaccucggccucccaaagugcugggauuacaggcaugagccacugugcccggccaaaaguuauaauuauuauaccaugcuuccaauaugccaaauuuauucauucuucugacuuccauaucaccuuguuuuaauucucucacaagagcccaggaggcaggcaaauaccuguuuucauagcagaaaauaccuuuaucuucacaugagcaaaucaaacaaaaaagaauaaaugaccuaaguuuccccauaugggacuaaaauacauuucuccaauucccuguccaaagcucauuugcaguuuugacaaguacaaauguuuuguacccaaagacaguaaaugaggcaguagagccauuggcaggcagagcucuuucuucucccauguacauucaacaauaccagaaacaggacugagagagccuuguaaccaucauuuccaugguuugaguuuugugguagggucagggaaggccucuguguguaagugaugacaagggaacaggaauugaaaggaggaaaaccagggacccuguguaggucagaggguggcaggugaaggucagaggaaugucagauuuuacuuuaagugaaagaaacagcaacagcaaccagaaguuuuuuuuuuuuuuuuuucugacacagagucuugcucuguugccuaggcugguugugcaguggcacgaucugagcucacugcaacuucugccccccugaguucaagcaauuaucgugucucagccuccugagaagcugggauuaaaagugcccaccagcacaccuggcuaaguuuugcauuuuuaguagauacaggguuucaccauguuggccaggcugguuucgaacuccugaccucaagugaucaccugccucagccucccaaaguguugggauuacaggcaugagucacuaugcccagccagaaacaaccauaauuucuuaaugcaaaggaacaaccuguucuuguuucuguauuuuuaaaaaucuaugucagcuacauagugguagacuggaggauggauagugguagacuggaguugcgggagugauaaacaaggaaaccugagagcucacugcacccaguucagacaagauuuggcaggaguaguagagauguugaguaccagacucagaacauauuuuugagaaacagccuccaugugcauuggaaggauguuuugagaaugcugucaauuacauauucuggcaucaucuccuugaggaagaauucacagaaaaucgccugaucucugguguugugcacauuucugcauuuuucugaacaaucagccuauuuuuaccucaagaauugaugcucuuuccuuauuuagguuggugauagaaaguucagggccaacuuugugacccaucuguuuuuguugguuuucaggcugcuaaagacacacccaagacuggguaauuuauaaagaaaaagagguuuaauagacucauaguuccacguggcuggggaggccucacaaucauggcagaagucaaaaggcacaucuuacacggcagcaggcaaaaggaaaaaugagagccaagugaaaggggaaacuccuuauaaaaacagcaaaucucgugagacuuauucauuaccacaagaacaguaugggggaaaccaucccugugauucaauuaucucccacgggcucccucccauaacacgugggaauuaugggagcuauaauucaauaugagauuugggugggcacacagccaaaccauaucacuaucucuagcaaguauauaaauauuuuauaucuauuugaugcacuaaucucacuuuugguccaucuuacuuuccuuuuacuacuucuugaauuuuguaguuugcuuuuuuuuaaagcacuuaaaucuuacucuacuuuuucauagucaccuuaaaucauguuuuaaaaauucuaggaaauaaaugaauaaacaaacuaaaauugucuaauggaaauuuccuugauuauuauagaaauaauaaaucagaagaagguuucaucaaagggaucaucagaaagaaauagagaucuacaaaagggcauguuauguaaggcaaccuguaugcaugggaagccaagaugauaaagccauaaaaacuugacuaaacugaagaaauugcuuacagagcugcuccagacuuccugaggaaggcaagacaguggcauauacaaucuugggaaaucaaaucucaugagccgacgaguuaucaaacccuucuguuagauuucucucagcugaggaaauaacugauuucaucagccuggcuggaauccacauggaaaucuaugaaaccugugcugggcaugggagggguugaguauuuuucaugcucaaaccaccuguuacuucucucucuuucaaagcaggccacuuuggaaugaugaauauuaguuaugucuccaagcauguguucauguguguuagguacauagaaauccugguugacacuauguuaaccauugcaguauacugccuggugugagaacuuaccacauuauucuacuuguuaaaugaggaccguuguccucuuuuaucuuuagagcuaaaaagccaacauggucaaccagggucacucaucuagcaaauauucauuuaacaaauauuuacugaacaccuccuaugagccuggcccugcccaggcagaggagaugcauucaugaauaaaccugagaaucaucccugcccucagagagcucacauucuagucagccugagacacacacacacacacacacacacacacacacacacacacacacacacacaaauaaauuauauaauaauuuaguguauaaacacuacaaaggaacgucaugugguaggggugcaauuuuaagauaaugggaaagacuauucugugacauuugagcacaaucuaaauagaggucugaaggaguugagugaacauagcauauguacaucuggggaauuggcauuccacgaagaauaaacagcugcugguucaagggcuaugaggcagcagugugcuuagaauguuaaacaaacaacaaggaaucuagugugguuggaucugagcgaauguggggagcuuugaaaguuguauguagcugcuguaacaaauuaccauaaauugguggcugaaaacaauagccauugaugcugucaugguuuuggaggccagcguggcauccaggugucagcagggccacgcucccucuuugcugcuccagcuucugauggcugucagcauuccuugacuugugaccacaucacuccagucugccuucacgaucauguuguguccuccuuuucuccauguaaucucccugucucacucuuauaaggacacugccauuggauguaggauuugccuggcugauccaggauaaucuccccaccucaaggugagauacuuaacucacacauccacaaagaccccuuuccuaauaagguaccauucacagguuucaaggauugagauauggacaucucuuuugagggauccccauucaacucacuacaggaaaaaugguaauagaugaaaucagaggggcaaugguugauggcaggggguggauggaggaguacaaguaggaaccuugucaaucacugugauaacuuuggcuuuaguuagaagaagguaggaagccacuguggggauaaugagagaagugacauagauucaacaagucuuaacaggaucacuccggcugcugccaugcaaaaaaguuccaauagcauuuaauccuuacauugauacuuuguuggcuuaagagcaugccaaauuuagauuagaaaugaaaaugagaagaaccugauauacagaucuucagaaaauauuuaauaauuaaaagaauauuccucuaccuaaccauccuguuuugaaccaaaauuaaauuuaucccauaaauauuuaucaaccaucuaauauacacaagauucugacucuaagaauugaagggaucacacccuaccuaaugugguauugacugacaaccccuuuuuuuuaagauuuaugucaucucuuuguguaaacaauaauugaagaaucucaacuuagugggagaaagacgugcuaccauuauauucuuugccauuacuuuuccagccacccuauguugaaucccuuucuggcucuuuaauaauaucuugggcagaacguauaacuauguagucacuuuccauaauuguaaaucucuccauuuuaaaauucuagucuugguucuuuuaaaauuuuauauccuaucaagcacagacuugagaugcaacuuuuauuacuuagagcucucuacaaguguucccccauagugaggcuaagcuaugcuagcguuaaaggcagaguggucuuagguaucagguugccugucaacaggugacagguggccaggugugguggcacaugccuguaauuccagcacuuugggaggcugagguagauugcuugagcucaggaguuugagaucagccugagcaacauggugaaaccuugucucuacaaaaaaugcaaaaauuagcugggcgugguggcccacaccuguagucccagcuguucaggaggcugaggugagaagaucacuugaguccuggagcucaaggcugcagugagucaagguuguaccacugcacuauagcuuggaugacagagugagacccugucucaaaaacaaaaacacaaaaugaaacacacaacacauacacacacacacacacacacacacacaaacaggugacagguaagugucccuggucuagcuccaguuccaucugcugggagccucugcaaauacgguagucugcacuggugaauuaacagacauguuuuuuccaggaagguaguaaagucucgcccccguuuguuucugaggauccauuuacaaaaggacagccaugucucccuuuuaggucugccgguguuccaugacccaauccccucucuggagaggccagcaccucaguuggcccagcaucuaccugagcaaccuaguggugccugccuccuacucggacauucauggucauuuacaggaaccgggggaccugcugagguuggugcuucugggcuucuucaaagggcuaccgaaaaggugaaauaguguagaaaaguuguucucaucuuuuuucccaggaacacuacuccucuucagugacuucuugcucugcuacuacaggccucuccaacaagccuccccugccccacccuacauucaagaaugcaaagaugagaagcaagcacucuugugugcucauguacaauuccaaacuccacagagcacaugggaagcucuccaaaagcaauuguaccucccugcacucccagaucaugacaguaccugugucagccugcagguccuacagcuucguagcaucaagccaaagaacaagaugccagugucauuuuguggaaagcaucccccaagagaugugacuuuugaggcagugggaguaauuauuccagaagagggaagaagaaagcaucccuacacuccucauuucaacugucgaucuuuguccucacguauccucucccuuugcgguuugggggcguggagguauguuucagugagguaggaaugguucugcugcugccucucaguaauguggauguggggagcaucuguccccacaugucagcauuccugcuuaggccuuagcuguuuauuccgcggaaauaugaaaaguuucacucaacaucugcugcacuccugaacuucaauuacauuacugcagauaugacucccugagagauggcuucuagagucauuuggucccuaaacagaauagaaaauacuaacugguauucuaggccucugcaugugaaacacucuagauuuucauguaauuccuguugauuuauuuuuaucuugacacaucuuauuuaacaacuauuaaagcaaucaucuuuggugaauggaaggguaucauggcuaacuuuuaaaguauuagcacguaaaucucuugaacugaaaauuaaucuuaaagauaaaaagaaguucuugauaacuucaggcauuucaaaaccuaucagaaaggagaaaaauuggagagccagaugaauuuagcuccuccuggacccauuuuaucucagagcaaauuaugcggcuaaccaagcuaaacugccuggccccauauagauggcaguggagaguaaggcuuaaaccuucuagacuuucagaagucacuaagguuggucuuauucuuaaaugauaaugaagcuuacaauaaaauaauaaagccacuaacagcaaaaugcccauaaaaauauaaauggcagaguaaagauuuaggaaaauacaacacuagaaaguggggcuaaugggaaagguuuaaacucuagggagaagaacuucucaggacacccaccccaccguacauagaaguuugcagcacaugugaaauguaacuggagaaggugaaaugaacaauggaaugagaaucaaaaguccuggguaaagcccagacucccaugaacuagagccaccauuggucugugccucagcuuuuccauucaaaccacucauaggccaaugaggauagaacaauuuuuguuucagaaagguucuugcucugcagcccaggcuagagugcagaggugcaaucacagcuuacuauaaccuugaacuccugggcuaaagcaauccuccuaccucagccucccuaguaguuaggacuacagaugcaugccaucacaccuagccaauaaacuuuucuuguagaaaagggucuagcuaugcugccuaggcuggucugaaacuccuggucucaagugaucccccugcuucagccucccaaaacucugggauuacaggugugcaccacugugccugugugaaacaaaauauugacuccaauaaugcauuguuagucauaaaauauaauuuuaauuauuuaaaauuaucuuaauguaagauauuaguuauauguauauaaauauacucuccacugccacaguuaccccaaacacauauacaaaaggaaaagaaaggaaggaaggaaaaaaggaaggaaggaaggaaggaaauugccucaguaucccccaugcuacaaguaagcuuucccuuaaaccacuauuaggaggcuaaguucagugugaggaagaugaccauuugauacgaagaaagaguucuguuggucuuaauuaaucagcuaaccuacaacuaugcuugacuuaauuggucuugaagaacaaagaacaugcuuggucuuaggaauauaaaggagcuucuuccaucuguuuuucucccucuaaaaucucccucuaaaaucuacugagaccaugugcauuggcaugucuauuccuguuauuacaauauugaaauacacaaguauuacuuauuacccuugcgugcugcucaccaccucuuuucuuccuccccugggacucuccagaccuccccacaaugcacaaauuaauaggcugaugucuggcacaguagagagcuuucaggaaccaccuuugacauuggucaguaccaccugucauacuaauuguuacacauaaacauaacuccacugccuaagacauauccacccauauccugacccccaaaugcaggcagauacaagcuaaaccaaggcuccugaaauauauuuaaagccuguaguagaaaucucacaaagauaguuuagauugcaaacuacuucagauaucugguauuguagagguuuuuaaggauaaguccaauguaggauuugugcccagaagcuauuugcaaauuuaugguuauuuuuucaguuaauuaguuugagaaaggaaauggcagcuaaguaaauaaauuagaucauuaauuugcaauaaauauaaauuaauuaugcuaauucuaagaguugaacacauauacguauuuuguauauauaauaaaaauaaggaacauacauaagacuauuaggagaggaaagcuaccuugacuguuguaaaaaaauccacguauauguacucaguagauuuuaacaguuuugauaugugcaugaaauauaaaagaauaaguaacuaccuacugauguucaaacaaaccuauuuucauuccaaauggaaauuagaauauauucugcauuauuugaguuaauuacaugacacuucuuauaaauaaugauguauuauuauuccauucauuacuucuaauuauauuccuuagcaagugcgaugccugcaacaccaugaccagucuuuuccuguuccuuaaaaucugaugacuugcauggaaagcaggucaaaaauaugcccagaauauaacgaacagaguucagugauuguuaaccaugacaguuuaaaacuacuugaaaaaguuacuguggaaauaaauagaaauggugaacagcuuuccaaauuacaggauacccaugauagcaacauaagaaauauuugaaguguugucuagauacauauaauuaucauucuaccauucacuagaauuggagaaagaacaccccuaauaucccucucccccagcauacauacacauuaacagaauuacauucuguguagauccgcagaucguaaagauacacauuucugguugcaaaagugacucuacagccuuuaugcaauucugagaaauguaccugcuaaaaguccuaaucaaaaugacaguugaauuuuucuccuguaaugcauaaucaggucaggccagcccaccccaucccaugcacagcacggucuggggcuagaagguaaaacauaguauggaagacaggucaagaucaaggaaagacaguuaaaacuaucauuaagcaacagggaccuaguaacccacaaggcuacuuuguacauacauauccucaccagagagcaggcagcaaggagccagaagagucaaggaagagaaggcagauagcaggaaguagucuagaugaggucuagagaccaacauguacaugccucaggaacaguguuucguggguaugucaccuucauuuugaaggggccagggcaaagugcacaaaguccacacauuuuucuucauccaauuucaaaccuuccuugcacacauacaaaguaccuacuuaauuccuucagcaucagcuuccaacaauccauuguucugucuaugauaaaaaauaaagaugucagucucggcuccagaaacaaaaaauaaacuugggagaggaagagacuagcaaggagggcuuccccuuccccucuagugcccaucacaguuacugccuucugaccccacgugcagccugaguccucaaccuuggcagcucacuaccaacugaucagcugguaugugagauaaaaugaauuuguuuucugcauuguaauucuuuagauggcaagucaagauggaugauggucacagcaaguuugucuuacaaugggaguuggcaggauucucugugguggauuuuagacacugaaaaaagauguuggucaacuuugaaugaugacagcauccaauaacuuccuuuguucccauuguccagugcuaucagaagcugcuuguagcugguggccauguacucuaauaacccaaggguaggugcacauucauauggaaaccuuucccacagaaguaggaaaaagaaagguccaacuuaacagucacugcuaaaugcaugucuuugaacacaauaaucugccaaaugaagucaagaaagaaaugugaccacaagaaaaccaacuugccccacuacaauggacagcaauauugucuuugaacauuucuccuccaaaagcucuuaagcuggcuaauauacaacaagcaugcacagagcaaagacaagacaugugcuuagggaaauuuuaagagcaaaaaccuaucuuuagcuauaaagauauuaaaauagugcuugugcucauuuuacuuguacaggaagguuugaaaagaacucuuuuuuuuuuuuuuuuuuuuuugagacggagucucgcucugucgcccaggcuggagugcaguggugcgaucuaggcucacugcaagcuccgccucccggguucacgccauucuccugccucagccucccgaguagcugggacuacaggcgcccgcuaccacgcccggcuaauuuuuuguauuuuuaguagagacgggguuucaccguguuagccaggauggucucgaucuccugaccucgugauccgcccgccucggccucccaaagugcugggauuacaggcgugagccaccgcgcccggccgaaaagaaacucuuuagagaaaugaaagaucacuaauaacugcaguuuccugaacaauuaaaggaauucacaagauuacaaccuacugaggaaaugacaaauauuucugauuuuuauggaaggacuaaaagggcgcuuuuauguauagcaucuauucuguaagaaucacuguuaaguaaugaagcuauuuuuauuauuuuuccacuuauuucaggaacacucaacaugguaacggucugaaaacgggggaaacuuaacauugcucuuuggaaaguuaauauuccguauuaaaagauauuugucagaguuuucuuuuuuaccuuuugaauuuggaucuuggagcacuguuugcaugguagccaacuuuuuauuucuaaugugucagcagaaauguucuuaaaguuaccuagucuaauucucucacaaauauacuuuguaaggcugucccuacaugcaucauccuaauguuguauggcccugguaacauucugcgugagauggucuugauuggaaaaaucugcucuuuuuaauaacugauucaauaaacuguugacguaugauuuguagaauacaguaugaucagugagcaagguuucugucauuacacacccuauucaauucauccacaaauguugcugugucucccucauguugcagcuccuuaugccauucagaauagcaaugcagagaucaauacacucucugcugaagacgacagaacaaaugaauaauuuuauuuacaaugaaagccccagucuucaaauggauaccacuaauguuuaaauucauuuucaugcucaacucaagaagagagauagacacagcacaaagcaaagggaguggggguaaggagaaguauuagccauaaugguucaaauuuauuuaagccaugaacaauagcugggcugcacugagacacaggaauaaaauguuugcugcagaauucugaauguguacucuucaaaaugauucugucaccaagaaacucugaaaagcauuuuccaguaacaagaaauuaauggauuaaagacauucugacauauucuucuaagcguugcaccacagaagccaaagccuguucaauaggcuuuaaacaguguuggcaaggaacagaagcguuugcuucaggugggaacaaggagggacugaaguggcuguuuugagaaugaagcaaacgauccugcuucaaaagcguaucuuuggccucugauuugacaguucuuuuucuuucucugaaagcuaugaaaaagucagugagcaaagucauaagaaauaaguguuggugaggggcagcaaaauguuauaagagagacaaguucaaagaugacauuuacaagccucucaugaauggcacacuccccaaagggcaccugaaugccauuuuuaagaagaagucaucaaacauacaaaauaaaauguuccauuuuacauaaagaugccaauauacugcccuuaaaacacagauugguccauucacaaauuaacauguaaagaaauggcaaagaaccuucucccaucugccaucaauucauucacugcuuuuagauuuaacucccuacacucacacgcuuguaaacagaauuguaauggacaaaggaugaaggggaagcugggaaaaccuagcuuggacaugauacugaaacaucuggaaaaaaguggugacaagacuuggccuuggggaugggaaacgggaaaaggugggauuucggcacauccugucucucuauucuguuaacuggaacaaugcauauacuccugauguuuccagcuucacuuuagauucagugaacacaguacauuuggaugcuaagaaaaaagagaugugcaagagcaggucucguccauaggaagcaaagacucagugcagacagaaauagggaugcacguacuuuggauaugaggcagacugggcuguguguuuggucuugguaccuggaacagaguaugagcucaguaauaaaguacugaaugaaucaacaugagaauaaggaagugagugucacaaacagaggacagaguuuuguuuuguuuucuucccuaggagcaggggacaguuaucaaagcacuucagaugaaaugaaaagcauggggaggaaucuccaguugaggugaggggcaggagaaaguauaguaaagggauaguacaacacauauucagggaacagccggaaagaagggagacugagccaguacaaugaagguccuuaaaaacuauucuaaggaauuuggacuuuauccucaaaaaacagacauuccuuauugguuuauuaacaagggaagagaagaaugauauggucagggcugugguucagauaaaguuauaggcuacauuggaaaagcccagaggcagggagacagcauaaaucuagaugaaccacaccuaagggcuagacuagggcaggcaggagagaacacuggaggaagauaaaagcccacuccagacaucucaccauuuauuuaugaaauguuaguggacagagcuauccacaucuuccauucucaagucucaggacaaaagacuagagcuuucugcaagcaaaggaguaccuuauuaagaugcgucucccaggccgggcgcgguggcucacgccuguaaucccagcacuuugggaggccgaggcggguggaucaugaggucaggagaucgagaccauccuggcuaacaaggugaaaccccgucucuacuaaaaauacaaaaaaaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaagaugcgucucccaguuguaacauggcagaguuuauaaagguaaaguaaaauaaaaaguuacaaaaucaucacauaaaaagcauugucugaauacacugucuacuggcccugagacuguuuuaaauacugcagcuguuaauuagacuuauagaguauaaugauuuuaaaaaagcucugguucucauuguucuuauaaucagagaggguuggauccuucuugcuaccuuccaaacaaacugaaguguguuaauuuuaauaaaauauucuccgagcccuugguauuuacucaaauauaaaguaacugagcaggguucauuucccaaauggugacaccagugccaucuacaaagaaacgaguugucauucacuacuugcucacuauucacuacagauauuuuccuagacauagacauuucuacuuuucuugaguucaaacucagguaugcccugguuuuagacaucacuuuuucugaguuuguuaaaaagucugaaauaucaaauuacucucaagauaugaguaaaaaaacuacaaagcagaguucauuccauuauuaaccauuuuaaaaaguggccaacauggcaaaaccccgucucuacuaaaaauacaaaaauuagcucagugugguagugccugccuguggucccagcuacuugggaggcuguggcacaagaaucgguugaacccgggaggcagagauuguacugagccaagauugugccacugcaacuuagccugggcuacagagugagacucugccucaaaaggaacaacaacaaaaaaaagugguacaucucugugaccucuaauuuucauaggaaugagagugaauuuagacaaauggaucuugucuaaauucauauuuucaucccaggucccuuuauuucuuuucuaaaagucaguuaaagcuggcaccuagagagagauggcauuuaaaccauauucuuuuaacaccugaauuuacagacauuuugcuuuaaaaaaccccaaaggaaaaagcccacuacaaacuuauagcaaaauaaaauguuacuucaagaaauucaggucuuuuaaaagauuucaauacacaauugguauuaaaauuaaaagugcuguuuucuagggcuuuucuaaaucauucuaguguuuuuuuuuaauaaacagaagaaaauaguuuucuaauauuauuuagacucauuuaaaagaagaguuuuaaauauuaagaaaagcuuacauauuuacuagaguauugcuuauuaguuuucuaaauuaauacaauuuauuugacuagaauuuggauuccagaaauuugggagucuauaauacaaucacaauuaucuuuugguacauguuuuucuuauuuguauuuuuuuuuuuuuuagcauacaauaguuacguggcuagaaaagaagcuuguucauaaaguucucaggcacuuuccacauuuucacuggaaaaaaaauguagcuuacucugaaaaaccucuuggcauauuuguacauucagaauuacuaagaaauucauuucaaagcaaaaucaugucucagcguggaaaauacuuauuaucugaaaauaucaaauuuuauucuguugccuucugcauggcaaacuaagugaaggaggaaagagaaaaacauccugaagaguccguacaaaauucauaugcacacaaucaggagugaaacuuuuaacaacauaaagauaacuucccaagcauuucaccaauacuuguuauucccacugcaaaagaauaaagcuccuauugaagucuauaggaggaaagacuacaacucaguggucagagggaaauaaaacaacuccaccaaugacacuggucaaugaucugcaagcugguauuuuucccaagagaaaaugcuauuucagguccuaauauuuuuuaaaaaaaauuuguaaguauaucuauaauauaaauuuaauuaaaacgcacaacuugaaugaucuccaagagguaaagcaacaaagucagucucaaauccucacauaucuuacuuccacaucacaaaggcaccacucaaucuacuauuaaaauucacaacagauaagcugaaaaccaagugcccgugauauucacugggcucauuuuagaagcaccuauuuauuuacucagcuaugguagugaaaaggucaagcaaaaauucaccuccaaagccacgguugcuaagcaacucuccucagaaguucugcaacauugaucaagcauauuacuggugccaccaacuggauucagaauaaauaugaguaacaucuuaccuggugucuccgaagugggagggagauggauucuuuauuuaccuuuuuggacagacuggaggccaaucuuguauuuauauucauuuggcugguuaggcucagaagacuuuuauuuucccucuccaaaaaaaaaaagaaaggauacguccugguaccacagguuuccuauucacaagagcgaaggacaguucuguuuugagaaacacuacagagggcuugaugagauguuggccaaaucugaacgacauguccucacaguugaagucuaaaagaaaagacaauggauaguuauaaaauucaauuaagaaacucaguucauauaccaccuuaaagaaagcaaauuccauuacuacagauucuuaguugcagagaggaugccauugaaauuguuccucauugaauguucaccaagaugcauucugggaaagucuuucuaaaauacuccacucucccuaccaguguuuccuugauuagaguuagcaauuuucaagcagaagcuuccacguggacaauaaaacagcuuuuccccuucacucccucugcacuucacggugccaccuuaacucaaauccacaaggcccuauuugucagcuacuuauuuuuacccaucuauuuugucaugucugcuaagcugaaaauuuucauuaaguauuaacuauaaaccuucuaauucuuaaaugcuucucucaaaugguuuuguguucauauaauagcaauuuagaacaaguacgaacacugucugaccuugccuacaauuacaaaaacaugagcacuuccagagaacuauucuaguaaaaucuccaaaauaaaggagaaaaaaaacauuuaaaaagaaggaaggagcaaaacggaguucaaaacuagaacaauuccugguuguaacagggccacaaagcagcaagguaccugaaauguucugcgucuuccuuuugagggaaagccauggggggccgggggcaggaaagggaggcugaagggaauuuggcaaauggcacagcugagacaagccaaauccaucuagcaccaaggaaugacuuuucaaucagguggaugccaauacaugacaaaguuacuuugugaaugacuaagacacacuuugugaaugacuaagaaacaccaucccuagaaaacuacuucauuuuucuaauucgggaacagccuaguaugaaacugaggaacauggaucaaucuacagaaaaacagagaaaggauuacaaaaaggaugaaauuagaaaauaguuggcuauuugugauaugcauuugguuuucaaccccauuuccuggcacgcaacuccuaaaauccuuagaaacuccaaagugaugucuuuuuguaugcuaaugauugacuggugucuagcagccucuaagagucuagguagcuucaggaugggguugaucacaagaaggaccaagcacacuuauacaccaauaacagacaacagagagcaaacucaugagugaacucccauucacaauugcuucaaagagaauaaaauaccuaggaaucuaacuuauaagggaugugaaggaccucuucaaggagaacuacaaaccacugcucaacgaaauaaaagaggacacaaacaaauggaagaacauucuaugcucauggauaggaagaaccaguauugagaaaauggccauacuguccaagguaauuuauagauucaaugccauccccaucaagauaccaauuacuuucuucacagaauuggaaaaaaacuacucuaaaguucauauggaaccaaaaaagaaccugcauugccaagucaauccuaagccaaaagaacaaagcuggaggcaucaugcuaccugacuucaaacuauacuacaaggcuacaguaaccaaaacagcaugguacugguaccaaaacagagauauagaccaauggaacagaacagagcccucagaaauaaugccacacaucuacaacuaucugaucuuugacaaaccugacaaaaacaagaaauggggaaaggauuccuuauuuaacaaaugguacugggaaaacuggcuagcccuauguagaaagcagaaauuggaucccuuccuuacaccuuauacaaaaaguaauucaagauggauuaaagacuuaaauguuagaccaaaaaccauaaaaacccuagaagaaaaccuaggcaauaccauucaggacauaggcaugggcaaggacuucaugucuaaaacaccaaaagcaauggcaacaaaagccaaaauugacaaauggguucuaauuaaacuaaagagcuucugcacagcaaaagaaucuaccaucagagugaacaggcaaccuacagaaugggagaaaauuuuugcaaucuacucaucugacaaagggcuaauauccagaaucuacaaagaacucaaacaaauuuacaagaaaaaaacaaacaaccccaucaacaagugggcgaaagauaugaacagacaguucucaaaagaagacauuuaugcagccaacagacacaugaaaaaaugcucaucaucaauggccaucagagaaaaugcaaaucaaaaccacaaugagauacaaucucacaccagcuagaauggcgaucaguaaaaagucaggaaacaacaggugcuggagaggauguggagaaacaggaacacuuuuacacuguugcugggacuguaaacuaguucaaccauuguggaagacaguguggugauuccucagggaucuagaacuagaaauaccauuugacccagccaucccauuacuggguauauacccaaaggauuauaaaucaugcugcuauaaagacacaugcacacauauguuuauugcggcacuauucacaauagcaaagacuuggaaccaacccaaauguccaacagugauagacuagauuaaggaaaauguagcacauauacguggaauacuaugcagccauaaaaaaggaugaguucauguccuuuguagggacauggaugaagcuggaaaccaucauucucagcaaacuaucacaaggacaaaaaaccaaacacugcauguucucacuuauaggugggaauugaacaaugagaacacuuggacacaggaaggggaacaucacacacuggggccuguugugggguggggcgaggguggagggauagcauuaggagauauaccuaacgugaaugacaaguuaaugggugcagcacaccaacaugguacauguauacauauguaacaaaccugcauguugugcacauguacccuagaacuuaaaguauaauaaaaauauauauauauaaauaaaauaaaauaaauuaaauuaaaauaaaaaagaagaaccaaagcaggauuauagggccagaacauucagccccacuccucaaucucccaggaagagagaggggcugaaggugaaguugaucaccaauggucaacaguuuaaucggucauguuuacauaaugaagccucuguaaaaacccagaagaacagguuuagggagcuucuggauagcugaacacgcagaaguuccugaaggauggcucgcccugggagagcauggaaguuccaugcucuuucccccauaccucaccuuaugcaucuuuucaucaguauccuuuguaauauuugcugugauaaacugguaaacuuaaguauuucccugaauucuuugaguuguucaagcaaauugauugaacucaaagaagggaccauggggucccugauuuauagucaguuggaaguuccagaggcccagacuugcaacuggugucugaaagucaggugacagucucauggcauugagcccucaaccuguggaaucugaggcuaucuccagguacguaacauccaaauucuucugaaaugaaucaaaggacauccagcugguguccgcugcuuuguguguuggggggaaagaaaccccacacauuuggucacaguaguagucuuugcugauuguuguugcuggugugaaagcagaagaaaaacauguugaguguauuuuuuuccuuauuuuauauagcacaugaauaaugcaugauuguuuaaugauucuaauauucucaaugacacagaagacagagagcugugcaaaugucacuuacuauggacacacccacauagccagaacuguacacauuucagguacuaaagaaauaagauaggaagguuugccccagugguacaagauaaugguuuuuagaacauuuacaaccagcucauuaaaaacccaacaguucucaaggugacgucccuccacaauagcaucagcaucacuugggaacuuauuagaaaugcaaauuuugaggccccaccccagaccuacugaaccagaaacucugggacaagggcccagcaaucaaggcuuccauagcuguccagguguuucagaaccacugaccaaacccaacuauccucccaaucccugggccuuuuccuacagaauuccugccaaauggcugccuagcauaugcuugaauauguccagugaugggaaguucaucacacauuccuccuaagacagucaacucuacaaauaacauaguugcucuuuauaccaaguccaucuguuuuucaugacuuuauuccuugggaucauauaaaacaaguaucaugcaaguggcagugcuucagauauuuggaguuagcuauuuuucauuuuuucuuguuuuucaagaauaaagauggcaaaucacauccaccauucuacaaacagcauugauucaagugaccugugauuauuucccuccccagaaucuacuuccuuagagucuuagcuguaccacuuugauuuuuugcuuuuaguaacaccccaccauauucuacauguggggcuauucguacuaccugguucuagggaugggcaagugacccaggcacccauaguccuuugacauaugauugguucgggaguggacacaggacacaaaaugagccaaucaaaggcaaggacauccuucagaguaauacugcuauuaguaacaaugccacuuucuuucaacugaguugccaaacugguagacuaugaaccugaaacagcuacgaguuuuccuaaaaaagagcuggcuugaugugagagccaauacugaggcaaagacagugaagacacagagacccauaccugaugacacugucugagcacauggaucuaacauugccagaagaagucauguaccagaaguuucuuucaggauaauggaauagaauugacuuagcacaggcucuacuugaugagcuacuauuaucaugagcccaugaaaggcucuucuuuuucuuuucacuuuuccaaucauuuuccuuuuuguccucuguguucagucccauucccucccuucccaccacagaaauucacuuuuucauaauuaauguauuauucagaauccucuuuacauguuuguguacauacauuuuuugucaaaaauacacagggcccuuauacauaauuuuuaaauuuguauauaaauuguagguuuuaaaucccauucuucuguauucucucaacauuguuuuagaaauuuauccauguugccauaaacaauuccuucacugcauuccacuguaguauuccuugcccauuccucuagugcuguagagcuagcuugauuacaaccuuuuaccacaaguuacacugugacuaccauucuuacacguuucccuggauuccuaucuuagcaucccauuguugggauucaggucagauacuuacuuagauuuucuaaaauauaugcaccagcuugcacgcccagcagcaauacauuaggauuucuauuuuccuacauccuuaccagcacuugauaguacuuccugcuuuccaaguuuuuaauuauugaaugguaaaauggcgucucuuccuuuuacuucauuugucucuaauagugugauguguguguauaugcauguuucucuucuuaugaauugccaauucauauacuuuguccucuuucauauugcuuuccucccuucaauuuucuaauuuuguagagucccuuguauauucuaaauauugaucauggucuauuaaacacaauaauuauauuuucaccaucuauuaauuucucuaucguucccuccauugaacagaaaucauucauuuugauguauuccaaguccaucaauuuucuuuuuauaguuugugcucugcaaaucucuccgaacaaaucccucucuaccauaaguuugcaaauauauauauuccuauauuuucuucuaucgacuuuauauuuucauccuuaacauuuagguauuuauuccacuuggaacuuuguuuauaguaugaaauacagaaacggcuucauuuuucuuuuugugagccaauuuuccuaguaccaauuccugggaaugauuacaguaaguucccauauauacacaggaauaagucuagacuccuuucuauucugcuucagagccagacgcuguagaacaaaggucgcacauuuuugcacauuuuuuuuuucuguaaaggaccagacacagcaggccacacaaugucuguugcaauuacucaacuuugucauggcagcaugaaagcaguaugaguaggcguggcugugccccaguaaaacuuuauuugaauaaacaggcagcagcccagauuugguuuauagggggaguuugccagcuccugcuguaucuuguuaaugucuaaagaaaaacagagauccucuuucuguauuuauuaucccauauaaauuuuagccuccacucugccccuuucaaaaaaaaauucuuagauguugauuagacugaauuuaaauuguaagaugggugaggggaaugugacaucuucaaaauauucaacgaagccauuuaugaaugcugcauuuaugcucuuuaauaccauaauaaaacucuuguaauagaguuuuaaauuucccuuauauguuuuaugcauucuaucuuagauuuauuccuagauagcuuuuaguuuaugucacuauuauaaaugguaucuuauuauugucauaguuuauaauuaguuacucccaauacagcagaaagcuauugauuuuucuacguucuuauagcuggcaaucuagcugaacucuugcauugcuucuaaugguuucugcugauucucuuuuuuguuguuguuuuguuuuguuuucagacagaguuucgcucugucacccaggcuggagugcagcggcgcaaucucggcucacuguaagcuccgcuucccagguucaagggauucuccugccucagccuccagaguagcugggacuacaagcgcccgcaccacgcccggcuuuuuuuuuuuuuuuuuuuuuuuuguauuuuuaguagagacaggguuucacuguguuagccaggauagucuugaucuccugaccucaugauccacccaucuuggcuucucaaagugcugggauuacaggcaugagccaccgcgcccggacuucucuuuguuuuuauauauaugauuucacuuagaaauaaugauaaucauaucuuucauggcaauuuuccuacuuucauguuucuuugucauacugcauuggucagcuaugugguaauguauugagaagcagaaguaacacagggauccuuuucuuguuccugaccuuaagagggcugaguuuaaacuucuuuuuuuuuguauuaugaaugaugucuacucuagguuuuuaauaugaagccuuuaaucaagcuaaaaauaucccuucuauuucaaguuuucuaaggguugauaccuuuuuuuaaaaaaaauugguuuuaugaaaugcuuuuccuauaucacugaugacacaauugcuuguuccgugccauuaauguggcaaacuacauuagcaaauuuaaaaauaauaauucacuauucuuucccuauuaugauuaauucaacuccgucacaagguauuauuuuuuaauauacugcuagauuugaauucuuagccuuuugaaugucauaagugaaguuggccaauaauuucucaaccuauuuuuuuuuuuuuuuuuuugagacagagucucacucuguuuuccaggcuggacacaguggcacgaucugggcucacugcaaacuccgccuccccgguucaagcgauucuccugccucagccucccaaguagcugggauugcaggcacccaccaccacacucagcuaaguuuuguauuuuuaguagagacaguguuuuaccacauuggccaggcuggucucgaacuccuaaccucaaguaauccaccugccucagccucccaaagugcugggauuacaagcaugagccacugugcucagccaacuuaucuaguuuuuguuaucaagauuaaacauaauaguuugguuuuucuuuuuuguuccaaagagaguuuauuaaacgagcauuuucuguuucaugagcguuaaacaaaacucuuuugucaaacugugucuuuuucuccugugccagaaaggacuaaguuuugacaaucauuacaauuuauuguuuucugauuuacuaaagauuuuuuuuuucuuguaucaauuucuuagccauauauccuuuucacauaauacugguaaaaacuuauauucuuuuuacuggauuuaaaaauauaaucuguaauuaucucuuuuaccuauuucguauuguguuuaucaugguacauggagauguuuuuucuucaucuguuauucaaaaguaagaucuauccuaugaaguuuuuuaaauaaugaacuucugguucuuuggcuuuuaugaauuauuuuuacuuuauuaccacauuuguauuuauuuccucugauuuguuuuccuuuauuguuucuuuggauuuacuauguugcaguuuuucuaguuacuugagucaaaccuugggcuuauaggauuccagacuuaguguuuuucucuuggguaacaaaagcuauauauugccgugaaaguauuccauuagcucuaucucucaccuacugugcuuuuauuaucacuccgcucuaaaacuuugcuauucuuguuauuauuuccuauuuaaccugaggguuauuucauaguaugucuuuucauauccagauauauaggauguuuuugcuaucuuuuuguuaacagugucugauuuuauagcacuguuguuaagagaaccucuaagcuguugauuuuuuagaauuugaggcuuccugacucauugaaaguugaagcuugugucuaauccacaugcccucugaaauaaaguaugcucugcuuuuguugaauaaguucuauauacaugagacaucaaauuguuauccaaaucucucuuugucucauugcuucauugguuucugagaggacuguuuuaaauuucuaacuauauuugcuaaaucaaugucuaacgccauaaauuauuguuuucuguaccucaaagcuacauuacuacauguggauauguuccuauucauuucacucccuuggucuucuuauuccuuuuucuucuuuguauuugacaaguauaaauuuuuccaucaccuuacauuagcguguguucucuugaauuuuuuuuuaauaaaauacuauagcaucuuguuuucuauccauuaaagaaucugcuggauaaguuuaaucacuacacauuuacacuaauuauucuuugagcuuauuucagauauuuuaucuuuucguuuguuucacuucacuuuuucuccugucuaccuuccacggguuaagucugguuuuucucuccccaugaguaugaaaauuacacauucuauuuuuauuucaguagugguuauucguguucuuauccuauccauacuaaugcuuaguguuuaaaagcagaucaggaucuuuauccuuaguauauuccuaccuccuuucaucucuuccagauaucauaucccaucuucgucauguccuaacuuuuaugcugaauugauauuguuauaauuucaaauaaugcuuuauaugcuuuuuuacccaccaucccucucuccccacuuacucuacugauuguauuuucauuugucuuguuuacaaagauguaaggacauucccuucucacaggcagcugugggcuccagcaccaccugcuucuuuugaaucuuacuuucccuuucuggccuuuaguccucccuuuuccucaaaacuaggcuacacuuuugaguggauaaagagucucagcucugccacucucuuccugaucuuccagaauucacugaaccuucuaauccucagacaucucauuugaaaauaguagauaaugaaguauacaaagcaugucucguugucugccacaugauguagguacccuuaaauacuaauaguuuucucucuuucccuacccaaaucuaagucuaccucuuuuuuaauugugguaaaaauccuccccauauaugcugcuaguacaccuauuucuucaaguuuuaauuucaaugaagaagaaaaauauucuaggaacucuaaaagggacaaaagcauuaaaaagauuaagagucaauagaguuugaugggaaaauuugugcaucuccaggaucugaaacugucuccaagacugagauaaauauuaaauacuuuccuuucacauaaaaauggcagaaagcaauuuuauuuucagauaaguaaaauugcugaaucuuucuaccaaauauaaagacuagauguaccaauauucuguggaauuuuccagggaaaaucaucuucagggaacugcuucuuagcaaauauggagauggugguuucuguaagccagagaagcaaauacuggauuaggaaccucaguccaagguuuagacccuuagacuuguagugagcauuagccaagaaggaaauacaaggaacuugguuuacucuagaaaugguaauugaacccuacucucucuuuauaaacaaacagaaguagauacauaaaugaaaaaaaaggucucacauuucuagccgauuacuuucuucuuuauuuuuuuggugaaaacuucuuuuauuugggacuaaaaauauaugauuucaacauucuuaaaugagucuccauuucccacuuuucagccauaaaagguagccucuugcuaccucucucuuaugacauauuuguacccucucuaccuccuauaaacuaccuuuacaucugcaucuccuacaauucucgccagcugguagcauaacacuuuuagagcuuuaucuuuaaaauuuaauaaacauaaaagaaacaaugaaaagaucucuacuauccuuuugugugugacucaguggauguguucagucauuuuuuugacagggcuagauaggcaaccuaacuuguaguagaguaagguucagugacacaaaagcaaaugcaggccccaaacugggaaaucuccaagcugugaacaggaacugacaauagcucacuucaggguagggcagauucuuuuuccggauuugcuuucaaauguuauguuaacauccaacuaaaguaacgaaaucucuuuugguauugccaaaagagauucacauuugagucagugggcuggggaaggaagauccacccuuaaucuggugggcacaaucuaaucagcuggcaguggauauaaagcaggcagaaaaaaaggagcacgagagagagagagcgagagagagagagagagagagacacucuucauagagaauauuauucaaggauuucuuaaacuugggaauauaagacuucagggcccugauuugggaaauacugaauuaauaacaacucugucacuuuaggcaaucccuuugcacuaaagccacauagcaguacucuguuaucagacaacaagcagcugauuuaaaauauaagccuauaucugucauuuucauauuauuucaucaaauagagaacaauaaauacaaacuuuuugagagcaugagggccuucaaaacccacuggccgaaguuuaagaaacucaggccuucagcaaaugcaccuaagaaaccaagcucaugaagaugugaaauucuaaucaacagauuaccugaaaacauuuccaucccauuucaugauuucucucucuuuucuguagcaaaugauguuuuuggaagaaaaagagcgcauauuucccuugccuggcuacucaaaaugugguccucuaaguagcaacaacagcaucacuugagaguuguaagaaauguagauucccaggccccagccuagauguaaugcauaaaccuguauuuuaacaagauccccagcuaggcuguuuguacauuaacguuugaaaagcacaucucagagcacuaguuuuaaaacuaggucuauuaagaucaacuugagaacuuucucaaaaaacaaauuccuauacuucaucauacucuugacuccaacaaucucugcaacaauguagcuaacccaucacggggauuugacaaacauggcuuccgauuguaucuucuuuccaauucauuuuaugaacucaggcaaguuccuuagcuucuuuaaauuugagaaaugaguaugacaacaguaccuucuucucaaggacacacauaaagcacuuaaauauuugauaagugcuagucacaauauugguguauuuugccuugacaaaaguaaugccuaauuuuauucaauaaacaauuguuaauugucaacucauacauaagcuaauauuguuaaguugcuucguauaaugcuuaucacaaaaaugguauguaaugguuacauaaauacaaauaaaaucauguauuugacaccauacugccauuaggugacuacuaucucuccauauuagagguagagcagugucaaaaacuaccaucugauuaaauaauagaaauaacagcuaaguacuuacucgguacuuucaucuuucuaagcaauuuauaugauauguuacuuaauccugacaacccuaugaggaagguccuucauacaccaacauaucaacauuuaugcaucucuuugauuacuucucaugcauuaauuccuagauuugagaaucacuguguucaaaguauauugaacuauuaaggcuacggguaugaacuacuaaauagcucucaagaaauguagccaauaguugauauccaacgguuguauagaaaaaagucccauuuccccaaaacuuuguuaaugccaggcauucucuaauucuccaaauugcuaauaaaaauuugucaugacuuaggaauacaacauaaagggaaauaacuucuucuaaauguccuagauaaaacaaucuaccaugaaaauuaaugucuccuaggcaaccaggaagucagacacaaugaaaaagaaacacuguucucuucguuaaaagaauaaaacuguguuuccuuuuaacuagaaaaauaaaguuguuauuucauuauggccaggaauauuaagguucacuguaaaaaauaaucugcuauuuuuauacccuggcauuacucagugaauggcaaaaaucuagaccaauccuagaaggcacgaaugucuuugggggaugucagaaaaagccuuaacuccagacacuucuaccaacuggagaguagguuucuauuucaauuaacuuaaacacuaggggcucaauuguuaaccaagaauguaaaugagcuuauuaaaagcugcuggcuaauggaucccaagaugaaccuugagaggaacaaugcccugucaucuaacugaggaacaacacaaucugaucuggccccgcucugaaacauacuuuauugaugacuuggaaaacaaggcacauaaaugaaugguuggagacauauauugaaguuuauaugauuuguaaaacauucuaaucuacaggcguaugucaaaauuccacaggagacaguagaagaggauccuagaagaagauaacaaagugaacaaagagaaagagaagacaacuugaagugucccagaauuuaagcaaacaagaauaccuguaacauuuuuauacaaagagaauuuuuuagugaaguauauuaagucaucaacuuaugucacuaaaaaaauuuucaauuguuaacaagucaaagaaaauccaaaaccucagcuauuuauaaacagaaaacaccuagguauuucaaaaugccaacugccuuuucaagaucucacuucaucaguuaccucuucucuguucugucauuuuuuuuuuuuuuguaaaccuacuuguuuuacauauuuaaccucauucucaccaguuucuucccugucuccuaaaaagauguucagggauuacauauacuuaauaaccuuuccucaucaaacucuaaucaccuauucauuuaauaaauauguauuauauacuugccauauuccaaauacuauucuagugguaaauaugacagaccagcccucugcucucauguaguauucuaggcacagggugcauauugcaagcaguagagacuacaagccagucaacaaggaaaaauauucugauugugacuugaaggaaaugaucaaaauccaagaacaggaagggacuuggaggaggcagaaguggcugccuaagugucaaaggaaaggggaaucucacguuugaucugcgaguugaaugauaagaaguccacuguaugugacuauauggggauaaaauguuccagauggaggaaacagcaauugccaaggcaagaaugaucucaagaucuuagaggaauggaaagaagagugugggguggagccuaacagcaggcagcaaggcagaggugaggagauggguuugaaagaugagcagggaucagaucauacaaggucuuguguggcguuucacuuaaugagaaacucgugauaacaaagauucaagcuccagaguguucagggucuaaauuugacuuucaaaaaaagauuuuacuauuguacauuaaaaaucaucucaggacgccuggugugguggcuaauaccucucauuugggagaccaaagcagaaggaucccuuaagaacaggacuucaagaccagccugggaaauauagugagaaagaaagaaagaaagaaagagagaaacagagagaggguaggggagaggggaggggagacgggagggggagggggaagaggugagacgggagggggggaggggaggggagacgggaggggggaggaggggggaggaggggaggagagaggagaggagaggaagaaauuagcugggugugguggcaugcaccuauagucccagcuacuccagagaccauggcacgaaaugccugagccugggaaguugaugcugcagugagcugugaucaugccccugcacucuagccugggugacauagugagauccugucuauaaaaauaaaccucaggagcuuaaaaaaaagcauaugccccauucccagauuauuuuucuguuaagacuuuugaaaagugacauacaauucauauaccauaaaauucacccuucuaguguacaguuugaugguuuucaguaugugugcaaaauuguacaauuaucauaacuaccuaauucagaacauuuuuacccccaaaagagaaaccauuuccuuuagcagucauuucacauuuuccucuagcccacagccccuggcaacuacuauucuacuuucugucucuguggauuugccuuuucuggacauucuauagaaauggagucauacgauauauagccuuuuauguguagcuuauuucacuuagcauguguucaagauucauccacauuuuaccauguauucauccuuuauuccuuuuaaaggcugaauaauaccccauuguauguauacaccacauguuuuucuccauucaucaguugauggacauuuguuacuacauuuuuggacguuugugaauagugcugugaauauucaggugcaaguuuuguguggacuuauguuuucaauuauugaacguacaccuaagagugaaacugcuggaucaugugggaacucuguauuuaacauuuuaaggaacugccaagcuguuuuccuuaguggcuguaccauuuuacauuaccaccaccaaugaaagaggguuccaaguccuccacauuccucaccaacaccccacucccagauauuuuaaauuaauuggucuggcugagaccuagauaucaggcuuuuuuuugguuuuuauuuugaaaguuccuauggugauucuauuccuaacguauagugaaggccaagaagcccuuacuccagccuguucauugccaacuugguaaguauuuauaccuacucccucuuccugauaaguauucauaccuacucccucuucugcuccagagcucuuuagacauguuacuuggugcccccagcacucucaaugacaucugcuuuguagcugacucauccagugagagaaggaaagauaauuaaggaagauacagucuuauacuuuuaacagucucauuuauuucugaguggggccagugucugugugaaaucuucaugguuaucugcaugucuggauggguuuucuccaggcacucugguuuccucccucauuccaaaggugcaugugagauuaagaggcaugucuacauggucccggucugagugagaagguauguagagugaguccugagagggaauggcgcccuguccagggugggcuccucccuugggcccugagcugccaagacaggcucuggccaccugagacccugaacugcaaugaauggguaaauaauuaucuugcuuuuauuaaucuuucuuauaauauguagacaucaucuuuauuucuguauuuaauauuaacaauauuuugguuuuuauuuagaaguuuggugauguuuuugugaggagaaauaugccacaggaauuuuuuuuuuaaucaguuagccuauggucaaauugguuucauuauacauuguuuugguuaaaguuguaguuucuaagaaaccuaccuaugacucaagugaggacuuguguuuuuacguaaugugaaucagcaacccccuucuuccacugauugauccgacggagaccuuuuaugcaaaaagaggucacugcuuuaaaauauauauauauauauauuuuauauuuauuuuauauauaaaaauuauauauauuuaaaaaaauauauauauauauauauagagagagagagagggagagagagagagagagagagagaggcuccugaaguucuucucaucuagucaagaaagauauaggguguaaauggauacuucuauguuuuaugcuucaaccugaccuugaguauuaaacaugguaucauauuuacaaaaauguauaacauuuagaacuacuuuugucacuuuauaaaaugauucuuccaaaccaaacacaggugaugaauaucuaaaacaccagcaucaaggccuagagcuuuguguuuguacaaaauaucagggaaaagccaagcacaguggcucacaccuguaaucccagcacuuuaggaggccuaggagggcagaucacuugaggucaggaguuugagaccagccuggccaacacugcaaaacccugucucuacuaaaaauacagaaaauuagcugggcaugguggugggcaccuguaaucccagcuacuugggaggcugaggcaggagaaucgcuugaacccagugggcagagguugcagugagccaagauugugcugcgccacugcacuccagccuggguaacaaagcaagacuucaucucaaaaaaagaaaaaaaacguaucagggaaagacagaaaccugaauaaaaaggaaacagauuucuacacugaaggacaaaguauggcaugacuucucagucugauggaggccgagauucguuuuuuucauucugagauucaucuuaacgguuaaaaaaaaaaaaagaacaaacaaaacgaaacccaaaucauguuuuucauguggacuguaauagcagagacgaacuuacauguuuaaauacaaaaacaauccuuaaagaggagaaucagaaguugaaaaucaccuuacuguuauguaucuuucuggaguaaucaaaauuucuacuauauuauagucucuauaccaucaaaaaauccacagauaucacagauauucaucuccauggacuguaugaagacauuguggacauauugggacaucaacucagaaauaaugucaaaagcuuguaugguaaaucugaaucaacugugaucuuucagaagcaggagcuuccaaagggguuccuguagcaucccuuuaucagagcaaggccagucagagguuaagaaacauugggucuuuuacuuuaacacuucucacauauuauuuuaaaaauaaauaccaaaagaaauaccaaaggaaaaaccacauaaauuauauuuugaacauuuacauugaacaaauuaaaguucccaacauaagugaauacaacauaauaauuacuauucugcauaugagagaaauuauuccaccauuuuuugacuccugaauuguuggcaauauucauggcaaagcaaugcugcucauagguuuuugcuaaaacggaguauaaggcuaauuacagugucaauuauagcuauguaucauuuguacucuauagacuuacuccuauuuuaaguggucuaccauauucuucuaauaucuaacgguguuauucacaagauaacuacaugacugauacauuuuuuacguaacaguguacuacaggugguacaaccuuguaagagaacaaguuuagaaguauauaaugcacaucuuccuucaauccuguuuauuagcauauggaaaacacauuugaagauaaccagauauaaauucaaggccuugaauccaaagccgucccaaacuacugauucccuguguucuuccaggcccucagaagaugucgguuaaaggaaaucauaaaaagucaaacuauagccucuguguuauguccccacuaaagccaguauggccagacuuuacuguagcugagagguucuugcucauggagucuugaaauagagcuucccaacuucagcagagaugccuauuauacaacauuaaauaaaagacgaauuuaaaugaaucaagucuugacucuucuuccaccaucauggguuuuacagaacagcauuauccagggcuccauucaagguaauuuugcuuuuucauugcuugacaaaugcuuucccauuucccugcacccuagacaaauugguauuucucagcagcucuuagaaugacaauggcaguuuucucuucaucguuuuuucauuucuucauccucucgccaugagaggcacucaucaggggaucucuaauccuacccaucucauuaccucuucacucuauuugucaccauuuggaauuucagaacucuuaauuauuagcuuacuguuaccaacaguaaugaggcucuggcugccuacuggggagcaucauccaacacuaacaagcuagcagacugagaccggcaccugaauuccaucacgugguuccauuguucaggccaggugggacauuucugucugcaggcaagcuuucugcaggagagcuggaguuugcaggguggcuauuauccauucacuuuggucuuaugauucacacugacucaaaacagcuuuccuguguggucaugcucauuuacauacuggcuauugccuuccuuauaauaacacuuaauguuuauuucugccuuguccuccuuuucacuuguauaaggacuuccuggagcuaagaguucucaaagggaacacuaauuggucauuuucuuauagcuacuuuugaucuccuccugaccuggaaugaacagugagucucucacagccaucugggugauccgucuauauacagaccuuccuugacacucccgcaguagucagcauacugccucaacacaaaagaggcuagacaaauguuaagugacaucuauaaaguuuucugagcaccaaagacagacccagaugcagaggagacagaaagguaaaggauuaagaaggagcuggucccucugaaacuaugacaaacaugucuuuauauaguuaacgagggaagaugcaacugauccaaaauccaucucuuccuuggcuucauauccuuucacagcaacaagagccuugcaccaaugaggacaaaugagcauugguugaauacuucuaaaugcccagccuacauuaggcacuugaccugcauuugcucauuuaaaccccaauagccuguacaguagaccuggaggaaaacaaaacccacagaagucaagcaacuugaucaaggucacccauuagugaaaaccccaaagcucuucucaguacaaguggucacccaacaccgcucagaaaacgguuaggcaaaaugagggccugggguggguuuuggaauagcaacacccugaagguaauagaggcuggugguagagaagaggagcaguggcaucaccuagguguguaacgcugccuuuguccccuguagcugcugccuucuauccaaggugaccaccguguugaacacugucuaggaaauacugugcucagggcaaaggaugcucucuuuuuuucacauuuuuauacagcuaagagaagucauuucugaaaacaggacuuggaggucaacguuuacauaugaugccaccaaggacaucuccugaugauacccaugaaggagagaccauuccguuagaaaacuugugcaguaacauuuaaaauuggcauuuguuaaccauacuaauaagagcuaauauuccuguagcccuugcuauauaccagacauuaugcuauaaaugcuuuauguaaauaucucacuuacuccucuccaaagccucugagguauuuuuaucacccuaauuuuacaaaagaaaacacuaagaguuuaagucccuugcccaaguacacacggaagcaagugauggagccgagauuuguacccagguaugugacacuggucuccuccccaccuccaacagugcuaagaaagaucuucugcccacauugcauuaugugcuguacuuuuuucauguaaaugaucauuccaaaugucuacauccuggugggugagcggaggaggugacaggaagaacaaaaaaaaaaauagacaugaugucaagaaaggaauuaauuuucaagugcacaaucacugcuacccacagagucugucuguuugguuuuccauagguauaaagagauuacucagaguccauaagguggccaugccaggucucucggggucaagcagacaggccaaggguguacccaggcucuccuuagcucucuacauggcucugccucaucugcuugcuugguucacccaugacaucagagaaacaaaguugggagcaaugcuacuucaagcauaugccaguuacuaaggguaauuuauggcaacucucauugccacgugggcugagaagcacaacauaauaauuaaaagacugauaagcaaucacuaaugaaaugcauagguauuguugaaaaaugcauuuugaguccaaguaaaacaaugauguguguucucccagugcagaaucucugagcucuguaaucuuaaaggcuuuugcuuuuaaaauacuauuucaaaugccagcuauuaguaacccauacauuugcacccugguuucauugcaaaaaugaggaaggaccauugcuuuccaaaagaggcaacaaauagaauuuuuuaaaaaacgcuucucuuggaaaauuuugauccguuucaagugaucuuguuuagaagaccccuacgccaagaguccugccgggacagaguuguguuggcaucacuugacugcuaccugugucgucuuugccuuuguguaucgcaaagccuguuagaaacagcucauggaagcggggcucagaagacagaggugugugcuagacccugcccuaccuuuguucucuaacagggaagcauaaugucaaccaaucucuagucaucucccugacccaugucccugacuggcauacacacagggccacaugaaaccauuccauggcucaggccaggguuucaagcaucaauuacccuuaguaacagcacaugccugaaguaggguugcucccaacuuaaauauuucucugaugucaugggugaaccaagccaagcagaugaggcagagucauauagggagcucaggagaguuugaguaugccauuggccuguccacuugaccccugagucuaaugacucagcauggucuuuggaguucuaggauggcauuauuuacuucuccucuugcacaguccagaaagaacauuuuuccccacuaaaugcacauucccaggagcuccgaccuccagucaaaaaaguaaaaguugcuugguaagcucacugccuggggucuucuauaccaggaagggcccaggccuagcacucauguuguggcaucuuccuccugcacuguaggcagaugucgcuaauuaacuaugacauguucuccugcagggcauuaacagaaucuuuuagauaccauuaccaaucaaucagaguugcugcauaacauggaaaaccuauugcucauuucacuuuucggcuuuagacuaaugacccagggaaacuuuucauggcagcccugagaugguucgauccauuucaagcuaaggaugugauaauacguguaucuuccagaaucuugacucuuucaauuaggagcaugaauaacaaacuucuagcauugaaauaacauauucuacgguaauccucugacugaucaccuuguuaauaaauaucuaaagaccgcauuuuucucugagcuuccaacuuccaugggaacauucugauugugauauaauuuuuaaauuagcggguuuauucauagauuuguguuaguaaauggcaagcuucuuacuaauuagcaaauuguguaaauccacagcaguauuaauuuucaacuguauggggaauuaauauaagacaaaauaaauaaggagacaauuaaaauuucccuagaggcaugcauuucuauaaaauucagcacaaaacaagaaaacauuaacccauuuugagggugcauuuagaaaagaucacaaaagaugugucagugucacagagaacaagugaagcaugcauuugcuguggcacgcacucucaguuacagcuaaauucccuaaagauauuuucucaaguuacugcugcugagauguccccucuugccuugaugcacuuuuccagcacuuucucauuuaauaagguuuuuauuauuucuuuauugauguuuccacucaaauugcuggugugcucucucucacuuuagaggacaaugcacaguauaauguucugauccucaaaaacugccccacaagaggucucucacuaaccaagcgcuugcuaauauccauuucacuuuucccacuaacccacugagaagauggaaagcauauguaucucugggcuccuguuuaaccucccagcucuagaagaugagaaaaagcaugucccucuuacgggcacuuacaccauuucuuaugaagccaucccacacacuguuaaacaaaucugauuguuucucaaacuccccuuuaacugcuucagcuuauugcuaagauguuggagucuuccuguguugguggccauggaaaccaccugucuauuuaauggcaugaggucuuuucuuuacuuuuccuggcaugccaggcuguuggggaaaggccagagcccuaaguuuaaacaagucaaguacagauguuuaagaaugacagcucccaacagcuucagaucauagcuaauaccaaaauuaaacuguaacaugguaugcucugauggggaaacugugcacaguuucuaaguacacaaacaagacaguacacagacaauuguagguuccauuugggggcaauuuucuucccuuaucauggcuaucagugauacaaucugcugcagaagaaugugguguuaacuaauuaguauaccauauagaagugccugucuuguauuauuuacagugccugggacacacuccuaguacagggcuucucauaggcacaguaauuaugcauuugccucucugucuuacauauuagauaaugaucuccuuaagggcugggaauacggucagagauugggauugccuaucagcccccucccaagcagaccuaagcagccaggugguaggcaagaacagcuucaugaauggcuacuaggcaguucccaguagugccuggaaauucuguaaguaaauuuuaaacggcuugguucaggccaaaaccaaaauggaucuuccuguucccucaccccaggucugcagugacauacuauccugaucuccucuuucuguuugagguugaaaauggaaaugggaagaaccaggcaggccuuaucuggccugcuugccauauggagacugaugggcagacuguucacaaccacaagcagguaccacagaaagaggacagaauagagccgguccuuuacuuuuaggugaguuuuccuccacuggcauguugucaccaggcaaggcaguugccauuucuacugauguaaggagacacacacacacacacacacacacacacacacacacacacacagagagagagagagugugugugugugugucaaggagagguggggaggaagugaguaggaagggacacagagccagggacuaaagagaaaagucccuuccugugaaaagaauaagauaauauuuucauuuaccauccccauauacacagcagugagcaaagugccaggcaaauaauugauacccaacaaacaucagcugaaugaacaaauggauucauucauugcacuuuuccaugucucuaucucuaguauuuaagauuuuuuuaauguaucuuagaagagccuacuguuguacaccaaaccaaaccaaaacagcagaauguccuaaaguacugacauauguguagaaauuacacaucaaauuaccaaucagauagacgcuaagguaggacugaaaugugggccaaacccauuuuggaaacaaagaacaaagucaauacucaaggucaagcucuuagacagcuauucuuccaaagcaccuggaccccaagacacacucaacaaauuucaggucauuucuucucucauuaagccaguuacaaccaaguuauagaaguggaguccuuacaagucgcuauugauagaauaagagcuagucaaagaauguuugagccauuuuuuucccagccucagaugauggggagaaaaaaaaaacaccucaaucaaggaugucaaaaugaaccaaucugcaauagucaucugggcaggggacaggugaauagcccaauucuucucacagaaaugaagaaaaaguucaggccauuauccaggaugacuugaaaaggcaacucagugacugagcuuuguaguucugacaccauucaaauagaaaugggagccagagauagaaggacugacggcucauucucaggaaugucugugacuaugcuuagaugugucaguagacaacagcuuccuaccaaaugguacaggcuuuggcagccucuuuuuuaaaaggccuuuuaguaacuagucaggcaccauucuuaauaucaaaacauucucucuuuuuuauugcccagacucugggaaucuggaaaaugaaagaaaagaaaaaaaaagaaaagagagagaaagagagaaagaaaaagagaaagagagaaacagagagagagagagagaaagauaauucugacucuuccuagguaaaguuaugcuuuccaguuaacuugauccacuaguuauuacccgaaaacaugcuuucccuauguuugaguucucauucauuuauucaacaucuacuaugugccagacccuguguuagaugcuagggauacaacgguuaaugagaaaaagaaaaugucuuaucauggagcucauuauuuaucugucuuauaauuaaucuauauuacuuuauuuaacaacuacauacauuaaacacugcccuuuuaugguuacggaaagacagcagugaacaaaacagacagucucuauucucugauccagggggaaaagacuaaaugaguuaguaacauuuucagauaguuaggagagcuggaaaaacauacauugggauaaugccauugagagugagugauggaguggcagcaggacuguuguuugagauaaauuggccagguggcgucuccaagaagaaaagucucacuugagacugguaaaugaagccagcaauccaggaaggguguuugucaggguggccagcuuuuccccacuccuagguuuuaagaggagucugacacugacuauuauuaggaaaauaaguuaguuggccuacuuggaggguauaauaccagccagcaccuuaauauucaauguguggucuggggaauaccagcaucagcaucacccaagagcuuguuaggaaugcaaauucucagcuccacuccagauguaauugaucaaaaucugcacuugaccugaccccuagguaauucauauguguauuaagacuuugagaagcccuggagcuagccaccuugaguaagaccuaaagucauguccaccaagccuggccucuaucagucauuccuuuguuuauuuuggaauucauuugagaaauuugaggacccaggcauagacaagggcugcuauuuauuggagguccucaagauccucuaaauaaagggaagaacaaguacaaagcccugauaugggccaggcugaauuaugagugaaaucaacagaaauaaacgcaagccauuuaaauuuuaucccuauaaaauggcuagccuuuggaaguuuuuaggcaagggagaaguaauauguucuacgugaaacuuuggagcagugacucugggugcugcagagagaguggacaauagccaagcaagcauggagaaaccacacaguuaagaagcuacaaaggcgagcccgaugggaagcgguagggacuugaguuggugaggcagcagugcacuuauucuggauaugucuugggagaagagcuaauaauacuuacugaugaauagaaauguggggcagcaguuaggaaagaggauggucaaagaaccagucagugcaggcauacuucauuucacugcauuuugcuuuacugugcuucucagauauugcauuuuuagaccaacuaauaacccuacaaucgccuuuuaaguguucaagugaaaggaagugucacacaucucucacuuuaaaucaaaaaguagaaacgauaaagcuuaguaaagaaggcaugccagaagccaaagacaggccaaaagcuaggccucuugggccaaacagccacgcugugaaugcaaaggacaaguuauugaaggaaauuaaaagugcuacuccagugaacacacaaacaguaagaaaguaaaacacuuauugcugauagggagaguuugaguggucuggauagaagaucaaacaagccacaacauucccuuaagccaaagccuaauccagagcaagguccuaacucucuccaauuguaugaagucugagagaggugaggaagcuacagaaaacaagucugaagcuagcagagauuggucaugagguucaaggaaagaagccauuuccauaauauaaaaugucgaggugaagcagcaagugcuaauacagaagcugcagcaaguuuuccagaagagcuggcaaagauaaucaaugaaguugaccauauuaaacaauagauuuucgauagugacaaaacagccuucuauuggaaggcgaugccaucaaggacuguccuagcuagagaggagaaguuagugccuggcuucaaagcuucaaugaacaaacugaaucucuuguuaggggcuacugcagauggugacuuuaaguugaagucagugguccuugagcauucugaaaauccuggaucccuuaagaaugauacuacaucaacucugccugugcucuguaaauggaacaacaaagccgggaugacagcacaucugucuguugcaugauuuacugaauuuuuuaagcccccucuugagaccuacugcucaggaaaaaacauucuuuuccaaauauuacugcuuacugaugauguaccuggucacccaagggcucugauagagauguacaaggagaugaauguuguuuucacacuugcuaauacaauaucuauucugcagcccacagaucaaggaggaauucugacuuucaagucuuauuaauuaaauacauuuuguaaggcuauaacugucauggacagugacuccucugauggaucugggcaaaguaaauugaaaaccuggaaaggauucaccauucuagaagccauuaagaacauucauaaugcaugggaggucaacaugaacauaguuuagaagaaguugauuccagcccucauggaugacuuugagggguucaagacaucaguggugaaaaaagcaggaaaacuagaauuagaaguaaagccugaagacgugacuguauugcuguaaucucaugaucaaacuugaacagaugagaaauugcuuuuuaugggugagcaaagaaagugauuucuugagaugaaaucaacuccuagugaagaugaugugaacauugucgaaaugacaacaaagaauuuggaccauuauaccaacuugguugauaaaacaacagcacugucaaagacgauuaacucuaauuuuaaaauaaguucuacuaugaguaaaaugcuauuaaauagcauuacauucuacagagaaaccuuucauuaaaggaagaaucaaucaguauggcaaacuucauuuuuauuguaagaaaucgccacaaccacccaacuuucagcaaccaccaccaugaucagucagcagccaucaacauugaggcaagaccuucccauuuuuauuguucacauuuuuuagcaauaaaguauuuuuaauuaagguauguacacuuuuuaggaauaaugauauugcauacuuaauagacuacagcuaaguguaaauauagcuuguauaugcauugggaaacuaaaauucacaugacugauuuauugcgauagucacuuuuucacagugguguguaucugaacccauaauaucuuugagguauggcuguaccccuacgaggcauggaggugggcauacuacccaugcugcccccaagcacuauggcugaccccuugcugggcugaucccaaauacaaaauacaagaauucauaaacaauacaacacuuuccguuaauggagaaugcuauaacaccuaguucccacuucuauucuucaccguuggauucuaauagaugccuguuauuccuuuaaaaauaugagagcaauggauuucauuuacaaaaaagggaaauuaguuacacaacaaaaugaauacucagaaaaauauuucaagcaaauagauaaaagaccacuuuuaaaaaucugaauauccaagauaacuugcucucguaaaaguuugugauuggcaauaagagacagauugaaaacugcuagacuuuucaaaaaaccagcuccuggauucacugauuuuuugaaggguuuuuugugucucuauuuccuucaguuccgcucugaucuuaguuauuucuugccuucugcuagcuuuugaauguguuugcucuugcuucucuaguucuuuuaauugugauguuagggugucaauuuuagaucuuuccugcuuucucuuaugggcauuuagugcuauaaauuucccucuacacacugcuuugaaugugucccagagauucugguauguugugucuuuguucucauugguuucaaagaacaucuuuauuucugccuucauuuuuuuauguacccaguagucauucaggagcacguuguucaguuuccauguaguugagugguuuugagugaguuucuuaauccugaauucuaguuugauugcccuguggucugagaguuuguuuuaauuucuguucuuuuacauuugcugaggagugcuuuacuuccaacuaaguggucaauuuuggaaucagugcggugcggugcugagaagaauguauauucuguugauuugggguugagaguucuguagaugaucaaguggguuucaucccugggaugcaaggcugguucaacauacgcaaaucaauaaacguaauccagcauauaaacagaaccaacgacaaaaaccacaugauuaucucaauagaugcagaaaaggccuuugacaaaauucaacaacgcuucaugcuaaaaacucucaauaaaugagguauugaugagacguaucucaaaauaauaagagcuaucuaugaccaaccaacagccaauauuauacugaaugggcaaaaacuggaagcauucccuuugaaaacuggcacaagacagggaugcccucucucaccacuccuauucaacauaguguuggaagcucuggccagggcaaucaggcaggagaaggaaauaaagggcauucaguuaagaaaagaggaagucaaauugucccuguuugcagaugacaugauuguauaucuagaaaaccccauugucucagcccaaaaucuccuuaagcugauaggcaacuucagcaaagucucaagauacaaaaucaaugugcaaaaaucacaagcauucuuauacaccaacaacagacaaacagagagccaaaucaugagugaacucccauucacaauugcuucaaagagaagaaaauaccuaggaauccaacuuacaagggaugugaaggaccucuucaaggagaacuacaaaccacugcucaaagaaauaaaagaggauacaaacaaauggaagaacauuccaugcucauggguaggaagaaucaauaucgugaaaauggccauacugcccaagguaauuuauagauucaaugucauccccaucaagcuaccaaugacuuucuucacagaauuggaaaaaacuacuuuaaaguucuuauggaaccaaaaaagagcccacacugccaagucaauccuaagccaaaagaacaaagcuggaggcaucacgcuaccugacuucgaacuauacuacaaggcuacaguaaccaaaacagcaugguacugguaccaaaacagagauauagaucaauggaacagaacagagcccucagaaauaaugccacauaucuacaaccaucugaucuuugacaaaccugacaaaagaaacggggaaaggauucucuauuuaauaaauggugcugggaaaacugguuagccauauauagaaagcugaaacuggaucccuuccuuacaccuuauacaaaaauuaauucaagauggauuaaagacuuaaauguuagaccuaaaaccauaaaaacccuagaagaaaaccuaggcaauaccauucaggacauaaguaugggcaaggacuucauguccaaaacacuaaaagcaauggcaacaaaagccaaaauugacaaaugggaucuaauuaaacuaaagagcuucugcacagcaaaagaaacuaccaucagagugaacaggccaccuacagaaugggagaaaauuuuugcagucuacccaucugacaaagggcuaauauccagaaucuacaaugaacucaaacaaaucuacaagaaaaaaacaaacagucccagcaaaaagugggugaaggauaugaacagacacuucucaaaagaagacauuuaugcagccaaaagacacgugaaaaaaacgcucaucaucacuggccaucagagaaaugcaaaacaaauccgcaaugagauaccaucucucaccaguuagaauggcaaucauuaaaaagucaggaaacaacaggugcuggagaggauguggagaaauaggaacacuuuacaguguuggugggacuguaaacuaguucaaccauuguggaagucaguguggcaauuccucagggaucuugaacuagaaaugccauuuggcccagcaaucccauuacugaguauauacccaaaggauuauaaaucaugcugcuauaaagacacaugcacacacauguuuauugcggcacuacucacaauagcaaagacuuggaacugacccacauguccaacaaugauagacuggauuaacaaaauguggcacacauacaccauggaauacuaugcagccauaaaaaaugaugaguucauauccuuuauagggacauggaugaagcuggaaaccaucauucucagcaaacuaucacaaggacaaaaaaccaaauaccgcguguucucacucauaggugggaauugaacaaugagaacacauggacacaggaaggggaacaucacacaccagggccuguugugggguggagggaggggggagggauagcauuaggagauauaccuaauguuaaaucacgaguugaugggugcagcacaccaacauggcacauguauacauauguaacuaaccuguacauucugcacauguacccugaaacuuaaaguauaauaaaaauuaaaaaaaaagaaaagaaaacuucuagacuucccaacacuuugagaaacaguugccaccuaacuacuaaagcaaaaugaacuaaaccuaccacuggaacucaaccuuuaggcauuuuaaaaggccauuuuuaaugaauucccuuucagcucuuagucaagcucaucuuuuugaauucgaucuuuauuuuuaacaggagcacauacuuaaagagguagaagguaugaagaggucagcagugaucaucuuuacuuauaagagacaaagcauuccucuuggaaaagucaccauaccauuuuggggacuuaaacuuugaauauuuuuucaagaaaacacauuuaugacaauucauuaugcuagagauucuuuuuuuuuuuuuccuuucaaaaauauuuuccauuuuaugucuucuaaggcugaugaaaacaggccuuccaacucugggcuugccuuauugccugucuguggcugaaacccaaacauuuuccuauuacaguuuaaguguuuuuauguauguuuuauacccaaauucaguaaagguuugacauagaccaagguaacauuucaggcaguaucuuuaaaauagaaaucuauuuucagauuccaggauguagaacaguugguuuugaauuuauaacuuugauaccagcauuuuccucuuuaauuguacuucuaaggauaccuccuggccaccaaaggacacuggcgugguuuauuucaguacugugauaaagugauugagaacugagauuuuauucccaaagaggcuaacuccuuuaucuuauucuaaagccaauuauuuugcaaauuagauccacugcuuacauaguaugacaugugaauagauguaaggaaauccaucacuacuacuccaagcauaugccuacugaguaaugaguuagcaggaucaccuucauguuugaagacaccaggacgauauaguagaggagaacguaagcucuagugucagaacgccuggguucuuauuccaucuggcuagcuaggagacuuugggcaagucccuccccuacaucucaguuuccccauuuauacucaauggcaguacuucccaaauuagucaccucauauuuagagauauuuauuuauuaauacuauauauauauauauauauauauauauauauuuuuuuuuuuuuuagacagaguuuugcuauugucacccaggcuggagugcaacggcacaaucucggcucacugcaaccuucgccucacagguucaagugauucuccugccucauauauagcugcuuuauugagauguaauucacauaucauacaauucacccauugauguaauucacccaaaugauacaauucaaugguuuuuaaucuauuuacccagugguacaaucauuacuacaaucaauucuagaauguuuucaucacugccuagggaucuuuaaaaauuccaaagcccagacuaugccacaaaucaauuauaucacagucuauggcggugggacacagacaucaguaguuugcgaagcuccccagguaauuccauugcacagauauguuugggaagccaugcugcacuggaaucacugucagaguuucagggaaaauaaacacagaaauaaagaaagaggagauguucagcagagagacuguccuaugauaacauaagcacagaagugguggugagaauaaucauacugaggacgaauuuaaugggaaagacuauuuaaagaauuacacugcaacuuuuauaaucgggacuaaaauagcaauuuuuuuacucguugguaauacaucuccaggcacagcauccucugagaguauguauaaguugggaauaagaguguugagguaggaaagggaucaggaggagauaagaaccuguaacuuaucuaacacauuucaagacauuaccaagcuucuuggccuucuaaaaagcuccugguuagccuuacaggaugccacugaagugccaccccuuugugaaaucuuuucccacugaagucacaguuugaugcuucuuaaagcucugcguuuggcauaauacagcaauuaucacccagagucauauacuucagaaguuggucaccuucaccagggcaagaguucuuugaaggcagaaacaauacuuaguacauuaaaaaauuaaaaaaaaaaaaaaaaaacuaucucaagagccuagcgcauguuauggcacaguguugacaaauauuuguuggacugaaccaaagcaaauucacauccacuacugucaacacaaaaaugaaaaaaaaauagugcacuaguuccaaaguucccagaacacuuaggggccauuguagcucucagaagacuggcaagcaagaccugcaauuuuacucuauaagggacauuguaagagcaaagcuugggguacuuaauaacuccacuaaauaaauggcacaaccacaagcuguuauuaggaacacugaauagaggcugggcacaguggcucucaccuguaaucccagcacuuugggaggccgaggcagguagaucacaugaggucagguguucgagaccagccuggccaacacggugacaucccaucuccccgucucuacuaaaaauacaaaaauuagccaggcuuggugaugugcgccuguaaucccagcuacucgggagacugaggcaggagaaucacuugaaccugguaagcagagguggcagugagcugagauugcaucacugcacuccagccugggcaacagggcaagacuccaucgcaaaaaaaaaaaaaaaaaaaaaaaaaaaagaacaaugaaugacguauuaccaacacugagaucaagaaaaaaaauugccauccaggggaaaaagauuaauuaauaucaauuaauuuucuuuuacaggaguagauuauacagaagucuuuaggcuucugaggagaauuugagaaaauuuuacaguaaacaggaauuugcauacgcucugggagcaaaaaguguguccccagacaggucaccugggguauguucaagaugaagaacaaaagucgggcauuucucuaaguguagagucaggagggugcaaauaaaggcaggcuuuagagggaauagagaaacuuuuggauucaaaagaaauacaauuaucauuacaauagagcuacaugguuacacaauaagcaauacuauuaagcacccucucuggaaagaguguucuuugaaaaacaaaaugcagaacagauccaaaagcaagguaacaaaagcuauuaggugaaguccaucagaggaagaauucucuuuccauagcaucuuccuucaaguacaagauaauuauguuuuauuuauggcacaggaauagaauaugagauucaccauucaauaaacucaggaaaaucauuucuuuggucauugcuuuuuauuuauaaaaugacggcuuggaucaagguaguguuucccaagguuuucuuucuuucuuuuuuuugggggggaagauuuaacaggcauuacuugaagaaacuuagagucaauagauucuaaauuauggucacuugaaaccagcaccacaagauuacccaucaagaccuaaucaaccaaauuaacaauuaguauuugggcagaaaguugaugcaauaucuccaauaucaaggcaguacagacugcuuugaaacugauauucuucucugugcaugcauauacacacacagacacacacacacucauacacacauauauuuauaauuccuucuaaauauuugaauguucauauauauaauucuuucuuuuuaauuacuccaagcugagcauguguagguuagauucacucuguuuuauaauauuuauuguguuuauagaauauguccaucacauccuagccccuaggcauguuuacaaauaagauaggaaaaaaagagacuguugauaacauaauggcuaaaaauccacagccaauauuuucagaaagaucacacaaaugcacauacaugcauacacacacagacacacacacacucuaucuacagaucauccugguauccaaugugaauuccaucaguauucucagugcaaaccacacccugugguuucuuuuccuacucccuacacaacuucugccaucuugagucuuaaaauauaaaacaaaaaaauauaugguccauugauggaaaggauagaaggcuuuagaugggagacagggucagauucaucacaucauuucuuuugacagccuagcacagggguuaauguuggcuggggagauggaaaaaggaaagagguaaugggagcagaccugggaccaguuggucagcaacucgcagaguucuuuaaucaccaacaaccucccuguacugaggcaacaugcugcuaaaugcucaacauacagcauuucguuucauccucuugaugucccuacaagguaguuccuauuauuuccauauuucacuugauaaaacugaggcccaaguuacaaaauaucccaaguuacaaagcuacuaaguggcaggcucaggaccugcacccaggucuucccaaggccaaaguuuagacucuucaccagaacugcuuggcuuuuugcuagaaagccuggggucaggaagguuaaccauucacaaagagcucagaaguggcaaggccuggauggaaugcaaucaugaggacaacauggggcacuguccauaacugugugauauugcacuuucccugaucaaacguccccucugaggguguccuagggacauuugagaccauuucccucugacacaucccuucuucugcagaagcacccaucuccuuuagaauuugaauuucugcuaaaaaguagaugcuuuccucacaaauguccccuccuccuguauucuuucuccucuuggaucuccaaacuaaaaacuguaguggguauagaaaggagagucucaagugcugugaaaaucuuucuagaggacuuucaucccuucccaacagccugcaauguggacuucuguccccucaguaacaaaccguacauguccuuccugaacugagaacgaaccugcagcauccagagcagcucuaagaagcaggagaagacaaaaaaggcaugcagcucccugcugcucucaggaaaggggagagaagcgcagcugccuccguucaaggcugggugagagugaugagucaaaugacugucaucauuuggauucugacauuucuuccucuacagagaaaacgaaagagucugcuauuggugaucauucauucugcguucauuuaugucuuguguacuuuuuuuuuuuauuuuucgagauggagucuugcucugucacccaggcuggggcgcagugacgugaucucagcucacuauaaccucugccucccagguucaagugauuauccugccucagccuccugaguagcuggaauuacaggcaagcaccaccacaccuggauaauuuuuguacuuuuaguagagacagcauuucaccauguuggccaggcuggucuugaacuccugaccucaagcgauccacccgccucagccucccaaagugcuggcauuacagacgggagccaccacgucugguuaguauuauguacuucugacuauuguguucuacuuuccgauuuaaacaaugaucccagcagcuaugggagcuacaaagagccaggaguuuggaagcuuuucaagacacugugagcccucuccuuuuauccugacuucuuucucacuuucugccuuuucuugaagaacaagaaaagcaacuccaguggaaaccacuuaagccugcaauuuagcucacaaauuguccccagcauccuuguaucuccuucuccaacuccuuuuuuuuuuuuuuaaccuuagcucuuccugaugauugugagcauagcucagaguaaugccaacuguugcuguaucagcuuaaaucagugugguaccuggugauggggcacaguugaggcaggcacuacgagcuuagacgagccuucagccccaacugaaagggauauauuguggagcacucacgcauucuauagcccccuccuaaucccucaagaaucccaggcugggaauggcugcaacuucaggauuguaaaguuguguaaacacaucuuuacauugacuacaucaugguccaacguaacacuuugaaacaaagggcuugagugugucccuguaccccuucauuccugaguuaaaaacaaagcuccaucagucgacucauauuuauagagugcucccugcucaucuccuuucaguccuuccgcuugccaggguaagaaaauuuagugcagacgaucccagccuucccagacuucccuccuccuuccugacagaauuaguuguugccccccaccccccauguuuuaucauagcccuuugcacacuguguuccccuuauuuauaugcuugucucuccaguugacucugagcuucuugagguugggaacaucguuugugccugucacaucuuuaugggcccaagaauagagaugauaggcaaaaguggaguaaagaauaaaggaagaauaaacauuuuuaaaaucagucuccaaagaguuuuccuucuggcagguaagacaaggcauacagugagacaugaggcaaggcaguaaguaauaagggucagaauaaaaaggaaaaagaaagcgacuguuggacuuggcugaguagguugauagcaagcuaguaagaaacaugaguagguaucaaauagacacaggugcaaaaacagggcugagaaagguaugucggaagggaugucuaguuccaaagugugcugagauuaaggaauuagaaauguaagcugagcuccagauacuggaagacuuuuaguaucaaacaaacaauuccauuuuuuucuuuugucuaaacauuagagauggguacacaaagaauauuuaccugguuggaauguccagaaggacuguaguggacuggaacucauggaagggagacccaauggaaacuguagaaacaggcuuacacaauagcagaggaaacccuuaauaguuauuuuaaucaaauaagauuuucauuuaaaagaaugaaagaauuaagaagaccacaguauaaaauguaaggaauaaaguuuauagagagcaacuggcaucggagacagaauucacaggucagaagagaacuuacaaacauaaguuccaguucuuggagagaugcaagaacauacugcuccuauaaguuaagaacagguuguuuguucaucagaaaauagaauuuuaugccuuacgguucacaugaagaguugugaaugaaaguaugagcagugcaaaggaacaaugagggaugccgggacaccaaagacuagcaacgggaggaagccaugacuaccacaacugcugaaaggacaagggcaaaacagcauuacucaaagccacuggcagccacagucacggaggccaagaugacuggugggagauguaguugcagaaggacacaguuacuaucgucuggcaaauaaaggagggaaugaguauacucaccuccuucucuucacacccuguaaacuuacacuaaugccucccauugagcaaacaccagggaggaaguccaggagacgcaagacagagacggguagaaguugaaccucaggcaaaacaaagauuacccaacacaaggcuguauaaaaaaggaaaaaaucaguuuaagaggcaagagcgucauuggaaauuaagaauaugauugguaaaauuuuuuuaaaaaauacaagaaauggaaggcaaggcaccaaacauuuccuaggacaaaaagauaaggagguggaaaauaugagagaaacgucaggaagcacagaagaggggucccagagagagcucugaguuuaauaaacaccaaggguauggugucugcaaaugcuccagggaaaaacacaagcaaaaggaaagaaaugcaaccugaaaauucuuuaggauucaauaacacguaaugauaaaacaguuucuuugccccgaguccuuggagcauaaaaaaaucugggacaauccguucccuuaccacaucagaaaagcaacuuuuuguuucgaaaggucuguggugaaacacaauuccaugacguuaaucaauuuauuucaauugggagugaagcauaaaugaaaaguuccuauuucagaacagaccgugaaaaugugaagauguuauuauuuccaagcuaaaaggagaugugagauucucugccuggcacauuucagaaagguacaaucagccggggcaggggaauagauuuaaaauagaaaaguaaugggaaaagugcuuuccauguaacagacagggugguggaugaaaaccuaucccccuaaagcccacuuuauuaauauacauuuuacuaggcacuuuggaaaguuugaaaauccacaugcuucucauuucccauagcuucugggucuaauuacauauuugcauccauuugcauacacacacacacacacacacacacacacacaggucucauccagugauauagauaauucaauauucaacuugucgaucaucaccuuaaaauagagaucuaauuauggaaaaaaauuguaugcuguuuuucaaauaaauaaaaaggaggacacugauuaaaaauauaacaccccucauugaucaacagguaccuuuuugguuuuaaccuaucauaaacaugagguuugguacuacaugguucuggcccucccaaauuaacacugagcuaguucagggaacaagcucucacauaccaaauucugaagcugccuuucagcagcaauuugagggaccaagaacauaggcuuuccaaaugucuagaagcuaaccagauuccucucuccuuaauuuagccccuuacauuaggugccccaugcucucuuuugggucaaaaauaacagggacaauuuaauacccuaugacuguccauuaaauaucugaauuaugaggauucagauguaaagugcaauaguauuuuaauaaaaguacacuaaauaaggaagcugguaauagaccucuuaacgaaaacguagucaaugguucauuuaauuugauggcagaguccacuuucaaauaaucccaaaaguguauauuuuguaagaaaaagguugcagaguucaccucaggguauucuuaaaaaauuguuugcacacugagaagacaucagugcuaagaggcuuuccugauuacugaaauuugguuggaagucuuuuuuauuucuauuaaaugaauauauacaaccguucggcugccucaggacauuuaugaaaaugagaugcucugucuuaaggaaguuagcuuuaagagcgacauuugaaucauuagaugccucauuggcuguuacaaaaacaaacuucaaucuucugcuuccccuuuucuaauauuagcuaacaauaauuaaguugcuuagacaauuccaggugacucaaauuucauagcacgcucuucaaaaggcuaagggaucacuuuaaguuccuaaagcccuaagacuaaguguguuucacucacuuuguguagcuccagcccagcaucauguaccaaagggauaacaugauuaaaaaucaucaacuugucuuccgaaaucuguuucuaaaccacagcacaaggaacagacauuuaaauacagaaagggauggagaacuacaaucuuuuaaaagugcacacuuuagugcccagugugguggcucacaccuguaaucccagcacuuugggaggccgagguggguggaucacaaggucaagauauugagaccauccuggccaacauggugaaucccugucucuacuaaaaauacaaaaauuagcugaguaugguggugugcacuuguagucccagcuacucaggaggcugacgcaggagaaucacuugaaccugggaggcagagguugcagugagccgagaucucaccacugcacucuggccugggcgaaagagcaugacuccaucuacaaaacacacacacacacacacacacacacacacacacacgauaaauauucacaucaucugccuuugguuauucaaccuauaguuuaucaugggaaacaagaucuuauucuuauaaaguaccugcauauuuucauuugcuagaaauuaaccaauucagcuuauaucauauguggcacaagguuuugucaugaggaggacauuuaaagaauaauuuaaaagaaaacaaguucaaacguucacauaaaacaaaauagccaucucuaaggagaaaauggguauugcugauccuaauguuaauauucuaaaauaaaugaaacauuuuugaagggaguauucaccaccacagcuaaagaaagccacaaaaauuaguguauaugugccuauauuuauauagguacauuucccaauuuuauucuuuuacuauuacagauagcuaauuccuaggaaacauuuucuagaugucuucuuuuauauaccaugucuuuggacauuaauuacaggcaaagaaaguaaacacucacaagaaaaagggaauuuuacaaucugaucuucaauguuaucucaagaaaugcuguuauagcuccuugguucugguuuccaugcaccugcaaauuguccuuucacccaucacuuguaaguaguagaggagcaagcauaccuguacagucaugcauugcuuaacaaugagaaguucugagaaaugcaucauuaggcaauuuugucauagcacaaacaucauaagagugcacuuacacaaaccuagauagguauagcccacuauacacauaggcuauacgcuauaugcuauaugcuguaaccuauugcuuuuaggcaacaauucuuuacugcauguuaacauacugaauacuguagauaacuguaacacaaguauauuuguguaucuaaauauagaaaagguacaguaaaaauauauuauaaucuuaugaaaccucaguuguauguguacucuaccacugaucaaaaugucauuauguggugcaugacuguaugugaacauuucuugaucauaaaaauaaaguguauguugacuuaguuagugcccuggcaaguuaauauguauguugacaaacuauaaugcuuaacaugaguaugguuaaaauaacacuaugugaauauauaaacacaugucuauacauauacacauauauaccuauauauacacacacauauaaauauauacaugcuuauaaauuacagucugucuuacauuagcuaaacuauuacuacaguuugagauaaauuugagauguuacaauuggaaaucuccuguuucaauuugagaagggaaaauguuggcauauucuccugaguggagaaagaggcuuucuaugucagcagauacuucagaggaacguuaaugucucgagguuucuagcaaauuaacagcccagguaacaaaaugcagggaacucuggccaguugcuuacuuacucaguuggaucuggccacuucuccauguauucccaccacacuaaauggagcaugagucauuugaguaaugagucagaaaaugucuagcagccuccgugcaauagcagacgugaugcuuaagauaaauuucagagauacuaggaugguguuuuucaugucugcacaucucucauuggugaugaauaaaauuccuucucccuucccaagagacaaaaacuguaucauaugcuauccugaggcucguuccaacucuaaaauuuaaaauuucaagcaaaaccuauagaaagaggcaaauacaguguauaaaugucuacaauuuguguccuauucaaaauuaguuuuuguggaauguugucuaauggauucaguggucacguuaaugacaacuucacucccaaguacuacaugcccuguuaaagaaaaaaugcuuaagugaacaaaaaauuuaaacaaauuuuggaguucagugaaauuaaugaauaaucucuuuuucaaucaucccugauuuuuuaaaaucacaauaccuaaauuaugaugauaggaauuacuacuagacuuugaguuuuaaucccaguaacaucuuuagcugauuuaaaccuauuucaacuuccauuuuaauauuucaucucauuuuaucuguaugguuaauauuaauuuccuuuuugcaccuucugguuguagcacaaagccagcuauacaauaguugugugcugcugaauggaauuugaaggcaauauaaaauaauguacagcaucacugaacuggggauuaaaaaucccaaguuugaguacugucuuggcaaugcacugccuuugucacucagguaagucacuucuuccuuacaaaaguuucuuccauuacagguuucaccucucaugacaauuccuaucaauuaguugaggcugucuggaguaauuaggcaggacgcuggugggauggagugccaugauugaugagugaugccugccaaggguguaugacagcgaagugguagcaauuuuguccuguacuuggcaauuguagauuagaacagggcugcucaaaugugcaucuaucaccaggaagcuuuuaaaaugcagauucugauuaagucuggggcgguggcugagauugcauaguucuaauaggauuccagguggugcugaugcugcggaguuagagaguacacaagaagcaaggcaaagucccuugcagcucugaaugaauauggaaucucaaccucucauucucucuugcucacucgcacacacauuauuucuacuuuauguaugugaaaaggugcuuacauaugccaagaauacugacaagcacauuaaauacguaauucucauccucccccacaaaagguaguuagaaguuuucagguaagaaaauggagauuuaaagaggguaaguaauuugucuaacaucacagagcugacaaguagucuagaugagagaugaaccuagagaacuuaauucuaguaccuugcucuugaccucuaucauaugcugucuugauacuguaacaacauuagacugcuuacuuagugccagccacuaggcuguuuuguacauauuaucuccucuacuuuucuuaagaacucuaggagguagguaauauuuuuguuuuacagauaacaaaauuaauuauccuuccacugucucaaucucgguaaaaccauagugauuccuauuaaguaaaacauuagauucauaucuauaaugaacuaaacacaaagaacaguaggcuaauaaaagcaacauguauaugcauaaggcuaagaguaaauauauaaaaauauucuuuuauaaauucauccuauguaaaugcauuuuugacagguaaacucaaauguuucugcagaguuuagugaugagguuaucaaaguccaagugauuauuggucccaaacagaauccaucagugggauuuacagugggagaaguaucaaagauucuuuuuucaucauacucuuuuacuaccuaaaaguucuuuauuagcaagcaaaugaaauaagauuggaucaguaaauuucccuggagaugagauuucaauauaagcaggugacaguggaugcugcaccgaugcacacuuaagaagagcaaacaccauugcaaugugagggcaggauuuuugcuuuacuuuguuuaaaaaaacaaaagugugcuucaaaaccuaagggucugaagcagugauucucaaccuuggcuggaggcugcacuuuggaaucaaguguguagaggggacuuaaaaaauacugaugccuagauccccuagagauucugauuuauuuggacuggggugcaaccgagacaucaggauauuuuuaagcuucuuaguuuuuaaauguauaaccaagguugagaaucauuugaauauaggcauaccugucccauguggggggcgacuagucauuaaaggcaugaaugucuaauugaugaaugcccucgucagagcagacugguggcauucagagagcagcaaagacuuucucccuugaaguuaagcuuaaauuucauaaguaagucuauuuuaacagaaaauuuuauaaaacauuuguagauagucugaacuacgaaaaucauuuucuccccuuaccagaauuauuuccacuggagggcagucuccucuugggaagaaaugaaugcggauacaaccuucuuaacagaccaaaguuuaaaauauugacuaagacuguggcauucacauggguuucauuucaagacaauuucugggagauggaguauuugggauaaaaaaaaauguguauucuaugugaagauacugccaaauuaaagguuuauuucugucugcuaaaacuaaaaggauaaaagcuuaacccaaaagauaaacacauccacauauggaagacccugggguguacaaacauaacaacaacaaauagaaaguagcauuuauuauagguuuacugugugucagauccuguacuaagcaauuuaaauauccuacuugauucucagaacaaaucuauauuuuauagguaagaaaacuaaagcugagaaguguucaaagaaauguguccaauaccacauaucaaaaaaguagcugagcuaggacuugaacccuaucugccugacuucaaaaccagcccuugcaaucaccaaugauaccgcuuuacugcuugagugagaagcaacauggucccuaugcguaagacaagcgucuaaaucagaacaugucaacacaagaaaacaggaggaaaaaacucucuuuacacagcauuagguaaugaaagaaacugaaaggaggugauucgggcagaaugagaaauuccuuauucuccuuacugguuuuauauuuuaacaguuuucacaaacuguuuuugguuccucuucauuucuuaugcaaacccuuuccaauccauuaaaaauaaauuuggcauucccauugcuaugucuucagccgcuguacagaaccuuggacuagcuggucauauuccucagagacuuauuuccuagaucagggguugucaaacguuuucuguaaagagcuggauaguaaauauuucagguucuucaggccccacggucuuggcugcaacuacucaauucugccaguguagcaugaaagcagccagagaugaugugaggauauagaugacagacgauaugaacaaaaagggcaagacuggauuccaauaaaacuuuauuuauggucacuaaaacuugaguuucacaucauuuucaugugucaccaauuauuauucuucuuucuauucuuuuucaaccauucaaaaauguaaaaguuaucuuuagcuuaugagccacauaaaaacaugcuguggccuggauucagugggcaggugguaauuugccaauccccguccugaauaagguguccuguauucauuugccauaacgcaaaggucuugucacaaagauaucuagcaauggcuccaugcucaaagagcaaauguauccccagauaccaucagcuaguauuucagaaucagcugccuucccccaaaccacuuuuugcuauuguauacaaauucucucaguaguaaaaguaucccaguuaaaucacaucagcacucugggaaauauucuucuuggggaaauauuacagaaucuggaaucugaaaaugauccagaaggucacagagggcugucauuucccaaaggcauucuccagagccuccaagcuccucacagcugcagauacagguauagguacaguuccuuagagaaaauagcuccacagaaugaccaggaccuaagaaagcucuuagcaggggugugcuagagccaucuccuaucagcucauagaagaacucauuauauuuuucagcauuuugugagccaguugacaugaguugauaaccugaaauuggccauggugggagcaucagcaccacagaaauucagaaauguguauucacaaguguuacaaauuaggcuuuuuuuccccucugagagcaauuguuaaacauuggccagcauaccucuauccauuaccccuuuccaacagacaaacuccucuuagaucuguuuuacacauacacacauacaacccuugugagcugcgguggcgguggcaguaacuguggguucagggaaaggaaagaauuuccccaaguaauaaacaaauguauuuaggauuaaucaccauuuuagaucauccuugaguuacuacucccuuuggaaucccaaaugcauuccccuuuuauauuaaauauggucaacuggagacuaaggaguucaaucauuuuugcauaggaucagaaauuuaucagaaucuuuuaucuucaauuaucuucuguaauuuuauguguucaucuaacauggacaaaaggaaagaaguuacaaaguccugcacugcauuguacaacugugauccaagaggugccauuuucacuucugcaucaugcuaauuauccaugagccuauucccuuuuuuauuuuugcuacuacugaaugaagauccuuacaauguaauaucuagcaauguucuaauguuccugaacuauauauuauuuguuuuuaagcaagaggcucucugauuauuucugguuccuggucucacuccacuaaacuacaugagcccauaaaccuaaucuaaacaaaucauuuugaauuuauuuuuucugcauuugcugccuucaucuuaguuuugcaucacuucaggcaucaacaaaacuauuuuaauacaauccuuucccucuacuucugcaagauuagaaaauaaaagagaacauuuauagcuacuaggugagcuggaauaucuaaaaagggauuauaucccucccuauuugucaauaaauaugacaauaguucaugugagaguaagcugaagcugaguggccuauaacuaauucugaaaauuucuaagcuuuagaaaaggauauccaggacuugaaugcuccugaaacgauacaacacauucaugcguaaucagagauacguagauucaaauaaaucuaccucuacaaucuucagaaagcaauuuuuggagucagacacaggugcauuuuguuagaguuuacugaaacucuuuacauuguaaagcuguagugguagucacccuuaaguuauucauagacaauuucaauuauuuauucauagacucacaugauguuauuuuucauucagauccaaagcuuguuacacauucugcaacaaaauauuuaaugaaauuccaagacuuaaaaaaucuugcagugaaagcaagaaagaccuaucaauacugagucaacagaguggaccuaccaauucaaccaggcuugguacccaaaggcacaacucaacauaaaguuaacauuucacuauguaaauucuaacuccaguuucuuuuugaaacacaccuuccggucaucuauuuuuccuucuugaucuguucauaagucauaggacagaaucaauuaccuaggacccuuucauugucaaugaaaauauauuucccaaaguggguucugugaaacacuauuauaggcauuauuacaguuguuuuacuauuuuuuuuaauuccagauuuggauaaauuugggagauguggguuuucacuccuuggggacuucucagagcccuuaguauauuaauguacaucagaacucuccaaguagggcauuagaacauacaguauuauccauacauuuuaaaacaaaagaauuuucuucucauggagaaucucauuggacuaguaucccacgaagcacacuuucaagaaugcugguuuauaagacacagcugagauuugcauauaggcaccaaaaguggaaccacagagaaagggggaaaucaucugagaucccucucacaugagcacacuggcugcaguaaaaugagcaauagaaacugcugaguucuuuuacaucuauuuccagauccugucaaaaugaauaaauaaagguaagcaggguaggaggacagcaauccugugaaauaaccuccccccagucuauuugauaguuuccaugacuugaucauugacucaucaaaauagacagaugugcucuuauccagcaaaguuuaaaguuagagauaaaaacaacaacaaaaaccugagcuucaccuucagcaaagaagugucagcuggagacuuuagaaauucaaagagguaaaaacagaacuaucauucaacccagaaauccccuuacuggauauaaacccagagaaauauaaaucauucuaccauaaagacacaugcacaaguauguucacugcagcacuauucacaaaagcaaagacauggaaucaaccuaaaugcccagcaaugauagacugaauaaagaaaauguuguauauauacaccauggaauacuaugcagccauaaaaaaagaacaagaucacgucuuuugcagaaauguggauagagcuggaggccauuauacuuagaaaaccaaagcaagaacagaaaaccaaauacugcaugagcuuacucauaacuaggugcuaaaugaugaaaacucauggauacaaagaggcgaacaauagacaaugggaccugcuugagggcagaggguuggaggagaaagaggagcaaaaaaaauaacuauuagguacuaugccuaguaccugggugaugaaauaaacuguacaauaaacccacaugacaugaguuuaccuauguaacaaaccugcaccuguaccccugaaccuaaaauaaaaauuuuaaaaaauucaaacauccugccuaggauuacaaauuuauuaaaaaauuauuuccuuccaucuaagcucucuaucagaaaaguaaucauggaaccaacccaaaugcccaucaauaacagacuagauaaagaaaaaguaguauauauacaccacggaauacuaugcagccaaaaaaggaaugagauaaugucauuugcagggacguggaugaagcuggaaaccaucaucuucagcaaacuaacacaggaacagaaaaccagacacgacauguucucacucauaagugggagcugaacaaugagaacacaugaacacugggaggggaacaucacacacuggggccaguuggcggguggggagcaagggaagagagagcauuaggacaaauagcuaauauaugcagggcuuaaaaccuagaugauggguugguagguucaguaaaccaccauggcacacauauguaacauguaacaaaccugcuuguucuuuacuuguaugcuggaacuuaaaauaaaauuuaaaaaaaacucaaaaagagaaaaaaguaaucaccugauauucaccgggauaaagaaaggaauuuagagaaaugucuuuugucccuacaguugaggcguaaaaccugacagugaggaugaaggcccuuagaagccacgcaguuccacuaacaagcccauguaguuauuucuaccuccauuaccugcugcuuuauuaauauaauuaaccacuauuuauugagcuucugcuaaugccaggcacuaugcuaggcuguaugccuauauuuuuauuuuauccucugaccaugguaacaucgguugucuuauuauccugauuucacagacuuggcacagagaaguuccgucucaugucaaagaucacacagccuggcugggguagaaucuguaucaggaggcaagucugccugacuccaaagaucaugcaaugccccuucuccuuuuuuuuuucccuuccaccacucuucugucaugccuuuucccuagcuauuaccauuuaaaagcaguugugauuaaaaacaaaggucagcuguccauaacuuaacucaaauguucuuucuuccuugcucuuagagacaaauuaccaucuuccaucauucacguggaccaagaaggauuuaggcugagaugauuaugcauaauaaucugggucucauuacaagcugagcacuuggaagggccauucucucagcccuuaaggcagcugaacuugaucauauuuucauuuucuuuucucccuauauccacuaaagaucaacugacacagaacaaaugaaguuacuaacaauuuacugauuucuuuaaaauauauaucuucaauaaaggaagaacaaacagucaaaugacugaaaucuaaguacggaaugugaaaaaugccacucucuaaaauucucaaaggaagagaagaaaauaaagaggggaaggagaaagagaggggaaggagaaagggagaaaaagaaucgaaggagggagagaggaauggaaggagggaaggaaggguauagagaucaucugcauuagaaucuucucaggcugggggucccugagcccacuccagaccaacugauucagaaccucuggggugggauccaagacugcauuugcacacacuccucucgugacuauaauuuuuuuaauucauuuauuuuugagacagggucuugcucuguugccuaggcuggagugcgguagcaugaucauggcucacuacagccucaaccucucaagcucaagugauccucuuggccucagcuucccaaaguguugggauuacaggugugagccaucaugccuguccuggugauuguaauuuacaccagauucaccuuacccuaagaagugacuuguauauguguugcuuauggaagucagaaguuucccaaguuuaagaauucagcauuuagcuccaggaaaaauuggucauaaauaugaugaugacacauaugugagacaaugacugcaugaguccaggaaagaauaaagacauucuccugagaaagacuccucguuggagccuauggguucuaccgggcaggugacucacccguuggagucacaggugacucagcaacaggguuauguaacaagaccaccuuccuuggugcuaauuuuagauuuaaauagagaaacuauuugaaugucaaauuaaccuuuuuauauagagagagaaaaaguauaacccaauguaagcacaagguaauaagcacagggcaacacauucaaacagaugcaaagcacguggagugaaaagugaguuuuccuuccaggcccaaccacuucuuucuggcacuucagaaacacacuuuguagaaccaaucacuuguauuugugugaacuccucccuguuaauacaaagggaggaagcccauuauacacacaguucucuccuucacuuuucccagaauaacauauccuggaggccauucuccacaguacauacacauuuacaucguucuuuugaacaucaucacaguccauguauuugaccaguucacuuuaauaaacauuuagacuuuuucuaauccuuugcuaauagaaaugaugcuauaaggaacacucuucuucauauggcuuuguccacgucgggggauauauuuuuaagauaacucuguggaagcaaaauggcaagggcaaaggauacaggcacuuuugagauauugccaaauuuucccucccaggaaguuguagcaauuuaaacuucuauuaauaguauaugauacuacuuguuucccccacaccuucaccaaagcaguauauuuuugauugugauuuaauuugccacuucgacuucuuacuggagaaagugcugaccagcaaacaugaauguaacuuggcagcuauauuucuccuggagaaugaauacauuggcauucuaauuuaucaucuucuuaugcauuagguaaguaugaaucuguggccuugacccucuucaacucuggguaaauuuacaaacuuuaguuucugggccugcuaacacaggugaacagugaugccuccaagagaggacacaucuacaagacugcuggaaggaguccucuuuuaauuuuacucuuccaaguuuuaaaaauaaauugcaaaauaauuuuucucuaauaaguuaacgauuuaaaauuguaauucaauuagaaauuuuuuuaaauauuaugaaccaaauuuuucuugcucaagucugcaagaagggaggaacucuguggaacgcuucagaucagaccaccuuggcggacaucaaagaucuaauucaaaugacaucuacucacagacucaguggucugcuucauggauucaaaaguuaaucaaaauucauacuacaaaugcuguuacuaaucgccacagcagcaaacuagaaccccuccuugcccaccacuuuuacacuccacccccagagaauaacagacaacaugcuguuucuuccaguaauucuuaggauguuauugauguauuguuuauuuuucauagaguccaugcacuuaggaggaaacagggcauaauauauaugcacuuucagaaaacuguuuuaauguuauaaauaauauccaaaaccauuaaugaguuuuagagguggcugccuugcagcggggaauuacuuaagcacuggaaagccaaucaacaaauauuuauuuugcaacuucugugugcaugccuaaaaaaucuuauuccauuaguaaaauaaguccaucuagaaaaauacauuaauucaacgcauauuuacuccacacucacauguugcaccacagcuccaagugugaaugaggcagagacccugcacucgaguuaggaagacacagccaacugaacugaugacuuaaacgcaaagggacagagcacaggcuauggcaggauuacagaaaaagggcuccucaucaagccuugagggaaucagggaaggcuuccaggaggaagcaaacugauaugauuuccaagaaggauucauccaggggggaaaaauggacagaauuagggaaauacuauugcuuaaucauagaaguucaccuaaaccccaugaaagucagcaauaguaccguuucuaccugaaauacagucagcccaggauuagaauauguucagcucucaugucauaaaaucccuaaagaacuuucugaaaagcuaagcccacugauaagaauaaaggaaaagcauagcaccccacaaacuaaaacauauuuuccauuacaaauacauuuucaccaacucugaaaaaccaaguggacauuuaacagauccuagaagacuuugcucccuaauugccucccaauaacccucacucucauuaaacuacagcaugacccucuaguuuggaggcccaccuucucuuuacucaaaaauuuccaaaccuaaugagagauagucuuagagaaagaugauggacuuaacagacugagacguauuuuccuuccuugguguuuacauuauuugacagcaaggagccccagagcaggagcuaguuccaagcaaaguccccaaagaauaucaacaaggaaaaacagccacuaggcuguauaaauccacuugcuauaaaauuccaacacacacauaauaaccagcauaugaagcugaauccuuauaggaaaacaauucaaaauccagguacauucaucaggcccuccccaugucguggaagacuaaaguuaguagcucuuccauauguuacacuaugaaacaagaugaaaauggcagagaggaaaaugaaaugagccuucugagauucauucuuuaguuuguucguucaaauacacggcagaagagggugcuuuccauacagaaauuauuccguuuugacacacucuaacuuaggcuauuuggaggagaauugucuggcucuaccuuacaguacacacuucccaaagucccacaaaucauguggcuuugggagaagagagaguucggggagcauuuaccccgaccauaccaaaaugaauuaacagggauuaauuuggguuacauggucuaugugccagucagaacagcuuccaguguguuucagaauuuaagguggggaaaaaagaaacagaaaaucggauuucaaaacuacccuuuaaugaaaagcuguuaaagugauuuaucuuaacaaaauaaucaucaaauuagaagcuauauguauucuuaagacauuuugaacuccacauuguaucaaaauuagguagaauauauauauuauuauauauauauuaucucucuauauauucucuauauguaaccucuauauauauauauacuauauauauuccauauauauacuauauauacucucucucuauauauauauauauauaaaaucauagauacaccaugauaauuuacugagaauacuaaaggagaugcgaauaaaaaauauguaucuagucuauuuguuagaaaucagguauaccuaucugcaacagacaaaaauaacaauggcuuaagcagacauggucuaauuugcucauguaagucugaggaccagcagaccagaacuugucuggccacuggcaccguggucaucuaaaacccaggcugcuuucagauucucuucuaccaccucugugaugguucuuauucuccuagcccaagauggcauuccagccaugccauucacugccugggcagcaggauggaggcagggcaggcuuccaaucuuuaaugacauguuccagaaguugcgcccaucacuucucauugucacuugucagaauuugauuauacaaccccaccuagaaacaaggaagguuagaaauguaauccuuccucuaggcaguugugcaggcucccagaagaaacagagcuggauuauucaagaaagguaagcgucagagguaguaggaaaguagccugagucuggagagagugaguagagccuccgugagaucuuguccucucuucuagccccucaucuagcaagauuuacaguggguuccugugccugggauauagcacugucuugaugguuauagcaaaggucccaguggcugugccuggcuugaaagaagucaacagcagcaauagcaaagcuugaccucaaauugauggcacagacaggcauaaagagaagccugcccaucgcuggguauccugaagaccuuucuccaacaucuagggggaaaaugugggcuuucauucagugggcagagcccacacuuucauuuugacuagaacauacauucugaguauguaaucuucuauugguuaaacuuaguuauacucucucacuuuguacccuuaacaccacauacaagacugcuuuugauaaggaauaaggacaggagauccuuuuuuguccuccaacuagccugcaaaaaaguauuacuguagauugauauuguauaauauuacaaagaauagcacuagcccaggugaccugacacuucucuauaauaauuuucucuggcacauuaauuuacacuugcaugcauaucacugaagaaagguauuugggguuucuaucaggacaauaacaggcuugaaauuaguguugaaaaacauucacagccaggauuucacccccugccccuggguucucuauuuuagcuuucuacauuggcaacuuucaacuuuugcugcucaaugcaaauaauaacuagcuuaaugauuuagaagaaaauauucuuggaguauguuauagucguauguuaacugcaaauggcugccaccuccaaauaauugucugacacuaugucugacuaucuguuccuccauucuauugaucucuccuaugaacaaagcagacagauaugcagguacagcucuuuuaggaacaaauugcccuuucuccaagcugacaucuuuagaauuaagaacucagagacagccaauguggaaaaacauuucuccccugccacaugcuuggugggucagaaagucaaucaaauucuauuucacaaaaaaaacuaauuccuaugagaugggaggcugcauuaauauuucuaagaccaaauauucucccucaaguaauauaaauuuauagguauaacuuuucccaaugcucuaucgacuucucaugguauaugaaaguaauuaggcuucucugaaagccagagcugcguugagaacuauauuugaguaaacacaaaagaaaagcauuuugaguguuacuuuuaauguuuccagaaaaguuaacaccuauaaaaauauuguuuccaguuuucuguauagaagucacugaaggaggaugugugaaagucuguggaaacaguacacuggcaaacugccagcuggaaucgcacggagcucuguuguaacucaaaucuggccaggccgcaagucaaagcauguccuaagaaauauaguacacacauacagcgaacacaaccauuguaacucuagcccaugggaagcugaacauucaauggacaguguccagacuauauagaaaaauagaacacugacccaccaccugcagaaaccagucgaggaaaccacaacuuuugcagccaucggccccaaaugguugguacuuaaucaacaacugccaacuuccccaaguguugcccccugcauccaacacaggaccaaccagugaaagcugacucugaucacauaggacaucuggcuucuagguuagccaccuccagcuuccugugccaacagccucaagucaggucacaccugaauccuccuccucccuucccucuccucuccccuuccaacacuauaaaggguuuucuauuccccuacuuccuuuugagucuucaccagccacaugugaugauggcugccacccuuguucuagaaagcccagaauagccucugcuucuucucauuugcauugcuuuuucccccauaucugguucucccugggggccuucuauccugccugggcccucugcuaggaguuccuuaacuuuucccuucuccauccugcagcaucuucauccuucccugcuuccaagggcuguguuucuguagaugaacuguuucuccccuauuugaggccaguccuuccaacuguauucuuuccucauuauuucuauuccuucuuccuggaccuuuuguuuccaccuguuguaucccuugcuguguuccucacaugccacugggacagcacagaaacagucccaaggcgucuaccuggccaagcacaguggagcuacugugaggacaggauauaaagaagcaacagucuggccucaccaagaaaagggagcauuacagauugauucaucugcauuacauuucaagccaaaguugaacagucuagauuuggaugcaaagagaacagagaaaaaagcuaggagccaauagcaaccaauucaggggucagaguggcaggcaucaagaaaguaggauggacaaaggagagccaacgaggagaaauuaggggaaagcgaaacaucaguaggcagaaggcaauuguacaggauuaagccugaggacaccauguuagucuuuuuuuuuuuuauacuuggcuccuguaaauugcagugagccauguauuaaagggaaagaacauggaggaucaccaagcauuucuguccuaaauauauacauauacauauaaauauguauauauguguguguguguauauauauauggacacacacacauauauauguguguguauauauggacauauguguauauauauauacgcacauacguauguguauauacguguagauauauguguguauguauauauguguguguguguguauaguguguguauguguguauuuuaagagacuaggugucacuccuguugccagugccgucgugcaguuauagcucacugaagccucaaacuccugggcucaaguuauucuccuacuucagccuccuaaguagcuguaacuacaggcaugcaccgccaugccuggcuaauuuuuuuuuaagagauggggucuugcuguguugcccaggcuggucuugaacuccuggccuuaagagauccucccacagcacgggaauuauaggugugagccaccaugccuggucccauaauauauuuuccuuugcaauacagucuauaguuaacauccaaaucccaugcaaaguauaauaaaacaccucuuaccagcuucuucuagggcucagaaaaacucucuucucuccauuuuugccucccuucugauuucuccauuauuauugcucuauuaauucuucuuucuuacaaauaaaaguauacuuacccauuaugaacuuuuaaauaaucaacuucuuuuucuccuguaauuaaccaaaaaaguucuuggaauaaucuacuaaacacccagucuccacuaucuccucagucaaauacaguguuggcuucuucccuaggccauucuuagagaauuccucuccaaggucauucgagcccaaaccucaugcccuucuucagcacgcacaggcugcaggcucuccugaaccaccuugaaguucuccaaccuuggccuugccgacacugcacuagccuuugggaucacccuuuuucagcucagcuauuuuucauucuuucacuccugcccaucccucuuuuaucaucccucagucucaucugcaauggaaacaugaccuaaucuccaaaauccuuuccaauugcuaucuccuucuggaucuccaaaacagacaagauugaggcucccguuugcuguucuugguguuugaaucacuccugcagcaauuuccuacacagucucauaguaaaggaaucugcaccccuguauucuacuucucacugggacuguaagcuccuuguggguaauggcuaaaucucauccaccuuuauaucuccaagucuaacaauaguacuagacacaucucagguagagacucuggagugugacugccuauagagagcaugauaauacuuucuaucucauaauacaacgccuagcaugcuggcucuuaccaucaucaucaagagaugagaguuaaauuaaaugaaccuaauaaugugaagacagauguuaguauugucccccugugcuguuucuacuguauuugauuucagauauuuuagugaaaaaaaaugugcuuugaacuaucuagaugacaccaaaacugaaauuuaucagagaccucugguauucuguuuugugcagacauacugcuucccaaauuauuuuacacagcaccauccccaccucauuuccugugcuuauggacaacggaggcuugcagaauuaaaguaugccuauuuauuccauaagaaaaugggaauaaauauuaagauaaugguugggggaggagaaaguguacagaaaauaauuaagucaaacucacccaacauuaacaugggggagaagagauuuuuuucaaaacccugccucccuagagcccuaaaccuuuucaucgauuuccaauaauagugagaacuuuugcuauaaaauuguuuuacagcagcuaacaagcaguaaauguuuaaucauuauacauacuuaggagagcagcauuguuauuuuauagauuuuaaaaccaggggcucauauagaucuaagagcuuucuucuugcaccuagaaagcagcagaaccauaccuugaacuguaguuuuucagacucaguucuuacccgcugucauucauauccauaccauucuccaaaagacucauguaagaaaauaaucaccaugcaaagaaaccauccagcucuucaugaaaagcucuaguucagucucuaggaggacccaaaugacagugaagucuaagucucagucucuaaugccaaggaaaugucagggaauuaagacccucaagugugaacaugggaggguaacucaggcuccucuucuaauaaagucuaaaugggaguucaucaaacuguuuaaaagccgaucuuaucaaccuaacuaaaccuaauucuucuugcuuuaucugaaacccuguuuuaaaguucaaaaugaccaagcuaugcaauuuguaugcagagaagcuaagcagcugagagauauugagccaggacucucugucuaguaaguuagaggaagaacaacaaaaguagauugccagauacaaagaaauaagcaacaucagagagauaccaaauaaaagaauguugacagcucuuggcuucaggaaagccaagaagaaucauacauugaggaauuggcauuugagcgaaggagguuuagaucauauucuuucaucuugaaaguauaaaaaggucuggaaagauguaucauccuaagcacccaccaucgaaguuagauagcagcaauuuaauuccagccuucauauuggagagcacauaggcaacuuaauauucagaaacaagauuuggggggacaauuuaaagagagggcauuuuccagauuaauggauacagcugaauaaauguguucuuugcuuuaaaaaucccucaaaauaauuagcaggaaagguagcgaucaagcaaaauguugacuauuuuucaagcuguguuuucucuccucucagaauuauuaauaaacuuaccauauuuugguuaaaauauuugcucacaaggaguauuaauuuuccuaaaaugaauaggguuauaauauuuuaaaauguauuucaccaacagcaauuaauuuguguugaguguuugaggauagauaauuccacugggcaacaaaaaucacuuaaucuuccauguuguugcaagagcaaagaaaagcaacugcauuuuaaaaguuuaauuagaaguaaaagcaaguuuauauaaugauauaucacacugcuagcaaguaauaaagauaaacauccucgcauauuaucagcaccaaaaaacagucaaauuucgcuuugcuuacagauugcagaaacuucuauaguaugaaauggcuuuuucagauaccgcuucugaguuugguggauuuuuuucccaagaacuugugguuaggauaauuugagggauuacaguguagacagugacauucccuuguauuugagagaaguuugugcaauucagacaugacuguguuugcuuuuagcaaacauacuguucacauuuugagaaaaacugcugaugcagucuggugaaaguguucuagcaaugccaaaucacugacagaugugcugucugccaagggauuucccuaggaauguucuaauuuucuucuaucuguuuagagaaaguucguuuaaaaucuguuaaaauguauuaaugugcaguguuccauuguaucuugcugugggcauacuagcaaaagaaaaguuacaggaagauugguacuggggugccuaccaaaaacuugaucccgccagaucagaaaccugcccaauccucgaucuuacagaagggagagcucauauacucuguaauaacuugcauugucuauaauuuuauuguguuagaacacaaaggggcucacuauucuuccaaacucauuuaaaaauauaccugcuguugaaacugcagucuagagagauuaggugauauauccacagucacagucaauuggccagugacaaacaauguggucaccugcaaauaucaauagaauuaagaaaacaaaagguaguucuuaccagugaguuuugcaugaaggaugugaggcucaaagauaagauacuuugaguacggaucuaaaauuuuuauuuguuaccaaaucaauguuuucuauauuuccuaaggugacuauuaagucggagucaaauaucagaaacaucaucacaguuauaaacuuaaccauuguggggaagauuaacauggcuuucauuagugaauuaaaauugacuucugcauguugguacaacaguaagacaauaucacaacuguacucccaaggaaguaaaaugcuaaaaaggacaaguuaaaaaaaaaaaaaggaaugcaauacuaccagaaguccuaaugguaccagcacauacacacugucccacaucaaugagaaugcucaccuacugccugagaaguauaauaaugaacagcuaucguucuugcccaucuaaacucccuuucuuuagggcaggaguucuugaccucagcacuauugacauuuuagaccacauaauucuuugcugugaagagcugucuguguacucuaagauauuuauggccacuacuuacuagaugccagcagcaucuccuucccaguagugacaaccaaaaauguauccagaugucgcuaaauguguucagauggggaaaggggagauauaaaaucacucccuuuugagaaacacaacuuuaaggaagcagccacuuccucacuguacugguagggcugccauucacaucauaugcccagaaggcacuuagagcucaguaaucucauggccauggccuucccaauauccacagauccauccugcuaaaggcaccaaugaucagcucuucucugggacuuguucuuuaauuccauauccuacacaacacucucccaaaccucuuuuuuccauaaguuauucaaaguugggucugcuacuuacaaacaaggaagccuacuugauuaaaaaaaaauaagcagcaaaaauaauuguuuucauuuguguaagaaaaaaauagugcaucugucauaaacuaauaguagaguaaggcaggauuacagaaucacacuccccaccuccacccugcaagaaacuaauuuuuaaaaguaagaaaaugauaaggauuuuaaaaagcuaauaccuuacccaacaccuauaaaaccaauaaagugguauaagcuuugcuauaaauuuugaaagccuaagaaaagaaaacaaagauucugauacgucagccccaccaacucacccuaauccaacccuacacacacccagaagcgguacuaaucaaagaagguaaguagacagauuucugaaguuucucagaacuacccuaaauaugaaaagguauggacugacagaaggggagugaugaggcaaacccagacaaauucgagaaaaacaacuuuguuauagaagcuccuacauguccuuuugagaccuuaucaggacuacaguacauauuauagauguucuuuuuaugagaagaugcccccucugggcagaccaaauuagaaaaaugcaucccucucaugagcggaugcaacagcccugcaccaagcaugcuuuuuuggaggcagagcacagacuggaauugagcuccccuuccgggccccucaccuauguuucuccauucaaggacaaccugcacacagcagcaguucacagcagcccugccagcagaggcuggaaggguccccagaguuuguugacuuccacagcaaugugccaagugacagaaccuuugaaagcccaaagacugcaacaaugcugguugaggaaugggcccagggacagaauauuaauaggaucucggaagauacagcagggaucaggucgcccagugugggcugcacccugcuuccccacagccuucuccacccucacccuccacauuuccuaccgcaguggcuuccuaaugucagcauguuucagagcugccugaaagccuugugauaaaacagguuacugggccacaucuccagaguuucugauucaauguguaugaggugaggcccacagauucccccuguuaaaugauguugcuggucugaagaccacauucugaaaaucagucaucuuuagaaaaguauguaaaaagcagcagcuagcccucaaaccauagcucagaauagggaagacaaacuagugucaaggaacuugaaaucaaggaagaugaagaucaacucacaccaguuaagaaaaacaacaauaacaaaaacauaaaacacccaucuuaauagugagcaggauaaaaauaaaaggcaugacuaccaugcaaacuuacuaccugaaugaggagaggguggggaauggcagaaagaaaauaacagaauguaaaagacagaugaagaacucagcuggaagaaaauguaacugaaauuaaacaacaguuuccucauaaguguuuuauaauauuaaggaaacuaaaaagaaucuucaauaacagcucaaaauugagaagauaaaacacaaacaagguuuugaaaaggaaauuccagaguuaaggaaguacucugaauauauuacauaccaauaaaaacuuaauuaauucauuagaaacagaaauagaaaaagucaaagcugaaaacuaaauuaccaugauggagaaacucaaaauaauuucacugaauaccugagaaaaaaggcaaggaacuuguucaagcaaacaaaguaagcauuaauuuggaagacagauagaguaagccaagaaaaucaucaucagugucccugaaacacuggaccguaaaaagaaaaauucucaguuuucacacaaaacauuuaucuaaagugaagaaagaacugaauccauggguggaaaugauacaguauccugagaaaaauuuaaugaucagcauugucauccuaauuaagcuauuacacaucaaggauaaaacuagagcuguucaaacaucuaagaagaaagcaagucaauuacaauagggaaaagaaaaucagccuggccucacacuuucuacagcaacagccaaucucggaaaaccauggagcaaugucuaaacuucagagaaaaagaaaaggugacccaagaauguccuaucagccaaguuguuauucagguauaaagguaauagguagauauucucaaaagugaaaaaucucagagaauauaaccuucaugaaaccuucuuggagagaaaaaaaauugcuugaugaugaaagguacccagcuaagagauaaauaaaaagaaacaauccuggcaucuagaaaccaugguaaaaagacuaccagagcuggauccaaauaaaaauacaaccaggacuaaacaaaugggagaaugacauuugcaaaacagaaugaggauguuaugagccugugcaauggacugaauacuuaugucuucuccaaauucauauguugaaauccuaacuuccaaggugacaguauuaggcaguggaagucaugagggcuccauucucaugacugggauuagugccuguauaaaaaagaccucagagagcuagcuaauagccccuugcacuaggugagaaaauagcaagaaaguaccaucuacucaugagaaagcaagccuuugccagacaccaaaucugccgguaccuugaucuuagacuucccagucucuauaacugcaagaaauauauuucuguuguuuaugagcuacccaguuuaugguauuuugcuacagcagcccaaacagacuaggacagccugucaggguaaaaauaauaugagcaacauaguuugaagguaguaagagagguagcuggaaagaaauuagaaaucaaucauguaaucucuccuagugaauaacaucuaaaauugguguaguuaaaaacucauaaaaacuccaacuuuugaauguuuuuauauuuuuucuuaaccuuuagaaaagucuuuaggaacaaauagcuuuaauggugaaaaaauacauagcugaagcucaacaauuccuuggauuucacuuucaguuucuuuuucuucuguuaaauucagguaaaauuaaauuuaacaucuuuauugauaaagcagauauauuaugaucucugaauuauucucauccuuacaauguuaauucuuacuaucuauccauuuuacuaucuuccuaucuguacauguguauuaagagauguuuagaacgaugcucuucaacuguucagaggguauuucucgguggugggauuuaggguauuguguugcuuucuucuguauaauuuuguauauugccuacauuuuuuaaugaugagcauaagucacuuguaaaaauauacaaucaccacucuaaaaaggaauacaugaaauauaacaccacuuuucugacacagugaguauaaauguaucucuuucaaugagcaacaucauaaagugccucucuggguaaggcaucauugugaauauccacccucauugcaaaguacacuagaagugaaugauacguaagaaugaguagaauguauccaaggcaauaacacuauaaggcucuguuucauuuuuguaaauagaucucuggcuuaggcuccuuuaauuagcaguaccuaacauuuccugagcauuugcuaugugcccggcugcaugccaccauacuuuauagguauuuuguuauuuaauucucacaguaacuauaagguaauaauaauaauggugacgaagagacuaagaacagcucagaguuguugagugucuacuauguacuaggcacugcuccaagugcuuuucaggcaauaacauucuucaguaggaaguacuuauagcaaugggaguacauugugcagcagaagagaaggcuaucaaggccagcuuuuaaaaauacaaggauuuacauuuaguacagugagagaaagugcacaggugagucuggccuuguguagagagaaaacauaaagagaaaaaacuggcagaaccacgcaauuaauuaaguacuuuugaccacaaaagugaggggaauccaggguagagcaggacuccgaccaagaagauauaaaggccuuggucagcuucugguugucguggaaaugggauuucaaccauuauaaugagaucaaaucauaugcuaacaaagaaaucaguaauuagaguuggggccacccacagagcucaccuccaucuugggauaagaucuaggaagagccagacaugcauuuuugccgcagauaaaaucccaaaaggaaagguuuuaaguaugaaaggguugggcugaaauaacauacucaagaauauugcuauucugaguguugcuucugcuuccagcucugaccaggucacugcagauaacaaauuaugucauuucuuauagcucuauuccacucaucagcuccccuucuaugcaggaaggagcaugaaaugggaaaaaaaccgagguucccacucuugguguccuaagugaucagccacaggaagaaaaagaucucugcucauuuucccucucacuuacuauugcccaggaaucuuggaucucuucagaauagugggcaaacugagagaaagcaaguucauuuaauccucaaaacaacccuauagauuccauucuguuaucaucauccccauuucacagauuucacaauggacagggaggagcagcauugaagggaucaguaaccugcccaagguccauuuuaacacaagagcuuucugacuucauucaggcuccccucucugugauugugauuucucucaugucuaaaccauucacauuuuuuaaaauuaggauuucuaugcuuaaguauguaccuuuguucacaacuaaguugaggauucuauacucaaacacacacacacagagagagagagagagagaugcaguugauuuuccccaauacuaauguccaugaacugaaagcuuaggcaauaacuuaguauagccacagcuuugguuugguucaguucuaggguacugcuuugcaaauuaaagguguaaucccuucaaaucacugcaauaaaagugauuugaaaucauacuauuugcagucauaauagaaacaaaugccuacuuaacuacucauggcucagcucuggugagaacacaucaauagaguaaaaugcuuuuagcuuuccagagaaagguuccaccugacagauaccaagagaucaaauauucacuccgcuuaggacaaagaaguguacggauuaggacauacuugagaagucaguuucagaaggcaccaguuuagaaaagaacccugaaagaccucuaccauuuauuuauauuucaauguauucauuccauuucuuccuaugucuuuucauucauuuguuuaucuccuuggucugugugcugcaggcuaaaacuacagcaauuaaacacaagguccuugcauccaggaguucuucucaauccaguaauggaaacaacuaacaucauauacuauuuugcuuuauuuucugcuagagguacggacaggaggugcugugggaacacagcuaauggggcaccugguucuugccuaugagaguuuugagaaggauaccugaaguaggguuuagaaacugaccaucacaggggaugggagaggaggaaagauaaaguuauaaggaauucucaaacuuugaacaugugaauguccuauauguaucuguaaauaguauauaaaaacacuauaguaucugacugcucugucacagaugaaaaccuucaaagagaagcugaucauagacacaauuauagaaaccaggggauguuaucucgcccaagucugccugacuacuuuuaaggaugcuaaauuccuaaucucucaaggaugacauucuucuugccccagagugugcuagagccagagggaccaacucuuucucccuaacuuccuacccaacaaagaauccuccucuacaauauuccuaauggauguuuacuauagcaaacaucacuuguucaguuuugguuccucagucccuauucccucauuguaauagcauuuuuuuuuuuuuugagauggagucucguucugucacccaggcuggagugcagugacgcaaucuuagcucacugcaaccucugccucccggauucaagugauucucaugccucagccucccaaguagcugggacuacagaugcccacugccaugcccagguaauuuuuuguguuuuaguagagaugggguuucaccauguuacccaggcuggucucaaacuccugaguucaggcaaucugcccgccucagccucccaaagugcugggauuacaggcgugagucaccgagcccagccugugauagcaucuugauucacuuuuagggacuuuucuccuauuauaagccaccauuaggauagugaauugggugccuuuucauuccacuccagaauuugagguccuggagacuucugguauauuuucugcuguaauggaaaaaggaugagcauguguccuaagcucaguuaauuggaccuucucuuccagggcucugaauccuaagaagagugacaugccacucacucacucauugcuguaauggcuucuuaauagccaaguagacuccaucuugauacuuuccuguuucuaagccuagucccuccugcccgcaucuugauucuguuaacuccccgauauccuucuauuuguaacaaauuccuuuucuacuuauauuaaccucagucucuguuaccugcuuccacuggaacucugauucugcuugaauccuuccauuaaugggaauauuacuacauugagaggcugcucauuccauugcuggaccucuauauuuguuucaaaaguuguuaauucaagcuaaagccggguucucuauuacuagugucugucaucaggaauuagaaagaauaaauuuuagucccucuuccauauggcagucacuauaguauccaaggaagggcaaauaaucauugauaaccacaccacuaaagcccuucucccagcugaaaaccaccaggguuuuuauaaaucuucuagaauaauauaaauuuucagacaccacagaaauagaagcuuugaauugccgaugagcagauuaaucauuuucagauggucucagggaacuaaacagucacuuccucggugggccucuuucgaagagggcacuuucauguuuauuacuugcaaggguuggcaaaugguagaauucuuuuuuaggaugauaaggauuuauauuucuaucuagucugccacuaauuaaaaguauauuaucuucccuacugaaguugggguaauuggugguuauuuucagagcaacucaucagggugagacagauucuuucugauugagguagcagagguguugaacauucauuguguacugaguucacguuucuaguaucacaauuucccacaccacaugcgugauagaugugucuucaacauuugcaaacaauuccaagucauuucucccuucaauuauucccucuucucugacauccuaacaagguuuucauuuuguacuaauuucacuaauuuaggaaaacuuuugucugcaauacauacauauacauauauacacacauauacauauauacacacauauaaacauauauguauauauauucauauucuugagaaguaggccagaaacuuggcuugcugugaaaaucagaggggaaauaaaaaggaugaauggagaauagugucuauucccuuuggcacuucuuaccuaauacucaagccccuuacuugcugaaacucaagucuucuccucccugcucccacuugccuuauaucuucucucaaugagugaggauuaagggcagguacuucucccauuccagagaagcagcagcuccaucuggagcacucugccucuuucugauggagcccucagggguguacacuguaauguccaucuucccucgucugcucacgcagaggacaagacucucacucucacccucuuucuuucccuaucuaauuuucucuccuuucucucucucuuuccucuucauuucuaguggccaccagcucugaagguaacaucccagccugaguaggccugagccaauuauucuagaccagaaucagcggggguaaacacaaacacucucauucucuagcuguuuccucaggugcuauggcuguucuggacuguucuccccuuccacugcucagaugauauaugacacucaauuacaguugaagagaaauggaucaacugcucuagauccaggccccugaagcuacuuuaauauguacauaaguguucaccagagguucaguccagcucucuggggugcuacaugggugcagaagguccaaagacccagcuaauaacgaaaguugacuuagcuuuuauuuagccuccuuuauuuuuuuucccaccaggaaaaaaaggaguugggucaaacaggaacugggcccaauaucauuacaacaauacugcaaggucccccuucaucccaaugccacaaucuagacuuuguuuuuaggaauauauuuuaggaauaauaaauacaaaagaaaaaauaaauccuaaauuaugaacaucguuauuugguuuugcaagucagucaaagucauguaaagagagagaccuagucauuaucaggaaauaacuaucuugaauuagucuguaacaauuucuucucauugaguauuuuuguguuucccuucucuucauaauagguaacaugauuuccuacuuaaaacgguggcagaguuucccuuaaaaacaaauuuauguuuuaaaagucaguugauucaaauaaauauuaaauauaugaaugcauaugcuggucacgcacaauuuggaaaaaaaaaaaaaaaguauauaaauguccuggagacuucugguagauuuucugcuguuccuacucugaauggacauggaucauuuucaugccacuuuggggauugaugcaugacuccuguugcuuccaaacugucucaaaagaaaauagcauuccaccugacagcugcaugaacucaagucuuucucauguaugggaggcauaaguauguccauccaacaaaucugccagcauugccuuuauucugguacugucuaaggcugccuauucccuucugcacagaguucagccuuuugcuuccuuuuuuauuuauuuuuuuuuugagacugagucuagcugugucgcccaggcuggagugcaguggcgccaucucagcucacugcaaucuccgccucucggguucaagugauucuccugccucagccuccugaguagcugggauuacaggugugugccaccacacccagcuaaauuuuuguauuuuuaguacagauggggucuaaccauguugguuagacuggucuugaacuccugaccuugugacucacccaccucggccucccacagugcuggaauuacaggcaugagccaccgcgcccagcccuuagccuuuugcuucuuauggaaaagcauucuucauuguuuuauucacuaggcuuaggcaaguaccacccuaacucucaaauagccuuuccaucugggcacccuucuucaugaugucuuuguuccuggaaugugccucaaaggucugauuucuuaggugccaagcagaguaaaacuucuaaucuuccuucuaucaauccggaguuccugcuaucucaacaauauacugcauacccaaagcacaugcauaaaauaaaguuuauuacaacaagacuuuguuuacagaagaaagauuagacugauugaauacauuguucuacacugauuuuaauuggugcuauaaucugaucugucucuaaccagcuaaucgguauuuaaucgguugcuuuaauuuuauuacaaggcagcuagaaugcagcuguagcuagagaccacacaguaaauaaacuacauuauuauuauauuuaugcauaugaguuuuauucugcuugugucaaaauuauacucacuuccacuccccuccuaauuuguuuguauuaaaccauugcugugcacuugcauagugggaagaguuaaaaaaugccuuuuuauugccaaggguaaguuaugugauaaguuuccagauguacccaccuucauuugccaaacaaucuugugauugauuuaaauauuuauacagugcuucaauuacugacauuguuucuauuaauuaaugauauuaggguuuaauucuacagaauacagaaauagaaacagaacaaauucaugcacaaaaaagcaucugauaugaucacccugaauguaguuucaugcuagaguuucuacgcaauuccccagagaaugaagcauaccagcauuaauaaaacucuaaguguuuuaggggcuuugaacaugggugcgauagguuccaaagcccuauguaaguauuugaacaacuugaccuuauuucagcuucuugagagaacuauuagggacagucacagaaucaacaugaaaaauuauuaaguacccacauacugccugccugaaaggacucagacaacuacagcaaacuucgaaaaaauauuaauaauaucaaaacaccuugcggcugcucuuuuagaucgcugcacauuuuuaagauguaauuuacuggaagcucucuuuugcucuuuccugucauuucaguuaugcaagaacacaaugcucucacccuacgccagucuggagagcuuugcuuuucucuugggaggaggcauggugcaaugaugagaagaagggcuuagcagcaggccgacccuggcuccagucccagcuuuuacauacucccugaaugacaucaggccauguacucuuaagccuaaauuuccucaucuguaaaauaggagucaucacagcuacucugauauuagugugaggauuaaaugagacaacaccauaaggcucuagccaagggguccagcuguuccuuuggcuacugugaucucaggcucauuuagcccaguaauuguggcucaucucauaguugucuucucauccugcugagauucauuuauuuaacaaauguuuauuggguacugaugggggugccaagcaugggcuagaaaccuggaacacaacacugaagguccaguuugcaacacaaaguccaguugguccaaugaaaaagaggauuagauuugccuuuuaacaaaacauuccuagguagauguuuaugguaaagcuaacaucgagccaaguaucacagaaauauauggcaggacauuaaugccuaguguuccauuauaggaacgcuaagcaugugggaguuauuuauaaccuacagcucaaggucaucaccaaggucugauuuuucacucaugcaaaaauucaaaaaacugaaaccucuggcauaaacggguuaaggaagggaaggccccuuaguccaagccuuuccuuauaaagguauggaaagaaaccauuguuccucaucagcaugagagcaauacguguuguuuacauaguauuuugccaucugugaugauuuuuauguaguguaggacaaggacuuucuaacgcucggcucuauacuagaccagguccaaaaaucuaccugaguaucacuaccucugucacugaacuacuguaacccaauaacaggauaagauggcuaacaaaagaugcccucguaggaggaacuauccaguaguuugauuucauacuuguccuaaaccuuuaaacuuguucuacccacaugucacagauauggagguuagugaaaacuaccuguguguguacagagcagcugggaggacauuuuggcucuguucuaggcagucauguagggcccccuuacuuugcuccugcagaggguccugauacugucacuguucugcucagcuucaaaacucucagcaggaugucccauuccucaccuagcccucaccugcucuaccuaaugaugcucaaucacugaacuggcccagaaauaauaccugccuauccugacuucuuacccaaaccuggggcuaccucccugacuggcauccuaggggggcucuccauggccuuuagugaaguggucaaagagaagggucaacucuuuauacaaaagaaaaaugagucaugagcuaacugugaaacucucaauaagucacauauucucugaucuccauuucccaaaucacacaaauugagagccaucuaaauugccucccaacucugagacucuauggauauacauauaugaaucaucauagcaaauauauaucuauuauagaagcuaaaggaaucuucucacuuucuccaauuaguaccaacuagauuacuccacaaaagauacuugaccuuguuaaaacaaaaagcaaaacaaaaauacucuuuuacacuauuaucaggaaaucuaugccuggcuuuagcagcagaguauaaauauuugguuauuggauacuuuucaauuuaggggaaaagguauaucuauugcuuaaaaacauuugugcccuucuuauagccaggucacccauuccaagucugaagaaaauaaauugaaguggugguaaaaguuaguuaaauuucagaauuuuuaaaagaagggauaucauucaucucuggcuagauaacucuguaaaagaucuaucuguaagaacagaaaaugcucuuauaagaacuuugagacuagauaaacaaaugcaugccacacagaccaccacucccaucuccucaggcuguggcagacauuauuaaucaauaacagaauccuucccacuaugucuauacacagccuucaaauggcucucaaugcaguaucucagguaacugccagcaacgaaucauauuuggcaugaaugauaaaagguauuuggaaucccuggcuuuaugacuuugacuguuacccugacugccauuuagaggauuaacagccaagaaugucacagugucauuauuuaaauaaaauagaaagggaucuugccugcaggaacaugccucugaauauuaguaggggauuucaagcuugaaacucuccagaaguuucuuuuucaucacucuaaugcuugacuuuuucuuccucugcccccuccuuccuuaugaacucucaaggauacuuacaggucagaagggucuucagguugaguucuggccaaaauuuguggcauuuccaagucucacuucacugaaugaguacaacccugagaccugucugggaacauggagugaaacagaaacuaagagagccaccacugcugaggcagggagggauggccuggugauacacaggaaagguaaguguggcagugcagugagagaugggcuggggaguaagguagacaaaaggaucuaaagaguggaguccaaaagcacaaugauacaaagugagugaagcucaggguuuagcaaguuaacaugaaaacccuagcuccugaaugaagaguaccuuuugcauggagccuggauuaucuuuucugcuuauaucuuucuuuucuccucccuccagcccuucccuccuuccuauaugcuccauuuucaacucccuuuauauuccuucaucuuucucucccuacuuccuuuucuuuaacuuccauuucuuucuuuuucagucauuccuacauuucccuuuuucucucauucuccuuugucuaagcuuuagacaacccugcucacuagcuccuuggccuuuaagagcuuauaagggcuaaggggcuacuaguagcuucuccccaugcaacauaucacacaggugucuuggagggacaaaguggggcuugagacuccuggaugcuacacagcagagguaagggcucagguacccaagagaagaaaucaaugaaguaggaagcagaggugaaaagaguauaucagcucaacaggaucaacaaaguccaggaacacugucaaaauaagcuuggcagaaaaucaacagagcagagaacagcaugaaacaugaagugauacagguuguggguggguggagaaagagaaauacaaggcaagcaaaguggcagcauuaauaagcagccaugacuggacacagaccugaagauggauauuaggaaguaggugcccacugagaaugagaguaaaaaccaaagugaugaacuaugccuuuguaacaccugacacaaaagaaaagagguaugccaguuaaauggcagcaccauguacagaaaugaguagauauuucuugguuuugcuuaauaucgcucuggaagcacagaauucauguucuaagacuuaagaauaaccuaaaccagcccagugugguggcucacaccuacaaucccagcacuuuggagguggauggaugaccugaggucaggaguuugagaccagccuggccaacauggcaaaacuccaucucuaauaaaaauacacaaauuaucugggcaugguggcagaugccucuaaucccaacuacucagaagccuaagucaggagaauugcuugaacccgggaggcagagguugcagugagacgagaucgaucacgucauugcacuccagccuggacaagaacaaaacaccucaaaaaaaauuaauaaauaaauaaauaaccuaagucuauuugggugccaaaaaauguguauucuauuuggacauuacaguggauugacagcauagaaauuauuuauuaaacccauccuacuggaccugaaggugaaccccaucguaacagggugccugguagagucauucuuaacuagccaucgauuuguaaaaaauugcaaaaguuguuuuuuuuuuguuuuuuuuuuguuuuuuuuuuguuuuuugagauggagcccugcucugucgccagacuggagugcaguggcaugaucucggcucacuacaaccuccgccucccagguucaagcaauucuccugccucagucucccggguagcugggacuacaggcgcccacaaccacgcccggcuaauuuuuguacuauuaguagagacaggguuucaccauguuggccagaauggucuugaucucuugaccucgugaucugccugccuuggccucccaaagugcugggauuacaguaaaaauuucuuauaucaaaugaccguucuugaauuguuaccuuggauuaacagggagcaacuauuggcauuuccauacagcaaucuacuaucuggggauaaucuagcuuuccuggagggauggaaacaaagugcauaaugguuguuuaccaaucauauaauaucagacaccaauaauuugucauucacucuaguguucuacaaucauuagaggagcuauucaacugcucucagacauaccagcuaugaucauguaggaaacgugauuccgugggcugaauguaccaacucuucacuaacaucucaauacucuagacugaaguuaaugaccagugcaaaccaccagaguauuacaguaaaagaacagcaguaaaaaggccuuaauaaaucagaaauuuaaauuggcuauucauuuuaguuacagccauucgucagagcaaagugaugguccaauucaccuaugcgguaacuuacauugaucauaacaguacuuuaaguaauaucauccauuaauuuauuaagcaaauauuugaguaauaccuacuauguguacaacccucugccagaugcugcaagauauauucagacauaaaagaaacaaucuuaaccuuuaagaaacuuguaauccaguaggagaaaaagacauuuuguagaagucuuauucaaauaaaauaugauuccauaagauaaggcuccaucuaagcucucugcauugcaaagcugauggcaagaacuacauuucccagaauacucuucccuggaugguucgagugaaguuuaccaauaagaauagagugagauguggaagaaaaagagauaaagaaacuguucuuuggaagucagacaaaugugcacaaaugaagucuuccucauugcuguacauugagagaugucccugcuuuccuuaucgaaacucugaucugucuaugaguuauuaacacccuugucaguaauaucacuugucauuaggucacaauucuugggacuaccauugucuagguucuucuauuccacaugcuuuguuucugugcauguugaguccaacauguguguauauuuuagguagugucaccuguuuggauauccacaagaccuauuuacacaacaccuguuacaaaaacucaccccagauguuuucuuguuuguucaguuuaauuuauuauacaaaucuucacauuugaaaauauaagcaaaagugauucuaagccacuacaggaaauucacaaaagcaacaccuggugucaacauauuucaucacauuuuaaugauuaugaugugcacaggugugcugaaaguuucuccuccauacucuuugauucuuuuuuaaaauuuuuuuaauuauacaaguaauacacuucuagaacuaauaagcaaucauagcaagcuugugggacaaaaguuaauauacaaagucaauugucuucuuauugcuagcaaugaacaauugggacuugaaauuaaaaacacaauaccauuuacauuaaugccaaaaauuuaaauacuuagguauaaaucaaacgugaaagaucuauauaaggaaaacuauaaaacuuugcugaaagaaauacaaaagaucuaagaaaaaggaaagcuauccacauacgcagacaggaaaucucaauauugucaagauaucaguucuucucaacuugaccuauacauucaaugcaaccucaguuuuaaaaaucccaagccaaaguaaaagccaucuacggcacacagcauuccgaaagguuugggcuaccugacuauuauggcaccaagaaaucucugguauaugagaacuuucacuuuaauucaaaauguuggaugaccugauuuucagcagaaaugcucuucaaaucaguuucacuuaggcuuuuuggugugaagugaaacgaugcagacaaugagcuuuggagaaugaggaaccacugaauaacuuacuauggaaguggauacugacauggcaaagaaacgacagccuggaguuuuuaacagaauguucccaaugagcaggaccugaagauguuucuucguuccaaaggagcuagcaaagaagugauuguuagcaucauaucaaaauaacuaaaagcuauaacacacacucuugaacgucuuucaaaacaaugggaucuaugaaggauuaugauaucagaucuugauacuguaaauauuuugggccauucuccugaaugcuuucuuuugucccaugaaaaccuaaacuuagggauucuaugaguuccucuacucagcuggauuuaccuguaaaugccuuuguugauuguugaccaaugucccuuguaccuuuuccaauagucucgaucugaauaaacagaugguuaaaguuuugcaggaaguauauuuuucauugggucacaaugaucccacagauuuuguaagaaagaugauuuuuuaaaacccuuucaucuuaauucaggguaccaagcagguaaaaacuaacauugaauuuuuacaggcaaguuucaauuugaacaguagggaauugcuauuuuaauaugugguccaggaaccaaaauccuagaccuuuccaaugacuaugccaaaacaaacuacacaaauaucaaacagaagcuguuuucucucugagguacugaagaagagguacaaaagcuugccuuaaguuauccagauguggggaaaaaaaguuauccagaugugaucuuuuggcagagaaaaaguuuagugagaagaauauuuuagcuuggugcaaaaguaacuaugguuuuugggcaaaaaccauaguuacuuuugcaccaaucuaauggauugucucauagaauaauaaauuagccuucugugaaaguaauuugugauaacugaaaaauccuuggguucuggauucaagcauaaguacuuuauaaagucaaaucaaagaauuaguaaaugcuggcuguaacuugaggacaucaagcaucacucuucuacucuggaguuaaaaaaaaaagauacaaaguaaauuuaaaaaguuaagcagaacacuggggaauuuuugaaagccagucauauaauguagugguaucuuuucauuuugaauuugggccuuucaaaaaggagggguaugauuucuuaaccacagauauauauauguaauaauucuuuggcuauuuuguuuuacagguuuauggaaacucaugguugauaugcucaggugcaguccuccuagcuaccuauuuuccaguuugaauuacuccaacauaccauuauuugauacaggcugugcugcuguagagaugguagugccauggugauuugcuacacagaucaucccaucaccuagguauuaagcccagcauccauuaguuacucuuccuuaugcucucccucccagcagcaccccuccaacaggccccaguguguguuguucccuccauguguugacgugugcucauuauucagcucccuguuguaagugagaacauguggugcuugguuuuccguuccugcguuaauuugcugagggcaaaaccugauuacuuugaaaacaaguucuacuguggcaggcagaaucauggccacaccuaaagaugucaacguuuuaauuugaagaagcugcgaauauguuaugcaaaaagauuuugcaaaugugauuaaguugaaauuugauuaaguuaagggccuugagaugaccuugaaucaucugaguggaccuaauauaaugcuaaggguccuuaaaaguggaagaaggaggcaaaagaggucagaaugaugcuguauaagacagacuugaccacuuugaaggaggugaaaaggaggcuuugaagaaggaagggaccauaagccaaagaaugcagggggccacaaagaaaacugaaaagccaaugaaacagaaucuccccuaaaggccccaaaaaggaaugcaguacggcugguaccuuuucagcccagugggcccaguaucauacuucuguccuacagaaccacaggaugauaaauuuguguuguuugaagccacugagucugauaauuuguuacagcagcaaagauuaacauagcaacuaaguagaugauuuguugcauuauagguggucacaaaauacaauccuuuaguaucauguauuuuuuccucuuacaagaguaauuacauuuaaaaaagcuaucuacuguucuagaaucacugucguuguuuacaauaaaguccuuuaaaugugcgcauaaaaaacuaaaugugaauaaaauguaaauaaaggaauauuuuugccuaauaaauacaaagaaaaugaaaaucccagcaaccuauuuuuuguggauauuaacaaacugauucuaaaguguacauggaaaagcaaaagauucagaauaugcaagacaauauuaaaugagaagaacaaaguaggagcacugacacuauccgacuucaagaguuagaacaaagcuauaguaauugaaacagugugguauuggcaaaagccaccaaauacaucagugaaacagaagagaaagcccacauagucuuuuccacaaauggaucuagaacaaauggauacccacaugcaaaaaaaaaaaaaaaaaaaaaaaaaaagaaucuagacaaagaccucacacuauucacaaaaauugacucaaaaugaaucacagaccuaaauguaaaauguaaaaccauagaacuccuagaaaauaauguacaagaaaguucagcugaucuugagcaugaaagugacuuuuuauauauaauaccaaaggugcaauccaugaaagaaaucauugauaagcuagacuucauuaaaauugaaaacgucuccuugauauaagacacugucaacugagaaagacaagccaaaggcuaggagaaaauauuugcaagaaacauguaugauaaagaacuguuauccaaaauauuuuuuuuaaagucuuaaaacucauuaagaaaaauaauuuaaaaaugggcaaaagacuugaacagacaccucaccaaaaaauacauacagauggaauacaggcauaugaaaagaagcucaacauauauuauuaggauauugcaaauuaaaacaaugauaccacuauguaccuauuagaauugugaaaauucaaaacaaugacaacaccaagugcuagugaggauguggggcaacagaacucacauucacuguggaugggaaugcaaaaugauauagcaaccucagaagacccgcaauauuuuacaaaaugaaacguacucuuaccauacaauccagcaauuauaauccuugguauuuacccaaaguaguugaaaacuuauuucuacacaaaaaccugcacacagauguuuauaguaacuuuauucaaaauugccaaaaccuggaaguaauugagaugaccuucaguaagugaaugaauaaacaaaucaugguauacgcagaccauuauucagccauacuaaaaagaaaugagcuguugagccacagaaagacauggaguuacuuuacaggcauacugcgaagcaaaaggagccaaauuuuaagggcugcauacugugugauuccagugaugggauacauuggaaaaaaaaaaaaaacuaugaagagaauacaaagaucaaugguuugcaagggcucagaggagggggagggaaagagggauggcuagauagaacauaggagauuuuuuagggcaguaaaacuauucugaaugauauaacagugguugcaugucauucaacagcugucaaaacccauaggauguacaaugcagacugaaccauaacauaaccuacagacuugguuaauaauaguguaucaaaauuggcucaucaaauguaaaaaauauaccacacuaaugcaaguguuaauuauaaaggaaacugggggagugguggggcguaggcaaacucugcacucguugcucaauuuuucuguaaaccuaaaauuguuaaaaaagaaauaguguauugauuucuuaaaaccaaauaauauauaaauagccuuauaaaaaaugucaaaccacucagaaguauccagacuaaaacauuuaacucccaagugauguuuucacaccaauccuuucauuccuggggcaaaugcuccucacaguuugguauuuaugcuuccagucuacuuuugauuuuuuuuuuuuuuuuuuuuuugagauggagucucacauggucaccuaggcuggagugcaguggcacuaucuggacacaccacaaccuccaccuccuggauucaagcaauucuccuaccucagccucccaaguaccugugauuacaggugcccacgacuacgccuagcuacuuuuuuguauuuuuaguagagacaggguuuacauuacaauggccaggcuggucucgaacuccugaccucaugaucugcccgccucagccucccaaagugcugggauuacagccacuagcuaccgugcccagccccagucuaauuuuuaauaugcuuacuauuacacuuauuuccaaaaaguguucaaacauaaauggaacauuuuauaaauaucauucugaaauuuggacaguuccuuaaagcaacuacuagugacugcacugagcauuaugugaaaaaaaaaagacuccagaaaauacaugugcaagguggucacuauacaaacacacuuuuggcuuuccagagcauuguacagcaauagucacauaguaugggcucuagaaauacuugagugguuggcaauuaagucaagaugaaaaggaaucaggccauuaaaauauagcuacaacugggaggcugaggagggaagaucgcuggagcacaggagauuaaggguacagggagcuaugaucaugccacuggacuccagccugggugacagagugagacacucuccaaaaaaaaaaaaaaauacaauuacauggucugacaguuaaauucuagagagaaucaaccuuucauccacacagcuaguaugccaaugagguguccacuguguagggagaauuaacccucugcauuuuucuuaaggauuugagcucucuuagcuacacaaacauaggaauuguuauccccaucuuagaggcaagaaagcugggagucagggagcuuaaauaacuugcuugagaugacucaaugauuggugauggagucaagauugaaaacccgggcaagccuccaugucucacggugccccuaaaaguacuuucuacagguaacaagcacccaaguggucuuuuccucaucagucccaaauuggccgaaaagaucaucugugaccaacuggaacaggauuauauccauaucucaauuaaaaccauguuuccauuugccccuuccuuaaagcaaaucacaguucuuuauguggauuuuuugaaacguacaaaucuagauuuuuuuuuuuaacacauucuggugcucaguugcuuaggaaacugcuuuugucauuaggugggaaggacuaacacacuuaagagagagaaaggcaaagggggaauauauaguaaacccagugcugaugugaauuguauccacagggacuauaacaaaacaaucagaacucaaagggaaaaggagcuuuugaguggguugugaaauaagcuauuaagucaugcaaauaaauccaaugucaacacuucagccugggcugauuggaugcaugcauuaaaacucauacuucauaagaauuuaaggccucugguguucucaguuuuucuucuuuuucacuuugggguuuuuugguuggagggaggcauuucuagagaaagcaugccugcuuuacgcuagaaucgcucaugaaguagagaauuugugcaucaagguuugaaacaauacauuauuccaagaccuuguccuucaucaguaguuucagccuuugccacauuucugagcuccgugcucaaaagaagcaucucuucucccaggcuccugcacccaaccaggcagggauccaacauucagauaauucagacgguacacacauucaugacuucaagaugcugcuguugacagucguacaccuuaacuugcagugggugcaaacauaaucagccuuuucucccacgaagcccaucuuuagaagcacugugagauuuuugccugucuuguucaagaccauaccuacagugccuagugcgggaccuggcacacauaguagauacguaacaaguaaucacuagucuguuacaugagcaagaaauaacuuuuuuaaugcaauugcguggcugaucuauuugucaccaaaguguaaccuccccuguccaauaugccaucacuuuauuuuccacugcaagcacaagaucuugcagcucaagaaagaacugugcuacauggcaugcucuaaauucgacaugccaucucaauuuaacaugauacuuauguaagccaauagucccacuuuacagaugagauauuggagcuuuauagaaaucaaguaaucuagccacagucccagagcuaauaaaugauaggacaaggauuuauaucccaucauuuuagcuguaaaacauguucauuuuuuucuuuuuaaaucugugcugggcuguguucugaccucaagugaaauacuguguguuuguaucacucaacucgcacauaccaaaguuuaagucaagagccuuuaugacuuauaaaaaacaauugcuugagaggcacugggugauacauaggcucaguuaaagcagaaggaacagcacuagcaugucauauugguaagauacaaauuaaauugcaguuagaaauggacugucaugguaguaaaacuaugggaagagcaaggaaguccucguuucggcgugucuucaggaacacaccgguuaaccaucuauuugcccaacccgauuuggucuuuaaacuugccugaagaagccaguuggagggaacagaaggcuucucucaaggucaaugucucccuccauaccccccacuucaggaucuccuaugcaucaggcacugugcuauacaacgaguaaaacauaguguuugcuuuugaaaaauucuacaauacaugaacagauaauuauggcagaacaugcuaaguacaauguuauaguaauacagagaaaaacagaaaaacugacucagagcacauucaaaagggcuguuuaauccaugccuaaguggaguaaggaggccaaaaguuaaugaggagagcaucccagagagaagaaaugguagagccaguggugugaaggcaaaagccaguaggacguaugcagagaaguccaugcaguucaguggugccagaaugcaaaaugagaagcaaggagugguaagagacagcaggaaagcuuagcuuacuuuuuaagucagccaugcugagcagcuugggcuucaacuugacaaugaugaacacauauuuggcaagauuuggcagaggacagguuggauaugaaguuuagaaaaaucccuacagcugguguggauuugaauggaauuggacagaagaccagcccaaguuaggaagcugauggagagucccagcaaaauacaggaaucugagcaaguuuuauaguuuuauaaauauaggaacaugaaugagaauaggaaugaagagagaggacugcuuugacaaugauuccaaaaguaaaauauucaagaagggugggaauggagucuaccaagaagaaaaacuggauaaaggcagaauaaaaacuuggaauaaauaauauuacugaaauuacuuagcaauguuaauaauguuaaaugugucugugguaggccugacccucuggcuguccauuauuccauauguggucuuuucugacuggcuucuuucacuuacuguaauguuuauaagguucauccauguuguaacauguaucaguacuucauuccuuuuuuuuacaagaugauauugaauugacaggauaugccauguuuguccauucagaaauugauaagauauuuggcuuguuucuaguuuuuuuuuuuguuuguuuguuuguuuguuuuugagacagucuugcccuguugcucaggcuggaguacaauggcacaaucucagcucacugcaaucuccgccucucaggcucaagcaauccucccacuucagccucccaaguaucugggacuacaggcacaugccaccaugccuggcaaauuuuuguauuuuuuguagaggugagguuucaccauguugcccagacuggucuugaacuucugagcucaagugauccacucgccucagccucccaaaauguugggauuacaggcaugaacgaccacgccuggccuuguuucuaguuuuuagcaaauuuaauguugcuaugaacauucacguacaagcuuuugaguggacauauguuuucauuucucuuggguauauaucuacagguggaauugcugaaucauauggcaauucguuuuucaaccuuuuggggaaaugauagacuguuuuccaaaguggcuauaccauguuacauucucaccagcaauguauguucaaguuccucuaugucuucuuuucaauuauagccauccuaugaggugaugugguaucucacuaugguuuugauuuguauuuucuugaugacuagugaugcugaguaucuuuuuaugggcuuauuggucaucuguauaucuucuuuggauaaauaucuauucagaccuuuuauccauuuuuuaaauuggguuuauacaaauauuuauauauucuagauacaagucucuuaucagauauaugauauguaaguauuuuaucccauucuguggaguuucuuuucagcuucuggauguuauccauggaaacacaaaaguuuuuaaugcuugugucuuuuuccauuuguugcuuguguugucuuuuuccauauguuguuaagacaucauaucuaaaauauuuugccuaauccaaggccauuuguuaugcuuauguuuccuucuaagaguuuuauaguuuuagcuuuuacauuugaggccaagauucauuuugagauaaucuuuguauauggggucagguaaggauccaaauucauucuuuugcauguggagaccuaguugccccagaaucauuuguuuaaaagguuuuuaccaugaauugucuuggcagcacuuuugaaaaucaguugauaguaaaugugaguuuauuucuggaaucucaguucuaugccauugaucuuuauuguuaugucagcacuacacucucuugaucacuguagaguugucaugaguuccgaaaccaggaaauccuccaaguucgcacuuuuuuucaagacuguuucagcuauucucaggaucccuugaauuucuguaugauuuuaggauuauccugucaaguuuuacaacaauaucugcugagauuuugauaggaguugcauugaaucuuuauggcacucaacaauuuuuggcacuuuuaacaauaacucuuccaauccccaaacauaaaaagucuugccuuguauuuagauauucuucaacuuauuucaaauauacauaaauucagaguuuauauuuuuuguugcuuuuaauuuauucccaaguauuuauucuuuuugaugcccucauaaauggaauuuucucaguuucauuuucugauugucuaucacaagugaauagagagaaugaguuuguguauauuguucuuguauccuaaaaacuugcucaacuuguuuauuucugauagguuuuuuaguggauuuaagaucuucuauauauaagauuaugccauuuauaauaaaguuuuucuucuuuucaaauaugaaugcaguuucuuuuucuugccuaauuucccugguuagaacuguuagacaauguugaauggaaauggcaagaggggauaucugugccuucuuccuuaucuuaggggaaaacacucuuuuuuuuuuuuuuuuuuacguuaaguaugauaugagcugugaauuuuuaauaaugcuuuuuaucagguugagaaaguuucauacuauucuauuuccuugaguguuuuuaucaugaaaggguguuaaauguuuuucaaauauuuuuucuaugucuauugauauaaucauguugcuuuuauccuuuauucuauugauaugcuauauuacauuuauuaguuuucauauguuaaaaugaucuugcauuucugggauaaauuccacauggccaugguacaaaauauguugcuggauccaguuugcuugucuuccacugaggauuuuuacaucuguauugauaagauauuggucuguaguuuccuugcauugugaugucugucuguuuugguuaacaggaugcuauuggccucauagaauguagugauaauuuuuggaagaguuucugaaaaacugauauuaauuuuuuaaauguuugguagaauuggccagugaagucaucugaacuuggacuuuuauuuguggguaguuuuuuauuauaaaaaauauauauucagucuuuuuacuuuugauggguuauucaggcuuuauauuuguagaaucaguuuuguuuguaucuguuuaggaauuuguucauuucauccaaguuauccaauucauagucauacauuuauucauuguuuucccuuguaauccuuuuucuuucugcaaggugaguaguaagguccccuuuuuuaauuuuugagauggagucucgcucugccacccaggcuggagugcagugacaggcuggagugcaguggcgggaucuaggcucacugaaaccucugccucccagguucaagcaauucuucugccucagcuucccgaguagcugggacuacaggcaugugccaccacacccggcuaauuuucguauuuuuaguagagacggggugucaccauauuggccaggcuagucacauacuccugaccacgugauccgcccaccucagccucccaaagggcuggaauuauaggcgugagccacugcgccuggccaggucccacuuuuuauuccugauuuuaauaauuugagucuucuuucuuuccugcuuagucagucuagguaaaguuuucucugguuuguucaucuuuugaaccaacucugguuacauugauucuauuuuucuauucucuauuucauuaauuucuguuccaaccuuuauuauuuucuucugcuuugugugguuuacucauuuuauaguuuauuaaggugaaacauagguuacugauuugagauuuuuuaaaaauacagguacuuaagcuauauguuucccucaaagcccuguuuuaguugcauucuaucagcuguuauguuacaucuucauuuucaucaaugacauaaaauuguuucucauuuucauugugauuuuuuaaauugacucauuggauauuuaggaguguguuguuuaaguucuguguauuugcaaguuuccaaaaauauguuagauuucuaauuucaccuuauuguagcuagagaauauacuuuauaugauuucaaucauuugaauauauugaggcuuuuauggcuuagcaugugguauauuuggaaaauguuccauguacacuugagaacaaugaauauugaagguuuuaucucuuucucugauauuucuguugucugccucaauuggccucacacccagcuguuaugcuucacuaauuacuggauaaucauucuauuguuuugaaaaauacccuagaggcauaaauuucuccacagucugacccaauuaaauucaagggccuuugggaguuagaucuucaggccaauuuuucguuacuccaggagggcucucuuaccuuuaccuuucuuugauucucucugaucaucuagguaaucgauggguuagcuuguagauuuuauagagcuaccagccuccuuuuaauggcuuaucaccacaaugucuauugcuuuggacaaugaccuuaguuaggcuugacauuccccccacuguuucaaaugaaaucaauuccuaugagcuucagaguucuuauggacugcuucuaccccuagcaaaaucugagccuggagcuccagagcuggcaggcagaguaacaccuauacuuucugaguaggggacuuguuggggguggcagccucuggcuuucuuagcuugccucucucagcuugccucucucagcauagaaucugccuaugaguaagcugaggcaagggggacuggggccucaauauucucagccucccauacccgggguagaacauccaccuaauuaguuggggguagguggaagaagguaauuccuaaacuuuccgccacucucaccaagaacuuagccucugcaguuuagggcagagggaaugagaaauucuagugaccuguuccucagugagauaccauaucccuugacuggaagcugaggggaaaggcagcaccaucucuuuggccacaucugcccagaguggaggcuccaucucacagagcuacaugaaagggauagauagcaggcugugucugacaugcuacagacucucauguucuuagggagauucuucagauuugcucacauaagugcuuuugauuugucauauuccauuacaauaauuuccagagacuuuaaaugaguuucuuuauauuuuucaucaguuauggauguuuucugggaaaugguccauggaacaccuuauucugccauucuggaaauaaaacuccaagaaacuucucuuuaagccucugagacuuagagguugcuuauuacugcaggaaagccuaguuuagcaugaugaaagccgugucuaguauuaaagcagaauuaaagucaacucaaggaaaguaaaaugauuuuccaacucuaucuuucucugauagguucuugucccuuaaagcugaguagccgucacuggccagauucuagaauaaugcccuuccuguuuuucuuuuguucuguuguccccacuugauugcuuuaauguaucuagguagacugccucuauuaagaagucccaaguuaauguaggcuacuugcagucuuugaaacacagugcccauuuaaagaugacaauccuagaaucauaagagcagggauacaaacuauuuuauucacucuaguauucucagagccuaaaacagugucuggcuagccugacacuugauagcugcucccaaaagguauuuuuugaaugacagugucaggaccuugcuccuguuccuuuguuacacuggcugcccuggggaucaaagcguaugggagggcuauuugucuuauguuaucuuucugaaaguauccucccagagacugguucaaacaggaacccuaccugacuccuauguccuaaaggacucuaucaauaaaguauuccaagauucuucuagccaggaggucuggcuucauuuucgaaguuaucucagaaaccuaaaguguguacucugguaucauuaacugaugugacacaacuagugugauuccaucaguuuuauaaaugacaaccagugugaggaagucgacaccaaaagaagacacuacuggacagaaggcaaaugauuuugaauaaucagccucuacccuauucccccagggagacuaaaaugccuaagcaaugcucucguugaucacaaaggauacauguuuguccucuuguuuagaguugcaagaacccacucuuuccaaagcaaucaaaauccuauauuaaggggaccaugucuagaagcucuggaaaauuccuggaauaguaacacaaaaaaggagucacuguaccaccaccacaagccucucugggaacuaauuguguucuagaugcaagagacacuuaacccagcauuugucuuagcagugucugccuacuaugugagccuuacgccaucccugagacucugccaggccccugcccauccacucaacacuuacaguugaacuuugccaggaaaucuagcucaucuaguucuccagcuuucuaauccuuccucucacccaagacugacccacuccuuguccuaucuugacgucccucugguuuauacagaguaauuaaaucacugguuaauugaugaauucaauuaaaucaaugucuuaccugagucccuguuaggauucuuuaaccuuuuuuggaaaauagccacaugucaaauuuacucacuucuucccaggucauuaaaaaaaaaaaaaaaaaaaaaacacacagaaauaacugaguaaaaaacacucucaaucuuugcccucuugguaucagcuuugagacaccuggccaaguacagccugugcuaaguuucaaagaggaggcagauaacuuugaagauuuuauuucacaggggacaacagauaaaagucucugucaaguugucauuagaugcuuaaugcuauucuugguggggagcuugaggcgccccuccuccucuguagacuucuagcagauuagguuucagagcuuuaauuugaggaaggauuuacagcugugaagagguauaauaucauuuugauuuggguuguacuaggcuggggaagccagauuacauuuguaugaaacuguauuagaccauaugacugaaaccaccaaaaucaaauaaagggaaaauuuuccagagagccuaaaaacaagagccugucuuuccagcaccugagcauuguuucacuaacuauuauucugauuuacaucuaggggauccaugcagaaaugcggagggagauggcaacaaugccugugcuugcuggaccuauccauucauuaaucugucaucaaccuaauccaggggcccauccccuagaacaagaggaaaaaaauuaacacuuagagaagaggggaaguuggcagggggaggggagauaacuuuaugaaaaauagccuucuuucaucuccggaggcacugucuaauucagagucucaaagaaauccaucaaauugucucucugggccucaguccauccaccgccaccauaugcuaccaugugcgugugucgcacggcauccccagauaaugacuuacgugggcaccgugccuuuccucuagaaccaucuuaaugcuauuuuaaaauccgacucucauuugcauggaaaacaauaaaucacuuuggguaacacagaaaacccaguuucuucugagaugaaacaugaaaaaaagaguuagcuguuguuuguaccacacagcuacacagaacugggcagacuaccagcaucuucuacugggauuuagagauggacgcaagaaacaccacggguaggacucugaaaauugaaauuauuuuugugccagucucuagauucaacuagaaugugcucuuggcuggggagaauuugggaaagaaguguuuuuuuuuuguuuuuuguuuuuuuuuaauugcaacuacuaaguuucaaaaaugggggaaaaucaugaagacagccacagacaucuucaggggcugacuaauucuuaaaugauugguuccucuaagagugguuaguggugaaagaguaaaugauguaugagaacgauuucucugauuucugccaggaguucuacucacucaguaaccacagggaauagaaggaucagguuuuccacagaaacuacuuuuagcacaugcuguguuucuacaccuguacuucucuuccgaacaacuaucuuagcuccaaguugacauggcccguuaccaaggggcuccaugucuuuuguuuuuguaguaaagaugacuugaauacagaagagguguuguaggagagcgcgucuucuccaaaugcuggcagaugacaguuuccgcagggacguaaagaggugacaaaggcacagaauauaauuuaguccugauuuccaggucuggcucacaaaacuaaucggaugaaaauguggccaaaagaauaccucggagauaaacuuucuagaacaagcuaacgccauaauuugacccuaauuccaaaaaucaugggaaggacauacuucuuaguaucuuuaucuuauucucaauuaaucaacaaaccuuaauguaaauaaauuuucuaaaauucauugucaccgaggaaaggguuaaaaaaaacuaaaguucucuuuugagaauggauuucuuucccucacuaccuucuuagacaauacaacagagguuauuucuagacccagaggagacaaugcaacauagcuucuccagccuuuggacacuaagcaaguuaucaauaaugcagaaucuugaaaccugacacuaaacuccuucagagguagguaucuugugagcaaaagagaacagaguaaaaggggcaaggaugggagaguguaagaagaaccaugcuguggacauuuuacuucuugggguguuaguuuccuucuaugcaaaauacaacuguagauugccacaagccuaaacaaaaucuguaagaaauaaauaaccuucaaagcaauuuaauaaaaagaaaugugcccaaaauauccucaaagacuuuauuaaucuagggaggcaauaguuaggaauaugagacaugagucaaaccaccugauuccacaucccgauugcacgaugaacuagcugugugauauugagcaagugacuuaacccccagauuuccuaccuguauaagaggaauaaugaaagcuccacaacuacugcaaaagcuaaaucaaauaauauguguaaagcuguuaguacaauaccugcccccacaguaaacacacaauaaguauuagaaauacaacaaauuauuauauuuaaguauaaagcgguaaucuguacauacuuggaacauuucugacuugagaagcuauaaaaucauggaucaaaacaguuguacaaaagaugguguuaugugagguccuuuggauuuaauauaaggagccaaauaaaagcaguccaaauuuagaaaaaucuuucaagcuauuccgcgaugacugugucugucaucacuugggaaaggaaacuguaugcuacucgcauucuagagagcuguuaggaaaugcuagcugacccucaacaaaccuucagccuccccaggaacacaguuaggcagcuuaauuugggcaagcgaggagaaagcaugagcccguacccaagcacugccugguuuccaucugcgcgauuuaaccacaagccacagagcgccucugcggacaccaaguccagcugccagggaaagguuucagacccacgguggugucccaacaauuuccaguucaguggaaaucuggggaacgcacaggcucauagcauaugauuucuucauguuucauuaguuuccagguuuuaaacaauuuuaaccuucucucuggcacagagcugcuguacuguaaguagaaaucacuggacuuugaguaacaugagccuguuucacguuuguggguggacauccaauuggcacagugaccuuggccauguccugacuccucugagcuucacuuuccucaucuguaaaaugggugaaagccaacuucagugaguucuggggacacaaacauguuucacaugugccuagauagaugcuguuagucucaacucauuugcuauccugaacuuaaacggguugccaaucuacucucacaccacucuaaaacaacaaaaaaaaaaucuuuucaaaagcuaacaaacugaacuaggagacgaagaaagaaaauucaccgcuacauaaauuagccaggagcaaagcaagaagcugcccgaguagggcaguuggcuucccacaauugauucuuuaauaacuucuguaauauuucugaggcacaucaaaggacaguaacagcccaguguugguaaucccucucacauauaaaaacuuucauuacagaguguuaaaggcaucacucugcuugagaaaucgcaaucaauagacguuggccuuuuuucuucuuuucuauccugggguaacggcaccagcauuuucucuccaguaaugcagugcuguguggccagaguuuccucugaugcugcagacgagcaccaagaugaaaaaaucuuugugauaaaugagaaagaggagaagaaguuugggagaauaccucucuguguuagaaacccgaaguguuccaugcuaauucacccuaaaugcuguuugcaaauauuggcuuagacaugcauuuaaaagucacagggauuuguuuuaacaugauuucuuuugcauucccauguggaaaauaccuuauuuuagagugagacgccaucucuauuucccaggcuggagugcaguggcuauucacagguacuauccucaacccacaacagccucaaacaccugggcucaagcaauccucgcaccucagccuccugaguagcuagagcuacugcaugccccacugcgcccagccuauaaaagauuucaauugaaaaauguuuccaauuagcacccuaagagcaggauaauuuuggaauacugcagcagaucuuagggacacaaacuaaaaggacagcaggcagucauuaauuucuuuguuccuuauuaucuauaauacaauuguuagagucagaaauauaaaauuacuugcagaaguuuuuuuaaauucagccuauuuguuuccuuugaaagauuacuccagguucuuuaaaaagccagaaucacauuuuucuuuuuauuaugaaugcauaaaggccaaaggccacucauagcaucucccucguaaaccgcaucuugccaaagcccguggccaauuucuggccucccuuuacugaaccacuuaguggcauuuggccaguugaccacuccccuccuucauaagccguuuucuugcacauaaaccccccaaccacacuacccuuuccccaccucuacuaccuggcuccauuugucuucauaguuuuauaggaauuuaagucaucuauuuguguguauguuuauuaucuuacuccaugucccaugccuagaaaucccugguaaguuguagauacuccauaaauauuugcugccuggcugacucuuaguauuuucuuuugacagauuaaaagcucagaggagugaagccacuugccuaagacugcauaguaaguggccgagucagaauuggaacucugagcccauacucaugaccuuuauauaauagaaaaagcagccucgggauaaauguccaagagcaggguuggcaaacuuuucccuuaaacgggcagacagcaaguauuuuugccuuugugagccacauauauauauagucucuugcauuuuuaaaaaagaauacuuuaaauacauaaaucuauuauuagcucaaagggucauacacacaggccacagcugaauuuggucuuaguuugucaaccccugcucaggagaauaggagcauuuucuacuggauucaugacuuuaacccaggcccaagaauccugugcagaaucaauuaagcuuuguacaaugauuuuuuuuuuuugagacagagucuugcucucucgcccagacuggagugcaguggcgccaucucaaucucggcucacugcaaccuccaccucucagguucaagugagucuccugcuucagccuccagaguagcuggaacuacaggcaugcaccaccacgccuagcuaauuuuuauauuuuuaguagagaugggguuucaccauguuggucaggauggucucgaucucuugaccucaugauccacccgccuuggccucccaaagugcugggauuacaggcaugagccaucacgccuggccagaaugaaugaauuuuaccuucauccucuagacaacaagauccucaagguuaccagacuugggcauguccuacaguuaaaaaacaguucacuuuccacaaaagggagcuggauaaauuccuauggauggacacaaugaucaagaggaggaagaauccugauaaauuccuauguaguaagagaaaauaacgcaagaucaagaguggcaaaaugcugaaaauuuuguguuauucuuuuuccaauuaagaggcuuucccccgcuaugaaguaagcaggcaucaccagaagugagaggaggaaaauaaccgcucucaccucuccagcguccugugcuccuauccugcugagacugucuuuuggcuacuacauaaaaagccaaaaaagugaguccuucacagcaugaggauacuuuuagcuguuggacacggagaagguuuucucuuggucuuuuauucaaucauucacagaaagggacauccugugaccucauuuucacucuaaaguaacagagaaagccaaguggcuuccugacucuggguucuauagaaacccuugcuuugauggugccuuucuccuccucugaggccaagucauggugggggcugguggggcuuccuuccauuuccaagacagguggaucuccuugggaaacagcugcugucugggaauccuggcagcaccagggauagagagagaagagaagcuccaguuucaacccucugagucacugcaaaagaauccccuucauuaaaacuaguucucaagggaaaggugcuuagagaaaaaaaaagacucagcaaaaugcauaggacacuuggguaggagacauuucauuauggccacuuugauagcaccacuuugaagcagucauuuugauuuugguaugaaacuucuuggaauuuuaguagaaguuagagaauuaccuaaguaaaugcuuuuugaucaaaaauaauuuauauuugccaguuugucuuucauuucuccccuuaaagauaagggcuaugccugucucguuuaccauuccaucucuaguacucaauaugguaccucacauauaggaaggguauauuuauuuaaaaaauaacuacuaugaccaucacuacuacugccuauguccagugcuuacauuagauacauaauaauuuguugaaaaaaugaacugcuaccaucacuacuaccauuauugccacauaauuacuauugucaccaucauuauuccuauuggcugucuauuguaaagccaaugggacaagcauuaugcuuagauuauuucaauuaucauucccauuucauagaugugaacacugaagugcagagaaguauccuaaaacauauauacaguaugugguaaaaaauugaauuagguuauuauuaugauuagucuugucaaguaaauugggagaaaugaauaggcugagagauaaggauaagguuguacuuagugccucuauuuuggacuuuuaagcauuucuuuucacggaaagggaccagggauucuuaaagaaaugacugauuccagaucugcuccaggaaauagacaugaugaauuggcaaauuuuguuguggaaagcuaucaaaaccuacuagaguaaugucaaaaggacuuggagcuaacuugaaaggggcucccacuggccaagacaaaucaacuucaauaaaaacaaugaaagugguagaaugaaauagaucaaauacacaaacauucaaacauuucuuaagaguaaaaaucaauggucacccuuagaaguugccaggacaccaacuuaugauuuagaaaauauuaacaaaaagaaacuaagggaaauuaaacacuuacccugccuuuccuguauggacaaccuuucaaaguaacaacacgacauggagggaacguuuuuccucauagaggaaucacaguuaauaaaagcaggaggaaugacagauuuagaaaaucaccauuucacagcucuuaaugaaauaaugggucuagacaaccaccauucauagcugcaaaaccuuugccuuaaagcuuaauuggaaacuugauauuuaaggcaucacacugacaacaugugaaucuaggaucaauccuaacuuaacuaaaugugggauaauaguacauuacaucagugguucccauacuuugaagcacauuagaaucacuuggggaacucuuaaaaaucuuaauguucaggucguguaccagaucaaucaaaucacaaugucugggguaagaguaucaguaauuuuaauuugagauguuuuaggugauuccacuguggagcaaaguucaggaaucuuuucauuuuauggcucauggugugaugcucccuaugauauauuaauguuacuaucauagggagauauauuaacauccuaugauauauaaccaaauauuuaccagaaacagaagaaacguguuuaagaaugacuacaaaaaugcaaaucagaaaucaaaugugugaaaaauucaaagagggugugaauggcauaucuucucaacaaacaaaugucauuuuaaaaaaugguguguugggggugggaauggagggcuuuccuuaaaacaugacuggaaaaguuaugcuucuggcuaugaaugaauaacuucauacaucagacuaauccuccugcagaaaguaauugugauagaugcauaaauuaaaaaaaaaaaaaaagcuguucaaaagcaucagagcacaaccaaggcaugcaagauucaagcauccuagaugauguaggcaaagaaagcccacugaggugagcucuauaguuaaagcaacuuuguguccuaagggcauuugcgaauuugcaucgugagggaauaaaccaaguagaaagcagcagcuagagcuugaugcaguuucugagcuagagagagaaguuuggaaguuaagggcuauagaagcagcagcuaggacuugagggacuaagauuugugagaacggugaaccaaagaaaagugaucccaauacuccuaacguaauuuccccuugagauauuugcaaauuccuaaacugcaaacauaugaagagaccaauuaacuaagcaaaaaucaaugcuaaaagaccaaaaacgaaggagccauuuugucagucuaaaaggguuggggagacaaaauugcaauuuagaagacacuaaggagaaagggccaucguaaaugccccaaaauuucauuugagaaacucaaaaggcuugaauuguuaggacaaacuagaaauagaccacagaauuugaaaaauaucauuucuggauuaaaucaauauaacuugcuuauacuguauccaccugccagaauguuaacauaucucugcaagaagauaaaauccacauuaaaggaaacacuaaaaggaacuaaaggggguuauuugggcagauuaaaaauuucccagaugaaagcauagaauguaggauggaagaaagaguacuagguaaauugggguaaguaccacucuaacaauuuaaucaagagaaaugaauacauguccacacaaauaucuauacauaagcagcuucauucacaauaauccaaacuuguaaacaaccccuaugugaaccaagugaauggauacacaaaaugucgaauaaccauacaauggaauacuauucugcaauaaaaaggaacauuaacacaugcaaccacuauucuccaagucauuauguucacuaaaggaagcgagacacaagggaguucauauuauggguuaauucauuaaaaauccuagaaaaugcaaaaucaccgcuagugacagaaaauaaaaucaacgguugccugagagcugggagugacagaaggaaauguccacaguguggcacaaggaaaguuuuagggguggcagaaauguucugcaccuugauuuugguggacucauggguguaucccucuuuuaaagcucaaugaaugaauuuuacaugggcacaguuuauuauauacacacuauaccccaauaagcuuuuuuuuuccuaaaagacaguugaaauuccccaaagacagaucaaaaagauaaguugcuguauuauucuauugaaguuuaaaaacagauaaaaucaauccaugauuauuaaaaugguguauaucuugcagagcagguguucacuuagugaacaggaaauuucuggguacuagugcuagugagugguauuuucuacaucuuugagaaauaguuacaugggauguuuauuuugaaaauauuuauugagcuaaacacuuaaaaugugugcacuuuugcuguuuuugucauacuucaauaagaaaauuuaaagguggaggauugagagaaauuaaagaaaauccaagagacaaagcaaccaaaggcaaugcauggaugucauauggcuuaugauuuuaaaaacucaacugaaaaaaaugugaggaaaugaaugaaaaucaaacauggacuauuuaucauauauuaaagaaugcuugcucauuuuauugcaugcuacugugauuacauuuaaaguccuuaucugcuaaauaaacauacuaaaguauuuauaggugaaauaauugaguaggauuugcuuuaaacaucagcaaaaaagaaacacacaggccaggugugguggcucaugccuguaaucccagcacuuuggguggcugaggcaggaggaucaccugaggucaggaguucaagaccagccugaccaacauggugaaacccugucuuuaccaaaaauacaaaauuuagccagguauggugguggguaccuguaaucccagcuacuugggaggcugaggcaggagaauugcuugaaacugggagguggagguuguaguaagccaagauuaugccauugcacuccggccugggcaacaggagugaaacucugucucaaaaaaaagaaaagaaaaggaaaaaauacaugugcucaaguauagguugaucaucauggaaguuggaugacagaugcaugagaauccauacuauucucuugaguuuugcauauauguaagaauauuuuuacaaaguaaaaauacaauucaagugaagaugagguacaaggaugaggcagagggcccaggagggugugaagaugucuauugugccuaugaccuauauucuauucuuugcacuuugaagauuaaaauacccacagcaucaaaauggcuaugucaaaaugucuugcuucagaauuugcauggcaagaauuuucucaggggcccagaaacaugacaagcaugaaaagaaugaaauuuacgagaguccaauuagguccugaaugacagccaggcagauauaugaugacaaacaguguccuucguuucuccagagacugaucuacuuugggcccaaagagaggaaagugagcuuguauaauccugggaauuucaccauccuucuucuggucccuaguuaucuccaucugaagccuauucagguuuuggaagggagagaauaaaaugggcagccaaaaaccagauucugauggcaucagucagaauccugacaggacacagaugucauacuccucugcaacuuugaagagaaauaaacuauuuucagagguggagguuggguuacaagguaaggauuugaagccccugguacuagcuacagcagaaugccuuuaguauccugggccuaaaaaagcaaagaaagagaacauguuaucagagccuggugagguaaagguggguggguuagggguaggggguggggagugggacgacuaucaucacugcuacagccuugaagggacacagacccugaaaaacaugaugagaaagacuuccaugggaguaaacaucccccaucucucucucucugcccauugccuggucucuuuccaguaccucccauugaccaagcccaaacuggaagacagagacauggaagcccaggugacacagucaaccuccugggucaacaagcagggcagacaaggucgccuaauaggcuaggaaggcgggggauggagaauuaccagcacaugcccccaaaggguaauuuacaccacacuggaauacauaagaucuucaaagccacaguuaguuagaaaugauggccauuuggcaaaagcuaauucagucagacccaggguugcagauccuuaauuuaaauggaacugaguauuucuaagcauuucacaagaggcccaaagacaaugaaugauaacagauucuuuacccacacacacacacccuccccaugggggaaacgguaaggagcuacucaugcucauucucaaguuuguaaaacaaaaaucuuuucuucuauauuagaaauuuccaaaguaaaugcacaaaaaaggggagaaaugugguugcauuuuccauugggcuuuaaccaucacucugcgaaagagaagaguucagagcaaagucaucacagguggaaacaaucucaagaucagaugggagaggaguauccucuuccccccaccucccccgcuccagggguaugugguccucucuugguuggugaugccaacccugcuuccucuggcccuggguuuuguaccugcugcuuucucugcccuuaaugugcuuuccucccuuccuucacuuguuaacuccuauuccuaucuuagcucaauugucacuuuccagaggaaacuuucccauguucacuaaugaggucaaagccccuaagacauacugucauagcaucuggaacuuuuccuucaugaaagcacuuucacaguuuuugguauggcuguuugauauugucuaucuccccagcugaacugguaguuccacguggcaaggacuauguguaucuuugaguaccauugcauuuccagggccucacauauaaucuggcucauaguaggcacccaacuauugucgaaugaaugagucuucacugcaagauaaagugacaacaguuuuccacucuagagaccaucuacguuuuucccuuucaauguacaacaugauuuuguuuucuuucccccaccccccacagcauuaaauuacuggaaacacauccuaugcucauagauggguagaaucaauauugugaaaaugaccauauuuccaagagcaaccuacagauuccaugcaauucccaucaaaauaccaucaucauucuucacagaacuagaaaaaacaauccuaaaauucauauggaaccaaaaaagaaccugcauagacaaagcaagacuaagcaaaaagaacaaaucuuaaggcauauuacccgacuucagacuauacuacgaggcagagugaucuuaacuguaccaagcuaaauccuacaucuagauucacagaugcaaaaguguuuaauaaaaccaaguuacuugcauucuuaggcucauguagaugcuguacgcagauggucuucuaaauagguuuuagauaugucaaaacuuucuccagccacaaagucaagaaugaucaccuuaggguugcaguauacucaauuauuuauacuccuucuaugaucaaggguaguaguaucugcauuaaguaguuuccuccaaaccagaaaggaacgaauuggcagaauauauuuccuugccuccagaaauaacuuaucaucauuagaaucaucugauauuuuugggaucuggaaucuauguucuguauuugugaggguaacuaugagacuugaacaguccaccagggaucuuaaaggcauguuuucaaaacacagcccccaucaaaacagugugcuguuaccaaauauguuugggcaaugccacugugaaauuuacaacauacacuaacagagaguuugagaaaucccauggcugguagagcuuggcaaagggaaauguguuucccucacauaucuaacuaggaaaccgucauuucaaauacuuccucuuacuauccugaaggccauauuuuaggaaaugcugcacuggaggaaagauguucuagaauagacagguacuacaagacugaaaaagagaaaauuuaacaugcuuuccugcuacugaaucuauucuauauauccuguuuuucuucauagguguuugccccacaauauuuuuguuuucucauuaucucuaauauuaaaaugggagaaaacaguaauacaagcauguugaaaaacugauaccgugaaauauugaaaauuugaaauugauuaauguugguuccuaaagcaaauuauuuuacugaaaaaaaugguucuauuaaucuaaauagauacauuuauuaauauguguugaauacauagguauguaccuaggaguuuuguagagagcaugucuguuuagaaauaagcauacaaauacauaacuucauguaacgaguaugcugaacaagcaugauccauugcauaaaacacaacauuuuacucuccuugccccucuaaauuugauuaggugguaauaaucuuccuuugcccuuggauaaaaacuacagcaggcccacgaguuugcuguucacagguaaugggcaguucuaaaacaacuucagguuacacauacagucccaggugagaaaacaaacuccacaaccauguugcuuuuguauggaaucuuuccccuucucagcuuggcccugcuucagacugaaagccuccagaucacccuguggccccuccaccuuauuagccagcauucugccuuucucaagguugaagaaacuaagagacagaagggcuccuccuugugcuaguucuguuauaaucuagcuuggcugucucugggccuggcagauaguuagggcugacacuuucucuuuugauaagcuuuuauggauucugcagagguuuccuguuggguucuuuucucaaacagcucacuagaucccagguggguggccagggaucccccaucccaagccccaggucaucuaggcaucugccuuggacuucauaugcuacuuuuccaugacuccuucaguuacuguauugaaguauaucaaaaacaaccccacguuggcccucuccuuugcacaguccagaacugauccccaggaaacacacacaucucaugccuugacaaaaacugggaaauauuggccacuucgcaagcaggagcauuccuacccuaccacccaagcaguuggccagccccucuucuccuggccuuccagaguuucagggugagucucaaaugcaugggcccucuaaacuucccaggcuugaugcaggcacaagccucugguuuuccaacugcaagaaauaauucagagcuuucugauuaguccucuuaaugccuccuauugggguuuuggguuacaagauaguacacucuacuuuuucucccaagaggguaaugaugacucaauacauggccacaguugucucuaaagagacaucuucucuugucuccucuggacucauauauacaaaagccauggaccaggaucaugacuuucuauaugaggcagcugucuuuuggucgcuguauuauggguggcucugugaaacugagacaauagacaauacaaccauucuaacauccuacuaccuacgucguacacauauauauguguguacgucauauuuuacuauacgguuucuauaacaacuucaaauaguuaacgcuauaagagccucaacacuccccaauucaauuauaaucuccagcuuucacugaucacugcugauuugguuauaaaugacuucacaaccaaaagcuuaccuugagaauuuuucaaucccuauguucccagauucaaauaaauaaaaccuacuugaaauauguggacuuaaaauagucuuccaacgcauuccucacacaugaaauuacucucgaauaacuagcuauuggugacauuccugauagugcccuagauuucucaacuuuugcaagagcccagauggucagaaagaacuuuaccaaauuugguuacuuguuuuuaauggaaggauuuuaaauguucuuuuaacaaucaucucagcugcauuuaaaggcuacuuagcaguguuugcagcuaggagaacagauaauuaccggagugaacuagcaaauuccuacugguuauaaccugaaaugggaaguaauacauggucaagaauguaaaaaauuacuuauauauauauacauuuacgcacacauuuuuuaauaucaagugagcaaaaugguauuaaaucugguuaauucugcccauguccauuugaaaaacaaccguguaauuugccuaagaaaaaaauucucucauaguuaagucagaugccuaauuauaucauccuuuaucugggacugucaaaaauaaaacauuuuggaucuauucacaauaaaaugacauuuucagauucaauuucauacaaguuuuuuauccauuaugcucacagaucaaaagugacuggauucaucagccaaaaagaauauuuuaaagagcugcugagaacuuuauaaaaauaauucugauuuucuuuugugggggaaacaauuucuuuuagaggaguuagaaaaaagugagaaaaaauuuuuugaaagaaaaagaaccaccaauguuacuagagagcagaguugacauggcguuacucacagugacugguuaaggguaaaagugggggaaaaaagcaaaacuguaaaguaacugauuauuucacugucuucaccuggccuuaauucaaaucagaacacuucucccaccugcauuacuucaaacaauuuaccagaaaagaagagaaaauguggauuacauaacccagagcauauagagcgaaacugcaaugcuaucauucagcaaucacagugcucuaguuuauuuuuaaaauagcucagaauuggccaugcucaagaagugguccuacauacagcaagagagcucuucguuuaauacaauacagauuuuuccuaacagcuuccucuacuacuucacauauuucuuccauaucccuacauggcccuccuaagaaauauaccuuuagcaaugaacacuaggaaaacauaucguuguggaaaggcaugggagagagucuacucucuuuacuugcuuuagcgugaggcagaaaauauuucuuacaggguagccauccaauaccugagcacuuucaaauacucugcagcagguaauuuguuuuucagaagggugggaguuaaaaguaacacagaaagucauaauggggugagagauuagacuuuucuccaaaguuacagccuuuagauuuagcuccugcaauucugaagggccucagagauaaggaaaucauguugcaaaugugagaagugagauuuagagaggugaagggaccugcccaaggccuccuagaaagaagaagagacucugguacucgaggcccucaaguccaggguucuuuccacuugcccagguuuaucccugguuguccucuccucugccccuugaucugacaaauguucaaaggauuacuuaaaauaguccccugcucaaaauaacaagggcuugccaaaagaagaaaaacaccuugaaauagagauuccaauuaacugccucugauugcuggauaacucuucaagacucccagaaaccgauucuagcaguauguguuauuuguuuauagccaaccuuuguuccaaaaauaacuugauauguuuuacagaaauauguagaauacauacaaugcagaaaauuauugcaaaggaggaaaaaggaugggaaaagcuaguaaucuuggggaugaauugucauacaccaagaaagcaauuuauauaccugguggcuuaacagcaaauauuauaaucaaugcaauaauagugacccagcagaaauacacugugaguugaaauaaaauguuaacaagaguuuguggggaagaauaagacacaaaaguccugauaaugucucaauaugcaggguuuggacuucugaagcaggucacuccuaagccuucaagcuuaggaaaaaagggaaaaaugagaggacagaggauagaugggacgacaaugggguggggagucagggaguggguagagggaaccacaacagguugacguccaccuagguaucacuuaucaaugaacugaaaauuuaucagguaauuggaagcucaaauucauacgucaccuggacugaacugcgcuuuuguuauuuauaaugcaauaugguauaaaucaauuggcuuggauuuuaaaauuagagcccaauuaccuguguaagggaaucauaaauccaacuuguauuuuucuaacaggguuaacaacucaugaugccagcuuaaacucaggaaaaucaauggucugggcuuaagaacaauugugcgugguacuuuaucucccuggucuaguguagcaggugggcagucuaggaguugggggugaaggauuugggggaggguagaagccuaaagcaaaggaaacaaacagaaaacauugaauauugcuaaaaacaccacaugccagguaaacaggaaggggggcacuuacauauaguagacagugaaaaucuggacaccuguuacuugaugaagcaucgcaggagcaaaggcaaaacacuccuguugcuuuucuuguucugcaaaacucuccagagcuaagagagcuaaugugagaugaaaagcuaaaaaaggagcgagucagaacucccacugacagcucccaaaucuggcccuuccuaaaggcguuugcgccugccuuaagccagagacucccuucucaggugcaguuuguugacccucucuucaauuggaaacaucugagguucacucagugauaaggggcacguggaggaauaaagcuguggcagugguggaggaauuaauaguccaacuuuuauggagggcaguuaacauuguguaugccuguguuuauguaaguauauauaccuacauauacacacauauauguuauauauuauugacauagaaauuccauuuucauaaaauucuccuugagaaaugguugaagaacagugcaaagauauacauacaaaauucuucauugcggccgggcgcgguggcucacgccuguaaucccagcacuuugggaggccgagacggguggaucaccaggucaggagaucgagaccauucuggcuaacacggugaaaccccgucucuacuaaaaauacaaaaagaaauuagccgggcgugguggcgggcaccuguagucccagcuacucaggagucugaggcaggaggcugaggcguuaaccugggaggcagagcuugcagcuagccgagauggcaccacugcacuccagccugggugacagagcgagaguccaucucaaaaaaacaaaacaaaacaaaaaauucuucauugcagcauugcuucuaagaaccaaaguugcacacaaacuagaagucauucaaagggggugauccaagccaaguguauuauauuucacucauacaauguaauacuauacugaaauuauaaaugacgauauaaaauucuauggacaugauacgugguaaaauaaaacaacaaaauaguauuacuggaugugucaauugugugaguguguguaugugugugaauaagaacgugugggagaaaauccugcauauuaaucaagcuuauugcuguuguaggauaacugauauuuuuuaauauuuuucuguuguguuggauuuuuaaauuuuaauuguuauaaaauagucagguauuacuuuuauaaucuggaaaaaaaaacccagcaauuuccauuuuggaucuugaauacaguaggaaggauagcaggguagcagcaguuacugggcaaagcagacgucaaccagggccuaacaacaaggcucucacugcacaaagcaccagcaccugucccauaauggcuucuguuuucacacaaaauuccgccaacuggguacaucuucucaaagaggggaaacaaaugcaccaaaauuaauuguagaacuuaucuuuauguucugggggccagaaaacucagucuauacugugcuucugagagcaaauaauccuuucuaggccuaaaauacagucugucuucuauuuugggcuugugguaccucuguugucucauuguucaaguggauguaaaaguauuaauucaaaaaacccauguucucugcuuaaagcacagaauugucaacaaaacauacuacagaacacaugccucucacucagucauuucuuugucuuaguuucuuguggucuauuccauaguaaggaauuugcaauguuggaguaagagaccuaagaggaccuuagagaucaccccauucagcauccucauuuuucacaagagaaagcccagacuagucaucaagugagcuagccaggacuaaagccgagggucugguagucaguccacuguuuaucacuucagcucuaauuccauucaagacacagcuauagcuucccccuucuggacaaucugaauauuccuuuagcuaauguugaaauaaaucagacuuucgacaucugaugugacauacagagagaaaaaggcaggaaaucuaacauaauguacuaguuagcuuuuccaaaugcaugagaaauacuuucaauaauggaaaacacuacauauacuacuuuaugcagucgacuuuugcuucugugauagaaaagggaaaaaguucaggggaagaaaacuacgcgggucauuuggugacguuuuuaagauuuuuacuuucagaggcacauaauuuaaaguguuuuucuuuuucuucuaucaaaaccaaacauaguuacuagaaaacaucugaaaaaugcaacaaaauuuuaagaagcaaaaaaagaaaacaugucacacaauucagccaacaaaaaaaccacaguuaaaauguuaguauaguuccuucuagguuuuuuuccuuuuugaaugguugagcacuucauauauauaccauuuccaaguuuuguuuuguuuuuuaccuaaauuauaccuaagcauuuuaugaauucauuaaaaacuauuuauaaacauuauuuaauguaugaauaauauuccaugguauagagugccaaauuuuauuuuuucuuuauuuaugucauuuaggguuuuucuauuauacauuauucuaugaugagcauuguaagaaauccaucuugaucuuaauuucugauuauuuucuugucuuaaauuccuaaaauggggaauugccagauuaaauacuaugagcauuuuaaauuaccaggaaguuuauaacaaauuuuguuguuccuaccaaaaguacauagaaguacccauuuuauaauccuuuuucaguaaaacauauuuucaaaccuuuguuaauuuuacagguggcaaaauuaaaauuaaaauuuauuuuaacuugaaucuuuauuauugaaaaauuugguauacccauuggccauuguggccauccuuuggcagaucuacucuugaggucuuggcccauuuauuuacugagaaaaaaggaaagcauuuugauagauccaaucuuuuuuuuuuucaauaaauaaauaaugaauuuuuaaaauaaauuaauaaacuuauuuaauucacuaaagcuuaagaaacacaaacuucugggcugaucaguuggaggcuguagaaaaaugaacggaacacacuuuuuuuccaaguauauuuuguauaagcucuaucuaauuaaugaaaccuuccugcaacuuucugcaucugcucauuccaagcauuagauuaacaaacgguugacauaaaaugaagagcuacaugguauuucuuugacauguggcauauaaaaaucacaaacucugucuuuaaaaauagaguguucugguucacacugguccacugagcaaaccuauuuacugccuuucccacccaaaauacuuucuaaaugauacuaaagaaaugcaaaagugcaaacucauaaccacaaagagaaugggaagaagccauuagaagauaaaugauuugaauaaaagucuguuggcuucugaaccacacagcaaaggaaaccacagccuaaaaagggauugcggcaaaggagggccgaccugccugguuauuccagaaagaaucgagccucagaaauagcagguacaacacaggauggaagagauugguggggcugaaaagggggguuaauuacaggccaggcugaauauguaacauugaccacccuuccuccuggcucuccauguggacuagccugaggccaagcaccagcuucaaggcaauaaaaaaguggggagaaccaucacaguuaucauuaguguuaaaaccucacucuaggccaggcgugguaguucacgucuguaaucccagcacuuugggaggccaaggcaggggggaucacuugagguugggaguucgagaccagccuggucaacacggugaaaucccaucucuacuaaaauacaaaaaguagggccaggcgcggucacgccuguaaucccagcacuuugggaggcccaggagggcggaucaugaggucaggauaucgagaccauccuggcuaauauggugaaaccccaucucuacuaaaaauacaauuagucaggugugguggcaggcaccuguagucucagcuacuugggaggcugaagcaggagaauggcgugaacccgggagcggagcuugcagugagcugagauugugccacugcacuccagccugggcaaaagagagagacuccaucucaaaaaaaaaaaaaaaaaaaaaaaaauucaaaaaguaccucagcaugguggcaggugccuguaauccuagcuacucaggaggcugaggcaggagaauugcuugaaccugggaggcagagguugcagugagccaagaucacagcauugcacuccagccugggcaacagagugaaaguucaucucaaacaaaacaaaacaaaacaaaacaaaacaaaacaaaacaaaacaaaaccuuacucuagcacauugcgauuccccaguucccaugcacacacccuaaacugaaacucuucaagcuugcuauucacaagacccacccacuuaaaaauagaccgcaacaauagccuucuuauugccucauucuuucacacacaccacagaucaccagaaauuuaauaugacaagaaagucuaccacagaaaagaaaaugagcaaguaaaacaacagaaaacaugacacuggagaaaacaguuuaggggaaagacacaaacuuuaaaaauaaaaucuaguuaauaucgucaagaaagauuugaggagauuugguaacuacaaaacaaaaacaggguucuauugaaaaggaauaaucagauaagaaagagcucuuuggaauuuuauaaaugcguaaguaaaaaauucaauagaaaguuuguaggcaacguuggaaaaaaucuccuagacuauagaccaaguacagaaguaagugagaaaaaaauaaaauauauagaugaacaauucaggaggucuaaggaugacuaaccaaauuuucacaauaagaaaaaaagaaacuggaguggagggaauuaucaaagagauugcaugguaaaauuccccagaguuaaagagaaagaugaauguucaaaguauaggaaucuacuugauaccaagaauaauuaacuguaaagugguagaaaaaugaaauuccuaacaauuuccugaaaaguaaaaaaaaaaagaagguggccuacaaaauaagaaucagaguagcaucagacuuagcagcagcaggauugcauacuaaaagacaggaaaaaggauuuucaacagagaagucuacacccaaacuaucaauugucuuuugagggcaaaauaaaaaauucuaaaccugcaagcaugcagaaaguuuaccucccauucacccugauauggcuuggauauuuguuccugcccaaaucucuucaaaauguaauccccggugcuggagguggggccuggugggagguguuuggaucauggggacagaucccucauaaauggcuugggcuauuuccuuggugacaagugagcuauugcucugaguucacaugagaucuggugguuuaaaauuguguagcaccucgcuuccccacucucucucccucuugcuccugucuucgucacauuaugugccuacuuccccuuccgccauaauuguaagcuuccugaggccucccuagaagccgagccagcaccgugcuuccuguaaagccugcagaaccaugagccaauuaaaccucuuuucuuuauaaauuauccagucucagguauuuauagcaaugcaaaaauggccuaauacacacccuuucuuaggaaguuaauagcaaaaucagaaggcaaauuagaaaagaaagaaaacccauucaauccagcaaacagugacuccaacccuggagagcaauggggacaucucaggaugauucuacacagcaugucuacagagccaccuguccaaaugggagcaaaauggaggucuguaagagacaggaccaauagaacaaagaguguaauuaugagcuugaaaaaacuugaagauauuauugagguauauacucagaaaaggcaauaggacaucagaaauuccagcaaaaacaaacaaaaauaacuuuauaagaaaaacuugaaauauauauuacagaaacuaaaagguggaaugauuuugauaaaaugauuuaaaggaagagaauccauuugcaccugauucuagacacaaugucuuugaguaucacaggaauugugacagagaccauguggggcugcacuaaauaauuuagcaaaucuuaauugugcaaauauuuucauuauuuccaacuuuggaaaaaucacaaaaaaagacuacucuggugacagagcaaaugucaauuaaauuugacaaugcaaaaauaaugguauauagcugaccgagaauggaaaguggaaggaaaagaaaagcagugaagaaaaggguauugagugcccauaucucauccugugauguguggaggcaagagacacaggcuagauugauggaccaaucaggggagguauaaauacaauuuagaaguggcaagcccaauagaaguugagaauaaugucauguuauggugggagcaugugaaaaguuuaguguaaguuaguguaaggcaaauacuucuugucuuuagaagaaaaucaguagauaacauaaaaaauaaauaaguguuaacuagcaauauggaaguaagaccaggaauguugaaaagugauugcauuuagggagcucagcuggaggugggaagggugggacugggaacuguuacuuugcacuacagguguuucaaaaccauuugauuuuuaacuacgugcuuauuuuugcuuucauaaaaaacaauuccaaauuaugauuauaaaaagcaaguacauuguuacaagcucuuuuacuaaaaacaacaacgcauaauugagccuguaugaaaugcugucuucuaagccacuggacacgcuggaggaauagcgaauaaaguauaacuggauuuauuuauaacgaggagagagcaaaugcaguguacggaaaugagacacaucauuuuaucucgacagaacaauuaagcuuucauuagggcuuaaugacaggaugacauucggggguuuggaggguaagcacaucaccuucauuaucaaaucaaagauuauccaguaucaagaggaacaguuuuauuuauucuguauucuccucgaacuccccaccccaagcucugucaugacccuagauaagaugggaauugaacaaaaguccccaagugcuaauugcauauucucucacauccccaagauugcugucuccuagccauuugauguuaauaucacagaaagcagacagcaaguguauauuuggaugcacagcuagguacauuucccagaauguauuuuggaagggguuaguuguuggaagguuggcaagacacuagugacuccacguuuuggcuacuacgccuuucuguccugaaagccugguguccauguuauuuagaacagccuggguaaacuuauuacugcacccuguguucacagaaaagguugguucugaguucaauuacaaucccuagcaguuuaaacgauagcugcugugcuauaaucuaaaauaaauugcuuuucucaagaagccauguaagccuuugcacugcaucuuagcagagcugcugguuuuaucucaucugaaacucaagaaggguacaaaagcaggaccucugaacuccuguuguuaccucaaaugucauucuucuacacuucuggggcucucucuucaccccaaauuccuaucccagaacuagauuuaugggaaagcaacaguguuuucauuuuuuaaugcaaaucaucauuuuguguuuauuguuuucuauauaagcugcauacuuugccuggggucuuuugaaagaacucuauuacugggggcaagauuuguuuuuccucuucccacagcuagaaggcuaaccugcuaccaugggccaagauagcaaguaugaggacgcccgcacccaaaugaauuggggcaccucuacagacucuccauucaaacgcacauccuccuccucucuccaaagggaauggaggaaaaggaaacaaacuugucaagcgcucaauacgugaaaugauaauucuggcuuucuccacccuccaccuccccaggaguuuuucccaaaggucccauuggcccaagcucaagccucagcacuucucuaaacaagaugcuuguagaucccuuugaugucuuuccacaaaggcaauuagaaggguuuccaacguuaacuauguacauucuuucagauuuaacaaggcaacuuaauuaacacugcuguguuucugcuagucaacaagagaaaauuguccuuucaagagauuuugcacauugacaaaaauaauccaguaauacuuuucccuuucaaauauuuuucuucuauugagauugaaagaggugguuugcagagugcuauaugguaugugcucagcagcauuuuucugaaagggaauuuuuuuauguccacacaaaaaaaaacauccaggacaaauaaaagccaaaugaauacuuuagacaaauucaaacucaaacuuagagccacucagaaggcaaggaaguccuauuucuuuuuauaacauacaugcaaccaugccacgggaggauaugaaauguagcucaugaauuauguuuauccuuaaguucucuuggagcuauaauaauuagaaagagacaaagugcugauucucaaccaguaucccuaggaggcacuaggaaauggaggaggugaggacauuucuuugaugucucagcaauuggagggcaaaacugacauuuggagaguucucaaaauguugcuaaaaguucuguaguguguuagcaccacagagcgaagacuuuuccugcccagaaugccaauagaucccccuugggaaacacugaccucaaaugggagguugucaaugcugcacuaaggcaaaaugagcuccuuguccuggguccuuugauuucucauuuugcaaacuuaggugucuggcagauagucaaugacuaaaggaaucaucuaguggugaaaugaugguaagucacuuauccauucaauaaauauguauuauguaccaucuguguacagugaaaguacugcuauugaccaagagucucuccuugaccaaacguuaaucaggcuccucugauucucucccuaaucaggccuuaacuuuuggacuucugugucuuucucuguauugcccaauuuuagcaagaauccucuuagacugguuuauccagaacccuucaucuucaauauuggauuacccucaauaucugaucagauuccauauccaccaccaucccuuaggugguuuaaucacauggccugccuuuagguacauuucauaacaauguauccaauuuuccugauccaauuuuucugcauccuugccagcauuuggcguuauuauuauuuuuuuccaauuuuuuugugguaaaacauacauaacauaaaauuuagcaucuuaacaauuuuaaguguauauuucaguaguauuaaguacauucauauuguuacaaccaucaccaccuaucuaucuccagaacucuucaucuugcaaaacugaaacucuauaccauuuaacaacucucaauuccuacuucuccucagccccuagccaccauucuacuuucugucucuacgauuuugaauacucaaagcaccacaaauagaugaaaucauacaguauuugucuuugcgugacugucuuauuucacuuagcauaauguccucaaguuucaaucauguuguagcauaugucagaauuuacuuccuuuuuaaggccaacugauaaggagggacuuccuucugucccauuuugcuauugauuuucuacacaccuuacaguuuuuuucugucccucauuuccugcaucacugucuucuugugugguuaguuuauuuuuuguagugaaacauuuaaauuccuuucucauuuccccuuguguauaucuauuuucuuuguaguuaccacagggauuauauuuaauauccuaaaguuaucgauucuaauuuggaauuauaccagcuuaacuuuaauaacauacaaaaacauugcuccucuacuucucuguccccacuucuuuaaauuauugaugacaaaaaauuaacaucuucaugcaauaugcucuaaaauauaaacugauauuuuaaaagauguauuagcuucucaaauuauguagaaaacaaaauguggaguuacaaaccaaaguuacaauaauacuagcuuuuagacuaauaauuuaaaaaaauuagucucauaucauguagaaaaaaaauggaguuaacaaagcauuauuacaauaauacuagcuuuuauaauugcccacauuuuuaccuuuacggagaacuuuauuucuuaacuaagauucaaguuacuauuaguguccuuucauuucaaccuguagaacucauuuuagcauuucuuacagagcauguguagugguaauaaacuuccucagcuuuuuuuuuuuuuuuaauaugagaaugccuuaauuucuuacucacuuuugaaggacaauuugcugaauguaggauucuugguuggcaguuuuuuuuguuuuguuuuguucuuucuguagcccuuugacuaugucagcccauugcauucuggacuccuacauuucugacaauaauucugauaaucguauugaugauuccuucuacauaaugaguugcuucucucauguuguuuucaagauucucucuuugucuuucaacaguuugaguauacugugucuugugucuugggguggaucucuuugaguucauccuauuuggaauucauugagcuucuuggauuuuuauguuuaugucuugcaucagauuugggaagcuuuuggccauuaugucuccaaauaaucucucuauucuuucucucucuucuuaagcuucugaacucucacaauggguauguuggucugcuucaugguguccagcagcucuguuccuucuucuucaauauuuuuucuuucuguuccuaagacucauaauuuccuuguccuaucuucaaguuuacugacucuuucuucuaccuguucaaauaugccuuugaauaucuccagugaauuuuucauuucaguuauuauacuuuucaacugaaaaauuucucguucuauuuuuacuuuuucugaaucucuguauugauguugcuaguuaguucauacaucauuuauuuuuuacuuuuuccauaucuuuuaguuuuuugagcaucuuuaagauacuuguuuuagacucuuugucuaguagauccacaauuauaacuuuuucagggacagaccucguugguucauuuucuuuccuuugaaugugccauacuugccuguuucuuuuuaugugcugugauuuuguuguuguuguugaaaaccggacauugaaauaaaauaaugugauaacugugaaaaucagauucuccuuccccuuccccaggguuugcuuuuucauucugaauuguuguagguugucucugugcugaggauaagccugagauguaaaguuaaguccuucucacaucuuuugugagccugcaucuuucucuagguaugagcggugacuuucuaauuucccauguauauguggcugcuuuaaaauguacuagucuuuaaugucuggcuccaaacacaaaaggggaaaagaaaaaaaaugaaaacaaaaggaaaagagugcuagcccuuuaaauccccuggaagucacuucagcuggagaaagaagggcuugcaacaauggaaggaaaugcaacaacaauggccccuggcucugucugcaccuuuguaaucagaagcaacaauuagcuaucagagaacagauuccugauuuuugaaugacaguggccuuuuugcacacccuggcucccauaaacugugugcaggcuacuccuggaaucugugcaaggaugccugcgagugggguaugaguagcugauauuauucuaagagcuaaagucaaccacaguuaagggcaauuuacugcccaagccuucucuuggaaauuaaaagccuucaauagacucuagaguucuaaaauaguuacaucagacagauuaugccaugcaguuguucucuaggugaggagauacauuccuggugcuuucuacuuuuugaucuucccagaauccccuccuuaucaauuuuuuuuauuuagccauuuuaauagauggguaaugauaucucauuaugguuuauauuugcauuucucugauggcuaaugauguggaauaucuuuuauugugcucuuuuuuuuuuuuuuuuuuuuugccaucugccauucucuucagugaaaugucucuucauguuuuuugcccauuuucuaauuggacuguuuggguuuuuuuacucuugacuuuucagaguucuuuauauauuguaaauacuaguucuuuguguaauaugugguuugcagauauuuccaaccagccuguaaauugacuuuucauuccuuguaguugggcuuucacaaagcaaaaguuuuaauguugaugaaguugaaucuagcaauucuccuuuuguggauuaugccuuugguguuaaaucuaaggacacuuugguuuguuuuuuuauuuuuauuuuuuauuucuauagguuuuggaaaaauaggugguguuugguuacaugaauagguucuuuagccaugguuucugagauuuuggugcacccaauacccaaacaguauacacuguacccaauuugucgucucucauccuucaccucccuccucccucacuugaaucuccaaaguccauuguaucauucuuaugccuuugcauccucauagcuuagcucccacuuaugagugagaacauagaauauuugcuuuuccauuccugaguuacucuacuuagaauaaugaucuccaauuccacccauguaacugugaauaucauuauuucauuucuuuuuuacggcugaauaguauuccaugguauauauguuccacaauuucuuuauccacucauuaacuguugggcauuugggaugguuccauaguuuugcaauuggaaauugugcugcuauaaacaugugugugcaaguaucuuuuuuguauaauagcuuauuuuccucuggguagauacccaauagugggauuguuggaucaaaugguaguuuuacuuuuagugcuuuaaggaaucuccacgcuguuuuccauaguggcugcacuaauuuacauucccaccagcaguguaaaaguguuccuuuucaccacauccccaccaacaucuauuauuuuuugauuuuuugauuauggccauucuugcagcuguaagguaguauuacauugugguuuugacucgcauguuccuaauaauuagugaugucaagcaguuuuucauauguuuguugguuauuuguauaucuucuucugacaauugucuauucaugucuuuagcccaguuuuugaugggauuguuuguuuuuuuucuugcuaauuuguuugaguuccuuauagauucuggauauugguccucugucagauguauaaauggugaagauuuucucccacucuguggguugucuguuuacugacuguuucuuuugcugugcagaagcuuuuuaguuuaauuaagucccaucuauuuaucuuuguuuuugcuuuucguuucguagucaugaagucuuugccuaagccaauaucuagaagaguuuuccaauguuaucuucuagaaauuguaugguuucaggucuuagauuuaagucuuugaaccaucuugaguugauuuuugugcaaagugagagaugaggauccaguuucauucuucuacauguggcuugccaguuaucccagcaccauuuguggaauagggugucuguuccccacuuuguguuuuuguuugcuuuguugacgauugguuggcuguaaguauuuggcuuuauuucuggguucucuauucugcuccauucgucuccgugccuauguuuauaccaguaccaugcuguuuuggugacuauggucuuauaguauaguuugaaguuggguaaugagaugccuccagauuuguucuuuuugcuuagucuugcuuuggcuuugugggcucuuuuuugguuccauaugaauuuuuggauuguuuuuuucuaguucuaugaagaaugauggugguauuuugaugaaaauugacuugaauuugaaagaaaaagauuucuuuaggcaauauaggcauuuucacaauauugauucuauccaucccugaacaugggauauguuuccauuuguuugcgucaucuaugauuuccuuaaguaguguuuuguaguuuuccuuguaguggucuuucaccuccuugguuagguauauuucuaacuauuuuauauaagaacauuuugccuugccuuacauacagagauuuucucccacauuuauuuuuuaaaauuguuauuauuuuacauuuaauucuaugauccacuuugaguuaauuuuuguaugaagguaugagauuuagaucaauguucauuuuuuuucccaauggaugucuaaugcucuagcaucauuuguugaaaggcuggacuuccuucauuaaguugcuuuugcaucuuugucaaaaaucauuugagccuauuuauggaagucuauuucuggguccucuauucuguuccauuuuguauauucuucugccaaaaccauguugguuugauuacuauagcuauauagcccuaauauuggguggagauauauaucucuuuaauguuggguugguugauucuucccacuuuauuuuaugucaacauuguuuuagcuauuguagguccugugcauuuccauauaaauggagaucaaauaaguuugcuagaauuuuguuagaaauuuaauuucucaaagaucaauuugggcagaacugacaucuuuaccaugcugagccuuccaagucucuacucauuuaagucuuuaauuucuuucaucagcauuuuguaauuucauuauauaaacucuguaccuguuuuuauuuacuuauuuauuuauuuauuucugagacggaauuucacucuuguugcccaggcuggagugcaguggugcaaucucggcucacugcaaccuccaucuccuagguucaagugauucuccagccucaggcuccugaguagcugggauuacaggcacccaccaccaugcccggcuaauuuuuuguauuuuuacaagagaggggguuucaucauguuggccaggcuggucucaaacucuugaccucagccucucaaagugcagggauuacaggcaugagccacugcacccggccucuguaccuguuuuauuaaguguauaccugaaucuuuuauuuucuuuggaacuauuguaauugauacacuguuuuugauauugguuccuacacauucuuuguuagcauguaaaaauacgauuaacuguuguaugcauccugcacccuugcugaacucacuuguucuaggauuuuuguuguuguagauuucuagggauuauauauguagacaaucauaucaucuacaaagagagauuuauuucauuuauuuccaaacugcaugccuucuauuuucuuuucuugccuuauuguuuuggcuagacuuuccaguacugguugaauaaaagucaugagagugaaccuccuggccuuguuucuaaucucagggaugcucuuuagcaagucgagauaauucaucacuauuucuaaauugcugagaauuuuuauuauaaauagauguuggauuuugucagacgccuuuuuauaugaugauauuauuuacuuuuuuuauuuuuaauuucuuccaguguuuccucaaugaauuuucuucuguagcuuauuucuaugguauauuacauuaauuaauuuuaaaauguugaaccaaccuuacauaccuggcauauaauaaauccuacuucaucauauuacauaauucuuuuuauucuuugcuauuauuucauuaagaauuucugagucaaaauuuacaaaagacauugaacuauagucuucuuuccucccucccccuucuuccucuuccuccuucuucuucuuugccugguuuugguaucaggguaauaaugaguugaaaaguguuccugccucuucuauuuucuagaaaagauaauauaaaauuggcauuauuuuuuuuuaacauuugguauaauucuccagugaaacaauguaguccuagagauuucuuuuuugggauauuuuuaauuauuaauucaauuuuuuaaauagcuauaggacuaggcuagggcuguucauuucauguuggcugaguuuagcuaguuuuuuuuuuuuuuuuagaaauuggucuauuucuucuauguucguugaauauaugaguguaaaguuguucauaguauuuuuauuguguuuuagugaccacaggaucuguauuuauauuuccuauuuccuuccugguauugguaauuuuguuauugucaauuuugcuaguaguuuaucaauuguauuaauuuuuuagaagaaccuguucuuugucucauugacuaccuuuuucuuauuuuuaauuccauugauuuauucuuuuauccuuauuauuuccucugucuacuugcuuuuacuuuauuuuucucguuucucaaaauaggaacuuagguuauugaugugaggccuuuaaagacuuacucuuugaccuguugauaacuuagaaguguguuauaaauuuucauguuuuagagauuuuucugcuauuuuuuuguuauggauaacacauucuguaaaaauuugcuaagcauuuuuuauggccuaugauaugaucuauuuuggugaauguucuucgguugcuugagauaaaaaguauauucugcuguuguuggauggaguauucuauauauuucaauuagauucuauuugcugauugugauggcgcaaucuucuauauucuugaugauuuucuguauaguaguucuauuuguuguugagagaggacauugaaguccugaaauauaauugaugauuuauuuguuucucuuucaguucuaucaguuuuugcuuuguguauuuugaggcucuguuauuugguauguacauaagaucauuuugucuuccagguggauccauucuuuuaucauuauauaauguuccuucuuguuuccagauauuuucuuuguuccaaaguccacuuuuaucagauacuaguauaagcacuccuguuuuuuuaaaaauuaauauuuguaugauauauguuuuuccacccuuuuacuuucaacuuaacuaaucauagaauuugaagugaguuucuuguaggcagcauacaguuagauuauguucuauuauucacuuuguuuaucucugucuuuugaugguguuuagaugauuuaccuucaagguaacuauugauaaguuagcauuucacuauaccauuucauuacuuguuuucuauuugauuccucugguucucauuccucuguuucucuuuucuugccuuccuguguguaaccuaaacauuuuuuaggauuucauuuugauauacaguguuuugggaaguacuucuuuguauaguuuucacugugguuucccugaguacuaaaaccuaauaugugacuuguuacaggcuacauuaucaacauuuaacuaguuugaaacuucacucccauuuaaaucucuuguccuucccauuuuucaauaacauugaauugaguaucagaugguauuauaauuuuuguuuuaaucaucaaacaugauuuauaaaacucaaagagaaaagaacaguuuauuguauguacccacaaaugucuuuccaauguucuuucuuccuuccuaauccucuaagauuucaucuuguauuguuuccuuucuguuuaaagaacuuucuuuagccaaucuuuaagaguaggucugcuagcaacaaauucauuuacuuuuccuucaucugagaauguuuuuauuuccucuucacucuggaaguauaguuuuuccagacauagaauuuacaguugauaauucuuucaguacuugaaaaauauuguggcauuuccuucucaucuccauuuuaugagaaaucugcugucauuugaauugguauuccucuauagguaaugugucauuucucuuacugcuuucaagauuucuucaguauauuuuauuuuuaaaagauuaauuaugauauaucauagcacagauuucauugggauuacgugugggguucauucagcuucuugaagcuguagguuucugucuuucaccaaauuaguuaaguuuucagucaucauuucuucaaauacucguguuuauuuguuuguuugagacaggaucucccucuaucacccaggcuggaguauaguggcacaaucacagcucacugcaugcagccuugaccucauaggugcaagaaauccuccugccucagccuccugaguagcugggaccacaggugugcaucaccaugcccaauuuaucuuuuucuuuuuucuuuucuuuucuuuuuuuuuuuuuuugagacagagucucacuuuauuauacagggcagugacauaaucaaggcucacugcaaccucugccuccugggcucaaccaauccucucaccucagccuccugaguagcugggacuacaggugugcaccaccaugccugguuaauuuuuuuuuuuuuuuuuuuuuuuuuuuuugguagagacaggguuuuaccauuuugccuaggcuggucuugaacuccugagcucaagcaauauggccaccucagccucccaaaaugcugagauuacaggcaugagccaccaugucuggcugucagcuaaucaaauacucuuucagucccauuaucuuuauccucuucugggacuccaaugacaugaauguugggccauuugucauugucucacagaucucugggguccuguucauuuuuucagucuauuuuuggucuauugcucugauuggguggauuccauuguuuuguccucaaauuuaguaauucuacccucucuuaucucuaauuaacaguagauagucuaaccuaucguuaauacuauccagcacuauuuuuauuucuguuauuuuuuauuucuagaauuuuuauucaguuguuuuauaacuucuauuucuuuucuaauauuuucuauuuuaaaaaauuguaucaaaaauuugcagcugcuuuauaggucauuuauaugacagaugcuuuaaaauuauugucagauaauuccaauaucugauucaucuugguguuugugucaguugauugucuuuucucauucaauuugugauuuucuugguucuugguaugaaggauaauuuuuuauugaauccugggcauuuugccuauuaugauaggagagacuagguccuauuuaagucuuucguuguaagucaguaacccuguuaaauuaaucaugugggucuuggcuacuuuuaucagcuguggcuccaguggcacucuaauuuucacagacuuugagguguuauuuuguucugcuugauuaaucugguugcaagaggccacugguuccugccucuaccccacugccuuguggggcagaacagauuuccccacacugggccucagguaucucucagugggagaggaauacgguggggucugccaucugccucagugucuuugggcagggaaggagagucucaggcaugugagaacaaagaggcuuccuagaauuggccacuuuuugugguugcauccuuguugcugguuaugucuucuugccccagugacucuagacaggggaggaucauuugaggcacacagagaaaaagaggcuucccugacaguauuauuugcuauaguucauucuuuuuuuacguguucugccugcccacuucaguauuucuugguggaaagggagagucucagggcugagggagagcagaguccuuccucuggccaauuauuuuuggcgaggcuuccaauuaaucucuuuggcugguagcguugaacuugucugauaguuccagagggacauccgcucaaucaggaaaaaaaaaaaaaaaaaaaaaaaaaaucagccucccugagcugcuucuuguugccaggcuuggacuuaggaaacacucaguuaggaaacacucggucuaggugaccaucuucuguuggguugggacacucuaaacacucugcuacugugcuguuccuccaggccuagggaggccagcucauucuuuuuuuuuuuuuuuuuuuuuuuuugagacggaaucucgcucugucgcccaggcuggagugcaguggcacgaucgcuucucacugcaagcuccgccucccagguucacgccauucuccugccucagccucccaaguagcugggacuacaagugcccaccacuacgccuggcuaauuuuguuuuuguauuuuuaguagagacgggguuccaccguguuagccaggauggucucgcucuccugaccucaugauccaccugccucgcccucccaaagugcugggcuuacaggcgugagcaaaccagcucauucuuacugucuuucagcgcucucauuugguugucucuuguaccauuaccagaguugguaguuguucuuagcaggaaaaagcaggggaaaaugggucuacaucaucuuuucuggaccagaaaucuguuuauuauauuuuaauugcauauuuccauucauuuuuuggcaauuaacccuuuuagaucuuauuauaauuauuuguguacauccacggauuugaaacaucuugguaauuuaucuuuguguauuuuacagugccuugaacaaagcagauucuuccuuaaagguacuuauacaugaaugaauguucaugcauauuuucucuggggcuguacaauggaacaagaccuaccuguuaaaagagugguuguugguagaauguaaacaugacuuauaaguguucauccuugcaaauggacauaggaguaacagggagaaacuugcuuaaugugauuuacagaaaccugguucagaacauaggcucacuuggucaucacuucccucuggucaucacaaucucacaaucauuuuucugcuuucagcagaugggaacaugugauaaugcugugacagauuuccccaccauuacuuccuaaagccauuacccgcuucuagcuuaaaaccuugaacacacaaacacacacauauauacacacuaacauacacauacauguauguuucaagcauccaagauaggaaguaggggaacaugaugaauuuucuuuucuagaaauaaaacaaucauuuguccaaugaaagaugagcauaaaacacccauaccuaauaacaaauggcacagaacaacauugcugggaauccccaaauagaccucacgaaaacaucacugaagauugcaugugagagcuagaaggccucaggcagggaaugccauggaauguaagaccaggccccugcuggggcucagaaauaggaaugauagaaaagcaagcaggaagagacccugggcaauugaguucucccacugagcaagaaagaauugaaaauaacagcauuaggcaggaaaacaauggaugccugaccucccauuuaaccauuguaaucaugcauuguuaucaauuggcuuggucuuuuaagauuccuagucacuugucccucauaucuguggcacauacuuaucacuguguggauuugcuuuuuggcaaacagaaguuuuaauuuuuaauggagucaaaucuauuacucuuuucagaaacgaucuuucucuuugucuucaaguuuaugaaguccccucucacuccaguagggauaaauacucauuucuauucuggguuucuaaugauugauuuuauacauuuauuuauugcuuuaauccagcuggaauuaacauuagcauaugguguaggaagacuguaauucuuccaacucuaaugcauucuugauaaguaaaaaauaggauuuccuacaguagaaaacucagccuagaaaccugccuuucaguauccugaggcaggaauggagugaaugaggcacuuuccucaaaccuaaaaaccucauccuguuuuacuggggacuugggauaaccuucuuuauuucucagugucuccuccuuuguguacaguagcgacacaaauauccacuguguuuccaaagagaagucaagugcuuaagcuccucaaauuuucugaguacauucuauguagaggauuuuccauuacugguuacacuuaauacacagggccuugcuggagaaugugaccaggagaacuagaacuucagaaaacacaaaaugagcuaucaaaggcuuggcacuuuguagggguguaaucagaagaaaaacgaguccuaauauuuagaacacauuagauguaaccucuuaaacuccaaaguucucuucaaaucuuaccuauuuaauuugaaagcaagcaauguuccaguguuaacauuucugauuugggggaugccagauagugaaauuuggauuaaacagagggaauuuauagucuuauucuaauuaauaaauggacuuaacgggguucugaaaauaaaacaaccucauaauuaguugguaauuaacauagcuaagagccagguagaacuguccaaccugugucauauucucacaggugugcccacaaaauacaauauuauauagaauaaauacauugcccaccuucauucauccagcaagauguacugacuuuucacuguaggcaugaaccugaagggaauuaaaaaugaaggaugguccuugcucucacaaaagcugccaaauuggguacacucacucagugucuucaaggaacacauggucagguuucuagauuaugcuuaacuagauugggagaguggauuacccucagaauacccuugauaaaagcuuucaaaauuuuccuuuacucacaaaaccauguuuucagggaaccuaaacagaaguccaauauauaagauagaauaauagauaaaaguauaaauuauuuggucaaaugaggacuacuaguguucucaaaacacuaccccacuuccaaaauacacacauacacacacacacacaauuccuggaacuuuacagaguagaguuucaaaaucacugcagcugaugaauugacaaauagaaagaagggguaacagauagguacaaauguaauauaauaaacacaauagaauguuaauguuagacaccaagcggugguuacacaggguguucacuauaaaauuacuucaguuuucauauacguuuaauuuuuucauaauacaauauugaaaaaaaaaucccgcucuugauuccuauaucugaaaguucuuaaaguuuuaguugaguaaacauuuagaauuauuggccgggugcaguggcucaugccuguaaucccagcauuuugggaggcugaggcaaguggaucaccugaggucaggaguucgugaccagccugaccaacauggugaaaccccaucucuacuaaaaaaaaaaaaaaacacaaaaauuagccggguguaguggcaggcaccuguaaucccagcuacuuggcaggcugaggcagcagaaucacuugaaaccaggagaagaagauugcagggagcugagaccaugccauugcacuccauccugggcaacaagagcaaaacucugucuugaaaaaaaaauuggaauuauuauuuguucuuaauugaccccuuuaucauuaugauaugucccucuuuaucuuugguaaaccuucuugucuuaaaguuuacuuuguguaauugauguagccacauuggcuuucuaaaaauuauuucuauaacauauauuuguauuccuuuuacuuuuaacucuuuguguuuuuguauuuaaagugcauauguuguagucagcauauuauuggguuuuauuuauuuuguaucuuucaugcacguccgugugaagagaccaccaaacaggcuuugugugagcaacauggcuguuuauuucaccugggugcaggcgggcugaguccaaaaagagaguuagcgaagggagauaaggguggggccauuuuauaggauuuggguagguaaaggaaaauuacagucaaaggggguuuguucucuggcuggcaggagugggggucgcaaggugcucagugggggugcuuuuugagccaggaugagcuaggaaaaggacuuucacaagguaaugucaucacuuaaggcaaggaccagccauuuacacuucuuuugugauggaaugucaucaguuaaggugaggcagggcauauucacuucuuuugugauucuucaguuacuucgggccaucugggcguauacgugcaagucacaggggaugcgauggcuuggcuugggcucagaggccugacaguauccauauugacaaucuaugacuauuaauugggacauuuaguccauuuauauuuaauguaaugauauaauucaguuuuaagucuaccaucugaauauuuaugccaucuuuuuuuguuuccuucuuccuucuuucuugccuucuuucuguuaaaaugcauauuucuaaaguuuccaucuuuauaccacuauuaggguuuuuaauuauaccucuuuguagcgugugugugugugugugugugugugugugugugcaugcaugcucuaggacuaacaauaugcauccuuaucuuaucaaaaucuaccuaaaauuaauauuauacuaucucauguaaaauauaagaaccugacauuuauuacuuccuuguccauuaugcugucacauguuuuacuucuauuugcauuauaauccuuucaauacauugucaugaguuuugcuuuaaauaguaaguuaccccguaagagcuuaacagaaaauaaagacgguuuaaaaauauauauauuauuccauauauuuaccauuucugugcuccucauuccuuccuguuaaucuguuuccauuugcuuucacuuucuuuuaggcugaagaauuugcuuuaacauuucuuauaaugcggguugacuagcaguacauuuucuuagguuuuguuuaucuaaaacuuagguuuuguuuaugcagccauaaaaaggaauuagaucauguccuuugcaggggcauggauagagcuggaagagaucauccucaacaagcuaacacaggaacagaaaaccaaacacugcauguucucacucauaagugggagcugaccaaugagaacacauggccacagggagggaaacaacacacacuggggccugucuggggugggauggggggcagcggugggagggagagcaucaggauaaauagcuaaugcauguguggcuuaauaccuaggugaugguuugauagguacagcaaaccaccauggcaaauguuuacauauguaacaaagcuacacauccugcacacguuucccagaauuuaaaauaaaauaaauuuaaauuuaaaaaaagaauuuaaaaaugucauucuauugucuucuggcuugaauaguuuuuauuuaggagucuaaaauaacucuuacuguuguucuccuauauguaaugucucuccacuccucccauccucagcagcuuuuuucuuuacuuuuggauuuuuaucaguuggccgucauacauccagguaugguuuucuuuguuuuuauccugcuuugguuugcuaaacaucuucaaccuguaguuugauuuuuucacuauauuugggaaaauuuguucauuuuuuuaaacuauuuuuuuuccucccucauucucucuauccucauuucuggaccucaaauuguacaaauguuagacuucucgcuuuugccccacagaucacugaagauucauauauuuuuucuauuuuuuccuccuguucuucagaucagacaauuucuacugaucugucuuaaaguuuccugaucuuuucuguaguuucuaauauguugcuaaggccauucaguaaacuuuucauuuuggaaauuauuauuugcaguucuauaauauagauuuguuucuuuuuuauaguuuacauuuguuucucugagauuucccgccucuucauuuuaugucacccauuuuaugucaaguccuugaauauacuuaucuaguuauuuuaaauuccucauuuucuaauucuaaugucugaguuauuucaaagucuguuucuauuuauugcuuuuuucugauuaauggagcuuccucuucacacauccaguaauuuuuuuguuguaugcuaaacacagggcgacacauuuagggaaucugcauuauauugucuuccuuauaggguacugaguuuuuuucuggcaggaaauuacauuucuaaaauauucucuugaaccuuucauuguuagaacuggucuaguucaaauuuguccuuaguuguagaacacagccuuaugguaguguacaggucucacuccugaggcuggccuuucugggguuucaacugaaugcccagguucucagggaaaucugcccucucagacuaagaauuccaacgucucccaucucugggcaaccacuagugucuuuguucggcucuuggucccacagugaacccucucugcuaggccucauggugucuugcccugcuuauacauagucaauccuucagacaaugaccugcaaagaaaccuccauguacacuaccuccacaugcccuaccucaugcaucucucuuauucaguacccuacucugcuaauuccagccccucagcagcaacaaaguacaaacucugccuuaucaguucauugaaacaagcauguaaugcuuggccccaccuccuuacuagccaguccagugaaugcaccccuaggcagaaagccaaggugaaugcaaggcuugccucagggguuuaccuugucucaagggucacagcccugcauugccuguuagccaauuucugaaaacaguugccgcauacauuuuaucuaauuuuauaguuauucaugaaaugaggucaagaaugauaccaguuacuucauuguggcuugaaaacuaaaaugcuuuaguaucucucuccacuaccaccaucaacacuugaacuuuacaaaugauccuauuuauucuaccaccugcuacuaaaugaugaaaaauaauuaucaagugaguugccgaggcuuccugcucuuauuucucuuaccauguucucagauaucugacugcuagcuaaugucucugcccgggaacaaaagaagccagagaaggagaaagaggaagcucaaguucucccauauucucucuuuucaaaaguuacgaagaguagaaaauaguuuaacaaggaaguuuagagauuacaugaaaauuguaaugagucugaugcaccagcuuccaauaccgucaucacaaccagcccuuccuuggugguaguuauguauugguugcaccugauaccuaagcaguagucugcucucuuuugcaauaaaucacaucugucucuaugauagacucugaccucagccuaccaacagcauguuuuuuaaugacacuggcuugcaaaugcaucugauuugaaauaaacuuucuuuguaccauuuuuagguucuguacuuuugaauaaaggugcaaucacagcaaaucaaauucucagaagacuacaauaaguaaacauuaagcaguguuccuuuuugaaagcaggagagaguauauguuuaggaauguucaaggauuagucugguucuuuuuuaaguuuuuauuuauugauuuuaucuuaacagcaaaauacaaugccuggcuagagccuuuaaauacagauaaacaauccaaacaagcugcaacuuacguauaucaaucuucuaagaucaccucagaaaagagaagguggcucccaacuugucccaaguuaaauacauuuaagagaagcaaaugggaauagcagcuaaagcugacggacagggcaauucgaggcaucagaugcucccuuucagguugcugagaugcuuccagaugguuccuguaucugcauggccaaagugguauaauuuauuuucuuagcuuuuucaaucucucugcauauuacaucacaauuuuagcucaaguuuauuuuuguuguguguauuugacaauccuuuggugguguggaacuuaaaucaucacuucccagagcaagaaaacaaaggcugacacuucugauauagaaggcugcaaucuggaaaggacgaugguuggaagggcagguggaugauugggaccaccacuagguuuauucuuuauuuguucaacauguuuucauuaaauuaggguacagagguggacaagucagaagcagucucucucauuauggaguuuacacucuaccagaggugagaauggaggacuuaaagguagacaaaaaugccuaaugugucaccuagagaacacaaccaaaaaugaguuacccaacaacuucauacagcugcuaccugcaguuaguauguacaugccagguaagcuaggaagaggccuacagccucuccuggaaaaucuugggagaccaaauagguuuugaucuugaccauucccugaaaauccucaucuauaaucuucaaaugcaagaaggaaccaggaggugccauuauguuucaccacaagaacucauuuuuuuuaauuacuguuuuuuucuuuuagugagcauaauuuuuucuuuuguuguuauuguuguuauuguuguuuuugagacagggucucauaaugucaccuaggcuggaaugccguggcgccaucuuggcucacuacaacuuccgccuccuggguucaagggauccucucaccugagccuccauaguagcugggauuacaggcauguggcaccaugcccagcuaauuuuuguauuuuuuugguagaggugguguuuugccauguugcccaggcuagucuccaacuccugggcucaauugaucugcccgccugggccucccaaaguguuuggauuacaggcaugagccacugugcccagccaauuuuuuaauuacguaaauuaaagggguacaagugcaguuuuguuauauggauauaccgcauaguggucaagucugggcuuuuaauguaaucaacaccuaaauaguguacauuguacuaccucacuccccucccaccccaucaucauucugagucuccagugacuauuauucuauacucuaugucuacauacacacauuauucagcucccacgugugaggacaugugguauuucacuauguuucugaguuuuuucacuuaagauaaugaccuccuauuccauccauguuguuguaaaagacauguuuucauucauuuucuguggcugaauaguauucuauuauguauacauauauacacacacauauacauaaauaaaaugugcuguauguauauauguguauauguauauacaugugguguguguguauauauguguauacauauguauauguguauguguguguguauauauauacauauguauacacuuauauacacacacagagcacauuuucuuuauuuaaucaucuugauuuuuuuggaagaguuucaguaggaugaguaucaguucuucuuugcacauuuuguagaauuuggcuaugaagccauccaguccugggcauuuuagggggaagguuuuaaaauuauugauucaaucuuacuauucauuauuggucuguuuaagauuucuauuucuuucugguucaaucuugggcagucauauguuuacaagaauuugucaauuuccucuacauuaucuagauugugaguguacacuucuucauaguagucucugaucaucuuuuguauuccuaugguaucauuuguaaugucuucuuuuucauuucugacuuuuauuuggaucuuuucuugguuaguacagccagaggcuuaucaauuuuguucaucuuuucaaaaaaccaacuuuuuguuuaacuuauccuugguauuguuaucuugguuuucauuuucauuuuauuuuuauuuuuaacaaccaauuuauaucauucaaacagauagaacugccuugugcuuguuucagccuuguuuucugguuauuaaaagaagaccugaaccagauacaaauucaccauauuuuccuucaaggacacuucucauaaaagcuacuaauaugcauauuuuggcauacaaaaucacauuugcuaaaacuuuuuucugcuuaaauacaauucuuuuuucauuuagcaacugcauguuauuauagaggucaauucauuggguuauaagagaaaagaaacacuuauugaagauucacaacauacauuccauuauauaucgcuguucaauagaaugcaaaauuaguaaauaucaccccuacaauuggaccauguaacugauagauuuuccuguaaggaguuaccaaaaugucaucaaaaucuagaguuugacaauuuccaggccuuauccugaccuucucaaugcaaguugcacaaaugaaaucaguuauccaagagaaaaacugggauagaaauagggguuaauagauuaugauccuaaguugaaaaauacagagcucucaguuuccaagauuuaccauuuucaagugucccuaauuuugucccaagaguggcuccagccugggcaugacagcuggcuguaauggggacagauagcucuuucuuucuaagaacaagauuuaccauuuguuuugucugcucucuccacaagcucuuccugaaacauaucaguggcauaauaaauaucaucucguuuuccaucuuaaggacuuuaguacucaaagguaacuguuuugaguccuuaaaaaaaaaaaacaagcaaaaaaaaaagugguuugcaaacuuuugucugugacauaacaccaaagccguaguaaagucaaugauaauaauaauaauagguacuuacuugggcuagggacugugcuaggcuucuuuucauucauuaucucauuuaauauucacaguuccuacauggcuuaguauuucuugcagacccuuuaaaugcuuacauauagaaaucugcccuacuauuucaaguauaggcagaaguuggcaauacaagaaaagacaaagggauaagaauccguccaacuggacaaaacaacuucaauccuuaaaaaguccuacccauuuuagaaacaggucaaugaagcuaccuguuaugauuguagaagucaugucugcuuacugcaccuaauuugagaauuacagaaaaacauuuuuaaaaaucacauauuauucuaucacucagagauaaacauugauaguguuuuuauaguucccagucuuauuuauauauuugccuucuuuuuuugcuauuuguuuaauuuuuaaaccaaauucggauuacauagcaaugcaauuuucccauauuauuagauauaauuuuugaaagauuuuaaaacacuaccuuauguuccauaauuuauuuaacaauuucacuguuuacugacagauaauuuagaguacuuaauuauucuauaaauacuauaauaccaaaguauaauaaugaauuuuugccugcaucucuauuucuuuaagaaagauuucuauaaaugagauuacuagaucaaaaaacauuaaaaaauucuuuuucuagggagaauauccccaugcccaauuccacuacauuugccaacuagcugaaaaugaugggguuuuuuuugcauguuuuaaauuguuauauaaugguauuagauugcauucuucugaaacucauuuucaaaacaucuuuacucaacauauauuuauaguuauucuuguuacuauauguuguuuuuacucauucuuuuuuugcuuuucgaaaaucgucucuuaguugaauaauaauauuuauguauuagcuauuggugaacauguacguuuuccugaauuaucaaaaagauacuauuguaaguauguugugcacauuccccuuggcaugugggccaugggaguugcaugucuucaacuauucuggaugaugccacacuauauuccacaguggcuguaccaguuugcucugugaaugauaaucuucauugcuuuacaaccucuccaacaccuagaauuguuagauuuauuuuucccuuuaauuuugacaauuggauagauguaaaaagcuauacugugcugauuuuagaaggcauuuccugauuacuuuugcaguuguacauucuuucauucauuaauuguccauuucuguugcuucuccaauuuauguuucuucagaccccuuaguuauuuuucuauugauuuuuauuucugauuacuuguuuguauuaacucuuuuuauauuucauauuaauuuucuacuaugaaacauucugcaaauacaggcauaaccugaaugauguugccucgauuaacauuuucaugguaaaaugacucuugguuuuuaaaauccaaauuucaucaucuauuuuuuuuuuuuugccaauguucauguagcaaaacuuuagauuuauaauaccaaacucugcaaaacuuucaauaaaaggaaauauaggaaaaucaucaagauauuuucaaaacauauucaguagaacaucagaauaauauauagauauuuuggaaagcaagcugagugacaacacacgaaacacccauuucagaaguugcugaugcuaaaaggccaucauaccaucagugugagccacacuuggccaccaggcacuagagcacauuucccagugccuuccccauuuuacuuuuuuugcuuauuguugaaauccccaaauuguugagaaaacacugaagacaauuguagagaagaaaacaaaacaagugagaauagcuacuacguacaaagcaaacauuuuauaacauguuaauuguagaagucaucaaggauauaauuuuuuuaaguacaagugaucgaggauauaauuuuuuuaaguacaggcauaccuuguuuuacugcacuuuguuucauugcacuucacagauaaugugguuuuacaaguugaagguuuguggcaacuuugcaucuagcaagucuauuggcaccauuuuuccaacagcacguguucauuucacgucuauguaucacaauuugguaauucucccaauauuucaaacuaauucauuauuauuaugucuguuguggugaucugugaucagugaucuuagauguuccuauuguaaguguuauggagcccaauauaagauggugaacuuuaucaguaaauguuuguguguucugacugcugcacugacuagccauuuuucccucuccucaggcuucccuauucccugagacacaacaaauugaaauuaguccaacuaauaagcagacaacagcuucuaaguguucaagugaaaggaagagucccaugucucucccuguagaucaaaaauuagaaaugauuaagcuuggcgaggaaggcaugucaaaagcugagcuaggaugaaagcuaggccucuugcaccaaauagccaaguugugaaugcaaaggaaaaguucuugaaggaaauuaaaagugcuacuccaaugaacauacaaaugauaagaaagugaaacaggcuuguugaggauaugggaaaguuugaguggucuggauagaagaucaaacuagccacaacauucccuuaacccaaggcuuaaaccagagaaaggcccuaacuauauucaauucuaugaaggcuaaaagagguaaagaagcugcagaagaaaaguuugaagauagcagaggcugauucaugagguucaaggagagaagccaucuccagaacauaaaaggcaaagcaggaagugcuuauauagaugcugcagcaaguuauccagaagaucuagcuaagauaacuaaugaagguggcuacacuaaacagcagauuuuuuuuuuuuuuuugaaacauagucucacucugucacuagggcuggagugcaauggugcgaucucagcucacugcaaccucugccucccggguucaagcaauucuccugccucagccucccaaguaccugggauuacaggugcccaccacuacgcccugcuaauuuuuuguauuuuuaguagagacaugguuuccccauguuggcuaggcuggucucgaacuccugaccucauuauuugccugccucggccucccacaaugcugggauuacagggguaagccaccacacccggccaaaggcagauuuucaagagagaugaaacagcccucuguuggaagaagaugccaucuaggauuuuccuagcuagagaggagaagucgauaccuggcuucaaaucuucaaagaacaggcugauucuuuuguuagcugcuaacgcagcuggugacuuuaaguugaagccaaugcucauugaccauucugaaaaugcuaaggcccuuaagaaugauacuacaccaacucuucauguucucugaaaagaaacaggaaagccuagaugacaguacaucuguuuauaguaugguuuacugaauauuuuaagcccucucuugagaccuauugcucagaaaaaagauuccuuucaaaauauuacugcucacugaaaauguaccuggucacccaagaguucugauggagauguaaaaggaaaugaauguuguuuucaugccugccaacacagcauccauucugcagcccaugggugaaggaguaauuuugacuuucaagucucauuauuuaagaaauacauuuguaagacuauacauagugauuuaucagauugaucugggcaaaguaaaaugaaaaccuucuggaaaggauucaccaugcuggaugucauugagaacauucaugauuuaugggaggacaacaaaauauuaacaugaaaagguguuugggagaaguugauuccaacucucauggaugacuuugagggguucaagacuucaguggaggaaggagcugaagauguggaagaaauagcgacaacuagaaucagaaguaaagcuugaagaugugacugaauuacuguaauuuuacaauaaaacuugaaugagugaggaguugcuucuuacggguaagcaaagaaaaggauuucuugagguaaaaucuacuccugaagaagauguuaugaacaucguugaaaugacaacaaaagcuuuagaauauuacauaaacuuaguugauaaagaaggguuggagaggauucacucauuuugaaaggaguuuuauuguggguaaaaugcuggcaaacagugcuguaugcaacagagaagucauucgugaaagcaagaagccacugauguugaaaacuuuacuguuuucuuacuuuaacaaauugccacagccacuucugcccucaacaaccaccagucugaucagucggcagccauaaauaucaaggcaagacccuccaccagcagaaagauuaugacuuacugaaggcucaaaugaucaccaguauuuuuagcaaaaaaaauuuuuaaauuaagauaacauauuuuuuuauaaugcuauugcauacuagacuacuauagacuguaaacacaacuuuuauauucacugggaaacaaaaaaguuugugugccuuguuuuauugcaauauucacuuuauugugauggucuggaagugaacaugcaguaucucugagauauagauaugccugcauuuuaagucucagugugacauuauuguucuacuaugguuauuuuacuguguuuuacuuacacuucaagaaauucacuagaggguugguuugacauauaacacauuuuuucccauuuaaguaauggcaaacugucucaaggaaaucauuuuuggguaauacaucugaucaucaggaaucaauuaguaacaucaaacaaggggugucuauauuuuuuucucagcauguuccuuaucuuuucuuuguuugcuuguuuguuuguuuucuauuuuacaugucucauuuaauccuggaaaaaugcuauaaaguagcuagcugauucuaucuuacagaugagggcacugagauucagagaggucaguagcuggcuuuauuaucuucuucacuguggcugcaauaaaaaauaaccacaaacuuuguggcucucacagcucuggaagccagaagcccaaaauuaagauguuuaagagcaaagaucccuccagaggcucuaggagggauuccauuccuugccacuuucagcuucuggugguuggugggacucuuguaauagcauuuaggucucccaaaauaauccaggaugauuuccucaucucaagauccucaauuuaaucauaucugcaaggaccauuuuuuuugcaaacaaggucacauucacaagcucuagaaauuugauguggauacguuugcagagccaauauucaacuuggcacacucaccgaaggccacauagcagaauacggugucaaguccagauauaggaguuccagacuccagaguucauguucuuuccacuccaugugcgguuuuccaucacauugugugaccugucgucuccaucccuccucacaccucagauucccuuagucuucccaaccucagagugagguuaauacucuguucucuccgugccagggucucuuccaaggagaguauucaagagcugugccaccccuuuacaaauuccauugcgcauccgugacuuccuuuccaauacccagacaguuuccugagucuaguucacagacuagaucaccaaagcaaccuuccugggaguaaauauuacaucuuucccauucauauuaguuucucaaaagugcucaagagccugaagaaugacagaagagaaaugcuaaagauugaaggaguucagaacacaauacuccaaaauauguugcucuaguauauugacuauuuugagcuuaaagacacuuggaaaaacagcagauacaaaaaauauacucugagcuuucuucuuuuccuuagaaacaggagauaacuuguccucccuacgccagagggaaaguagcguucuuaucaucaaagacgagaaguugaugcugagagaaaucugaacaaacacaccuuauuaaaguaacccuuaucuuccuaguuacuucucuacccaauuaaccucccuagcccaagcccguuggcuuugucacauacucacaauuuucuauuccuuucccaauucaguacauagguguucaacuuucaacucugucuuuggguuucauuuccuuaagagggcucuugugcucacauaaaaauugaaugaauuaaauuuguaugcuuuucucccgcugaucugccuuaugucaauucaauccucaggcccagcuaaaaaacccuaagagagaaaauuuggccuccccuacaaugucauccucuuucuuuuuucuggaccuucuaucugcugguacuuaagauacuaaaauggacgggagaaagaaagcaaaccauguuaugucuucugcauuggccugguacacuccguuugaagguuacucgaagccagcuugcuuuuugucaagagauugcuugaucuggagccauauagaaaauggugacaucuccaccccgugacauaugggccaguaagggcuugcaaaguuccauucugcacacuucucuucauucuaagaacgaguauucauuccauuuaaacacauauuaccaggaauucaauccaaccucucuuuuuacagucuaccuagaauuacuauuauacuauuuacauacaauauggaaaccucacacauguaugaaucuauuuacaaacucccucuaaauucaaguugucauugaaauuacaucuaccuguauuauaaaucccauaaaaaugaugcuauaguuuuuacuuaaacaaacauacauauucuuaaaacauuaggaggaaaaaauugauuuuuauauuuaucuuacuauuuaugauuucuuuauuuuuacauaaggaucugaguuuucaucuauuuuuucuugucaucccaaagaacaaagcauuuuuuacaguguaaguuggucugcuggcaauaaauauucuguuuuuguuuuucugaaugcaacuuuauuuugacuccguuccugaaguaugaguaucuuuggauauggacuucgggauuggauagucauaucuccuuacagcacauugaagauauuguuucauugucuucuugcuuucauaguuuuugaagguagguuggcaguauuuagcagugcaguuucauguauauaguguguuguuuuucuccggcuauuuucaagauagugucuuggguuuucagcaguuugauuacaaugugccucagcaucuugaacguguacauuuaucucucaccaauuuugggaaguguguggggccacuguuucuucaaauauuagguuggcacaaaaguaauuguggguuuuguaaugaaaaguaauugcaaaaccacgauuacuuuugcaccaaccuaauauuuuuaugacccauucucuaucaccuuuccuucuggggaaccaauuacucauauguuaaaagaauuaucccauaggaaccugaggcucugguugcuuuuuuuuuaauccuuuuuaaaaauacaaucucuguucuucauagagaaaaucuauauugauauuaucaaauucacugacugcuuuggucugccuguguauguauauuccaaaggucagccagagauuugagcagaauuuacaccaaaaauuuguaaugcuccuuuucuggcccucuuuuuaaugacauuccucccuuacuuuccaguagcugggguugcuccaaacucuguccccugguucauaaggccagaaagacugagcuuccuacaggaguuucagccacucuguguggcccuaccuguggcuugaccucaggauaauagucauaagaaauuuaaccuauacuacuuccaggugucuucaacccccuucgagaaucuugcugccuuuguucauucuucagaucccucagagaguuuuguuguugcugcuguuuguguuuugugaggguuuacagacuacaugggaagcagaaauuguucuuugggauuuaacuuuuacaaaaaucacaagcacucaucucauuuguggcagugaaaguaauauuuacaauguuaacguuaaauaacauaccuugcuacagguuuccaguaaauaucuuguauuaugcugcguaagcuccuccuauuucuagcucauuaaauaaauauuauuugcuuguuggucuuauuuaacagaaaaaaaaggagucucuauuuauuaauucauuaguuuuauuuuccacagauugauuuuguuacucuccuuuaauaaugaaaguucucagggcuauuaauuuucugcuaaauacagcuuuagccauuuaaaauauugauacauagaguucuuacucuccuaacaguuuauuauauaguuuccuuuccuguuugaaucuggaguuuuuagaaaaaaauuugguuuuuguuaucauuauuucucuuuuccaagcuacugauuuuugcauuuaaacuuuugcuauuaaugucuagcucuauuucaguguaggcagaacauggaggcuguuaacacuuuauauuucauaauuuaauaugguuucuuugagauauaauauaugaucaauuuuuuucuaaaugcuucauggcuccuuaaaaaaguguauugcuuauuucuagagaacaaaauuuaauaaauauuuauuaaaucaucuuuguuagauuauuaaaauauucuaucaauucuguguuuauuugacccaugaaagaucaauaaaaguguauuaaagugucauacaacaauucuacuuccaucaauuuuuccuuauauuucuaacagccuuuguuucauguauuuugaggcuguuaccaagucaauaaaaauucagaacugccuuaucuucauugugaagucuaucuuaaagaaaauauaaccuucuugauugcauuuaauauuuuuauagccuuugauucuauuucaucuaaauauugccaagauuacuuuuuuuuuuaauuucgcuucugccuaauaaaucuuguccauucuauuguucuuucuuuuuuaaucuaaugaguuacuuuguuuuagguauauuucuucucaguacccuacaguuagauuuugcuuuuuagcugaaauauacaguuguuguauuuuaauagacuaguuuaauaaacauuucacaaugagauucagcuuuacacaaugcuuucacauuuauauuuccucuuuucaacauaucagguacaggggaaaugucauuccuauguuaugcauaaggaaauucaaagccagauagguuagaugcauuucccaaggucauucagguaauauauggcaguggcaagacuuaaccaaaggaugauaauacuaagaaaauggcuuuuuacaaacauauacuauccccuugcugaacaucaauauucagauagacuauuuggucaaauuauguuuuguguuuuuuuuuuuguuuuuuuuuuuagacagaguuucgcucuuacugccccagcuggaaugcaauggugcaaucucagcucacugcacccuucaccuccuggguucaagugauucucccgccucagccucuugaguagcugggauuacaggcacucaccacaaggccaggcuaauuuuuguauuuuuaguagaguugggguuucuccauauuggccaggcuggucucaaacuccuggccccaggugauccacccaccucagccucccaaagugcugggauuacagguguaagccccuguguccggccauggucaaauuaucuaauuuuucuuccacugggggacuuuauacuauuuauuuuuauugccguaaaugauauguuuguaacacuguaaucuuauuucaugcuuuguguaguuuaugcuuuacucuuuuuucuuuguuuuauauacuauuggcccuccuugucuguggguuccacaucuguggauucaaccaaucauggauugaaaaugcucagugauaugguguggcucuguguccccacccaaaucucaucuuguagcucccauaauucccuuguguuguaggagggacuugguggaagacaauugaaucauggggggugggucuuucucaugcuguucuccugauagugaauaagucucacaagaucugaugguuuuaaaaacaggaguuucccugcacaagcucucucuuuuugccugcugccauccacauaagaugugacuugcuccuccuugccuuucaccuucugccaugauugugaggccuccccagccacguggaacugcaagucaaauaaacgucuuuguuugugaauugcccagucucagguaugucuuuaucagcagcaguaaaaaggacuaauacacucaggaaaaaaaaauggcaucuauacugaauauguacagacauuuuauugucauuauucccuaaacaauacaacuauuuauauagcauuuacacugcauuagguauuauaaguagucuagagauaauuuaaaguagucuguagguuacaugcaaauauuaugccauuuuauuccagggacuugagcauccacaaauuuugguaucuggaagcaauccuucacagauaccaagggacgacaguacuuggugauuuagaucaggcugcacauucuuuucucucuccauugguuuggaagucaugcauccuacuuuuguuucuaauaguggcaccugguauaucaaaaagaauauuaauauuuguugaacgaauacauuuuaaaacuuucaaauauuuagaauauuugagucuaccccuagaaaaaugagaauuugucacaaauuuauuucuggaccuuguaaauaugauccuggguuucuuauugcuuaguguuaaauauuaagguauuaaauauuuaaugcuuauuaaagcauuauuuugugugacauauuuucucuuucaaaagcauaguuuuacauuugcauucaguauuauaauuaaaguuacaaucacuuaaaucucacuuuuuguuaacuugguuuaauuauuaacaaccagccacuucucuguuacugaauucuuuuguuguuguugugguuguuauuuaguuuuuauuucauaaucauaaacuuaacucugcaauccagcuaggcauggaagggaacaaggaaaacauggaacccaaagggaacugcagugaaagcacaaagauucuaggauacugcgagcaaaugggguggaggggugcuccccugagcaacagaagaaauggucuggugguuaagauaaaacacaagucaaacuuauuagagcuguccacagucagcaauagugaccuucuugcuagucuugccauuccugaacacaaagcgcuccauggccuccacaauauccaugccuucuuucacccugccaaagaccacuugcuugccauccaaccacuuggucuuggcagggcacaugaaaaacugggaaccauuugcguuggguccagcauuugccauggacaggaugccaggaccuguaugcuucaggaugaaguucucgucaucaaauuucucccuguagauggacuugcuaccagugccauuauggcaugugaagucaccacccugacauacaaacccuggaauaauucugugaaagcaguaacccucauaaucaaauccuuuuucuccagugcucagagcaugaaaauuuucugcugucuuuggaagcuugucugcaaacagcucgaaggagacgcagcccaagggcucgcuauugacagcaaugucgaagaaaacagugggguugaccauagcugguaauacggggcucccaguggcagcaccaucugugaagucucuguuacugaauucuuaacuucaauuucucucucaguuaccugggcagugcuuccuaaauguuaguauguuuaagaaucuccuagagagacuguuaaugcacagauugcuacaguucauccagaguccuaacuguucuaagcaguagguuuuauagcaauauuuuguaccauauaguguggccaaaaaaaaaauaucugauuuuuugcuccuuuauaaggcuaacuguuuuguuugccugugugugugaaggauuuuuuuuacuuuauucuuuaaaaaauuaccaaguugaaaugauauaaaacccuuuucauuaauguugccuggaguacggaaagucccuucaauuuuuguuuuuugguaucggguuuuguuuuuguuuguucguugugcuccgaagagcuuuuauuaaucuuucacuacuauuuguguucuaauugcuucugccucaagaacaucugugauucuuacuuugguucuggguguucaaaucuaugaucucuauuuucuauauuuuuaaucaucucuuuuguuauuuuaauuuuuauugcaccuguucauuucaacagaaauuaucaauuuuuuuccccucuugauuuuuucuuuuucuucuuuuuuuuuuucuugagacagggucucugucauccaggcuggagggcaauggcacagccacagcucacuguagccuccaccuccccaggcucaggugaucuacccaccucagccuccuaaguagcugggacugcaggugugugccaccacaccuggcuaauuuuugccuuuuuugaagugacagguuuacauguugcccaggcuggucucaaacuccugggcuugagcaaucugccugcauugucucccaaagugcugagauuacaggcuugagguaccacaccuggccaugaguguuuuuuaaauagugauuucuuuucagcuuccaacacagacuucaauuguguuaugacauucuggucucuuuacaauauuuucuugacuaauccaucuccuuuuccaaauaauccuacuuuuuacaaucuaaacuuauucucucauuucacuuucuguuuccugaugcuguugaggaugacaaaaaaucccuucagauuucugugacauaucaucuugggaggucaacauuuacucugagucucugagauacuguucccuuuuccuuguccauaaugauuucuuuuuacuuuaguuuaucaugaaagagaccguguuugccaagaaaaagaugaagauugucuuuaugugucacuuaaacauaaaucucuuacagcuaaaugacauguugguuuacaaaacuuauauccuaauuuccauccucuagcagguuuuccaccuagcauaccuguugggauuggcauagacucaucuuguaucacuaccugcaucuguauuaugaaaaacaacaauccccaaggcccucguaguuucagcauagauauagugcuuuaacugugacagauccugacaaacauauuuccaaaaauauuacugcccuauuuaguaagcaggauaauggucuuccaaaggugucuacauccuagucccuaaaaucugugaauguguuagauuacauggcaaaggaaaauuaagguagcagauagaauuaaguuugcuaaucgucugaccuuaaaacagggagauuauccuccaguaccagggugggaccaauguaaucacaagggucauuaaaucucaaaaacagaaguagaauagucagagcaaugcaauaggaaaaagaguugacuggccauugcugauauugaagaugaaagggggccacaagcuaaggaaugcaggcagcuucuggaagguaggaaggacaaggaaacacauuuucccuuagagaccucagaaaggaauucagccuaacaucuuagcccacuaauauccaucuauuucaaacuucugaccucccaaacuguaaaauaauaaaucuaugucauuuugaaccucaaaguuuguguuaauuuauuacagcagccacagaaaacuaauauaugaccauuuauuugaguaaccacuauuugcauucuucacaugcauaugcaaaagaugucuucauuaaaagugaugcuucacaaaaguacuuacaugcauaguaauucuuguucacuuuucugauuagcguuugcauguuucugaagcaggggaaagauagcagccaaaugauuaaaggucuucccucuguuuggccacagcauaagggaaucaccuguugaaauuguucauucuaguuccaccaaacaucucauuaguagaauucucuacaagaaucaagacuagcuugacuauaaaaacaaauuuuuaguggcagcgacuucuuuuuggcauauaucuucuugaguauuuuuauagaaaguugaaccagguauaauagaggcuacuacuccaauaugaauuuaauuucauucauucuucaaucccuucuuggauaaggugcugauccaccuaagucacucccucauaagugaaugcaaacuuaagaaauuauaccuucauaaaaugggcauauuuuucuaacuguaaaaauguuuucuuuaaauaggcaugacuauggccugucuauuuuaauuucguauagcaguaauuucccuuggggaaggaguaaaagacaauauuuuuuaaaguuucucucuaucuagauaggaugcuaguagaagcaagauuucuauauguucugaugugaccaaguagauauuucucuacucaccagccucugaaaaucccuguguuuacccaagauuuaacuaaagaggcuaaacucguggguaaauauuaagagggaauugacaaaggcauauuaagucuaaggaguagacuauacuuuucuaaaauaaacacauaauuacagaguuaacacagcagcaccuucugccuugucagugcugaaggccccauggcagccaguacucuucacuugaccucguccugcaaacuuucuguacagcagauaaaggcccaaaguacacuauaguuuagugaauagcauaaacucauucaucuguaaguacuagauauuacaacaucaggcuucucacugguccuacuauaaaaauaauuuuaugcuugcacauuggacacaauuguucugguggcauagcucuuuagcuacaccagcacugaauagaaagaggcauccucuacuauuagucugcaacagaacccagcauuuccaccauugcaaacaucaaacuggaugaagacuuuuuauucccagcaggauuaagucaaaacauagauugaccuaggagaagaagcauuagcccuugucaaauaaguauaauuacuugaugacauugguuaguaaagcugcaaagaauacugaggaaauuaaaccagcuaauuugggaaagaccagaaaggcaauaugaacaccauaaaaacauggguaaggaacaguaagaugcugaccuuuacuguuuucucugggcaugauccugccuggcagagcuauguuuaggcuccucagaaaacccgaugcucucuuugcauuacuagccaaugugaagcaacauuaaauaaaaaaaaaaagaaaggaaagaaagaaagaaaacaaucagagaaaugcaaauuaaaaccacaaugagauaucaccucacaccaguuagaauggcgaucauuaaaaagucaggaaacaauaggugcuggagaggauguggagaaauaggaacacuuuuacauuguuggugggacuguaaacuacuucaaccauuguggaagucaguguggcgauuccucaaggaucuagaacuagaaauaccauuuaacccagccaucccauuacuggguauauacccaaaggauuauaaauauugcugcuauaaagacacaugcacacauauguuuauugcggcacuauucacaauagcaaagaccuggaaccaacccaaauguccaucaaugauagacuggauuaagaaaauauggcacauauacacaauggaauacuaugcagccauaaaaaaggaugacuucauguccuuuguagggacauggaugaagcuggaaaccaucauucucagcaaacuauggcaaggacaaaaaaccaaacaccacauguucucacucacaggugggaacugaacaaugaaaacacuuggacacaagaaggggaacaucacacaccggggccuguuguggggugugggggugggagggauagcauuaggagauauaccuaauguaaaugacggguuaaugggugcagcacaccaacauggcacauguauacauauguaacaaaccugcacguugugcacauguacccuagaacuuaaaguauaauaauaauaaaaaaaagaaaaccauuaaaacacuuuagaaauauauaaagguaggccgggugcuguggcucacucuuguaaucccagcacuaugggaagccaagacaggugaaucaccuaaggucaggcguuggagaccagccuggccaaaauggcaaaagcccaucucuacuaaaaauacaaaaauuuagccaggugugguggcggguaccuguaaucucagcuacuugggaggcugaagcaggagaaucacuuaaacccaggaggcaaagguugcagugagccgagauugugccacugcacuccagccugggcgacagagugagacucugucucagaaacaacaacaaaaaagaaauauauaaauguuuucauuuguaugagaacuuaugaaauagugauuaagagaaugggcuccaaagucaaacugugaggguucagaugcuggucuuccccuuguagaaauguuauguaaauuauuuaugcuucauuuccuacaucuguaaacugggggauaauacuguuaccucacuggcugcuuugggaggaucagcugugauaauucauguaaagcuuguagcagagugccuaaucccuaacaagaguucaacauaauugcugcugcugcuagggagaggcugcaaagcauucuggguaagaacagggacgcugggacaagauuguagaggcucugccauugacaagcuguaaucuugagcaacguauuuaacuucuuuguaccucacuucccucaccuacaaaauggaaguaauaauaaccauuaugaggguuguugugagaauuaaagaguuaauauuuguuagguguuuagacuaguaucugauacaugucugacaaacuauucagcuguacaugaaugguuuuaaagcugugauuauggaaaaccaagggcuuuguacggaggaauggagauaaggagagugugcagcccagucccacucuguaugcaaacaaaguaauucuagcucuuuuacauauuuaacuuucaagcaagauuuucuuugaguaaaggguaaugcugcuuuaaaagaagaaaggaaggaaggaaggaaagaaggaaggaaggaaggaaaccauggcucuauauguaugagccucauauaaaauauaucaguacaggucuuacaaaacacugaauguuuuuauacacauucccuagcagauuuaaccagaucaguuuuaagguuccuucuagaaaggaaguucuccauacguugaaaagugaauuucaguacauucaaauuuuaaagacacgacuucccauacuucuucaggguaaacaaaaaucucaauaauucuaauuuaacaugcaaaagccaugaauauucacuacagucaaaugaauaauaaaucaccccuggguucaagugcuugccaugcaaaauugccuauuuccuagaacauccagaaaucuguuuuuaaauugcuuuuuauuacuuuugcucuugugaugguugcucuucaaagcaacuuggaaaaaugugccauucucagcauuaaggcgauaaaggagaagugaggacagcagaacacggugccauccacaaaaggaaagagagucuguggaucagagggcugggcuccggaagacaguuuuuaaaugucacuagauaaaauuuaugagauaaaagggaauguuccuuagucauccugagcauugauaucuacaugaauaauaaaucaaaaggcucuuuauccauuuacugguaaacauuacgaccuuagguugaagaugugauuuacuccacugauaucaacacaacagaaauccagugaaaguaucacuggacuggccccaaguucuggaaaaucaaugaugcgugggagaacaaacauuuugaggggaagaguauuuuuuuaaaaguaaauauuuguggcacuagcaacaugagugcacucauuaagauuucuuuuaaaggauuacccuuuagucucuccuacauggaaaacucaaguauacucaaguugucaauuguauaauuugauggaaaguuaucccuaguauuuucccccaaauuggauugaauuauuaauauuucaccuuuacaaauacaugcaguauaauucaauuuauauaaaauuuaaaauauacagaacuuacagugauugcaaguaccuaagcugguaauaaagguaucaauuaaugaaggaaaauggauaugucaaaggacaggauagugacuaccucuaauaugaucagagagaggguucagaucagggaauuuucagaggacugcuggggaugcuagaaauacaauguauugacuugggugaaccuugagauagguguuuauuuauaguuauucauuaaacuguucauacaugucauaugcacuuuuccuguacaaauuauauuucacaauuuuauuuaaauaguauguuucauucugagaugacucuccaaucuauuacaugagacacacuuauacucaaaaagguguucauucuuuuucucugaaauucagauuuaacugggcauccugaauuuuaucuggcaauuguaaaccaaucagaauagcaugguuagauuacaaauaauauauauauuuuaaaagacaggaaaauaaaccacagauaaaaugcauucuuaaaagucuuagucauuucauuucauauucuauuaauaugauacauuuguguuucaugguuucugaccccuuguguccagcggacuauaaacauaaguaugcuaccuagacccaaacuaauuuacuuaaaggaaggcaaagaagcugaccauuauaaauacagcaugccuuagaaaggagaguuucaagucaaaaacaaaucuggaaaaaaaauuaauuugcuucuuuuuuguaaagcaaugaugugucguuuuuaugugcauuuguuuacacaguaaaagaaaagacaaucaaauagguaaaauggaugcuguauugcucccuuauacacacaaggaauuacacaucugucuaacaaugcuaaccacucugagcgauaauuauggaucaaugcuuuaaaaaauauccugaauugccugcagaaauggcaaggagaauacaauuaaauuauuuguaaaagccagagucuuuuuuuccuauccaucugcuacuugaaaugggaugaccuuucaaauagugcuugcuguucucaaugcaaacucuaaauaaagaaguggaguguggcuuuuuuuuuccuuuccagguucagcauagauacagcauuuguacugacauucuacaccacuccauaagaaugcagauuuggcuucuagaacauaaaagaggcguuucaggaauauaaaucaggcuuuugucccauaccuucagucaugacauuuggcuucuaucagaaaggugugcggcuucugagauaaguguuugagaacaagcuacaugaaguaauuuacucccuggagaaaaauugcaaaccucacccccaaacaaaccgcauaaaguaaauguguuagugaagaaccuuuuguuaaacuaccuauggcuggggagcuaaauagaaaaggucagauauuuaagcuaacaaugggcucaaaacaaaccuuccaacaggucucucaauaggccuacauuaucaacuaacaacuugcacuauuaagacuauuaauaguaauaagccaugcuuucuucacugagucuauauauauuuuacauuguuuuauugcuccccuacccuuuuuaauuuuuaaagcauuuccaguuugguccuuugugugcuuuuuuaaaaauuaggauuuuggacaaacuuucauguauuuuucuuaauaaaaguguaucaagcacauuucaaaaaguucaaaaaauacagaaauauaaaaaauaaucuauuagcacaucacccagagaaacugacuuuuaacagucugguguuuauacucccauucaucuuaauacauaagcguaucacaaaauuagaugauauuauauaacaaucaaaacuaaucaacuguuuuaugaacaucuuucuaugccauaaguaacaaucuguaucauuauacaaaaauuuucauuacaccuuuuaaauguuuuauggguaucucuguguguguauaguuguaaaauauaacuuuuaagugaauuuauuuaaauacccaacuacuuaugaguacauagauuuacagcuuuuuccacuacuguaaacaaaauugaaaugagcauccauacacacaucuuugcaguuauuuccuuaguauuacuuuccagaaauaguauagcuggaccagaaaguauaaacauuauuagagccuuuugguuaauauugucaaucugccuuccagaaaguuuacuaagcaagguagguagauuucccucuacuguauaauacugagaaauaucaauuuuuuggauacuugucagugugagcaaaaaugucauuauugcucuaauuauuauugcuuugauaacuaauggggcugagaguuuuacugguguuuuauaacucuuccuuugugaaucauuauucagauacguuucaaaugguaauuuguaaaguauuuugaauuuuggcccauuuuucuauaagauaaaagcauuaucguuagugggugcagcgcaccagcauggcacauguauacauauguaacuaaccugcacaaugugcacauguacccuaaaacuuagaguauaauaaaaaaaaauuaaaaaaaaaagcauuaucuuaaaguacaacaccauuaggauuuaagauaaauacacacacacacacacacacauacacacauacacacacacaaugagaaaaaucauuuuaauuuuaaaaacaauacucagcauaacaaauuaaacaaaaaugcacacauacgccagguacagugguucacaccuguaaucccaacacuuugggaggccgaggcagguggaucaucugaggucauggaguucaagaccagccuggccaaccuggugaaaaaauacaaaaaaaguagccagguguggggugcaugccuguaaucccagcuucucaggaggcugaagcaggagaaucgcuugaacccgggaggcagagguugccaugagccaagaucacgccacugcacuccagccugggcagcagagcgagagucugucucaaaaaaaaaaaaaaaauacacagguauguauguaugugguauauaaaauaagucaauacgcuaucccagcacuauuuccaauuccauuuucccauggcaacuaaaaaaaacaaaacaaaaaauagaaacaauuacuuguuuauccuucuacaucuuuuucuaguuucauaccaguacauacaaacagguuuugauauagucauucuuugcuuucuaauuccaacggucucauaucguuccaauuagucaaaugauuagaugcugccauaucauggacaugcuggacaucacauauagauguauuuaguuauuauuauuaguuccauaauauuucacaguaugguuauaguauaaauauauucaacaaucucacuauucaugugcuguuuuuauguuaauguuauuugucuugauuuuuuuuugccacuacuaaaaaugcagccaucuuuaaauauacauuuucacaucagagauuacugacucccaaaauuaagguugcagagucaaagagcaaguguaccauuaauuuugauaaauauauccagauuuagcaauauaugaaacucuuccauuucuaagcaccuuuaacaagcauggauauuaucaauauuuuccaauuuugucaacuacuugacuggaaaaguauuuauuucauugugauuuuaauuuguauuuccacaacuacuaguaaaguugagcagaguugcaugucucuuggucacuuaaauuuucccucugugaauugccaauuaauaucccuagccauuuuucucaaauaugguauauaacuguaugucaucagugucuaagaauuccuauuuuucuaaaauuuauauuguuuaauguacauucauauauuuaauucaucugaauuuuuagauuuuuauuguaaaaaauaguggucuaacauuuacaacuuacugaugaaaagccaauuuucauagcaucuuuuauuagauaaacauacauuucccaacugaacugaaaagacccuuuuuuuuuuuuuuuuuuaagacaggaucucccuuuguuguccaggcuggagugcaggggagugaccucggcucacugcagccucgacuucccuggcucuggugauccuccaaccucagccuccaaaguagcugggacuacaggcaugugccacuguaauugcccaguggguucuccuugccuacugccuagacagagccaauuucucaagacgagggaacugcaauagagaaagaguuuaauucacgcagagcaggcuguaugggagacgggaguuuuauuauuacucaaaucagucucccccccaaacucagggauccaaacuuuuaagaauaaugugguggauagggggucggaaaggggggagugcugauugguugggugggauaugaaaucacagggagucgaagcuguccucuuuugcugagucaguuccugggugggggccacaagaccagaugagucaguuuauccaucuagguggugccagcugaucuauggaguguagggucuacaaaauagcucaaguacugaucuuagguuuuccaauagugauguuucccuguggagcgauuugggagguuuagaaucucgcagccuccagcugcaugacuccuaaaccauaauuucuaaucuuguagcuaguguguuaguccuauaaaggcagucuaguccccagacaggaaggggguuuguuuugggaaagggcuguuaucaucuuuuuucaaaguuaaacuauaaacugaguuccucccaaaaguuaguucagccuacacccaggaaugaacaaggaaagcuuggagguuagaagcaagauggaaucaguaaggucagaucucuuucacugucauaauuuucucaguuauaauuuuugccaaggugguuucgccaccaugccuugcuaauuuuuuguauauuuuauacagacaggguuucgccauguugcccaggcuggucucuaacuccuggggcucaagcacucugcccaucuuggccucccaaaaugcugggauuauaggcgugagccacugcauccagcugaaaagacacuuuuacugaauauuaacuucauauauuuggaucuguuucucuuuuuucuguuucauuuauaaaauguucucguggcuaacaacauaccauuuuaauaacaguaacuuuauauuacauuuuaauguuuagaagaaaaaguaaaaaugaaaccuguugccauucugauaaauuauauuaacauaucuauuuuauaggaaugaaugacauuuuauaauaauaaaaacuauuagggaauaugaguaugacucuuuugacaggcaguuuuaucuccauaacauuuuucuuuuuucuauauaggccuuuuuuguuaaauuguuacuaaggauuuuauauuuuuuguuuccaaaguaauuuuuuucuauuucuagauaacuaguuauugaaaguauaaagaaaaaauuugauuuuuauauauuuauuuugugaucauccagcuaacauguuuucuuaguaacuguguaacagucauaaauucucuaugaauauaaucauaucacaugacagugaagagaguaucauuuucuucgcuuaauuuuuuuguuugauuacaacaagcagaacccauaacacagugcuaaguaacagugcuaauagcaaauauuccuguguauucuuccugauuuaauaugagugacuuuuauauuuuacuguuuaauguaauguuugauuauaggucuuuauaaauauuccuuauuguguuuaacuuccuuccaugcccauuuuauuuagaguauugcuagaaauuucuaauacauuuuaucacauuucuuaucaguaugcauacugaguugaauacaguccuccauaauuuauagucauguggaaucucaagugacuuuauuuugaaacugggucuuugcagauguaauuuguuagauuacaguaauuagaggucauaagggauuagagcggccccuacccaaugacuguugcccucauaagaagcaaaaccagagauauagucagacacgcagagagaauaccaugugauaaaggagacagagacuggaguaaugugucugcaugccaagaaaugccaaggacuguuggcagcuacuaaaagguaggaaaaggcaagggagggccaccccuuagagccuucaaaggcaggaugucccugcugguaccuugauuuugaaccucuagcuuucaaaacugacagacaauaaaugucuguuauuuuaagccacucauuaccaaauuaccaaacgguaauuuguuauggugguuuuaggaaauuaacaaagcauauguuguauaaucaaaucauuuaaucuuuuaauuaaugguauaaaguuccaauucagaaccaguuuguaauuuuugaaaugaagccuauuuuaaacauuuuaucauguuuucauaagcagauagauacaaguugcuauuuuuuaauuauauacuuccacauaugaaaaugaaauuagcauaaaauaucucauuaguguuauuuaucucaaguuuugauauaacauuuugcuagauuuguacaguugagccccauucuauuuucucuauagucuugaauuguuuaagaaccauagggaauaucuguuuuuuaaagcuuucguauguuacaaguaucuuuuaaucuuuuaaaguaccuguuuuuaaauaucuaguuuacauguaaaacuaucugggccuggugccuuuuuucuagugguacauguuuaauaauuuuccacuuucuucuaugauuauugguauuaaauguuuuuauuuugccuaugggaauaauauaauacugaauguauauauacuuuucuaaagaaucaucauuuuccuagauuugaaagugaauggcuauaaaauuuuuuuuuaaaaaaaaucuagccguaccaguauugauuggcagaguugaccaagggaagcuaagaggguacauaccaucuuccucccacacgacuacauaugcauuaaaucagaagacgacagucuuccaagaauaaaaugaaucaucaagggaauaagagcaguucucaucccuaguuagaaucucuaaacaaaccaaagcaaauguuuuuauuugaaucaucaggacugugucacaaugaaaccuagaugguuugucuucaagucauuuacuacuccccuaaagucuuaucaaaaguaugcuaaaaaaguuuaugacauuuccacugagcuacaauaaagcuucuauuuuuuuagauacuugacaaaauuuuaaaaagaauuauuuuucccccacaccugcacacauuuuaaaauaucuucaacuuuucuacaaaacaauuuucucuacagcucucccagacuucacaaacauauucuuuuauucauagcagauggaggaaauuagaguaacauauuugcucuaaaaucauuagugcugcaucagcacuucugaucuaaaugacauuucaagggguuauuguuacauagagcaagacuuugcuccaggcagaaagagacagaaaaacaacuugaaaaaugaaccuuuuuuugcaauuagcuucugcaucuuaauuuguugaaugccauucuauuuggauuuuaaauacaaaucaaaggaagaauaaagugauccaauucugucagggucauaccuuccuuacuggucagucgucugauuaaucauuauagcugcuuccuaaaaaauaauguuguuaaaacuuaccaucaacuacuugauucucuggaaaacuaacauauucuuacuucucagagauaucuugagaggcugauaagucugcucuuuagccucaagaaaugccuaaaauuaaacuauuuaacuggugagcuucacaugacugccacucuguccaagagauaaauaaacaucccuggcugaagaaugaaccaacccauagguguuucuuuagcacauacucuguuaaguccacuguggaauuaaaaaaaaaaaaaaaaguuuaagguacuacacaccuggaaaaugcaaucuuguaaacauaggagaaaccacagagaaugauacaagauagcaacaaucauacuuuauauuuuuacacugcauuacaauuuucaaacuacuuucaugacacuuuucuuauuuuauccucacaguaaauccauaauggaagcaggauaaaagaggaaggagacauaaacauagaacuucagagaugaaagcaacauuaaaggcaucaauaaccuucuuuacagauaagaaaauggagaccaaagggaaauaagaaccuucaccuuguuucagagucaggcaagcaaagcuaaugaagugaaggcuugucaccccaaguugcaaaaagaagucacaaaaauaagacaagaaagagaaagaugauagaaauacaggacacuaauuuggauuuaauguacuuuuuuaaaaaauagaaaaggaaaagcaauucuauugaauucggguuugaaauucaacguuggucucuagggaucacuuggcuauggugguuuuaugccauuaccagaucccuuugagaaaaauacuauuuugaaauucaugguuuccaguaaauauguucaaggcuuugaagaacauacuccuguagguguaaaugguguauacacauauacacaaaagcuugaaaacacuacuuaauuacugaacggagucuaaacauucuacagcucaguuaagaagcuacacaugcgucucacacccaccaucucuccagcuguccuccacacaccaucccagcaaguccuagcugacccucuuaauacugugaccucucuguuguauaauaaagguugaaaaucauccuuccuuugaauaagaauauauuauaacuauauuauuuuuuguuacagccuucucaaaaauguauuucaagccacacauaggccauugucauggcaucuuuuauuuaacagacaauagcuauuuuccaugacucaguccagaauauucuuuaacaucuacaucuaggauauuaucauaauuauaauaagagacggcacuacauggaugaagcuggaagccaucauucucaggaaacuaacacaggaacagaaaaccagacagcguauguucucacucauaagugggaauugaacaaugagaacacauggacacagggaggggaacaucacacaucggggccuguuggggguuuggggggcaaggggagggauagcauuaggacuaaugcaugcggggcuuaaaaccuagaugacagguugaugggugcagcaaaccaccauggcacauguauaccuauguaacaaaccugcacguucugcacauguaacccagaacuuuaaguaaaaaagaaaagaaaggugcaaaagugaaaacauuaaaaguggaaucaugauuuuaaaaaauaaauucacagugguguugaaagaucauaucaggguuagaggacaagucuuuggguuagaaugaacacuuaauuuauuaucagagugaacaauaauuaccucgacauuuuaaaacagcauuuugucaccuuuuaaacguuugggaacagagaaggcgaaacaccaugucugacacacuauggaaaguuuuauaauucuccucaaaaaggaagaaaaaauauuucuauuuccauuccagaucugcacaauauauucuugcaucccauuuggucugauucauuuacauuuugcugaauucuguuuuuguccauuuucaucauucaaaagauuuuaaaaauucaacaacaucaaaaagccaucaaaagaugcuuucagaugaaauugcaaagaaaauaagcacaugaauuagugaagcaacuuccaaguuauacaauuguggcacuuacaucuuuucucaucuuguccgagaauuaauuguacugcugaaauuagacauccagccugcuccaugcagacaggagcccaagccggaagaaaacucuuugaauaacaacacugccuucugauucuuuucacauggcuacauuuuugacauuuacuucaauauucuacccaguugcagugugacuaugacaaaauauuucuguaggcaugacuggcaccucugcgguaaguggcagggaauggaauaggaaacgagucccuuuaguagcuccaaaaagcccacaggcacucugcaaaccuuuugcauacaugcuguuaaguaaaggaugugaaaaauggaaaccgugaugacaauuuuaaucaccuuacagaugauucuaugaucuacuauaacuuuauaauggcaaagccacugacacaggagacugacaggcauauauucucucucugccucuaagucuauuaaauguuuauuugggggguuuacacauggauagagaugaacuuaacagaguauuuauugaaucuauccacggauaaauuauaaaugacuacaacuuuaacuagguggaauuuucaugguuauuuuuaauuucuaggcccaaaucacuucccuaggcucuagaacugucuuccaggagaugucagaugucaguaaucagagggaacccaucuacagucaaugcagccaaaaguucugccuacaagguagcaauuagaguccagcagucucuucuggaagugccaauuacuguucugucuucccuuuugaaugccuccuuaauauaagaauaacauaucauuuuuauccuaucagauuagaaaauauuguuuaaaauaacacucacaguuggcaagaaugcagagagagaagcacucccaaacagaugcuggugaggauguaaauuggaauguccuuucuggaaaacaguccagcaaaauuuaucaugauguuuuuaucuuccugacauuaguuuggguauacuguugcauauuuuuaaauagucuucaaaagcuagaguuuuaaaacucuguguggcauuuuguuacgugaauacgcuauaguuuucaauuauuuccacauuugucagcauuuuaguugauuucaacuugggguauuauaaauaaugcuccagugaacaucuucauaaauacacauuuaacucacauucuguuuauuucuuaguauagauucaaagugaaaauacagugguuggcaaggcuuauauucaaguauaauuuuauccuaguaauuauggaauuaguaucagcaaacggauuccuaagcuagaauucaccaucauuuacuaggagaaagaucuguggugguaaaacagacucugcuuauuuacacagccuuacuaaugggcaauuugccagaggaauccaaaccagagagcauguaugauugacuaaccauuacauggaaagaagaaaucagcuccuaccaaaagcacauucauuucaaguaaugccagcaaccugcugagucaguuguauucagccccuauagaaacccuucccaaguucauugauaugugacacccaugacauauuuuuaccaucauugguuuucaugaauuugccugucuuugagaccugaaaaacaaucugauuuauugaacugaaaaaggcgaauguagugaaacccuauccuguaauuggcaaaccuuuuaccucccugguggcuugaguagagaaguuacuggcuggaggcuguucuaaaggaaaacaugaauggcccuaaaauuaaaauuccagacuuuaggagccaauuaaugaggacauaccacuuuuaauccaucacuuugcaauauauuuaaaauguuaagacucauuguuggcaagggaacaguauuccccaaagcuuauuccaugggaaaauguuuuuguggacaaaagaguuugggaaagagugauauuggaaugaaguucaagcugaacuuuuaaugugcuauuaccaacugugaaucuccauggggggcuguagcuaguaacauuuguaaacuucuucaaccacaaauuauuccugcuuuauauugccuuuguuucuggcaacuggguuucuauagcgcauugcaaggcagagcauucuauggaacguacuuuagagaauguuucucuaggucagcaguucucaaacauuuuggucucaggauccauuuccacuccuaaaaacuguggaaggccccaaagaguuugugguuauguugguuauaucuauggauauuuaccauguuagaaauuaaaacagaaaacuuucaaaacacuaugaauuuauuuuaaaaugacaguaauaaccaauuacauguaaauauacauauuuucccgaaaaaagagcuagugagaagaguggcauugucucaacaucacauuaauauuuagccuaauagaagacagguggauucuccuaucuguuucugcauuguguugugauauauuauuaggguugaagugugccaagaaaaucuagaaggaauauuuuaauagccuuuucaaauaacuggauuuuuucucuaauacugcaucaaaacuuaacaaaugguaguuucuuuaaaaguuacuugcagaguagaacccgaaaccacaucaagaaauuuuuagugcucuguuaugugaaaaauccauggucuguguagcauuuugaauggauccuuuccccaugugaaauuuuguaacagugcacauugcucuggacaaaaauagugguucauuggauuaugcagaucuuccaaauguugacaccuuucauugcaugauauaaaaaagaauuauauuugcaauaucaucauugaccuuuuauuagaaaaagucuuuaaguauugggaagcugucaagcucaugguggcauauccaaguuucccaaaauuugaauuuuugcuuagaagcuugaauuuuaucacuaucaacaaauacuggccaacgguuuacuuaaagcaacagacucacuuugugcauuuuaaagaaaauauguuaaauacuugaguuugcauaauuauaguuugucuuucaaugcuucuuucaugcagaaaaauaguguuccauauaaaagguagcugguucauuucacuacccagucucacaagugcuuuuccuugagacaaccaugauaugucaguacacagcagcaguucuuucugcauacuucccauuucagcacacagaaugcuaaaaaaaaaaaaaaaaaaaaacucaacaaucaaaaugcaauuaaauuaauaauuuuuacuuuucaacaaggauauucuuagaaaaaguugacuuuuuauuuuuuuuaaccauagugcauggcagugaaaaaugaaaggccaaaaguacaguucagugccacugucuugauucaugcuauggugccaguaguuuuaaaaaacauuacauuuggaggagccaagauguccgaagaggaacagcuccggucuacagcucccagagugagcgacacagaagaugggugauuucugcauuuccaucugagguacccgguucaucucacuagggagugccagacagugggcgcaggagagugggugcagugcaccgugcaccagcugaagcagggcaaggcauugccucacucgggaagcgcaagggaucagggaguucccuuuccugcucaaggaaaggggugacagacggcaccuggaaaaucgggccccucccaccugaauaccacgcuuuuccgaugggcuuaggaaauggcgcaccaggagauuauaucccacaccuggcucggaggguccuacacccacggagucucacugauugcuagcacagcaaucugagaucaaacugcaaggcggcagcgaggcuggggaaggggcgaccgccauugcccaggcucacuuagguaaacaaagcagccuggaagcuccaacuggguggagcccaucacagaucaaggaggccugccugccucuguaggcuccaccucugggggcagggcacagacaaacaaaaagacagcaguaaccucugcagacuuaaaugucccugacugacagcuuugaggagagcagugguucucccagcaugcagcuggagaucugagaaugggcagacugccuccucaagugggucccugaccccugacccccgagcagccuaacagggaggcaccccccaguaggggcagacugacaccucacacggcuggguacuucucugagacaauacuuccagaggaacuaucagacagcagcauucacagaucacgaaaauccaugguucugcagacaccacugcugauacccacacaaacagggucuggaguggaccucuagcaacuccaacagaccugcagcugaggguccugucuguuagaaggaaaacuaaaaaacagaaaggacauccacaccaaaaacccaucuguacaucaccaucaucaaagaccaaaaguagauaaaaccacaaagauggggaaaaaacaagagcaaaaaaacuggaaacucuaaaaagcagagcgccucuccuccuccaaaggaacgcagcuccucaccagcaauggaacaaagcuggacagagaaugacuuugacaaguugagagaagaagucuucauaugauccaaccacuccgagcuacaggaggaaauucaaaccaaaggcaaagaaguugaaaacuuugaaaaaaauuuagacaaauguauaacuagaauaaccaauacagagaagugcuuaaaggagcugauggaguucaaagccaaggcucgagaacuacgugaagaaugcagaggccucaggagccaaugugaucaacuggaagaaagggugucagugauggaagaugaaaugaaugaaaugaagugagaagggaaguuuagagaaagaagaauaaaaagaaaugaacaaagccuccaagaaauaugggacuaugugaaaagaccaaaucugcauguuugguguaccugaaggugacggggagaauggaaccaaguuggaaaacacucugcaggauauuauccaggagaacuuccacaaucuagcaaggcaggccaacauucagauucaggaaauacagagaacgccacaaagauacuccucaagaagagcaacuccaagacacauaauugucagauucaccaaaguugaaaugaaggaaaaaauguuaagggcagccagacagaaaggucggguuacccacaaagggaagcccaucagacuaacagcugaucucucggcagaaauacuacaagccagaagagacugggggccaauauucaacauucuuaaagaaaagaauuuucaacccagaauuucauauccagccaaacaaacuaagcuucauaagugaaggagaaauaaaauccuuuacagacaagcaaaugcugagagauuuugucaccaccaggcugcccuaaaagagcuccugaaggaagcacugaacauggaaaggaacaaccgguaccagccgcugcaaaaucaugccaaaauguaaagaccaucgaaacuaggaagaaauugcaucaacuaacaagcaaaauaaccagcuaacaucauaaugacaggaucaaauucacacauaacaauauuaacuauaaauguaaauggacuaaauuauccaauuaaaagacacagacuggcaaacuggauaaagagucaagacccaucagugugcuguauucaggaaacccaucucacauacagagacacacauaggcucaaaauaaagggauggaggaagaucuaccaagcaaauggaaaacaaaaaaaggcaaggguugcaauccuacucucugauaaaacagacuuuaaaccaacaaagaucaaaagagacaaagaagcccauuacauaaugguaaagggaucaauucaacaagaagagcuaacuauccuaaauauauaugcacccaauacaggagcacccagauucauaaagcaaguccugagcgaccuacaaagagacuuagacucccacacaauaauaaugggagacuuuaacaccccacugucaacauuagacagaucaacgagacagaaaguuaacaaggauacccaggaauugaacucagcucugcagcaagcggaccuaauagacaucuacagaacucuccaacucaaaucaacagaauauacauucuuuucagcaccacaccacaccuguucuaaaauugaccacauaguuggaaguaaagcucuccucaacaaacguaaaagaagagaaauuauaacaaacugucucucagaccacagugcaaucaaaguagaacucaggauuaagaaacucacucaaaaccgcucaacuacauggaaacugaacaaccuguuccugaaugacuacuggguacauaaugaaaugaaggcagaaauaaagauguucuuugaaaccaacgagaacaaagacacaacauaccagaaucucugggacacauucaaagcaguguguagagggaaauuuauagcacuaaaugcccacaagagaaagcaggaaagauccaaaauugacacccuaacaucacaguuaaaagaacuagaaaagcaagagcaaacacauucaaaagcuagcagaaggcaagaaauaacuaaaaucagagcagaacugaaggaaauagagacacaaaaaacccuucaaaaaauuaaugaauccaggagcugguuuuuugaaaggaucaacaaaauugauagaccgcuagcaagacuaauaaagaaaaaaagagagaagaaucaaauagacacaauaaaaaaugauaaaggggauaucaucacugaucccacagaaauacaaacuaccaucagagaauacuauaaacaccucuaugcaaauaaacuagaaaaucuagaagaaauggauaaauuccucgacacauacacucucccaagacuaaacgaaacgaggaagaaguugaaucucugaauagaccaauaacaggaucugaaauuguggcaauaaucaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccuggcagagacacaaccaaaaaagagaauuuuagaccaauauccuugaugaacauugaugcaaaaauccucaauaaaauacuggcaaacugaauccagcagcacaacaaaaagcuuauccaccaugagcaggugggcuucaucccugggaugcaaggcugguucaauauacgcaaaucaauaaauguaauccagcauauaaacagaaccaaagacaaaaaccauacgauuaucucaauagaugcagaaaaggccuuugacaaaauucaacaacccuucaugcuaaaaacucucaauaaaucagguauugaugggacauaucucaaaauaauaagagcuaucuaugacaaacccacagcaaauaucauacugaaugggcaaaaaccggaagcauucccuuugaaaacuggcacaagacagggaugcccucucucaccacuccuauucaacauaguguuggaaguucuggccagggcaauuaggcaggaggaggaaauaaaggguauucaauuaggaaaagaggaagucaaauuguuccuguuugcagaugacaugauuguauaucuagaaaaccccauugccucagcccaaaaucuccuuaagcugauaagcaacuucagcaaagucucaggauacaaaaucaauguacaaaaaucacaagcauucuuauacaccaaugacagacaaacagagagccaaaucaugagugaacucccauucacaacugcuucaaagagaagaaaauaccuaggaauccaacuuacaagggacgugaaggaccucuucaaggagaacuacaaaccacugcucaaugaaauaaaagaggauacaaacaaauggaagaacauuccaugcucaugaguaggaagaaucaauagcaugaaaauggccauacugcccaagguaauuuauagauucaaugucauccccaucaagcuaccaaugucuuucuucacggaauuggaaaaaacuacuuuaaaguucauauggaaccaaaaaagagcccgcaucgccaagucaauccuaagccaaaagaacaaaguuggaggcaucaugcuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugacaaaaacaagcaauggggaaaggauucccuauuuaauaaauggugcugggaaaacuggcuagccauagguagaaagcugaaacuggaucccuuucuuacaccuuauacaaaaaucaauucaagauggauuaaagacuuaaacauuagaccuaaaaccauaccauaugaggcacuauucgcaauagcaaagacuuggaaccaaccaaaauguccaacaaugauagacuggauuaagaaauuguggcacauauacaccauggaauaccaugcagccguaaaaaaaugaugaguucauguccuuuguagggacauggaugaaauuggaaaucaucauucucaguaaacuaucacaaggacaaaaaaccaaacaccacguguucucacucauagaugggaauugaacaaugagaacacauggacgcaggaaggggaacaucacacucuggggacuguugugggguggggggaggggggagggguagccuuaggagauauaccuaaugcuaaaugaugaguuaaugggugcagcacaccagcauggcacauguauacauauguaacuaaccugcacauugugcucauguacccuaaaacuuaaaguauaauaauaauaaaaaacaaaacaaaacauuacauuugcaucauuaaugaaaauauuaacauagugaaaaagaaaaagagcaacuuaguauuacaguaauauaguuucgaccuugcagacucccuggaaggaucucagggaucaccaggagucugugaagcacccuuugagcauugugguucuagauucaaaauguggccuuggcugagcacgguggcucaugccuguaaucccagcacuucgggaggccaaggcaggcggaucaccugaggucaggaguucgagaccaacauugcaaaacccugucuuuacuaaaaauacaaacaaauuagccaggugugguggugcaugccuguaaucccagcuacucgggaggcugaggcaggagaaucacuugaacccaggaggcagaguuugcaguuuagcugagaucacaccgcuacacuccagccugggcaacagaguaagacugucucaauaaaacuuacacacacacacucacacacacacacaugcaaaaaacccuuaguuuaaaacacaaacacaucguacagcugcacaaaaauauuuucuuucuuuauauccuuuuucuauaagcuuuuuuauauuuuuaaauauuuguauuauuuuuuuaaacuuuuuuuuguuaaaaacuaagaaaaacacaaacauuagguuaagccuacacccggaugguaucaucaauaucacugccucccaccuccacaucucauccaacuggcaggucuucaggggcaguaacaggcaugaaguucuuaccuccaaugaaaacaaugccuucuucugaauaccuccuggaguucuugccugagacuguuuuauaguuaacuguucuuuaauaaguagaaguacaugcuaaaauaaugauaaaaagcacaguagauaguucauaaaccaguaacagucauuuguuaucauuaucaaguauuauguacuguauguaauuguaugugcuauacagcuggcagcacaguagauuuguuuacaccagcaucaccacaagcacgugaguaauucgugacgcuaugauauuagcacacuacaaugucacuaggcaauaggaacuuuuuagcuccauuauaaucuuaagggaccacccucauaucugcagucugucauugaccagaccauuguuaaguggcacaugacuguauauacaauggaauacuauucagcauuuagaaagaaggaaaucuugccaucugcaacacgaaugaaccuggggaauguuaugcuaaguuaaauaagccaaacauagaaagacaaauacugcaugaucucacuuauauguagaaucuaaaaaaguuaaauucauagaagcagguaguagaagguugguugccaggggcuguggugugggagaggaaaaaaauggggagguguuggucaaaggguacaaaguuugaguuaagcaagauaaguaaguuuuggagaucuauuauacagcauaauaacuauaguuaauaauaauuuauacuugaaaauugguaagagguuagaucuuaaauugcuaagagaguagcauuuaagaucuacucucaccacaaaaauuuaugagaugauggauauguuaauuagcuugauuucaucauuuagcaauguauacauauaucaaaacaucacuuuuuacccuguaaauauacacaaguuuuauuugucaacuauaccuuaauaaagguggggugaaaaugcauauuccugaaacccaucaugggccuacucaaacagaguaucugaggaggaggcagggcuacccgagcagcagcgcagguuguacacugcacaccuugcacaaagguauacaguuagcgaagauuugagcuugaaguuugccuuuuaaagaaauugcauaugugaaucuugguuauaguagaacuuuaaguguucuagagcaguuguucuucaacuuuaugugcaucagaauuaccugucuugggguugaaaacacaaauuucuuugugccaugcuugaacuaccuaauuagaaaccugagcaucuguauuuucaaggaacuacuuagccaacucugccaccuaccaaaaugugacagccauuuuucuagacuaaaaaugguauagcugucuacaagaaaucaacucaacaaaagcugaagacaacacacacacggcuuaggauacucaggcaucauuuggacagagucuauucaacagcuauaaauuuguuguuuaaaauagccaauguuuuuuaaaaugcaacuuuccauaguuuucuguuguuauauuuguuuucauucugucaguaugguauuggaucucaaccuuguauguuauuucaccaacaucuugaaauuuauuuagccauauuuucaugguuuuauaugaaugcuuacuaaacauagucugauuuuuuaaaagguuuuaucuuaugcaagauucuucaagagaaaagacaaacuuaguuuacugucaaauuaccaaacugacucagauuuuuaaaaaccauucgaaguuucauguuaugcacuuaacauaaaaaaaugacucaauguaaaugucaugucucguaaugauccuauuccugggaucuuucacaugaaacagagugggcaggaacauucuauggcugccaaaauggaauuaaacacauggaaacaaagaaacaaaagcacaacucaccccuuccagacaacaggaaaacauguagauaaaucagugauuuuccuuccagcuaaccaaugaaguagagacauguauuuuaacaauuguaagggcacugggcuuaaggaaaggcaaaguaaaaacuagguuauaauguucuucuagaugcgaaaaugccaaaucugccagucacucaugaaaagaacacagccccaggcaacugauauugauacauucaaagauuauaguuauguaugauuacagaauagcauuucauaaacucuaucagacagaacaacucuuuaauggaauguuaagaguugggagagagagaaaaguuggucauucuaagguccaauuaauuugaaaacucaugaguuauauagaauuaaacaaauuuuuuugacuguggaacuucucagagcccuucuguacuaaugugcauuacaccucuccaagaagaaaaaagcaugcagcauuuuucaaacuuuugauacuuugaugcuuuuuuauuuagcuucugacugggcuagaguucucugggacacacccagggaaauauugauacagacaggucaaacaauuaaggcaaaugcucaggcauauaccugaacugugguagaacaaucuagaugccacagaaauggugaaggcaugcccaacagccagccccacuauaucaagucccuuagccucucuccauuggccuuagcucugaaagaaagaugaugcuuauuaguaaagugccuugggaugguugggcaagaaacacuaaauaagaacaaauuauuacccucauuacaggguagaugaucuaauaaaccaucucuauuacuuacaaaguuuggaggccugcuauuuuuuuccuuuuaacuacacuccaauuugaccuuaaaaaucuaugcuaaaaauaacuuauaggaaauaucccaaaaccauaccauaaacuuucuuaucggaccucugucuguuugcacauucucaaugacugccaaucaccuacagguaaaugcaaauuucuuagccugcuguauaacucuccaucuuucaggagcuguagaguuuaugauuaagaucauggucuuuguagggagacagacaagguucacaugcaggcuccacucuacuacaucugaaguuauuucucuucucuaagcccuagauuaucaaaguaugguccaugaacuggcagcgucagcagcauuuggggcuuccuagaagggcagaaauucaggcuccauugaaaaccuacugaaucagaaucuacauuucaacaagagccucacacuguaguuugagaagaacuacacaaauucucauacgcuuugaccagcuccucugcaaauuggagguaauaauaguaaacuuggagauggcauucaucgucuacuccuuugaauccauccucaaguccuaagguccacgcaaauauccuuaccugucucuuucccuucauuaccuuaguccaagcuguucucauuucucuccagaucuccugcaauggccacucaacucauuacaaugcaucuccucuugcuuccuucuauucuguuucacuuacugcaaccagagagaucucccaggaaaagcaaaugugaucagagcuuccaugagcucucaaaauaaaggccaaaagccuuucacagaacuacaaccucuguugagggggucgcuucccaccucuauaucuuaucuugcaugaugcuccaccugguuuccucugcuccagaagcacugguaaauucuuuuuuccacuccuugaacuagccauccuccuucccgauacagaauauuugcaaaaccauccuccuggucaucagugccuuccccucaacucuuuaccugguuaacuccuucucaaucuuuagaugucagcucaaaugucaucuccccugaaagcuuucccugaaccuccuacccagcagccaaacacacugccugaccuguugccugugccccauaaauauuuguugaauaaaugaaggaauuaaugaauguucauucauaugguuauugugacaaucaaauggauugaaaccuguaaaucauuuagcacagugccugguagagagcaagagcuuacuuaaugcaguaccaaugguaauauauuuugaauauuagucuugcuaaaaacuagaccccaagcaguacuuaacaggggcuaacaauuagaaucaccugggaaauguuacacuucucaauguccaggcucugcugcagaccaauuaagucagaaucucuagguggugggacccaugcaccugaggauuuuaaaacucuacaggagauucuaacguacagccaaagugugacugcuuuacucguugucucacuguggucucccagccuuccagagaauagcauacugggcgucaagaagaguccucauuaaucauggcaugagucuguggcccacagaaaggggcaguaauaugaauacauguaguaaaaaucuagcaauucauuuccccuggcuccuugacagcagccagaugguggaaacucuccaucuauuacccaagccagaagaaaaccuuucugggaaaauccaaguugccugaacuacuguugggaggaaguaugguaacacgugaagaugacucugguccuuuggguuaagugaugacuuaacaaaauucaucaggauuccauuauaaaucugucauaauuguuuuguugaagcaauugcuuugugggagcaauuaauuccuacugcuaaaaaaaaaggugagaacuccugaguguuccaucaggcaccaagaaauaggugagccgggaagcauuugcccuuaccuucugucuucuucacuacucaaguauuuggagugucaagagaccacacuguacuucaaaggccuccucuuccaaauaaccaaccuucugcuauguaaaaacaugauuaagaacacacauauuuguacuguaugucucacucauuuugaacuuuucaaaaugugauauugccaaagaagcuuuaucucuuuuaaggguuucacacacacacacauacacugccuugguuugaaaaacaacauagaaugcaggccucauacaauuugagaaccauuuacaauuauaaccuaccaagucagagcugauaccaagccaacacaaaggccucagaauuguuauaaaaggaacagaauugcucucuggaaauaauaucccagugggcuaaauucccccucccccuguuccuccaaggugguaaauugcaacaacaacaaaaaagcaugauucaugaauauaaauuuuucuuggcuuuuaaaaucauacacuggcauaguccuccccgaacuucagccaaaugagaauacacagauaaugacaauuuuacaauaagugguuccaggacacaggcuuuucaagauccacaaaugaaaggcacuauaaaaaagaguauuauuauuauuauuauuucaagcacccagaaaaaccacaaucaaugauuagccauaacaauuaaacuaacaauaguacaucuggaaucagcuccaugguaauauguacuucaugcuuaauaguucaaauuaauucaaucugaugguguuagacauaccaguuaggagcuggagagcaccaaaauucacauuagcuuccacuucaaaagauauuaugaaaagagaaggaaggaaaugaggcuauaaacagcagugguaaauacgaaaggcucagagaugauauggucaggaauaacucucagcuauuaggaauucagugaugaaaauaugaaggcugauauuucuauccuugcacauuccuccagagucaaugacugagccacccaucugagcgacagaacugaaacccuaaaaucagggcaauuauauucaaagaagagggggccuucuucauucugcuuacagcauccuuuacuaguagcccauuuauauugcagaaugcauggagaauuucucauuuucagguuauagacuucaaguaauaagaaaagagagcaggaguuggggcaggcauaaaaggugagguaguuauugccugauuaccuuauuugucucacuccuccuugaagauucacuagauaacugucuuaagcugcacuauaaauauucucuaaggcaggauuucucaaccuuggcacuguagacacuuuggccuaggucauucuuugcugugaagugcuauccugugcacuguaggauguuuagaaacaucccuagucuccaccuuguagaugcuaguagcaucccccacccccaguugugacaacaaaaugucuucagacauggccguauguccucuugggggaaaaaucauacugguugaaaacuguuaccuuaaaucuuuuuuuuuuuuuuuuuuuuuuuuagauggagucuugcucuguugaccaggcuggaaugcaguggaaugcaguggcgcgaucucggcucauugccaccucugcuuccaggauucaaaugauucuccugccucagccucccaaguaacugagauuacaggcaggagccgccacauccagcgaauuuuuuguaguuuuaguagagacuggguuucaccacauuggcgcuggucucgaacuccugaccucaagugauuugcccgccucggccucccaaagugcugggauuacaggcaugaaccaccguuccuggccuacuuuaagucuuaauucacuuguuucugggcaucgggaggaaaauccagagggcagacuccccucuagacucuucuuccucagagaugagcauggauuguauugccagcugugugcaaggcagcacucuucccacggcaugcugaauccuccuccuaacaccuuuugcacauauaggcuuguugcauauaauacagaaauuuggaaccuggcagucuucuauucauugugcagaaaagaguuaacacagagcaggcucgagaaggccuauccuuagaaggccuguuugcaauguuggccuuugguuagcagcugggaauuggagcugguaaacaguucccuacacuaauaugacauuuuuccuaaauuauagaguggccacuaugccucaccuguuuguacaaacagugugguuuaugcugaacaccugcuuuccuucugggagucuggaauuuggguaugugcuaggcagaucagcucccagcaguagccuugggcacugagucucuaaugagugcccuaguaggcaacacuucaaacuuguugucgcagcuuguugcuuaaggaacuaagagcauccugugugacugcauuggaagaggacucuuggacgcuuacuccugauuucuccagacugcacaccaugcaccuuuucccuauguugauuuuacuuuguguucuuucacuguagcaaaucagaaccagaagauaacaaugcugaguccuaggaguccuccuagagauuuacagaaccuugcaaguggucuuggggaccaccaaugcagggacucauucagcauucuauuugugugccucuauuucuagauacagcaaagacuuaaacuccaaguccucacagaauuuaugugguagcagcgagcaaagcauuaauucuagcauauuucaagcuucuuucauagaaaacaagcccuguggcaucucuuuuuuguuuuuauaacagcuuuuuagagauauaauucacauaucauacuguuaaucaaucuaauguguacaauucaagauuuauauucauagagucgugcaaccacgaccacaaucaauuuuaggacauuuucaucaccccacaaagaaacccuauauccauuuacagucacuacccauuuucucccaaccacccagcuaggcaaccacuagaguuucugccgcuauggauuuaccuauuuuugacacuucacaauuggucauaugauauguggucuuuugugaguggcuucuuucacuuaccaaaauguuuucaagguuccuccaugauguaacauguaucagcacuacauuuauuuuuauugcugaauaauauuucauugcauggauauaccacauuucauuuauccauucaucaguaaauggaacuuuguauuguuucuacuuuuuggcuacuaugaauagugcuacuaugaacauuugcauacaauuuuuuuaugcacauaugauuucauuccccuugaauagcuaccuaaguguggaauuucugggucauacauauguuuaacuuuuaggacauuuucaaacuguuuuccaaaguagcugcaccauuuacuuaccaauggcaguguaacagaguucuaauuucuccacauccuugcuaauaguuacuauuaacugucuguuuuuuuuuuuuguuuuuuuuuuuuuugagacagccugucacccaggcuggagugcagugaugcaaucuugacucacugcaaccaccaccucccagguucaagcaguucugcugccuuagccucaugaguagcugggauuacaggcacgccccaccaugccuggcuaauuuuugucauuuuaguugagaugggguuucaccauguuggccaggcuggucucaaacuccuggccucaagugaucuucccgccucagccucccaaagugcugggauuacaggcaugagccaacgcgcccaaacuuaucugucuuuuugcuaauaaccgucuuagugggugugaugugguaucucguaaugguuuugauuugcacuucccugauggcuaaugauguugagcaucuuuucaugggcuuauuagccauuugcauaucuucuuuggagaaaugucuauucagaccuauuugccccauuuuaacugggcuauuugucuuuuuauuauugauuuguaagaauucuuuuuauauucauauucuaucuccaaguuucuuaucagauauaugauuugcaaaacacuucuuccauuuuguggguuaguuuuauuauuucaaucauguccuuuaaagcauaaaaguuuuaauuuuuaggauguccaauuuauccauuuuuuucuugcauuacugugcuuuuggcaccguagcuaagaaaccauugccuaacacaaggucaugaagauuuaucccuaugguuuugucuaauaauguuauaguuuuagcuuuuccauuuaggacuuugauacuuuaagguaauuuuuguauacagugugagguaggggguccaacuuuauucuuuuguguguggauauccaguugucuauggcaucuuuugcaucacuccaagacauaguuucagguaauuuuugucuauacaaauuaagguaacagguaccaaaacacagaaccuauguaugugacaaacugccugaaagccuuuauaaaaacuuuugcaauugguguucuuuuuuucuauuuucagaauaugcucaguauuuugcuauaucaggaagcaguaccaccauuauuaccacuggugcuacugcugcuaauaauaauaguaacuagcagauauuuuguacuuaguaugugccagacacuacacuugcauuuaacauucauuaacuuuuaagcacuacacaugcuuuaacuuacaugaucuuccugccaacaccacgagauagguagaaucauuaucuucauuuuacagaugaugauauuaaggcucacugauguaaaaaaauuuuccuuaggucauagaacaagcaggaaaaccgauuuaaaaaaauugagggaaggaauggcacuggaaaguggaggucaaguaaugucggauagcaaauucuaacaaacaguagcuaagcacguaugcgaaauauacaaaaauaaacaagccaaaaucuagcacugguagaugacauucccaguucugaucaaguugcugacaacaaaggauuggucuccccuucuaacucaacaaaggguaggaaaucuuaucacucaagauaucaaucaagauuuauuugaucgcugaaaggguuuugucaacacuccaaaaauuguauuagugacuagaugauugauggaauaagucaauuagaaccagauuagaaaucgagauaugaagucaauuacuuccaaucugaaaauuaggaaucauuaaacaauaauauaauagauggcaucaauuuucaaaacuacccuucguguguuugucuauagggcaaaauucaaguaaaaaauaacuuugaaaagacuaaaacuauagagcaacuugaucuugggaguguuuucccagauggguagugggcugagucuggucaguuuucaguggagaaaauguagacgagauaagcaguugauguucccaaauucaaauaacuuuauggcagaaaagucagucaaguuuaauucucuuucccuauacuagcuguguccuuaaugauaaauacaauaauaauagcugacauguauugagucuuacauuauauagcucucuagguaccuaaaagaugacaacuaauuuauuuaaaccaaggcauaugaaguaaguacuauuauuauucccauuuuauauaagaggaaaaggauguguaaagugcuaauugaccugcuuaagagguagagugagaccuugaacccuguagucuauguuuguccuccuaauagugucucuauaugguuucagaauagaagcaaauagacacauaaggguuaagcauggcuaaccuaacuccaaguugagucuuuuuacacuaggcaaugcugucuucaauauauuuauaauaacuuuauacaccaaauaacauuuugaaguuuauuuccucccaauacagaaacaucacugcauuuccacugggauuuucaguacugucuguuguggaacugaucugggcuuagugaguauugcuuuaucauucuuaaauaaaaaccauuauagagaaugcagaaaacaauuucccuuucaguuugcccacuucuacccauaccgagaaagacggauccuuaaagcucagaauguaauaaaagcucacaauauaauaaaagcucaguaucagaaauguuccaagucccuccacucuuucucuauaguuaggaaacuaaaauuuaauauagggcacaacgcuccagagaauucaguguaucgaaauguuaauacacuuuuauauauuuuaacugagauaaacaagaaagagauagggaagccagagcagcuauggcaaagacauaauuaugauaagacuaauccagcuaacagcaauagaagcagauagugacuccacugugaugcugugguagaguuuguauggucagaaaacuauaucaguauacaauguuaaugacgcaggagccccauuauaggaaagcaaagauaacuuacuaugugacucuauaaaguaaaguucauccaaaagaucaaagagcauuuguccuauuacuaaaauauuauccaaauguauuuuaucaauuaaaacuuggauaaaaucauuugcuucauugaacaguaauuuaaaaggagcauaggcugggcacuguggcucacgccugugaucccagcacuuucggaggccgaggcgggcggaucacaaggucaggagauagagaccauccuggcuaacauggugaaaccccaucucuacuaaaaaauacaaaaaauuagcugggcaugguggcgggugccugcggucccagcuaaucgggaggcugaggcaggagaauggcgugaacccgggaggcagagcuugcagugagccgagaucacgccaccgcacuccagccugggcgacagggcgagacuccgucucaaaaauaaauaaauaaaauaaaaggagcauaguauguccauaaccaaauaggaaggaaaaugccuauuuugauuuucauaacagagcuuaaacauuguggcaaaacuuuaaaaugcaggacauaauguaaaaauucuucuaccagcucuaaauucgugguugugcuaucaacuaugucacauuucucaguguugaccacaaaaauaccaugagauacauacacauugcugaaauacacuauuucucaaacucaacuuuaucuucuacuccaauaacccugucaaaaggaaaacuagucugguuacuucauuucuggcagauccacauuaacuccuuucuuuuaaugcucauuaaucuuucuguuaacaauacuucugacccucaauacccacccuuucagacaggucaaaacuaaauucuucaguuuaccauuuaagccuuuccuucaaguuuuugcagguaaaaugagauaaaaacagacguuuguauuccagccagauugaaauuuucuacuacccucuuugcucuucccauuaaauucuaccucgcaguuuguuuguuuuuguuuuauuuuguuuugcgucguuuuuuuaaaaaaaauuguuuauuguuuauuuacuaaaucuggggcauauuagauacuugaccaauuuaaaauuuacaucuuuuaaaucaauuuugaaguguuuucacacacacauacacacacacacacacacacacacacaauuggcaugcaacaguuguccuaaggugaaacaaucaccucaucaacaaagugucauagguguucucacccaagguugcuuauccuaaaccugaaaaccuguaacaaauuuaaauuacuuauauaaaacucauuacuuguaguuuuccccuugcaaagaucuccagaaauguacaaauaacuaauauacaucagucacaacauaauccuggaucauccccacaucaaaaccagaugcuccuuuaauuuuaaacucauuaucagagagcaagagaaagucauuucguuuuacacaaaacaaaauucacauaugccaaaaaagaaagacccaagagaaacaaaaacaaaaacccuagugcugacacugauguucagugcccugguuaaacaguggcccgaaggccacggaucaaaaauaaaauagcggcuguauaucacugcaaugaaguuuaacaggcuuuaaccuucuggcuucagaaauccagauuuuuccaauuacaugaaugcauacuuccuacauuccaagaguggagaaaguggaugcgccaguguggaaaugaaaagagccaccauucacugggacaaccacagaacuggcuuuaacagagacuccuuagaaaguuacgcaaaaaauaaagacaaaaaaugguuguaugcggcuugugucaucaauuuuaaguggaggugacugaguccuaagguacaauguaaaauguaugggggaaaauaggugcuggggcaagucuuaccuuuaaaagcaaaacuugaaaacaaaguauaaaagugcccagccuggcagcauacacccaagccagagagcucugccaugagcaugcauagaaaaugucaggauucauacuauuguuucucauaaggacucaacaaaaugaauccuuaauagcuuaaaccacagaaugagggaauacacagaaugcagucauuucaguaaaguacuaucaggcuuugugcugauuuccugaacuaacugcauuuuauuaucaaaacaaaaggaaaagaagauuuuaaaaauauauauauauauauauuccuauauuucaauuccaguguuuaauuucuggaaggaccuauauaauggaggcagcauuuaauuaggaaauuaugccaaucaauugucaaauuuucacuaugacuuuccuaaaaagguguuuucuuccaauuucuauuaaucacaaagaaacauaagcugugacuguauaguucagaaaauuaaaacauagaaauuaauggccuaugacguuaucaccaagguguuugguaaacaguaaacuaugaguuuggaaucaucaggaagaggcuuuugaaacaacccucuggacuucaaaaaaucucuucagguaguagaugugucccaaugucauggcaauuagaacaagagcuucaaagaagcaccgaaggaccacugggcuguuuguguugucacuaauggcucuguguauccucucccagauuuucguguauuccucuuugugcuguacagcugucauggccacagccagcucacugaucauuucuucuaguuuguucuggugagcuucuguuuccaugucuucucuuuuuguagccuccccaauaucaauggugaauaucacuaucuuuggagucaugguggacacucggucacuaaaacaaaauguauuuguuccauccaugugagcagaaaauguguauuucccacuggauucuuugucuccuuuauaaauccuuuuauucuuagguccuguaaucuccauguugaugcccaggaagccaccuucgaagaugaggcccaucuuggugccugaggugacucacuuaagcauucuucagcaugugcguggaugcugaugaaauagcccaagaccauggucaggagaguguucuggagcaacagcagcucagcgagcgucaccacaguggggcuggagcagaggccaggacucgcacugcggccuccagagccacugccgccaucaccacccuacugccuucgccuaccuggcacuuuuugcuaauccuaggaaaaacgcaaacucaaaugccuuuugugcugggagguacuguaaauaaaugaacagagaagucuaguguuaagaaaaauaagacaggccaagugcaguggcucacgccuguaauccuagcacuuugggaggcugaggcagguggaucacgaggucaggagauagagaccauccaggcuaacacagugaaacccagucucuaauaaaaauacaaaaaaaaaaaaaaaaaaaaauuagcccagcgugguggcacgcgcccguaaucccagcuacuugcgaggcugaggcaggagaauugcuugaacuuggcaggcgaagguugcagugagccagggucucgccacuacacuccagccugggugauagagcgagacucugucucaaaaauaaauaaauaaauaaaaauaaaaaauaaaaauaagacagcaguacguuacuggccgaacauaucugagucaugcgucaucaaagaauguuaccagcagugaaucuguaugggucugcagcaaccucaguucuuaccucuucagaagaaagaguucaaccaaggggcauaaggcagaaggagacaccaaagcaaguuuuagagcaggagugaaaguuuauuagaaagcuuuagagcuggaaugaaaggaaguaaaguacacuuggaggagggccaagugagugacuugagagaucgagugcaugguuugaccuuuugacuugggguuucauauauuggcauacuuccagggucuugccucccuucuccccugagucuucccauggagugggcuguucacgugcuggguggccugcaugcacaguguguuuacugcagugguaugcauacccacuugaggcaugcuucccuuaccuaucaagcgucccuauaaggucauacaccaguuaaacuccaccauuuugccucuuagugcacauacuugaucccacgcacccaccuccugagaucuuauuaggaagcugcugaucaccgguuuuagguuucuucugucuguugggagacuauuguucccuggugccagcugcaaccaauuauuauuugagagaaccaucuuaacaacugccugaccaucaccugauggucgccugacauuccuggugggauguggggugucccuuuacugccccaacucauaucugacuagcugacuagcuaccuacuguaacaauuacacuugauugcauuuuuuuguuguuauuuaauuuuuauuucauaaucauaaacuuaacucugcaauccagcuagggaacaaggaaaacauggaacccaaagggaauugcagcgacaauacaaagauucuaggauacugcgagcaaaugggguggagggguagucuccugagcuacagaaggaauggucuggugguuaagagaaaacacaagucaaacuuaguagagcuguccacagucagcaauggugaucuucuugcuggccuuaucauuccuggacccaaaguguuccauggccuccaugauauucaugccuucaccaugccaaagaccacaugcuugccauccaaccacugagucuuggcagggcacaugaaaaacugggaaccauuuguguuggguccagcauuugccaugggcaagaugccaguaccucuaugcuucaggaugaaguucuccucaucaaauuucuaccuguagauggacuugccaccagugccauauggcaugugaagucaccacccugacauauaaacccuguaauaauucugugaaagcaggaacccucacacccaaauccuuucuuuccagcgcucagagcacgaaaguuuucugcugucuuuggaaccucgucugcaaacagcucgaaggagacgcggcccaagggcuccgugucaauggcaauguggaaguacacggugggguugaccauggcugauaguagggugcucccggcaguggcagcgucugcaaagacugcuuuuuuuuuuuuuuuuuuuuuugacaaagucucgcucugucacccaggcuggagugcagcggcacaaucucggcucacugcaaucuccaccuuccggguucaagugauucuccugccucagucuccggaguagcugggacuacagaugcgagcuaccacaccuggcuaauuucuuuuguauuuuuaguagaggcgggguuuugccauguuggccaggucucaaacuccugaccucaggugaucggcccaccucggcaucccaaagugcugggauuacaggcgugagccaccacgccuggccugauugcauaugaaaugcacuauuuccccauccuaucucacccccaucuuuuuuuaacaaagacuucugaaaauguauuuuucaucuuucaaacuuugcuggacaaguuuuuaugaauagucucaacagugcaagcaugaugcuagagagcaauuaaccuuugacuucaguguugggagacugcagggagaggugaagacugcgacaaaccacucguguaucauggcaaucgcuacucccucucagccauuucuugccaacuaggaauucaggcagaauguugucagaucuuucaguuauuacagaaaaguaagaaaaccugcauuuuaugugaaacuuccagauuuucuaguauuuucuaauuuuugcuugaaaucuuuuauuguuccaauauauuuuauuucuauauuccuguguagcacacaucugguuuuuuauuugugugguuuuuguuuuguuuuguuuuguuuuguuuuuaggccagugagcugacagaucgagaccucuggguuaugucauuccuuggucaguagcuuucagucuuuuucaccacuacacccaccucaaccaaccauccuuuccaccaaccgaugcccaucacuuccuuucagauguugcugaagaaacuauuucuccauauaauuuucccuagaucacucuauccuucauuccucauuaccaaacuguuuuacucuuuuagccuuuaguauguaugcucugugguccauuggugagcccuuuaucuuucucuaauuacaccuggacuauagauuucuaaugccgaggacccuuggucuccugccacauucacauucccuuagcagaauguugcacacccagcagacaguacauguauacugugaguaaauauuuuguauuccuagucuugcuaggauagaaguuuuuauucuauacuugaugcauuucuggaucaaaauauuaagucuaagucaagucuccauaguuaagguaaucuugaggauuaaaacacuuagguggacaggcaacauaaaacacuuuaucugaauaaugaaagaagaauccgucuguuggucugaaguaucaaagcaacugucccaauccuacaaacuuucagcauugggacuuccuuucaagauguaagcagggauggaaaauauacaaugcaagcgccauuguuucacucuccugggccugugacagacaucauuaagugaucacaacguucuuuucuucuaaggcugaaugcagucuuagaaaccauuuuaacaugguauccuagauguaucguguccaucuuguuuauuucuauuaagaaauagaguuggcaugagagcugaagauccuaucauaugaagguacacauacaauuuauuauucaaaagccagagaacaacauacaacugcugcugcaucucagucucucuauauuuuaauuuauuuauuguuuugagacagggucuugcuuugugcaggagugcaggcuggagugcagugauaccaacacagcuuacugcaaccuuugccacccaggcucagaagguccucccaccucagcccccaagaagcugggaccacaggcauggcaccaccggcaucccgccauguuaccaaggucucaaacuucugagcucaagcaauccacucaucuuggccucccaaaguccugggauuacaggggugagccaucccaccuggccucaaucucuguauauuuuagaggauagauaacuucgaaugggaaaaguugucucuaaaguugaccagucaagaagaaacaaugcuuccacuuuaaugccuaugccagacuuaccuuacccauuaacuuuuaauccuguaagaaagauuugcuaugugaugaggcugcuuuuguugcaccuuguaaaacauacugaaauaaacaaacuguaaaugacuuugcagggauugcugauuuaaauaaauaaauuguuauaauuguaguuacaguuauagucaaggggcuauuucauuucucagacucugaaccaaagcaauuaggaacaacucagacacaaaaugaccagcaucaagaauuacaaugaaaagccaauuaccuuuaacuauaagaaaccuuauuugcauuuauuaaaacaaaugaucucucaguacuggagaaaauuauguggauugguugauuaacccuucacuuguaagagaccagaaauuacuuuucagagagccuguaucuuuucuaaauuuacagacaggaaaccaguaaaugauaaaugaucaaggcccaaggaaaaaacugcauagcacaauggacaucuaugaguuucacuugugcuagcaugcauuccucauugugcugguaccaucauccucacuuuccucuggggaauccccuucuccaguucugacuccagaugguguagauggagcuaacuucacuccccacugagaaugagcaaaugaccaaucaauguauuucaccgaugaaugauucagggagccaaucauuaauucgagucaguccaguacuacucaaugcuaagauuugagaacuacugaaggaacuauugugaaagggaagaauuuaaaaaaaaucuugcuggcauucugagcugguaagauaaaaacuuugagcgucuagcggccaucuaaccacuacaaagugagaccaugccuaugcgugagaccaacccaauggaaagaaaacuaagagaugauagagacauauuucugaugccaucuuugagaagcugcauccaaucauucuggaggcaaaaagcucuuaacuuuauagauaggcaagccaaaaucuucuuacuuucauuaagccacaguuagagcuagguuucugucauuuguaaauaaagaaguuaagacuaaaugcaaaucacuuauagcuuauuuuauuacuagguacucaaugucuaugcuuuugcauagcuaagugagagaacuuaaauuccaauacugaugggcuauuaccucaugcagguacccuaauaaaucuuguuuccucucagugccauuguuuccucauuucuaaaauggagauuaaaaugguagcucacaaagaagaaauacaaauggccuauaaucacaugaaaaaacuguugaacaucauuagucaagaaggaaaugcaaaucagcucuacaaugauaccacuucacacucacuagaauggcuaugaucaaaaagauagacaauaacaaguguuuucuaggcuguggagaaauuugaagucucauauuggcaagugggauuauaaaauggugcuucaaaaagcaucuggcaguuccuuaaaaaguuaaacauagaguuaccgugugacccagcaagucuacuccuagguauauaccucugaggaaauaaauauacaaguacacacacacauacaaauuaaaaaguccauaaccacauuauucuuaacagccaaaaugugggaaaaaaaaccuuaaauuuccauuuacuaaugaauggauaaacaaaaugugucauauccacacaaugggcauuauuuggcaauaaaaagaaaugaaguucuguuacaucucacaacauggaugagccuugaaaacauuaugcuaugugagaaaagcuagucacaaagaccacauaucauaugauuccauuuaugugaaauguccagaauagguaaauucacagagauagcaaguagauuggcagucaccaggacauaggaggagaggaaggacagugacuguuaauggcuagggguuucuuuucagagugaugaaaauguucuagaauuagauagugguaauggcuacucaacuuuguauuuauacuaaaaccaccaaguuucacauuauaaacggauaaacauugugcuaugugaauuauuucaauaagaaaaauaucuuauagaaaaaaaaugguagccuauucugauucucacaaaugaccauuauaagaaauccaugaugauaacaauauuaaagugacguucuuguuggagccuaaggaaaaacaauccauacaaaugcaaaggccuauuguuuuuaaggccucagcaagugcuaagagaaugggaaaagaaaauuaccaaauagauuuucccagaucacuuagcuuccuuuguauccagcaauggucaacaaauauauagcaggcauacauaaaagcuauucggagaucucuugagguuaacagcaugcaacauauugccacugcccccagccuggccaggaauauuauuuaugccacccuuucacagcuguaucaaucucccaugaaacauucagagccuccuuguuaauaaacuacauuaugagccggaugcauugucuggauaaacugcauuguccaaaacacugccccauuauuacagaaaaugcagaauguaauuaguauucuucuuugcauaaacugcagcuuccaaaaauggugccauauuauaaagccuuaauuaauaaacaagaguugggccaugaccaguuacacuuaucugaauuuuauauugugaagaaaggccacuguucaaauuccguuuacaaauaucuaaauucuggcuagccuacaugaagauagucuaaacagaaagccugagaauucuguguugcuaauagcauuguguugguacaccaacaauagcaagccauuaacugcugggacauaaaccauccugagaaauguucagaguggaaggaugauaacauuguauuucagcugcaucguauggugcaauucuucuauuuguucauaugcauuucccauuuaauagauggaggaaccaggguggcuuuucauaucucugugaaaccuuaaaugugggggagaaaagugagcuggcaaaaaaacaaaaaggauaaguacgagguauuguggggugggagcaggguuacaucacaauggaauguaaguacacaguugcuuucuccauuuccagcugguuuuuauugauuuuccccuaaccuaaccccaaagcaaggccauuuacauaagucaugagcauugaacuaauauuugggaccauaauauuaagcagcccauuuuaugaaccucggcuaaaggagcauuugcauuaaacugcacucaccugauuaaaauccaucaacucuagcaccuugagaauuguagaguaccuguuaagcucggcugugggacucugcauacugaggcagaccauaaucagaaggcagcaaggaauccgaccgggagaggaaagggaggaggagaacaugugauguguguugaaaagcagaucgcaugaaagaccgccagugcucaaaucugaaaagaguccuaagccuacugcaaacacagagcugugcgaacaugauaauucuuucagcaaaguccauaauauggcuuauagggcccugugaaaacaagguggaugagauaguauuacaguucagugaagaguaacuggcccagcaauggaauguagcauacacaggaggccccaaaauggucccugccucagcagaaugagcaagagcucagagaguccaagccgagggacuuucugcagccuaaacaagccgucuuagaucacugcccuuuccaucagcuccagguaccaagcacaggcucagaguccuaucugucucagaaggaccugcuuuaccgugaccgcaaggauggcauuugaaucaguaauaggcugucagaggccaccuugaugcauuugaagaagagcuaucccugagacauugguucaaguucucgaucuguaccaccuagcuguguggucacggacaagcagucuugcucaucugaccaaguggaugcagauaauaaacacaugugaaaugaaugaaugagagaauaagaccucugaagcagaauuucucuccccagugauacagacagaagacaaggaaauacuggguagaagagggagguucccuggcaaaggccccaaccucaagccuggagaccugcggccccuaaguggggcauuucuguuuuuguacccaaacgguugccuuuuggcaugccacacucccuuauccuguacccauauaaaucccggaccccaggcuccaggagcagacaaggagaagaggagaaaagcagacaaaugacacaacagagaaagagagaggagaaggaaugucugaacgccgagaggaacucagcugggggcagucggagaagaguuuggccgcugaacagccaaaacuccaggggaagaucaucuucccauuccaucccccagccagcuccccauccaucccauugagagccaccuccaccacugaauaaaaccccugcaugcauccuucaagccugugugugacccaauucuucuaggaugcuggacaagagcuugggauacagaaagcugucacacuggcccucugcccuugcagaaaggcagagggagcacugagcugguuaacacuuaagcuaucugugaauggcagagcuaaaagagcauuguaacacuggggccacaggcacccaccccuagacacuaccaugggacuggagcccaaagcacucacucuugcuccugcaccuggccaucugugugcucccucucccacaagggguuugaguucauggugguugaacagagagccgcaccccugucgcaugccccaugaguggggccagggaacucuucuguuucaucaacacuauugacauuugaggugggaugauucuuuacuggggaggcuguccugugcauugcaggauguucaucccuggccucuaccuacaagaugguaguagcacacauacucccucaauuauaacaaccaaaaagucuccagacauugccauaugucucucaagagccaaaauuauucccaguugagaaucucuaauuuauccuucagaauguacauuccaggaucuaaauuaaugagccauacacccagauagugcccccuaauuauuaggaaaacuuacauagauaccuucauuaucacuggaaauucaucaagacaaaaauuuuacugagcaccuauuaucugccauguagaaagauacuguuccugcuccugagaagcucacaaguuuaaguggaaaguggcauuuuacaacuucacaucaaagaaaagagaaauguucagguaaccaucuuuccaauaaauaauagaauauccuucuaucugauuagagaggugaacuguaaagacaggcaagaaucagagcauaucucuuugcuauuaaaagaauacuacauguaucaaaguugcugacauuugauaaggugaauuuuugguaauuuugacucauuuuagauguuugcugcaguuguuuauugcugggugcagggagucucagacucaaaggacaaucuuaugaggugguuuagccuaagagcauaagccaaaagagagagcucuggaaugaaacugccugguuuuaaaucuagauucugccauuugcuuguuacgugaccccuggcaauucauuaaccccuucaauccucaaauccuucucuaugaaaaggagauaaucaauguaccuaccucacggauuuguuaaaaggguuaaauaacuuauguaaagugcugaacacaaugccucccacaaagcaaaaauuguaagaacaauagcuguuagcauuguuauauugauauugcugccucuccauuuuauuaugaucuuuuuuauuguaguaaaauacauguaauauaaaaugugccauuucaaucaucuuuaagucuacaguucaguggcauuagguacauucauauuauuuugcaaccauuaccaucauccaucucuagaacaucuuuuauuuuccccaguugaaauuucccauuccucccuccaccaggguuguucucuuaaaccaguccuuacccagcaaaauaccuucuaaggaaaugaggacaaagcuuuuguaaaugagacuaaaggcaauucaaacucagguacccuggaaacugaauagagguagugcuuaaaauggccauuugggccacuugggguuauguugaugaguuuagucaccaugaaccaacuccuaggaguaacauucuaaguggguuuuuguuuuguuuuguuuuuuguuuugaggcaaaugguuccuggcucuguggccuucccaucuuaccaucacagaagcauucacucuacuccucuaaucaauauuaacccagaaaaaaaguccagggacauauauauuuugguagccuagaauuaaugggaaaagacaaguugcugggucuaaacuaucaaagucacguacuuuuuaacagagaaugaacaaaccuccucccuucaagaauccaccuguuuuugcaagagcauucuggggugggaggaaaaccuucugauuucuagccagcuccucaaaauagcuaaagaguuccuaauuucaccucaaaccucuguuucagcaccuacuguguugugccaaguuauuucucauccacuaucauuuuugacaguggaucugacccuauugcaaucgaguuuaaggaguuuguagacaggaacccuaucugagcugucagcacguugccugaucaucuucagcaaguggucuggcagaagcaugcagguaaggaugcccugaagcaggcugucaagaaaacugaccaaugagaaagguguuuugugcuccacagcugaagccaauucugcugggacaucccaagacagacuccacucggacucaacugauaauacacacuuuacaucugucacuaucugcccaggcauauugacuuuguaacauuccccccaggcacuucaaguccaguuucgacucugugacuuuugccuguggucacuuugccugaaaugcccuuucuccuucuccuucuuauccauucauuaggaucuagcaaaauguaccuccuuugaaaagcacuuucuguagcccucaggcacaaguggggauggcuguguuggaccagaaaaagcaaccauugaaauuuccaaacugaaucuguacuuugauuuauuucagugugguauaauguaugguauaauauauggcaauguuuuccaagucugacuguacaucacagugaccugggggacuuuugaaaaauagauucccaggcuccccuccaauuaagacagcaggucagaagguugcaacucaggaagcuuuacuuaaugucuagaaguuucccaggauauucugaugcaugaaccguacuugaaacaauagucagacauugcuacuuaucagcugugugauuuggggcacucugagcuuguuuccucaucuguaaaauagcggggaaguaggggagugucacaaggucuuagaaaggaccacaugagggaaugagugcaaaauucuuaaaugaugccucaguaagugaaauuaugaugcuaauuacaacgaauguccuuaaaaagcuacuuuucacuuccaauaguccagcuugcaaaaccuuccucuaucagagaaaaauuuagugaaagaguaaaugggcuucacaccaggaugauagccuggaaaaaucaaaagagacauugagacauugcccacauagaaagcaggggaagagcauguucaguuuuucugaaggucuauauucuucauuccuacuguccauuucuccugauuaaaagucucucccaauagcugagaccauuaacaaauauaagcccaucaaaugguagcuaccccacuuuguaaaauuaggcuuuugugucucucauagaauaauguucuaacacuucacuaccuguaauaaaguauuugcaccacaagaaaaaaauguauuucaugaccagcaggcuacaaccagcauucugcuuuuaggaacccaugcguuugauuguauccuaaguugguaaugagucaccacuuuugcauuuaguuaaggacaccaaacaaugacucugugaaccucagcucagacugccccugaguccucagaagaugccuaaauauggacuguucuguagcgcuuaaggauaucaaaugacaguauaccaugacaaucacaacuaaucgaaguccccugcagaguaguuccucauaaagagauggagauggaaaaguaggaacguuuuucaaugcuaugcagaaggaaaauaauaccuacugaccauauucauccuuucaaaggucugcccugaaggcaaguugacaacacccaggcuugguucucccuuuuggaagagcuaacgcuaggagaguucacccuugcucccucuggcgggaaucagcagaacagagcgggaggcacuguggcauuaggauugcaaacccuggcuucggacacagugcugcuugaaucagaaucuacacugcagcugggcaacuggcugaggucacauuuuuaggcucugagcugcuuucucuauuugcaaagugagaauacacagcuucuaaggucauaaugcagaucaaauuauauauaaagcacuuaacaugugcucaguaaaaagucauugaucuaauuauuguuguacuuuauugucauuaauaucaagggaaugacagcauagugagucuccuagggaugcaggucaauagauguugaacugcuauuaugcagcagguacugugcuagguccuggguaauaccagagcaaacaagaucaacacaaucugcaccuccaggaagcuuauggucuaguucagagguaggaaaaauguguuuuguuuggccugcaccuuguguauaaacacaaaacauagagcaaacauuuuaaacuuggaugacuucacaccacaguccagauuucuggcuucucuuugaaaacaucagaaauucugagaguaagggagauuucuguccacaugccaagccuucuaagucccaaagcaccaaccuuccacuggagaguggccugcuggcucuucucauuaagaaaaaucucccucuggcuacacaugaugaggggccuggaggaauuaagagagaugagguagcugaggacacagguccaggggaccagaacugaagcaaggaaggagaaaggagacucagcgcugguucucuuucacgggguuuuuuugucucucagcucagcucgcucuguuuggcuggacacagaaaacccuggaggagaauucugauuccaacuugcucuuugcacaguuaauuauuuggagcucccagaagguuggagagaacaaugacuuccccugcaguggcagcuggacuagcuuaguucccuuuucugcccccaggggucagaacccaaggaaggggggcuauuuguuuuggccuuaaaccaaaucugccuagagacacagagcgaugcucugaccugagaccacaaaagcuacuauuucaaugccugguaaagcuccucucucuugccguccacagcagucuacugacgaaaaacgcguuuucccuaugcaaacuguuuacuucucuccuuugcaaauuggaaguaauguaaaaaaaaaaacaaaacaaaacaaaaaaaaaaaaaaacagaaagaaaagaaaagaaaaaaaccuauaugcacaagaauuccaucucuccuugcaaauaagauauuucacauuuccuuaggcagauagcaugcagacaaguaggggaacuaauugggauggaucagugaaaacaacgaaagcucauuuauacacaacuugcuaaguguccacaacuuuguucuaauaggggauccaugacaagucccucaaaaacagagaaacaggagagaauaauuuacacuuuauaguugugagcccuguaacaguagaacaaccuuccugcagucccagagagauuguccccacaucuaaccaaaaccauuaccaucaaugguguccugcauuuugaacaguuguuaaugaagucuugccugacccaauacagagugaaauggguguaguugcugcuacaggcugccuucuagccuuccugcaucugaauacauuuucucuguuggcuguucugauagagauucaucuggaauucuuaacuagauaaaucccucaaugacaagguaaggcccaucuucugauuaaacuuguauugaauuuauuuauuuggccaaucauguaauccauauuuauuagguaccuuuuaagcaccaagcauugugcugagugacggggauaucaaggugagucaaaacaaccauagucccuguccuuagaaguccagaggggcugggugcaguggcucacaccuguaaucccagcuuuuagggaggcagaggcgggaggauagcaugagcccaggaguuugagaccugccagggcaauauaggaagaccccauucuccacaaaaagggggaaaaaagcaaguccagagaaaaggaagcuacuaaucaaaagaucucacaaauauaaaacugacccucugaaagguguauaagaaguauuuugguacuaggaggcucuauuacaaagaguucgucuagauaugggguggcagauaauuugucucagaagaaacaguacuugagcugacauuuaaagccaggggaaaagcaucauaggcagcgggaaucaaacacucaaaggccuugccgugaggcugagcaguaaacauaaggacugaauaaagaccagugagauugguguggagaaugcaaggaauagagugaugaagauggagaguugguagggaccgugcaaggccuuguggagcacuucaaagauuuccagcaacauaaagcuauuuaaagauguuuaagcaggguauaauggugguaguugaugugaucagauuuacgcuuugaaaaaauauagauuagaguuggcauuuuggggggacacagaguagauccagguagauccagguagaccaaguagucuagaccuccuaggucacaggugucuaggaggggaugguaauuuggacuuggaugguauggcgcuagaggugauguagccacauugacauauucuaacaauaguuacucugguaccaacccaauauaccagagucauccaauggcccaagagugguacuaacuguaauuccugauucugugaagcugaguaaaaacauuuagaaagaccaaacuaaaaaggaucugaacgcaucuguacucccucauccccagcagcaagguaccaccacguacucugagugaucauagcuuuauacuugaauugacaaauucugcauaagacuccacaggaaacccauuaaauaggcagggaagaaaaugcucaccauucagcauugacaagaaagaugauaacaagcaaguuuucagucaaaguggguaaaauguugaauuucuacucuagugucauuagcacugcaccugauuuuuuaaaacaauauuuugguuaaucaaaacucugggucaaucaacuguuccacagugacagcuccuguggucaucaaucuuuguuaucgcuugaagcugacauggucucgguccacaggagaguaagcagcaaaagacaaagguuucucuucauuucccccaaagggaguuaagcaaugagucauaaaagcaucuaaauuauucacauggcuuuccagaaguuuaugauucaagauuugggagagauaauugaaggagguggggugggaaacguaacacuggaugaacacauuuauuuugaaaaugaaaggaugaguuucugagguagacccaauuaccacacacagggcuucaggagcgacagcagcggccuaugguuccgccacacaaugcuucauucauuccuuacauggguucggacgaucauuauuaaccuacagucaccugagaaaagcucagugucugccaaucagucacacuggacuuuuguggaaauggaaaaaggaagagagaguaagaagggagggauggagcaaggguauggagggaaugugaggaaagcacaaggaggggccagaaggugucagcugguggaggagauaaaauguuuucuguuucuguuuuacuuguaggguauaagaaagagacaucagugugaagauaugccacuggguaggggcugaggguuguuuguauguuuguuuguuaauaaacguggcuugaauuagauauauggcucuccguuuuaguauauaagaaauacaaguaaaagaguucagcuauugugaaacuucauucucuugccaaauggaguuuccuugacuguaaugcuccaagacugaaccauguacauucacuauuuauaaaagcuagacaugcauuuauugaaccuaccagauguagguacuguaaccaggcaugauuaacaguagaaagaacugaaaaacccuucaugauucagccuuaguuuaccuuacugguuuuaucuccugugaauucuccuuuaaaacuaagaucacaguucugugguucuuggaauucacaaaaaaaaaaaaaaaugcucuacuuccccucuguguaugugaguauucucucugcacugaaugcccuuccuccuucaucuagcagcacugcuccucucugccuggaauugucuaauuccugccauuccucggaucuguuuagacauaacuuccucaggaugccauccugaauucugagcugagucagguaucccuucucagggcucucacugagcuuaucucaacaguagucuagguagcauucaaucauaauuagauagugugcaagcuuucugauggcagaggcuaagacguuaucauguuuguauccccagccccuagcacaccaugaaacacaaaaugcccaauaaauuuuugcugaauaaauaaaaaaauacaauacuugauacccaacuccaaggcacuuucaguguaguuaguaaagauagaacauuuugaaacauaacacagcacagggcaauaugaaagaaaauaaaaaauuaaauaaaucuguuauaagcaacaaagcagguauuuagagaaggcaaagauuacuuuuagcuggggugacaggagcaacagaaucaacgacaauucaauguguguucaugacacaaguccuguguuaguuguuuucaacaacaacccuguaacuugauaauauuauccccauuaacaaauguggaacccaagguucagagagguaagugauuuuucaagguuauauaaucagcaaugccaggauuugaaugaugaaucuaagauuucaaaacacugagaauggaaagguggguaucccagguagaguaaaaacagaaacagaaaaaaaugugcaagugcaucucaguguaauguauguccuggggauuaaaaacaaaucaacuugauauaaucuauuauaggaaugcuaaggaugcugauccuagcaaguaagcugugacuagacugcugggggccuugagugucaugcugaggaacuugggugcugaggagccauuagaagcuuuggaguagagaaaaugugaucagagcugaaacucugaaagccuuauuagagagugggagauaggaugaacuggaaagauaagaaggaaguuugcaggcaagguaauucuguuggggacaaaaaaacuuuuccuuuaucuucuuauguuagguauuugggggccugcaaauuaaacugacaaaccacagauuaacaggagaaaaguuuauuuaugugcauauggaagcuuacaaaagaaguaacucaauaaaugguuaaaguuagaggcuuauacagucuugccuggguauccauggggaauugguuccaggacccucucucgcccuccaucggauaccagaauccagguucacauuccuuauauaaaauagcaaauauaaccuguacacauccucccguauaauuuaaaucauaucuaggccaagugcgguggcucacaccuguaaucccagcacuuugggaggccgaggugggcggaucacuugaggucaggaguucaagaccagccuggccaacacagggaaagcacaucucuacuaaaaacacaaaaauuagccaggugugguggcacacgccuguaauccuagcuacuugggaggcugaggcaggagaaaugcuugaacccgagaggcagagguugcagugagccuagauugagccacuggacuccagccugggcaacagagugaacuccaucucaaaacaacaacaacaaaaaucauaucuagauuacuuauaacaccuaauacaaucuaagugcuacauaauuauuacauuguauuguuuaagcaauaaugacaagagaaaaaagucuauacauguucagcacagaugcaauuuucuuuuuuucaaauaguuuugauccacuguuaauugaaccucagauauggaggggcaaauguauaacuaccuuaguagggaaaaaggagugggagaaaagaccucuuuggaaagaauaagcagguuucuacaggaaaaacaaugagagauaagaaaguuuguaauaauguuuguucauccagguacgaguggucucucugucuucuucaaggcuauaaaacucccccagagaggauauuuaugauauauugagucuccuuccuaggaguaaaagccacccugaagaaggaauuuaugaaagccucauuucccagaaguuucugcuauuagucaaauaagagaagcucugagacgguuuuuuuuccgcaucuguugaaucccaaaugucuucagcuuaaaauaaucuucagaccaacucugggcuucugaguggguacccgacauuaccaccuaggagccuagcacaacucuccagcuccaaaggcacugaugucugggauggagggaaaggguggauucaagcccuacugugagagaagacaccaacagccccuaacagcugaguuauugugcgucugaaagagaaggaacuaauggugacuuaaaagcauuaagccaagaugacagagagaucauugucaccacuaacacaaauaaggaagccagucaggagaaaguacuaguuugaagggggaaauuuuaaacaugcugaauaagacacagcaggaaaaaucucuaggagacaauuggaaacguggaaccagaaaaccagaaagugaucagugcaggaaaugcaacuugggagucauuugccuaaagccauaacuugaagccauaguaaauguggguauaucuccaaggauuaaggaauagagaaagaagacuagaagguaagcaacaaaucuuaguuaauacucaaauuuagauggucugcaugugacauuaacaagugaaagauacaaagaauuaagauuaaagugcccaguauaagucugacacuaaacugggaacuuuuucuaugucauuuuaugacguaggcacuaccucuauuucauuaaaaccaaggcugagaguaauguaucuugucaaagccauauaacuaguagacaacagagaugggaucaaaggcauguugccucacucagggaccaucugacucaugccuucauggacaggacugugggauggagggcaauggaggaagaguuuucaggagugcauaggaugaacguagucaaaggcaauggggaccgagaagaggccacugaauucugaguccucugagaggacucaccucucagaaauaguugcaguauaaggucuaaaaucaaggcccccauauuuugugcugcuuugacauauggagaaauucaggagggccucaaaugaccuaaugacaaguuccccuccugacaugguuuggcugugccuccacccaaaucuuaucuugaauuguaacucccacaauucccacauguugugggaggaacccagcaggaggugauugaauuaugggagcaagucuuuccugcacuguucacaugaucaugaaucagucucacaagaucugaugguuuuuaaaaugggaguuucccugcacaaggucucucuuugccugcugcccuccauguaagaugugacuugcuccuccuugccuuuagccaugaucaugaggucucuccagccauguggaacaguaaguccaauaaaccucuuucuuuuguaaaucacccagucuccgauauaucuuuaucagcagugugaaaacagacuaauacaccucccagcucugcuccugcaaauaaagucccccagccaaacaacccucccugucaugugaaccaggcaugguuccugcuuauuccucuuauuccggaguaguggauuucaguuuccugccagccugcagaauuauucagacaagccgacuucauccucccauagaaacagggauaaucccaccccucuuaauacuaaagccuucuucccacauccccugauugcucacuguguucccaagugcaacucccacguggaccuguguggcacucaggguccuuccucccugggcugugaguauaugugacuaacaaacugcugucucacugguccaguguuguucagucaucuuucuaacccuagggugggacccuuucucaccaaccagguaagucgagagugguuagaacaacagaagacaccagaguguuuacuguggaaguaacaugggugaaaugcuucacuuuaauaacuacuggcuuuauuacaacugaagaaaucugagaaauggaugauuacucuuuucuaauuuuauauaggaggaaacugaggaacagagagguguucaauggauacuuagagugagacagcaccaaauuauuuuucucacuuuaauguugcauuguucucaaauauuuuuuuuacaagauccuuuccagaugcuucuaugagaaucacauauauccaguauuuacagaaagccauugcaagcaauaaggaaaauccaaaaagcaaaauaugggcaaaggauaggaacagauaauuuccaaaagaagaaauaggaaugccaaugauggcauaauguccaaccucacuaugaaucaaagaaauucaaacaaaaauuacaacaaauauuuuugucccuuuuugguugagaaagcuuuauacuacccacuguuggugagauuuuaaggaauuggagaugcucauacacagaugggauaaguagaaaucaguaucucucugaaaggcaggguagcaacuuucucaaaaucuuuaaugguaguauuuuaugaaaaaaaaauucauucguaggauuauauccaaaggaaacaacuugugaaauucauaaauguauauggaugagaaugcuuauucauuguuuuuuuauaauauaaaaaaaccagaaacaaucuaaaugcccaucaaaaggggauaggcuaaguaaguugugguacaccuauaaaauagaauacuaugcagucuuuuaaguggaagauguagauguauauuuaucaacauaggaagaugauauuugguuuuaaaaacuagguuauaaagcugcagguggaagaguacacauauuauguaaaauguuuauaaaauuuuguguuuuucuacguacacgcauaaugagacauuuguugggaaauuugcaaaguuuuaguauuccauagucuucaaauuucaggugagucuuacucucuucuuuaguuuaucccaaaggcacauaucaguaaucaggaaauaaaagguuguuuucacugggggugggggaacacauggagaggaaugaauaggucaccucaaaaagaaagcauacuucaggaagaacuuacacaaauuacacaacauacuuugcuuuugcacuuauuuuuuauuucccaacagauaacacgugaaauuccagaaaggggagaaucaauugugcauucgauuuuucacagggagcucaugaaacuaaggcuucugugcagcagcagggccauggaguggaaacuggaaggcgacuggggucaguaggugcuggccagucccucucugauugaaaaggacaugugaagggugccaagugagaccuccucuccaaguucucaacaauggcuacuuuuuugcguuuuauuuugugaacaauucgaacccacaacccuggauacauuccacuuguguagguuuccccuucagacagcaaaugcugcuguuuccaaauccaaucaugaguguuugcuguuggagcgcuugguguaaggcauguguguccuauaaaauauguuucucaaaacuuaacuuuuuaagaaaucagucacugguuuaucucccaauucuaucacccagaagaagagaaagaugccaaaacagaucccacagagaguuucauucugaaaaacagacauuuaauguaguuauucugaaaaaaauacaaacuguauuaugucacuuuagaaauuucaaaauagagaucucuagguaucccguuaggcaucugucgugcucccaauuacauuacuuucgacagcccuaagagaagcaauauuuauuggccuacuaagucuuuaagaaugcaaaacuuaacccaucuggaacuaguuguguuguuggcuccaggguuccuuacaucagaacaaauucagacauaaacucugggacaguucuugaauauugcaugaaggugaguugcaggcauucacacaacacagcauugucuuuuaaagcauuuuuauaaagcagauccaaaggcuggcaaaccuuuccuucaccauaaaggaaaucuaggcuaaaggggaaaauaagaaguuuaugaacuauuaaaaaaauaaagcuguggaguuagggaguuauggauuagguuccaauccauuaauucuuuuauucucuggcagagcuggcugaagaugugcagcccucuggcggguaacagaaacauucauguccagaacaaucacaaaaagggagagaaauggcuggcagagcagagggcggauccacucauuuggauguuaauuuauacagaaaucuggaauucaauaaucucacaucccccagguaagggagcgauccacucuccaauuucauuugggaguucuauuacauuaagcaauauucuguuuggccagacaugccauucuucucuugaaggaaauuaauuucuugauucuuccaucuaauaaucuaauauaaucccaagucagugcuuuaaguuuucucaugacacuacuagacaaaauaaacucugaaguaccucuugugggaacucacaagauacagaugaaaacaaaagaagaaaguaaaauugaagagggugaggccagggacaauuagguauugaacugccugcccugccucugacacaugauacaugugauuuguuaagacgauuuucuauccuuaacucuucacuaaguagggcugcuuuacaauuuccauaggaaauuuauuuuuaaguauguaaggccugugaacaggauaaauaaaagauuacaaggaaaaaaaaaagcagugauuucugguuguuuaaaaggcaacucaacaagccuuucccagcaaaaggaaaaggucaggaucaauaaaagggccuuuccuuugggaggagaucuguuuucaauuuaacaaaaauaaauccuuaugguguagucuucugaagaccaaggaaacaucaagcuauacaagggaucuggccuuaccaggauaagaaaacuucuucauuugauauucuccaauaauaucaaaacaaaguaaacuguacccacuuugcacucuuucucggcccccugccuguuagugaaaggccaguuaaccugaaaaaugaaaaccagcucuuaaauguaaagaugauacuacucauugaugcaauguuauccugauaguggcuuuucagagauaucaucuuaagcgugauaucaacagggggaaucucacauacgaguagaggcugguuuagaaaaauccugcaggauauggagugucuuuggugacagaagucauacucuuaaagguaucuuggucaaacucaucaucucuuacucuuuuuauauuagccgggcgugguggcacaugccuguaaucccagcuauuugggaggcugaagcaggagaauggcuugaacacaggaggcagagguugcggugagcuaagaucgcgccacugcacuccagccugggugagaagagugaaacucugucucaaaaaaaaaaaaguacuggcucaacuacuaugaugagaagcuuuugggagauacucagugguaaugucagccuuauuuucuguggcaaaucugaaucuuugcugccguaacacaguuguuuucaacauuuacccuuucuacacucauaggcacacacacaauuuuaacugaugaauucauagaauucauaaaccugacagugucccauugcuggaaccuuagucauacccauuccuagcucuugcuaacuauaacuucuccauuuuuccuuccucucaagaaaguauauuagauugcaagguugcaagagaguaagagucuuaaccuuaaauaugcuuucauuuauuagaaaaaaggaaaucaucugcauccuucagcaauuuaaauauuauuagagaaaaaccuggugggauucagcaucaaaguuauucuccuuucuggcaugaccuccucucagcacuucuucaaguauauaaauccuaccaauaccucaagguccaucuacucuguauucugaaaauacuccaaucuccucucccuggaaucuaccaggacucucaaacucaaguguuuuccagcagucaggaaaguuaguugcaugcugcaggccaauuuucaggcauguguguuuacuggaugagugaugaggacaugacaacagaagagaacacguccucccugaagggggcagcagccagucagucccaucccauugcugucaggugggaaugcaggcccauagcuacccgaucuuccaauguuuuaagauaagucgaaaaucugcauucuauggauaauaucucaacuucaaauguuggcucacuuaggaugacaaugacucugugaucugcauuggacccauggaaccacuaauuugcaaccucugguuucuacaaaacaugaagcugacugauaaaugacaagcuugugccauuuaucagcaaguguuugcuauuucacaucaucagucacaucaguauuucagagagccauaaauaaauguauaaguuauagguaacaaaaauaaagcagggcuuuaacuuaauuaucuuuaauuuagcuuauuuaaaguuucaaauaacauguaaagagggccugagauauuuauauuuagaaauuuagagacauugguuaaauaaguuaaggaacaaugagccagacucugaagucccagcaaggagggacuguaucuuuguuuuauucaguaccuaucaagagugcuaaguacacagguuugaauggaacugauuugaaucauuuaaggaaaaagguuccagacaaacauugcaugcauuagaaacugaguauuucccgauuaaacauacaccacccuuacauuuccaaagugucagcaaagcauucuguucuuuggucaaaucuuguaaaagccacuuacuccuaaauauuuuuacuuuguaaccuucaccguuccaaguucaucuaaaagaauaaagaaaauaccuggcacagagaaugcauucaaaguguauuaguuaaauuucacuaaaaagaaguaaacaaaagacaaaaaacuucaaugcaucuugauucucuguagagagagcaccuuguggcuugggcuucuucuaucaaacacauacccacaccuuuuugucagauaaacucauuugguuuuucuuguguaauggggugaguauuguacaagguuucaaugccuuuuuuuuccaacucacauugucccuuagaagcucgaaguacuaacaaagugcuucaccacacaaaagugcugucuacauuugucuggcaaauacgaugccaaacgaaaagccugaugagucugcaauucgucaugggcaugaucaagcuccaggcugcuuccaccagagagcaaauucaacauuauaaaggaaguguggacaggaaagccuuccagcaagauucucagaauauggacaugagauucaaagacuaauaaaauggguuggggagacgguauugaugaagaagcagccggagaggaaaaaaggaggauuugagcagaugucugucacuaaagaaagugaaagacacagaggaaagagaagaucuauguuaucaccugugauccuaaaacaacucuaggaauuaggccgcauuauccuugcuuuuauagaggaagaaaauguggaacagaaaagcugaauaacuugucacagucuuacccagccaauuaguggcuuaacuggaguuuggccaggucuuuuugucuguauagcacaaaccuugugaccacacagcacuaacuuccaauaagucacccaaaaagucagcugcauguaauuagcucugcugugaaacuauggacuggggaaagggcauuguucauuuguuagcuuaauuuuuguuaaaggcauacaagaccaaccacaaaaaaagaaaaacaaaaacaaaacaaacaaacaacagcaaaaaaaaaucagccagagcuguagaaaaucaacucugucauuaguaaguauauuuuauucaaguauguguuauuaauauauuugagaucucccaaauacuaaagagauagaaauuuagauacauuggagauaaacuucaaguaagcuauuuuuucacuauugcauaaaugggaagauauuuucauugaaaauaauguuccuuuacucaaucacccaauauuuauugagaaaccaccugggccagacauuguucugaauucugaagaucagagagugaacaagaagcaacugacuuuguuuuguuuacaguucagauugaacaaagcaauggcaacagagaaagaaagagaagccauuuaugguuugugauaaaugcugugaaggaaauauuuucugauagagaaugaauggaaaacuuccuuuaggcaaagaggacaggaagggccuccuuaggugauugugucuaaaugagucaagcaugucgaggguugaagaaagggugcugcaggcagagagauaagaguaugcuaagagccggugaggacacugaacuuagcucuuccugggaaguggcagccccuugaguuggugcagugaccaggguggacauguguaguauaagcuucagggaagaggugaguagaaaccagccagccccucaugggucugguauaccacuagagugcguuuggaauuaauuguaagcacaagagaaagcuguugaaugauucagucuucaacaagggaacaacaugaacagauuggugguuuuauuuuggcugccaugugaagaauggaugacacgacacucgcauagaaguggaagacuagucuagaguuuggaagauagcacuuggacguccugcuggaugccugccauuacccucuggaucugcccuccacccuuuccucgccuguugccugccucagaggcuggcuuacauggacuacggcccagggcucucuagcuuccaguuaguuuggucaaugggaaaccccagccagagaucagaagggaggagaaagaacuuaggauauuagucccucagcacccugucaccuccaagcagaguuucucacagguugguuguaucccaccacccagggcugcugguccuucagguggccucugccaaggggccugucacacagcucucccucaggucccaauaaccuucccucuccuaugccucuuuccuccccuuuacccuucaggaguugaguagcaucagaaaacgcugcagcuagccccaagguacugcacucugucuuguaguuugaaaaugcuaccuuuguuaaacucuagucaaauuacccaauguauggaugccaucuguuuccuguggggcugacugauacaggaagagagaagcaagauacuauuuugacacguucaguuacugugauccuugaguaacauucuguuuagcuugaguucauauaacucaaaagguuaucaaggaaaucuuacacccuuuuaccuuuuuaggagaagcaacaaauucaccaaagagguaaaaugccaaaaucaugggcgugcggauucagaaaauaaaauaagcauuaguggucaucaguauuugauuucaggccaauuguuagagcugucgcuuaaaaauuuagauguacauuucucauuccauguuucauuuauucaaucaauguuuauugagugccuacuacuugcaaggcacuauuuuaugaacuagacauagagcagagaccaaaacaaaaugccuacucucuuggagcuuacauucugggggagaaucagaaaauaaacaacucaaugauaucuuaugugcuuauaagaaaugguuaacaggaauagagagugggagaucagcaagaggacugcugauuuauaaaagacagaguaggccuuucuuaaaaggugauaaucugagcagagaucuaaaggaaaagaugaagcaagcuacggcgauguccagggcaaguguguucugggggcggaaaucaugagaugacgagguguggguggcacuuuugaguaccaguagaaggccagugccacuguagcagaggaaguaaggaggacauuggcagccuaugcaaucagggagacggcagggacaagaugaauagccucaagaacuuuggcuucuauuuugagacaauaaguuuuuaugguuuugaguagaacagugauaggaauugauuuagguucaaggggcucauucuggcuacuguguugcaaauaagguggcaaggauagaaauagagaacacuuacgcaaaagucuagagcaaagauggugacuuagaccaggguuguagcauuuauauuugauaugccauuuaaauauccaagggaacaugaguaggcaugggauguguaaccgaagucuagaguugaaagaagaggucuaagcuagagauagagauuucgaaaacaucaguauuuaaccuugacaguggaugagauuuucuaggaagugaggagagcauuaagagacaaguuuuuaaggauggagcccugagucauuacagauugacagaucagaaagaggaugaugaccagcaaggagaccaaaaaggccagugugguuaagugggaaaccaagagggugugguguccccaaagccaacugaaaaaaaaguaugucacgaaggaggaagugaucaacuguaucauguacugcugauagaucaaguaagaauagaacugaguagaaaaauggauuuggcaaccaaggggccauggaugacccagacaagugcauucugagaagcgguggggaugaaagugggauggagagaacaugugcaggcaacuccucugauguucuuugcuguaaaugggaagcagagaaacgugggagcuggaaugaauuaugcaggcuucuuucuuuuuuucuuuucccuuccuuccuuccugcuuuccuuuuuuccuuccuuccugcuugccuuucucccuucuuuucuuucuuccuuccuuuaucuuucuuucuuuucucccucucuuacucucuuuauuucuuuucuuuaucucuuucucuuucuuuccauuucucucuuuccuuccuuuguucuuuuucucucuccuuucguucuuucaucucuuuaguuuagagacacuacagcaucuucauauccucucagaauugucuaguagggagaggaacccaaaugaugcaggagagaacagauaauugcggaagccaaguguuuuuguaggcauguguugagguucacggcaccaugaaggccgaggguggaagcagaacaguucagagagcacauggucuaggagcagguaggcuagugagagcauguggagguuuccuccugacugagcuuugcucaguaaaacaggaaguaagggcauacacauagcaggaccagcagagagaagcuauuggagaucugagaaaagggugggaaauagucauccagggcaaguggguggaguaggguccugcaguaggauugcugagcaguguguugggcuuuaaacugccuuucauaugaauccacaaauccuacuaauauuaaugaaagauauuaauuuucauuuuuccugcucccgucagcuuaaaacgaaaaguuucucuacuuagcccaugaggagucagaaaagaaaaaguaaugcccagcaaauuucuccuuccuaagcuagaaaggaaaaaauaagauauucauguaaggaaaauaaagaagacauggcaacuugaaauuaugaagaaauuccaaauguugcauuugguaguguucuuaagcuaccauaagagaucuucauucuauucuggguagggagaauguacguggcaguugcuaggaaugauccuuugcccgugauccuucccaugugguaccccacuguccccaauagaccugaguggcacaaccaacaaaacaacauucaaauauauggaaaugaucuuuauuuuagacucuuucucauuuagccuguugggcuccgagaaugugaaaaauaaaucugaagccuuacuuuuaauagcuuucuuauaaauuauccccaguauguaaaagcccagcuccuagauauaaccagaagaagggggaggggggaaagacuaaugaccuuugacauuaaaauuuaaaauguccugcaugcaaauacacuuuccugccacucuuuuguaaugcaauaaccagcaagaauuagaauugcaaaaauuccaaaagagcuacauggaaauuauacaacaaagugguuucacagugauauugagaaaggaauaugaaaugaauacaagauaacauagagacagaaugggguguuacagauguaugagugaacgugcguaugagcacaugcaugucucagagagagcaacagauaaaaaauuauuucuuuuuuuauguugcucuucaugagcaaaauuuuaagacagacacuguucuggucacauuucaauaaugugacacaugguuucuauuuacauuccaaaugaguuuucacuaaaugacuuucgaaauauuuacuugcaaguauaaaggagacccuuugaaugucugauuugaaaaaagaacaaaaucaagcaauuaucaacauagauguucuaauacaaacugacacuauuuucuuccaugucuuuuuuuuuuuuuuuuuucauuccuagacaccacaaaagaccaaugcuacagaugucucucuuucggcuuuaaauacuucaacugugacaaugauagugagacagacugcuucaggcccuguagcuaggacauaauaaauaauucaaacaaguuuugaaaaaucauuuggcccauauaauauaccagcuauccgaacauuuaccaaugcccgcccccuccccucacaccucauccuuauuuucauuuuuugcugcuuccaucagcuuaaaaugaaaaguuucucuacuuagcccaucaggagucagaaaagaaaaaguaaugcccagcaaauuuauccuuccuuugcuaccggcuuccauuaaauugaaggugacuucacauugauccuggguucaauucacauauccaaagagaccucagugauuaacauaaagggcaguccaaucaaggauagacaccuccauguguguauggugagcaauuuggugggauguaaaacauaaaugauguagcaucagaacaccugguguggaugaugccaccacuugccuacccaguuauucuccacuucuugcccugaguuuuucuuucucucucucucuuuuuuaacuuagauaaaaaauaaucagcuucuuaaccucccuugcaucuaggagucaucaaaaagauaucgguugaucaauaagaucaauaagaauuugauaggcagggcuuccaaaaaagucuguugaaaagggaagacucagauaacacaguuuguuaguguuugccuuuugcccaagauccuucccucuuucuucugccugugaugcccagggauggaguagucaguuuguagccuaugaggacaaaagucccauggcaaggcauaaccaugcagaaagauagaaggaacugugucccgcuggcacuuugaacuucuugaggcaucuuggggaaaauaagccccuccuuggucuagcaguaugugacaguuaauuucaggugucaauuuggcuaggccaugguauccagauacuuguucaaacauaucuggaugucacugugaagguaauuuuuagaugagauucaucauuaaaucaguagacuuugaguaaaacagauuacccuccauaaugugagugggccucauucaauuaguugacaauuaguugacagucuuagaaaaagaguagcaucccccagggaagagggaauuuugccagcagucugcuuuuggacuugaguggcaauaucaacuguuccuuggguauuuauuguguuggccuaaccugcagauuuuggacugagaucucagccuucauaaucaugugagugaacggcuuaaaaucgaucaucucugucucucucuggagaacccugacugcuacaccauuacaccauucuaacuggguuucuguucacugaaacugaaugcaauucucucugacacaucugagaucaccacuucauacacuguguaacuguguaggugucugugacccucagcuuccagaucuacaaaaugggaauaugaguacuccugacuccacaggcuuguuggcuuacacacgagacagaauguguaaaagugcugugcuguguuaaguuacaaagcccaaucgaaaugauagggaucauuaucauggugggcucacugucaauucacgacuguaagucuguuaugauuguauucacuuaaaauaauaauauucuucaaaucugaccauaaaaagucauuauagaacauuugaaaguucaaaaacgcaugaggaagaaaacacucaaccaccuccaucauuccauagcuacugucaucuaccaauaccuagcauuuauugaguuauuauauagcaggcaaugugugaagcaauucaaugcauuaucucuacccugugaagguagguacuauuuuggugcccauuuggcauaugggugaaaacuugucaccggacauauagcuaguaaguggcaaauccaggauucaaacccaggucugaauuauucuaaagcccauguauguauccagcaacacauggcgaugagcuguguucuuuaauaauguauuggcuacuacaaaauuggagugugaucagguaacccuuacaucaggaaaaaugggguaugcacauugcucagcauauacacaaaucaagacucauauuacaaggcugcuagcucucuugucagggauaacauuuuaauuugaaaugaaguggaagaauguuucauaucagcuacuccgguuaacacugcuuuuuacuucagauaaagauaucccuucugucaggcacccugaaguuuuucuguaaaaaguuguguucauuuguuucaaacugcccauacauccauggucucauuucauuuucccuauagcccgcugaguuaagaggggcagguauuauuaacuccauuucacaggugaaagaacugagcccuagagagguuaacuaaguugcuuaaggucacacagcaaauuagugguacgacggggauuggaaagccuaacgccugacauccagcgugguauguuuuccaucauguagugcuccaucaccugucacucccaccauuccugaggggcuuggaguugauggggcaugcuaucaauuucucaggguaaaacuguccuaucuggguaggaaaaugcacacacacacacacacacauauacuagacacacuguaauugcaucugccaaaaugguuuuauaacaauccagucaaggauacagaaaacucccaggcugccuuucagaaacaaagcccaaaggaucaauuucaucaugaaauaggauuuccucagcuguagguggauggguagguggggagguggaugaacugcauuaacaauggaacaguggacugcaggguaaaagcucauuugacauucacugcuauuaagcaguggcaauguaaaccugggguagcaaagagcaauacccaggaaaaaauacgaagaaaaguuucaacuuaacccuucuguaacuuucuauuuauaagucucaggguauuaagucucauucuuuagaaauaacaaaugcauauuuugacucacucuguaagauauuuauaagaaauaaagagcaaggggguauugauuaagaaaaaacuaggaugagauuauagauauauuaauauguguuaauauacaacauauaauuacauauaauuaauauauaauaaauguacaaauauauaauguuauauaaaugacaugucaauauaugaauauauauauuucaagaucauauucuuaaccugaaaccaaaaaaaguacaaauagagguaacauauugcauugucuauuuagcauugaaaccaggauuuucagauagaaacauuugccuuuccuaagcuacgcaagccaucagauauuuaccucaguggcacuggucucagugaaacaucuuaaugucucuucucucaguugguuagaugaauggaugucauaagguaaaaagaggaacugcaagauuugaagcucauagaaaaaagacuggcacugggaauggcaguuaccgggagauugaaacaagaaggcuucuaaauaugcugucaaaaccagcaccagugaccucucaucaagugaggggcagcacuaaaagcuauaccuucuagaaugauguuaccuugaaaaucaugaggaaaucucaagugucuuucuacuacauuagcaaaaggaaguuuagggaguuuagacaccaagagacuggaccuucucaaaagggaauuugccacagaaucauagauguucaaaaugugaaccaagcuuucuuucaaauaaaagugaauaucagggcuuaaaacagaaagacacauuucaucaaaaaugauuaggggcccacgaguguugacuggggaaugagaauaguggguaagguuagggggaaagccagaaaaaaaggugaaucaaauauacuuacacuaaaaauccuggggcuccaugugauccagucacgguaccuugucacagagagaaauguaaucagggauccaggaaguucuuuacagguuuacuuggugugaugcuuaauauuaggugucgacuagauuggauugaaggaugccuagauggcugguggaguauuguuucugggugugucugugaggguguugccagaagagacugacauuugagucaguggacuggagagaaagauccaccuucaguguggguggguaccauccgaucggcugccagugcagcuagaccaaaugcagguggaagaaggugcgauaagcuggcuugcugugucuucuggcugccuucuuucucccaugcuggaugccuccucccaucccuccugcccuuggacaucagauuccagguucuucagccuuuggaacucaggaacuugcaacaguggcucagacuuuggccacagucugaagccugcacugucagcuuuucugguuugagccuuucagacugagccacuaccagcuucucucucucucaauuugcagacagccuauccugggacuuugccuuguaauggugugagccaacucuuccuaauauauucccuuauauauauacauacauauauccuacuuguucugucccucuggagaacccugacuaauauacuuggacacaugaaaaauuauuaagaagagaugucuauucuuaaugcauuaagaauacuguaaaauuauucucuccucauugcugccuuucugaaaauucuucaugugguuggcagcugacucaggagcacucucuuuccuggcacuuauccaauggcucuaacacccaaucugggcagccuguccggcuuacugucuccaucucuccacucuugcuuauguacuucaacacagacucuuuauuucuuuacuuuuauuucuguuuucuuuacuuuagggaggaccugggaguuuaccaggaagcucaaauucuuccuguauagaagcuaggaaaauagugaagauugugacuauccauacucgaauaauuuuauccuauaacaucucaacagauuuugucucuaagaauucuauugucucaaauaaacccagaaguuagcacuuuaacaugggagccuuuucaaaugguagagucucaaggccacaucugacuccagagaucaugguguuccuacaacacugagaugaugauaggaacuacaguugaaaacagaucuuucuccccacaucaccuugaucaagucaauaaauguuaguauaugccagguacugggcuagguaguaggaacacagagauaagcaagacaagauccuuaucccugaagaagucacaguucaguguaguauuucuaaaauugcauuccuuagaaugaaagugacccuuguaaaaauaauccauggaccaaauaccuuuuggaauguggcaugcucaaucuccuuuuggacauuuuucaugcucauccuaaugcgaaaugauuauauaaacuucaguucuuuacuccagcauuucccacauuuaacucaucgcugacccauuuggcuugcaaaacuuacgucuugaauugagccuacaaauguuaacagaaauucuaccauuagcuuaaaaaacagacaaauaacaggcauuuuaaagauaaaauaagaaauaaugauagcauuuuaauauaaaguaaauaguauuucaaccaaaaggcaagugaaucuguauguugucuuaauggagauuauauuuguuugcucacuacaguuuauaagaacagagaggaugauaaagacaccacaaugaugaccaugcacagaguguuucuaucagcaagccuauauugugggucuuuacucacaauauuuuauuuaauucuuacaucccuucuaugaaguaggaacuuauauuucccauuuuccuccauaaagaaaucaagguucagagaauuuguuaauuugucugcuacgaucaugugccugguaagugauggaagugagauucuaauccagacuauuuacucugaaaaccuaguggcucccaauucuaguuauauaucccagagaaucuacuguuaacugauuuaaaauguccauuagcagagaaacagauuaacaaaauucggugucuucacaugauagaugaucagauggcuaucagacuaucuguggcuucugaacagaaauaagaaagaggcuuuggcaagcucuagauuagaaucaaagaaaggcuuucccucuuguuaagcaacucuuguucuauugcgccccaacaagagacagaauguuucaagauaggacaccaggugacuguguggccugagcugcccaaccugaauuggguguuguuuuauccacugucuauuacauugggugcacucagcagcagcugucuguaucaaaugaaaguagauuacacgggauuguacuauuaggcuuacucuggcuaucccuguuuuaacccaaaccuaagacuucauggggcauuuuuuauguaguuaccugaagaaggaaaaaaauaaagccuacuuuacagacaacauugcacgauaagcuagcuccagccugaaguggacccugaauauuauaaccccacucaaggugaguagcccuaaaggacauugaagaagaaaaaucccaucagugggcaaaacuucaaauaauuaccucuuguggucaacacugccuggaaaaauaguuggccugagguauuguuccacguuaauucaugggcucaugaaugaggcauuaggaagaaaaagaggggaagacugaaagggaagggaacaaauacacaguaaggcuucucaaacuuuuaccagagugugaaaauaucugucuaugugaauguagacuagaagguccccacuguggagaaggcacucaguagcuagguaggcaaggccucuuucccugccaacucagagcuuaaucagcauauucauaaaagcuauuuaguaucuacgguggccaaauacagagguuugcaugggcugaccaauaaggacuucaccaguucuggccacugccacucccaaauguaccacuugcuagaaacaucaauaaggaaaucuguuggagaguuaguuuuuugauucagugaauaccaaugugcucucccacauuuccucuaccuuuugugguaagguggggccaugugacuagugcaggccaacgggcuacgaggaaacagaaaccugucaugccugugaggggcccuggcaaggcauaccgccugaccugcacaccaagugaugaggucagagaaugccagauugcucugcauucucuguauagaggaaaauugccccgcaaacugccugauuaauauaccaauccugaaucaaagauacagaaaaauacccugacuggacccuccagccaccugggggcaugcuguuuguauggaccccaucuaucauagaggagaugaaaauguauacuucuuggaaaagacauauacucaauaagaauuauuucccuguuugccaggcuucugugaacaaccucaaauguuuuauucaccuugauggucucccacagaaccuucuugacuaagaaacucauuuuauauguacauauauuuauauguacauauauuaaaaaguaaagcaauuuaguuggugcucaugggauuccauagucucaccuaguaccccauccucaacaguggaauggccaguuaauaacuuggcugugguuccaguuaaaagacaacacccugaaaagcuaaaggacuauccuacaggcugcagaauguucucuuaacuagugauuaauuauagugcuauuuucccauaccaagaauauauauguccaggggucaaaggggagaggggagagcagugccuuucaccauuacacagaacaaaucacucauuuugcuuuccuuaccaggaaauuugaggucugcuguuguagaggucuuacaacucaagugaaaaaugcuuccaacaauagauaugauaaaagaaaaacuucagccgaguuaaauuuaaaggacuuuaauugagcaaugaaugauucacgaaucgggcagcccccagaaucacagcagauucacagacuccaggggugccucauggucagaacaaauuuauagacaaaaaagguaaagugacguacaggaaucagaagucggguauagaaacagugagauugguuacagcucaguguuugccuugugugaacgcaguuugaacauucagcagucuaugugugguugaaguauggccgcugggauuggccaacacucagcuauuguuacaggugcauacuauuaacuuagguuuucaauuuugucuguuaagcuagguuacaguucauccacaaagacucaaauauagaaguauggccuuuucaggccauauuuaguuugcuuuagcagaugcaagaguguuucuaugaaauuggaagcugaaacuguccaguggacauuuuggacaccucacaccccacucaaacugaguaaaaagggaguuauuguguugggaggggucauuagucuugauuaucaguugggaaaugaaguuccugcucagcaauggaggccaugaagagaauaccuaccaugcagguaaauccucuggaguauuccugcuacugccgugugccaugguaaaggguuagacuccagcaaccccaaaugagcagaagcauugaggguuuccuggauagaauuacugauggacuguuuguucaaggguaaguuagaguauguuaagucagagcaagguauuauaacuugaaaguugaaacauggagaaaaaaaaaaaggaguauuauugauauuugguaccaagaaagggaucagagcgaaauuugucucgcguggcugcccaauauccucuggauauucuugcucauaauaauguuugcuccacaucaugaauucuuccuuuucaaagggaauuucagaaaacucauauccuuugcagcuaaggagcaggcaugcggucugcccuccucuucucaggccacacaagacuucacuguggaagugagcaaugaggaaaaacaggcuauguguggacauucauuuuuccaguauaggcagugagaaagguauccagauuuggggauguuaggauaaauugcaauaaaauuaaauccuucguauccuagauguuacagucaggaaaacauugugguauccaguaaguagauggugacaauugccucauaagcccaguucuaagaaaauguucugcagucaacagcaugucaauggcuguuuucugaccagaccaguucugcaacauaguuuuggacauuguucccaaaagcuuagccucaagcuuauuucucugggucuacaaugauucuuccaaaugccccauauccuuuaauaaauuccuucucuauuuaaauuagagcccauucuauuguuugcaacuaaugcuccugaccauauuuuccuucucccacuuucaauacccaggcaaagauuguuuuaaucauucacaaccuaacaguucucucucaggaaagucuaaucuagcaauauuuuuuucuguggaaucugcaaccuacuccuuuaccuuuaagccauaagcagugaaugaaacugacuccuauuuccagaaucccaccugcauuccuuuuccaacucaaucuucuuucuuagccuaaggcuagccuauuuauuguaugaaauauucuuuucugucagugaacauggcaacaucuuuggcuaagucaaaagccuaacucuucaucuagcuuucaacuuggaagcacaucccuggacacaccuaugcuuugaaaguaauauuuaucucucucucucucuaucccacuguucaacaaucauuuugucugcuuuuuuugaguuacacuuugcauaucaauacucuuucugaaaacuccuccaaaguguuaaauaucuggcauagucauuucaaaacaggaacggaguggucugcauguuaaagaaggcaagaaugccagaaauugucccauuucccauguugaucagugacuguguaacucagacacguugcagaggccuacauggccuacuuccugagaggggggucucacugccuugucaggauuccaguuuaagagcacagggcaagugagaccacugaauacagucauuuaaaaagugcuacaggaaaguauuuaaauagucaucuuauagaagggggugaaaaagcacauuuauugaugcaguaauuaaaaaaagauuuagauccagugugucaauucccauagaaucccacuuagcccccuuaucuaugucaaagcaaacuuaguuucacaucagcagugcuucucauuuaucuuaaugcuaaggauuuauuucuuaugcaaaauuguucauuuucaccagccuggaacuuuaaaaaaauucacauucucuucuucaagaauuuuuauuaagccaagaugucaucaagcugaaaaucucagacacaauuuuggcucucuucugcaggaaacucagaggagugcccaauccaggcaacagcagauuagcacuggcacugcugacagguucuuaaaaguguuggaaagagaagaacaaaggugguguacaaugauugacaaagauuucugcuauaaacuaaaguugaaccaauaaauaugucuagacucugccaugacuaucuguggccuggaagcugcauucuucagaagaaaaaaaaaaaguugcaguuggaauuuggaaugguuuugcccccaugaugugcacacaggacuuugaugaguagucugauaugcagaagcauccagauuaucacugagauagaaaugaaacauccagaugauagauuaaguagauuguucacuucucaucuauauauauauauauauauauauauauauauauauauauauuugacaucauagaggcauaaucaaaaucugaguagguaaagucacuaaccagaauacgaauaccaaguuaccugugugguuucauggaaaaauaauaggggaauugacaucaucuuuauaaauguuguaucaaugagaaaauuaugacagucggggagaucugaucuagcccaucugccuccugucuuuagcauucaagcugccaagcuagcuuugggagacauuuacuuuacaguuuaaaugauaauaacccuuccccccaacucaacugccuuuguaaagcuaaugagggaccaacugagggaaggagagaugccuggaugcugcuaagguacagacaugaacaauugccagccauuauuccagagaucacaagauuugcaacuucccuaauuacuccugcaggcaacaucacuauuguagauuggccuuuugagauacuguuucagguuuuuugcaugucuggcacccauggcucuacuuggacccaccaacugaugguuccucuggccagaagcaacucaguguaagaggacagcuucaacucccuaugauuaaaucuccaacccagccaaucggcagcaaacacccauugcauagccaucccuacgccuucgcccaaacuaccuuugaaaagccccuaaccuacaagccuucuaugagauugauuugaauaauaacuccaucuccggcaugguguggcuagccuucugucaacuaaacucuuucuuuacugcaauuccauggucucuguuuguguagcaggcaggaagaacccacuggguggucacagaauuucaaggcugcaaagagucagacuuuacucaaauauucuaggcaaaaaaaauagaauuuaaggguuacgaucugcacaaucauggucaaaaucaaagacacaucgaaacaguuaaaacgcaacaguuaucccaaggucaaaaccaagaauauuuauuuauuaguguacccuguagcucuguacccaauuaagcccaaacaucucccuagacuucaucuccauaaucauauggguaucugauacccgucaaugcaauuuucuugaucacuaaugaaacauuccuuguucauugcauuagucuuuauaaucacaauauuaaaucauuuucccugguguuuuccccuagcaacaauuuaugagccauuacagaauuucuguuuuuuuucuaugucuucucucuucucauaaguuaaaccauuccaguaucuugcaaaugaccagacaacuacuuuaagacuuugguuguaacuagagcuuccuaccaagcuauguaauuaagccacaguaucuuugcucuucuagcuuacaagauaaucaucugauucccuuuuguuaaacuauuugcccuuuggccuuauaguuuauucacuugggaacuagauuacaguuucccagacuauauagcuacagagaaauuauugugacuuauuauaaguuuaauucaugccaaacaauaccagucugauuucuggcuuaauaccaccuucuuucauaaagcuggaccaucauuuugccuuuaaucaucuucuugauuaguauuuuuccaaguguuucucaacucauuucuucuauagaauuaaaacauuccuacuggaugggcuacucauuuuaaggauuuaaaauuuucagucuggauuugggguuacaccuuugauggaugagcuuaaggaagauacgaaaauggcaaaauuaucuucaugaugacaucauaauggauagaacaaaguaaauuuuauaaaaugguuucacaugccuuauuccauuugauacuuaacagacuugagaacuggacagaguagauauaguaguucccucuugugcacagggaauauguuccaagaaucccaguggaugccugaaauccuguauaguccuaaacccuauacauacuguuuuuucccuauauauacauauuuaugauaaaauuuaauuaauuuauucuuuuugagauggaguuccauucuuguugcccaggcuggggugcaauggugugaucucagcucacugcaaccucugccucucgcguucaugcaauuguccugccucagccucccgaguaguugggauuacaggcaccugccaccacgccuggcuaauuuuuguauuuuuaguagagaugggguuucaccauguugaccaggcuggucucgaacuccugaccucaagugaucugcccaccuugaccucccaaagagugggauuacaggcaugagccacugugcuuggccaaaauuuaauuuauaaauuaggcacaguuagagaugaacaacaauaacuaauaauaaaguagaugccagcaucacuacuuuugugcuuuggaaucauuaguaaguaaaauaaggguuccuugaauauaagcacugugauacugcaacaguggaucugaucacagagcuagcuauaaugucacuaacgggcaagcagcacagacaucacagauacaugggaugauucauacacugggaagggcagagcagggcagcucagauuucacugugcugcucaaaauggcaugcauuuuaaaacuuacaaauugcuuauuucuggaauuuuccauuuaacauuuuuagaucgaguugaccacagguaacuaaaacuuugaaacagcagauaauggggaacuacuguauuacuaugcccaucuuuauaaagcagugguuuccaaacuguguuaaugcagaccaaauucaugacauuguuucaaccagugcagcuccuuucauauuaguuuuuuaaaaaaacacaucuaaguaagaucaccauuugaaaugaauagaguguauguuggcuuuuaaauaaggaauguuuaaaugccccugauagaggaagaaaccaaagcucaguacaaaugguaaacucacaucuccaccuguaaacaccagguaaaaauugaaggagcagggacaaccacccaagucuccagccugugagacagccaggugaggagggguccccagaagaccuccaacuggccugugcaccgggguggagccucgggaauuucaucauguuugcagcggggaggagccuggcccuuccuuuuccuguguggaaccugggauucaagcugugggcgggaagugcucuaucagggacucaagccuugggagacucccucuuuccccuuuacuucuuuuucacccaauaaaacccugcucacccucuccaucggucugugaaccuaaauuuucguggcugugggacggacaaguacccugucuuuaacugaacuauggaaaaguccugcaauauuuuuggcgcccaacguggggacucgagaagggguaagugagaugcaaaccaauaauucuuuuucccucucccuucugagucuucucauccccguggccuuuuccuuccuuuuuugggauggaccggcgagcagcagcugcccacugcuccucacuccaugccggggcugggacacauggccuaaguguccugcacagccugcuggcugguuccccgucacuccuggcugucccagccuuccccuucccuggccaagggauguaacucuaucagacaguaauuaagcuuaaauuugucucccugguggaggaaccacuugcaaagaaauaugagguucuuccucaggcacuuuuaaacuguuucuuuucuuuccccuucucuaccccaucagcaaguuaacuuaaauuuuuuuuucuuuuagaagauguuguacuaggcuagccuccacccacccccaacaacugucaguguauucucugcaaaguuucgguugugaaaucaagccuccaucuuguuuuauauccugagggcauggcugguaauuguggcaaggauuuguuuagcaaagccuugagaggaugaacccuguaagauucaaugucugcauguuuuccuagcccuuucucuuaaagggccccacccagcaacuggguuuucuucugccugccuguguguguacuguacguaauguuugucaagagaacucuaauuaauacagccuaaagaaagacaagugcuugaaucuaauauuuuuuaaagggaagauaaagucugguaccuuucaguucacaugacuuuaaucuuuaagaaauagaaacagucuuaaaaacuauuggucaaaugcagguauuaucaaaauguaaauagguaggcuaaauaaugcaggucagaugcaagguuugcuaaguguuuugagguuacaaacugcuuuuuggguuuucagaacuauauugacuugccagcuucacaacugguaaggccuggggacacacggaacuaaccgcacccuuaacuaagaaggcaaaccuuggcugcaguuagcacacaauuaaagcaacuuaacaaguuuuaguuuacaguuaaaaauugcuaggaguuaauugaauccacuagaaauagauuuacaugcaagguguaugagaacaguaaaauguguuuuucaguaaaagguuauaagaagucauggaaauguaaacuuuugccuaggguuaaggauuguuuugaguuacauuaggaaaaagcugaagguuccaagaagugguggaagaauuguggaaauuaaucuugcagaagagguucucugugugaacauacugacuacauucaaccaaggguauuauaugguuuuucuguaaauugagcguugaaguaaaagcauaacgagguuuuccuaaggugcuaaucuuaaucugcucuuuggcaaaauuuguaaaggguuauaaaagguuuucgcuucuucaaaauuucugagucaucauuuugacaaaauaaauaacuuuugguaauguugacaaaaggagucaaauucuguaaaauauuuuuacagacuuauugugagccacauaugagugaccauggcccgugacacagcccucagaagguccugagaacaugugcccaagguggucaggguauagcuugguuugauauauuuuaggaaagcaugagacuucaaauauauuuaagaaaugcauugguuugguucagaaaggcaggacaacucaaagcggagccuuccaggcuauagguaaauuuaaacauuuuucuggaugacgguugaguuuaucugaagaccugggaucaauagaaaggaaauguucagguuaagauaaaggauuguggagaccaaauuuuauugugcagaggaagcucucagauagcagacuuaagagagagcagguuauaaaaugcuucuuaucagaccuaaaagggugccuggcucuuaguugauuaucuccuggaucuggagagaaaggaaugaaaacaaagggggaaggggauucucuauaaaauguggauuuuucccacaagagacguugcagggcaacuucaagguauggcaaggaaauauauuuugagguaaaacauuuugauuuuuuuccuuguuaugccacagucagauuggaaaguaagucacgauauacaggguuaaauaaaacccaucugaugaaaauuuaugguuuguaagccaugacuccccaggcuccuuagauaggaauuugggcaauauuaaaaaaaaaucagagcuuaguccucaguaaucuggaauuccguuucauaacaucaaguguuuuaaaccuugaacauuuaacagccuucccaaagucaaacuucaguuucaaaaucgucuucccugguacauggcuuuucaaauacuucagagggcccccgauguguccagaacuaagagagguaaacagaauuauuugacauguuuagguacaugggauugccaaaaugaugcucaaucuucuuuagguuauagcugggugaauaaugccaauauauguuccaaaauuguaugggauuucuaaaauucuaaugucugaguauaugcuaucaaccauaauuaagguuuuuauguuaaguuauaguaaaccacggagauaacuaaacuucuuugucagucguguuucuaauuguaacuacccuggaaauuuugcuauucacagacaauuguugcuuuaauucuuuuucagaagaugguuuauaauaagcuauaggacuuugacaggugcuuucaaauacaggcuucugauaacuuuggauauugugacacugaaauacaggaaaauguacaggacucaaaagcugaaaugcucaugauuaucaagcaaaacaagaguuagccaaauggacugaacucaggaagcugaagcaaccuuuuugacuuuugcuuggaauauugcuaauccauguuucauuuuucagagucaaggaaacuuauuuugaacuauuuacagccuuuaacaauugaguaagguauacuccuaugaacaaaguuugaagcguguuuguuucucucugccugguuccucuagaauuuggaaacuaucugugaauauuguuauggcaauauaguuguuugcaucagugccaauaagaauccauuuuucuuuugcagcaggacacauuuggagaaaguaguuauuuuaccaagguuuugacuggaaugguaugcuucccuuuaaggagucaagcucaacuugcagagccaauaaaagccccauggggaaacuggccucauacuguugucuaugcagucccuguacaggguuccugaccuguggucaguaaagaaugucacuuucuagcagguccaagagcuccaaguuuauugugggaccuuaagaggagaggaucacccaacucacagguauuugaggaugcaaacccauggcuaggcucagcuuuaaaaggucuuaucugugauuccuuguggaaaacauuuccaucagugccaauccaaaaagccuauguagaaauaguuauucuugcugcacuuuaugcaaauaaucaggccaaguguaagacuaaagucuauuuugcaaagcacucaguccuaccauaauuuuuuuaacaaaaaugaggacuggagagacagaaauuauguuccaaaauuugccauacauuugucauuaaaugcuaaacucauuaguuguuuuuaaguuuucaucuaccuuuuagaccaacccugcuugcuccugugaaccaagcagcaaucuccagcugcagcucagaaagaacaggagggauggguaauguagaaauauggaucaauauucuagcucugaacaauuauccugcaaacccugccaggugauggaauaaauagggugcccauuaccaggagguuuccuuuuugggaaaguaagaccaagugaacuaaccaaagccaagcaucacguauccaaauccuggcaagcauaacuauagcuaccaguuaucugggugugucacaagacauccuuuucucucucuuguuggaggagaacuggguuccacagcuucacuuuagcauuugucuuaugauaaggaggccaugcaaugccccauccgagauacauuuuugucccagacugaauuccaagcuucacaucaaagccuuaggaaggaaaaucggaucuuagggauccagaggcaaaugacaacagaaguuaaaaggcacagcacaggugagcgugacugauuccugcugauuaagccaaccccaaacuuccuguuucauggauaaaggccacguuaauauccauggcauaaaugaggucuacggaacuccaaggcuacugacagcaggggagauagggcauacguggguaagagcggaugauucccaccccuaggccccccugcuucaugggugcaaguugcuuuaacacccaugguggcaccuaccaaggucacuggaacuuggggaugcaaggauagaagauggaaagaggaugcucuucccucucuaccucacauaccuaagguaucugcuggaagaaaagggaaccagguaugccugcuccccucuuucuagauggguagccauucaucuucagucuguaucccuuucaaaugcauccugaaccucugggacuccuuuaaaaggcaccuucuuuuugccuuucuucuccucuguucucucuucacuaauagguaauugugucuccauacuacaaggcacucuccucagaugcauccuccaaacuagaaagaguugguuucccaaaccuuaaacugguuagcuuaggauugggcucaggggaaggggacccagaagcccaacgugccagcaaaaggguaaaguuuuuuuugccagucaggcuuuuggccucccucuacgugugcaaacuggcaaaaggccucaggaucuuugagcuguccuuacccucccuucauuucguuuugauacauaguuucuaauaaccugguuugucuguucuugccuucaggccauuaaacucuaaacaaucaugcaagcagagccucugacaauggcccuuucugcugugaacccuuagaugggccucugccguuuccccaaaacagcgcccccucucagcaggaagcaguuaaggucagucuucauccuuauccuuaaucuaaacggcagcuggauguaccucuuuagagggaggaaugagacagcuaggugggaggggguccccgaaaaaccuccagucagccugugcacuagaguagagccucagaaaguucaccauguuugcacuggggaggagccuggucccuccuuuuccuguguggaaccuggaauucaagcugugggcaggaagugcucuaucagggacucuagccuugcagaggcucccgguucccccuuugucuucuuuuucacccaauaaaaccuugcucacccucuccaacagucugcgagccuaaauuuucuuggccaugggacagacaaggacccucucuuuagcugaacuaaggaaaaguccugcaacaccuccaacaacuaacaauuguuuccagugcaccuccauucuccaggagggagaaggccaaagcacauaaguggagaaugcacacguuagcccauuuucaauaguuuaauacuuuaaaaaauaguaguguugcugacuuucaagcuuuagcaucuacacgugcuagauucacuuauugacucauuaaacuauucuuuuaccaaugagcuuaccauaugccaaaaacuaugcuauacugggaacccaaaggcacacagaaaaacuagaagacuauuucugcaccagucaagaagcacacaaauggacacucaugaagaaacuauagacccaaagaaaaccauugacaauauaggacaaauggcauaucaaguccugaggaaagagauuaguaaggagguuaauauuuuaaaaaaaauagaaaagggagaaauaaugaaucacuggaaauggucccaucaaccugcaguucuucacuauuuuucaacuuaaaauuggauacauuuauagucacuugaccucucuaggucccaaucuccccauguucaaaguacauauccuauugcuagcucucucuacuuugcuaagucuauugugaaaauaucacaauauaaaauacuuugaagccuuuuagggaagcuuaaggucuucuacaaauaaaauaacaagaaguaccacuuggcugaaaaaugaaagagguaggacaccaaugguaguaaaucacuuguaucacuuuguucagaaauuauuucauuuuuuucauuuuauugaauauagacaaauuauaguuguauaucuuuaugaaguacaaagugauacuaugauauauguauacagucuggaaugauuaaaucaagcuaauuaacauagccaucaccucaaauaccuaccaucgauucuccuaacugaaucauuguacccuuugaccaauaucuccccauuuccccuacucccagccucugggaaccaccauucuacucucugcuucuaugaguuugauuguuuuagauuccacuuguaagugagaacauaugguauuuguuuuucuuugcuagcuuagcugacuuagcauaaugucugcuugguccacccauguggucaaaaauggcaaaauuuccucauuuuuaaggcugaagaauauuucauuguguguguguguguguguauauauauauauauaucacauuuucuuuauccauuucaucucacaccuauuaaaauggcaauaauaaaaagaugaaagacaagucuuggcaaggauauggagaaaggggaacccuuguucacuacugaugggaauguaaauuuguacagagcugguucaagggaaauccaagaacauggcugugaggcaaggaccagaugaggguauuaagggacuaucauuacaguggaaaaauuaacccuaucuuuuuugagagaagccaguuacaaugcuugaugcuaucccugacacacucucucuagcaacaaguuccuuuucuuucggcccuuaaguaaggcuauaagaagaacagaacaaaacagcaaggagaugaauaccaaagcacuggccacacuuuuccccugugggccugucuuauuccauucaugcugcuauaaaaaauaccacaaacuguguauuuuauaaauaauagaaauuuaauucucacagcucuggaggcugggaaguccaaggucaaggugccaguagauuaagugucuggugaagucuugcucucugcuuccaagacaguacauuguuucuguauccucacguggacgaaggcagaaggguaaacaggcauaaagggccuagcuaguucccccaagcccuuuuaaaagggcaccaaucccauucaugacggcucuguccucaugaccuaaucaccucaaaggcuccaccuccuaauauuaucacacuggguuguuuuuuguuguuguuguuuugacaaggucucccccuguugcccaggcugauguguaguggcacaaugucagcucacugcagccucaacuuccccagacucaagugauuuuccugucucagccuccuaaguagcuggaacuacaggagugcgccaccagcuaauuuuugcauuuuuuuuuuuguagaaacaguuucgccauguugcccaggcucucacugggucuuauguuccaacauacgaauuugucugggggaugggugacacauacauucaaaccauagcagggccuucaauaggucauuagagagagagccaaggaacaccaguguggcuuuuugcauugaacaacgauaaguuaauggaaguuuaacauagcccacagucuguagucagaggucagaggaguaaggccuuacaugcuacagaugcccacaaaggagauaagaggaagccagaagaaauagaaauuuguuugucaguggauaaagaacaaggccaagguuuucuuaaauagugauugaugaggcccugguuuacuguaacaguguacuugugauuuuuuaauuuuguaaaaauugucccaguguguaauucucuguuuauaccugaguguggggaaaugaauuuuaaggaaaaagcccuauauuuccugauaaaucacuucuauaacuaauugguuauuuaaugauucaucuguguaaaaagggggacuaaugguuuuaaaauaaaauuucaucaacaguugucucuuucauaagguuugaaaacaaagaaaauggagaugaugaugcagguguggcucuuuaacagaacccacaggggagcacacaggcucuggggagagcaaacaaggcaagggcucagaagacuagguucuaaucccaaugccccuuucucccggauauuuaaucauagucaaauuacuuaaugaccccaaaguacagugauuuccuuaauauuuuacaaaagaauaaaagcacuauggacuuuucuucaaacagacauaucaccccuggccucaggaguuuaauauucagugacucuuuggcaggucgugaacugcccaucagucccagugguuguuaugaauguccucugcucauccauccagauccccuccccaucuuucuucauccugacucuuccugggagggugaucaauauagaccugccaauaggcuccugcacccucuagcuucuaauugcauucuguccacgggaagcccuggugagaguuacaucauuccaggauugggagcaaccuguaagaggccccggacagcuguguccauccucugaaaaugaaggcuguucucaggugaccugcucuacccagaucuuuuuccuuccagguucuuuuuuuuuuuuuuugagauggagucucacucugucacccaggcuggggugcaguggcacaaucucagcugacugcagccucugccucccaagcucaagugauccccugccucagccugcugaguagcugggacuacaggcgugccccaccacacucagcuaauuuuuguccuuuuaguagagaugggguuuugccauguuggccaggcugaucuugaaugccuggccucaaaugaucugucugcuucggccucccaaaauucugggauuacaggcaugagccacaguacuuggccuccuuccaggcucugauaaauguuucuuccccucaucucuuaaagccuaggggagguuauggacugaauguuugugucccucacaaaauuuauauguugaaaucuaaucccaaugugauggcaugaggaaguagggccuuugagaggugauuaggacaugaggguggaacccuugugaaugggauuagugcccuuauaaggggcugaaaagaccagaauucuaccccuucaccaugugaggacacagcaagaaggcauccucuauuaaccagaaaaugggcacucauuagacaccggaucuggacuucacagccuccagcauugugagacagacauuucuguuguuuaugagccaccugguuuaaggugucuuguuuuagcagcccaaauggacaaacacagggagguaagagccccuaccagccccuguccaccagaaagauggggaucugaacagaagccagagguguaacuggaauggacucagguguuuuccucacagagcagauaacuaaagcuagaauucuugauaagaaaaaugggauaaagaaauaacaguugcaaagguaagaagcagagacagaguuauaguccagaggccaaaaggauaauuuuaagaagaaggaguaggucugaaagugaugacugagacuagcccuuggcuguggugauuaagaucuuuggugacaauagaaaauguaacaauaggaguggucuguuguggugauagaaucugcagaccgguggaaguccaugggcccauuuaccaugccacaggcaaagaguauauuaaacucccacgaagagaagugccucuggauucauuuugccaacauucacuguacugauauuagccauggacuugcagaggguuuauuuacuauugcagccuggcucucugcugugucugaaaguugaccuugguguccucuaaguuuuaucccagagaaaaagacagcaauugagcuauuccccaggcacagggggcaaaauuugaaauugacauaaaaccaagauucccugucugacuugggccucugggauuguauugcugcauccugugguggcaaaaagaguauccugggcaguaagugauuucaauuccacuuaaagcaacaaguauuugcugaaaaccaaccauauucuuaguaagaagaugggugcuguaggagacagagaauuaaaugaaaucauuccuucccuccaggagcaaacagcuucaugcuagaaauaaagcuaacucaaaugcaacaaacagaagacacacacacacacacacacacacacacacacacacacagagagaguacuuuucaagauuaguaacaaagagauuaucuacagagauaaagacagaagaauccaaugucugcauguuuuguuauucauguguauaaguuuucuaacuuuccuacauucagugugaauuaguauugaaaucagaauaaaaaagcaauauuuuuuuaaaagccuaauuuuuagaaauugauaguaaaaaaugagacagcccugggcugaagucccaggcguccuucuuccuaacaacuugaacuuagccaaguugcuuaacuacuuggugccuaaauguucucauuuauaaaacugggaagauggcauggagaggcaaugggcauuuucuggcaagaaacuaagaaaaaaggccauaaccaauaaguaacuuauggaaaugaaaaaaucuuuuaaguuuuauaaucuugcuuuaguugauaucuuaaaacaaaauuuugaaaguuauuaagucacucauaaggauuucaggaagcacugcaguguaauaugcuuaagaauggagaugguucaaaugcuagcucggcuacuuagcaauaccuguccucaaauaaguuauuucacccuaccugagucuguuacuucaucucuaaaauggagauaauccuaaaacguaccucacaggaaccuugugaagauaaugcauguaaaaugcuaucacaguccuuggcauggaauaagugucuaauuaacuuuuauauauaauuauaauuaucaucuaaaaaguuuagugguguuucagacaaaucuaagagaagauaagcaugaauagguauaugucuuuuucaucuuuguauuucaccagugcuuugcacagggccugucacaaaguagggaucugagaaauacuugugaaugaagaaugaaugaaugaaugggcugauuuuccuauuugaucaaaagccacauccauauaugacuaaaucugaguauauaaaagaagauaaaacuuguguuucaauucaaucuagugaguuaaauuaaaagaagaaagggaggaaggcaaauuaaaagaagaaagggaggaaaagaagcaggaaagagggaaauaagacaaaaagaaaaaaaaaaaaacaaaacagaaguuggccaggagaaagggugucuccauccuuaaauauuuuacuccuuauugugugauauauuauuuugucagcuucuucuagcuacaauucccaaggaagggauagagagcagcagcuuccaaguaaugacccauguggguauaaagagaaauuuuuaucauauuagaaaaaauauauuuauauacaugcuaccaacuuuaccuagaagagaagagcaagggauuggaaaacaaauuagcauaaaaucccugcuccagcuuuuuacacauacagauguuuuccugcauauuuauccauccuucugagcacugcucaaauguuacauccucagagaagcucuccuggaccccucauccugggcuggauacucugucacaugcucuaauagugucugauacccuuccacuagaacagggaucacuguuguaauuagguaauuauuuggguaauuaauuguuuaacaucuguguccagugucaguaugcaagcaagcuccaugaaggcaguguuccugucugccuguucaccccaaaaucaccaacacuugcauaugccuugcaugaaacagguaagugaacauaaauguguauaagguuggcauccauucuuugugcauucuguguuugugaauuugcccacucaauaaaaugcauuuguaaccucaacaucgauacuugccacauuucuguggucauuuuugggcaucacagagaagugaaaaauuugucacccaacauguacauuccccaagugaagcagaacaaagcaaagcuccaccuucuugcuccaucucucauacuguaaacaagggucuuuuucugaucuauuaaaugccagguuguugggguggguuuucuuuugcauuuuuguacauaauggccccaaaagaacagugcugaagugcugucucuuguuccugaguacaagaagaauaugaugugccuuacagaggaaacaugagugauagaagcuucauucaggcucagguuaaacagcucaggcugugucccaugacuucaguguuaaugaauuagcuauauguuaaauaaggcaucuuuaaauaaaaguaaacauuuaaaaaguuuacauauuaaucaauuaacaaaaauguugugaagaaacagccaguagcacgugccuguaguucugguuucucgggaagcuaaggugggaggauuacuugagcccaggaguucgaacugcagugcacuaugauugcaccacugcacuccagccugggcaacagagugagacccuaucucuuaaaaacaaaaaaaauauuguaaucagaggcucucaggaacucaacccuggauuuccccuaggggcaaugguucauuauuugcuaauucagcguuuguggagacuuuauacaacaauuuccuaugaaaaaucaggaucaacuauauauauacauagaauguauauguguauauauauuuuacauauuuguguguauacaugcacauguguauauauguauguuuaguaguuuuuaaccauuuugguguuauacaccuguuguaaaaauuuaaggaagacguggauacuaggggcugaggguugccacaaagggagguauguacauauauacagcccugugcuaugcaucuccagggcaggagacaggguguugacauucacaguauagccuaagugaauauuccuacuccauagaauuguucaguguggugacacuucaugcaaauaaauacauguauacacauacacauuugcauaagauucugggcauuuguggccuccuaucguguaccucagguaaaaauccugacagagaaauaauagauacacaaauauaaauauauauuauauauggcacauucaauuuuacuucaaauguuuuacauaggcuaaaauugaaacuaaaaugcuuugcauuucagccaccaccaacagggacuagacaauuccaaaauauauguauccccagaagaaagauaauuuguugugaaacacuggcuaaagacauucccuaagguaaacuaaacacaggcagaaaacugagaguugaaaaaaaauauauacauauauagagagagagaugagaguugaauaucuauauguauauauagauauguauauauagagagagauguguguguguguguauauauauauauauauauagagagagagagagagagagagagacagaggagagagagagcacaacaagaauacgaagguuggccaggugcuguggcucaagccugaaucccagcauuuugggaggccaaggcggguagaucacgaggucaagagaucgauaccauccugggcaacaugaugaaacccuaucucuacugaaaauacaaaaaauuagcugcgcaugguggugcacaccuguacucccagcuacucaggaggcugaggcaggaggaucacuugaacccaggagacagagguugcagugagccaagauugugccacugcacuccagccuggcgacagagugagacuccaucucaaacaaacaaacaaacaaaauaccaagguuaaccugccccguuugcuuuccuaagagucuaagauucucuggauucucaggucuguauggugggcagcaauguaaauuuaagcuucucugacaucuaaguucuuuggagacaguaacuauuaaacaccugacucugucccuugaauaacagacauuucuuaguaaagcuuuuaauuagaucuguugguugaggaugaaaauagaaagacaccagaaggaaaaaaaaaauucaucccuguaaaugguccuguggaaauaguaacuaaaacaauuauacuguuaauaauucaauguugguuuaaaacuauacaauugugaguuauuuauacagaccagaguuggcauguguuguaccacagguggaugugaggucaccaagaaaccacuucacaguuuucccagaaguguagcgucaaaaaggucacuugugguaaaagaucuuuuggauuagucuuuuaaaucaaugcaugaauuaaagacaauuuacauauaaauaggcuaauacucuggcuuugaaauuaaauggauuuuuaaaagauuuaaguaacugcagaaaaggucaguuaggcaguaaguguacauaaugugauucuugaaaacugcugucuuguugguuuauuaauauuuuguauucauugucaguguuguucuaaaauugugugcauaauuagcaaugcaccaaagucaacggcaggucccaaaaguaaggaaagcggaauuuacaaaucagugaaggaaggacaagucuagauuuggacaugaaaauagucaaaauuaaccuuugccuauauauuaauacacauuagauucaaauaugucacaacauauucuaaauaagcauggcaucacucgcuccaguuaaauuuaccuuggcauuuagccucacugauaaauuuucaacucuuccaaaauacaaaagcugcaguagucuccugaguuaucacaacaggaucaugauuguaauuugaaauccugauuccccuuuuagggaacagaaaccugcaguuuuuccaacuguaaugaaaggauagagcgaaacuuccauaggaucaaaccacauuccauuaccaccacuccucugaacauuaauguaccuuaaaacauauugaaccauaggaugaauauauggagcaggggcauuuuuaggagagugaaacuauucuguaugauacuacgagagauacaugauguuacauacuuguccaaacacacaggacuaugacaaaagauugaguccuaauguaaacgagggaugacuucaguuaacaauaguguagcaauauugguuaaucaauuauaacaaaugugucaauccaaugcaagauguuaaccauaaugaauacugugggcaaagggaggggauuugugggaaaccucuguacuguacuuucugcucaguuuuucaguaaaacuaaauuugcuguagaaaaucgucuguuuuuuaaaauagugaaccaaauguaauaaugcacucaaagacucuuuuuagacaaaugguuuauaaacuauauucagaggagcccuagugguccuuugcuggccauuugguuuaggaguguuugggaaaauagaguaggagagaagagggaacaaugaagaaaagacugcucaagcuggccccuuaucuuucaccccuguuucaaacaaagcaacaaccuuuucaccuguacauauuguuucuccacauuggagcccaguaaagaaggguuucucagcuaaagagaaaaaaaaaacaugaaaaucaccaauguaugcucaauaaaguaucuugcuacauaaaucagcaacucaaagaagaaaaaguuaaauuauaaaaaccuugcuaauaauguacacuaauucccucagcuacuuaauaaacauuuaacuaaaacuuucugccugaccauuauuacuuccuaugauugggcuaagcauaagcuaaaugacuaccuuggaagaacuccaacuaagaaguauuuauuucacaucaacaaugaaccaguacucuguuagaacaugcaacaugcuuuggaaagacaggugaaauacaaagcaucauuccagcuguccagaagcuuaucaucuuacaggacagagaacaugaacacaacaaaaugcagaaacaauauaauacaccugaggcacccagcacccaacuugaugagcuaaaaaauagauuucaggucuucugucagguguuaacaaauugucaacucugaauaaugugagggccaguaugaaugagaacaguccaauccccaguuaagccccacuuuucuaaaucuucuucucucuuuaaaaaagcaaagugaaugcuaacguagucuaucaguaauggacaguguccucauaaaaagacauauguaaaaaggaggggaaguggaagguaagcagugcuuacuauuuuaucauauucaauuguauacacaccuccucucaaaauuggugucccccuaucaguaguuacuaacaaguuaguucccaggaucuugcagauggugggcugguuucagacaaaggcacagugguccagaggaucuggcaaccucuuucaggggcuguugggagaugcccugacggcagcagaagcagccuccaaugaggauggcuuccugcucaagaccuccucacacuccucuugcauaaauaaaugauuuagacaccguuuucuccucuaauagccagcacuacaccaaagagaaaacacuccgcuauugaugacaggagagggcuuuuuuuguaaguguguauguguguuaugcuauaaauuacccuguugguggguguaaaaauaaauauccauguauauaguuguguauacacacacacacacacuuacacagagagaauauguuacaguuaaaaucaugcugucgacagccacucaaaucuagagcaauuuauggcucucaaugcagucacacauucaggauaaagacaggaugauaauaaauacuuugaauauuaccagcauaaauaaacugccugaggagcuuaaacauuugcaacauagccuugcuggcucacacugacaaccagcagaccuguugccagugagcgacugaaagaucaaacaugauuaaaaaugcaaagaugcugcacccaaaugacaugcuuuauuugacaaugaacucuggacucagaggcaccacugcaaucuaugagcaaagugcuuuuugguaauucauuugcccacugaggccagcuacugaggaaucacaauacaagucccuuuuaaaguaggcacaguucuuuacagccauuaguaauuccaucuugagacugcccuucgagaaaacaauuucuuuuuuuuuuuuuuuacugagaauugaugguuuguguuuugucaaaaugagccccagaaguuguuaagaacuuguguaauacauuagcuaugaguagccgaauaauggucuucaaguaaguacaggaaaaugaauggcugugaugaagauggugggcagguauccuuuuacugaaacuacuaaagcaggggcugaagucagguuuuaaaaaagauucuugugaccauaagacacaggaauguccaguggaagaaagccaguucuagcuuggaguuuuaggaacaagccaguuuccuuggugucucaguaucauuugauucuauaguauguuauuucuuuuauuuacauacauaugacauucaugauuucuuuuuaaauauccauaaauucaaaguggaauacaaugucacaaugucuuaagucucagaauaagaugcugagaagaccaugaacaagugauuucuuuuucuuuuucuuuuuuuuuuugagacagaguguugcucugucgcccaggcuggagugcagugggcaagaucucagcucacuacaaucuccaaccccuggguucaagcaauucuccuaccucagccacccuagugguugggauuacaggugccugcuaccacgcccagcuaauuuuucuauuuuuaguacagacagcauuuugccaugcuggccaggcuggucuagaacuccugaccucaggugaucugccugccucagccucccaaagugcugggauuauaggcaugagccauagcgcccagacaaacaagcggggguuucuuaaggaagggcuuccaagaaaaacugcuuacagcguggcaagaaguagaacagggaaaggcaagaagccaagcgagggugugauucaggguagaauccucugagggacguuuucccaccagaggcaaggaaacugggcuuucacucucacucaccaaucacucugcagcuaagagccauccuggggguuccuaaacuccaagcacuuccagcucucagcagaccuagugaagccagcagcuccaauugguccugcaaagaccauugccgaagcagccauuggaagguaaauacacagaagcuggggcagggcucacagauauguugaaagguaccagggcagugcuccgacaccuucugcuacagcaaagaagcaaaugguccaaaaaucaaaaugaggguagaauaagguuggagaauucaaaaagugcagaaaaaaaauaaaagucccccuucucucacccccaccuuccacucacccuucaccuaguccuucuuuccaaagguaaccuuuguuuacaguuuucuauaaauccuucuaaggaaaaauauacacauauacuauguaucuauuuaaacauucuuuuuaaaaauaugcagauuggacaacuguuccacuguucuacuccuugcuuuuucucacuaaagaauauaucuuguauucuagauauuauauuagaucuauauacauauucuaaauagagagaugauagauuagacagauaaaugcaaagaggaaggaagggaaggaaaaauggauggauggauggauggauggauggauggauggauggauggauacuacacuucauugauuuaaagauaaaacaguuuuccacauuuuaacauuucugaaauaggcugucuuauacuugacagcauuuuagauuugcuaaaaugcaguagauagauauauagcuauuuauggauggauugacaguucacacauagcucugccacuugagaaguagugcaggauaguaguuaagaguauauuaacacauugcuuauuaaugagauacuuucguacuugaggaauaaggaccucuuuugauggggcuaauauuuuaauaaucugauaaauuguuuauuaacuuuaaauuuucauaaugaguccguaaaugaguuugauuuauaguuuucuauucugugcugucucucucagacuuuggaauccauauuacauuggcuucauaaaaacacacuggcaguuuuuuucuuuauuugugcuaugggcaauuuuguuuacuuuuauaauucuuugacuauguaauacauguacuguguaucaaauucaaaaaguacaaaagggcaugaguaaaaaaguaucucuaccugucuuccagcugccuagucccuucccccagaugcaaucauuguaauccguugcuuuugcguuccuuuaguuauguaugacacauacacauaugcacaaggacacacacuuuuacucaaaugucgguauaauagacacaaugcucugcaucuugcuuuuuuuucacuucauguguuuuguagauuguuccauaacuauacacagaaccuccacauccuaucugaugacuucacaguauuccauuaugcagauauaaaauuaauuuuaccaguuuucauuuuuaaauagaauuaacauuaucaguuccuugaaaugcaaaauuauuugcuucugaaagcauaaagaccuguggcuuuuuaagaucuuugauaacugcuucagauuuuuccgauguuauuaaaguucucuuuccuguugaauauguuuggguaacuuauuuaccuguuuaaaaaauacauuccuugaagauuuucaguuacuuuugcaaaaguucuccuuugaauauuuuaauuucuuuagccaugguucuuuuuccuuuuuccuuuguuuuuuguuuuuuuuuuuuuaagacagggucuuacucuguccucugucugucacccaggcuggagugcaguggcacgaucagggcucacugcagccuaaacuuccugggcucaagugauccucccaccuuagccucuugaguaguugggacuacuggcaugcgccacuaccccugucuaauuuuuguauuuuuuguagagaugggguuucaccauguuacccagccuggucuugaacuccugggcucaagccauccagcugccucggccucccaaaguguuaagauuauaggcuugagccacugggacugucugcuuuccauuuuuuguuuuuguacucccuaacuuuuugaguaagugaauuucauugcuuggcauuguuuucaagguguguuagucuguuuucaugcugcugaugaagacauacccaagacugggaagaaaaagagguuuaauuagacuuacaguuccacaugacaggggaggccucagaaucauggcgggaggugaaaggcacuucuuacaugguggcagcaagagaaaaugaguaggaagcaaaagcagaaaccccugauaaacccaucagaucacguaagacuuauucacuaucaugagaauagcaugggaaagaccagcccccaugauucaauuaccucccccuagguaccucccacaacacgugggaauucggggagauacaacucaagcugagauuuuaauggggacacagcgaaaccauaucacaaggagacaguauuugagcuuauuuaugauucuuauggauuuauuuuuaaauuagaaaaccuaauuucuuauuuuuaucuuuauuauuuaguucuuucugcauuuuuuccaguuuuuuggcugucccuuucuuaagucagaugcauaauuccuuuauuuuuauucuuuuuuaaauauucagguguuaaaggcuguauacauuuucuucuaagcgaggcuuuagcuguagcccauagcucagauguguuauauuuucauuaucaauggugucuagauauuuuucaaguuggguuuaaaauguuucuuugaauuaagaguuguuuaucaaagaggguuguuguuuguuuguuuguuuugagauggagucuuggucugucccccaggcuggagugcaguggcacaaucuuggcucacugcaaccucugcuuccugggucaagcaauuccccugccucagccuccuucauagcugagauuacaggugugugccaccacacucaacuaauguuuguauuuuuaguagaaacaacguuucaccauguuggccaggcuggucucgaacuccugaccucuggugaucugcucaccucggccucccagaguaucaaagaguuuuaaaauauccagauuguaagguuuugauaaaacugauuucuaauuuauugcauuguaaucagguaauggggacuuuauuuguacuucagcuucuugaaauuuccugcaauuucuucauaacuuauaaaggccauguguuuguauuacauuguuuuauuauuugauauauuuugaaccacauauuuuagaggggcuuuccuaucacaaacauauuucaaaguuguuugcaaaauauuuugcauuuucuaaucaccauaagugaagugauuagaaaacacaucagggcuucuguggcucaggauuuggugcuugccucacauagacacaaccaguaacucuuacucuugugccaaaugauguaauugcccuaggaaaauguuucuacaccucucuugcccacuuucauugaagaaauggugacugaaucugaaugucaggaaggguuguggguuguggauauggcaacugcaaaacugcagacaauagagauguacacugcuuuugugguagggacaggauuugagcaguggaaaggcauaaauaagaaaaagagaaauuaauucaugauuaagacagauucuggcauaaagaaauugcaguaguaguaguaguaguaguaguaguaguuagugcugaauaccguaucuauuuucuuucaucagaaucugcugguuccauuucauaguucagaggucucacaaauucaggcaauauucacagcuguggacauaguaacuuaggcauauuuugcauuauuaaacgauugaugcuaucuuuaaauuuagguugcaacauaacauacaugaaaucugauaccaagucuucacauuggcaacuagaugggcauugaacacaaaacuagaaauuguuuuauuuuuauaaaauauuuaauaagauuuaauuaaagugucauaaaaauccagcuacauugaaauguuugauuuaaauguuuuuuauuagcuaacccauucuucauuuugcuuuuuaaauucuaauguauaauuuugaauauugugcaagaaauaugacuuucuuaaaaacauuaaaaauuaauuuuaauuuuuucaauguauaauuaauuuauaugcuugaggaaaauauauucaaauuguauacauuuuaaauacaaaugcaguuuaauuucuaauucuuuagaucagggaucagcaaacuuuuucuguaaagaaccagacaguaaacauuuugggcuguuacaacgacucuucucugucacugcccuagcacaaaaggaaucacagacaaugcauaagugaaugggaguggcuagaguuggcccuggggccuuaguuugcagaucccuguauuagaucauaacugccaauagacaaaaaguaucuuaaaaaaaaaccccuugauuauaacaacaugacaauuuuacugaaaugaagaugagaaaaaauaacuuaauuggaauaaauauauaauaauuuaagaaauauuucagucuuuuaaaaaacucacuaaaaugucaucagcccaauaacagaacauguacaauaauaaucaagagcuguugucuuugauauuuggucaauuuucaaucacguaaaaacuagggcuucaccuauacauuuagauuuuguccuuaaaaaaguuaucucauggcagaggauaaaaaacacuucuuuaauggcuuacuagcuggauuuguuaauuuuuaaauauuuagacagaugguauauggccuccuuuuugcccugggccccauaaaccuuagauguaggccugaauacaacagugaucaagagacaaaggcccuacugucuugaauuacagucuaguaaauucuagugcacauccauugacucuaauuuagaccagucaaucaucuauucucacaugcacuacugcaauagcuuuuuuuuuuuuuuuuuuugagacugagucuuguucuguugcccaggcuggagugcaguggcauguucuuggcucacugcaaccuccuccucccagguucaagugauucuugugcaucagccucucaaguagcugggaucacaggugugcaccaccacgcccugcuaguuuuuguauuuuuaguauagaugggauuucacccggccucccaaaauguugggauuacagguguacuguacccacuguacccagccugcaauagguuuuuuauugcucucucuauaucuauucuugcccucaccaaccuauuuuccacauaacaaauuaauauguuaaaaacauaaacuaucaccucuuuccuaaaagcucuucaauuguuuuccauuacauuccagauuaaauccaaagucuuuuaugauuaguauuauuauuuuugagacagaguuucgcucuuguugcccaggcuagagugcaauggcgcaaucucggcucacugcaaccucuaccucccagguucaagcgauucuccugccucagccucccacguagcugggaucacaggcaugugccaccgugcccagcuaauuuuguauuuuuaguagagacaggguuucuccauguuggucaggcuggucuccaacucucgcccucaggugauccaccugccucagccucccaaagugcugggauuacaggcaugagccacugcgccuggcccaaagucuuuuuuuauaacauaugaaaucuuguucuucccuaucuuccaacuuuaucuugugcacuuccuuccuugcccaguauuaucuggccuuuuauuguacuucuaacauauugaggcauuucuugccucgggaccuuugcacaugcaaucaucuggcuacaguguuucuccuuucccuacuccuuuuucggggcuacuuuuuucauuuuuacaucucugcuuaaacauuuucaccuccaagaagacuuguaaguccauucagucuaacauauaugauucuugcuauauucugucacugcauccuguucaauuuccuucacagccauaggaagaaaaccuguaauucuauauauuuaucuguuuacuuguauauuuccuauucuguaaacucuuugagagccaggauaauuuuuauuuuguuuaucacuuccagugcccacaaugccuggaaaucauacauacucaaaagauaguuguuaaaaaaguaaaugaauaucaauucauuuguugaacaaauaaauaugaaauggauaggcacauucuggaccuaucgaaccauucuagcaugaagccuuuauucccagagugauagcaauaucaggguccccccaacuaaugauuuucaagcccacucagauccuuuauucaugcuguauuuccaagcugaauuuccuucccccacuucucucugccuucucaaauauuuauuucuuucacuaauucaaacacacuucucucaacaagucuuugguacccuuuucagccccaaauaauaggucuugauuucuacauuuauuaucugaaucauucacuuuaguaucaucuuacggugccuaauucuuucuaaaucuaaguuccuuccauaguguauguaguagagaccaugugcacuuaauccagccagcagcauggaguggaaccccaaaacauauugauaucauuggcagccuuagccuguguuccccaucugacucuuacaucccacucaggaaagcagacccuaaacaaaggcuuacaacuagguaguuuauuuugggaaaagaacccuagauaaucaaauugaggaacgagggagaguaaaacaggggaaaaggguaucuuaaaucagauucccuagaaguacacucugaaauggguacgcuuguacaagaaauugauugaaauagugcccucaggagaaaccuauggggaaaugagggaguaggaugggccagggaagaagccacggaaagauauggcuucagcuggaguccagccauggcccaaacccagaguauggacaagaguauggaguaugaacagcaccacagaguuauuccccuugacagcuucuguuaguccuuggcuguggacugcccuugaccaggcauaggggauccucuaagguauuucuggggaaguucauuucccucaauagaggguuaauucuccugagaugaguucagcugugagaccuuaguauccaacacucuaagcagcuggggcauggguguguugacccacuaaugguggucuugguaggggaccaacagcauccucuacagagggaaauacaauauaaguauacauucucaagucgauaacaacuacaggcaccuagggcucaaccugcuggaaucuuccgagaaaacuuacaugcuucagauguauauguauaaugugcuucagacaugucuaaacaaggcauggaagagauuauuuauccaccaacucccaguccccaccagucagggguuauuccguggguuaauaacucucuuauacuuccagguugccagucucacucccaaggugguagaaaauagggaugaaaauagggaugcccaaugccacuuaggcaagaggcuucaggucacacuugcccuaaccugguuuccacagcgacagcccuaauacagaaagggagacaagaggaugugagaugugucacaggaaguguccaauccacuaacuacuugcccuagaucuuuggagaauuaaauaaccuguccuacugcuaugcaugacagaagcccuaccagugggggcuaguuggccuucacauuggcuccuggccuucucauuggcucaucuuaggugucuugggcuaucugccugauacacauuuucaguuaggcacgucaugugaccuuacagaccaagguuaugcaaaagagaaaugaaaauuaacuuauuaaucuuaugacaguauugggcucucuguauuuuucucagggucccugacacugaugguauuaucucauucuuuggugaugauuauguguggaauguuucauuuaaaaauuccaguguugucucucaugaaagccugauacgguaggcucuauauacauacuggugaugaucguaauauguguguagcacaaaguagucccugaacaacauuuuuaauggcaaacagugauuccuucccccaacaaauuaaguaaaaaugauaaauuccuacauugaaagaaaucggcaaaacagaacauuuccuucaauucacauaaucauuaagaaguaucauucauaagggguuagaaacauauaauauccaaccuuccuguuuaacagagcccagcaaggacucaaaugcacaguucauuacugucauuaugagagaauuucugccaacaaguuacagucagguuacuaucauucaaucauguugcuaauaggacuaauuucaugguaauuggcauauucuagaccagagaagaacucaaaugguuguggaaucauuaaugauuuaugcuuucaugguaaaaaugacaaucuauuaguuuaccagaugcuggaucaagccaugggccauuaacaggaggguguucucagaacguuuucagaacaaauaccagcuacuuuauuuucagcuugcagacauaaucacaugcauccccuaucagauccaccacuauacugucagauacaucauaaauuaaaggcuccaugggcucauuauuggcucuuauucguaaaagcaacacguugcccuggcaagacccaaaauauuaaaugggcauuuaaagaaacugcaaaauguguaguuuuggaaaaaugaaaucuuccuuaaaacuauuuacaguacucaaguuuucaaaauguccuucauccucgauuuugccucaauauuuguuuuuuuguuuuuuguuuuuuaauaaaagcaaagaaaaaagaaacaaauuccugcccugucaggaaagcuuuuaggccgagucucuuaggaacugggugucauuuauuaguaaaccuaauaugcugccuucagaagaacagaggugccagcaucaaauaaacaggcuuaaaaaaaaaaauuccaggaaacuuaauguacacuacguuaguaaccaggacaacucuuguuucccagcaaucuauggcauagauacguugguaugagauaaagccuccaucuuuccugaaucuucaaaacaaauguaaagcugauuaaaauuccucuucugucuugccuauguacaaggcugcucucccaauaccaagcaauccuauuuggagacaaugggauguuugccaaaccaaaccgaaauaaauaaauaaauaaauaaauaggagaguuucuguuuucaacuguugauggcaucacccuugccauuuguggugaucagauuauccaccuagaaaguguaagaaaacaagucuuccgguuagcacuuacugggcaaagggcugaguuucaagaaucacaacugaaaucggugggguugcucuuuguuaaugggaaaaagcaccauguuaaagugaccagggccuggugugugcaccgcaugaucugugagcaugaguugugugugcaacaugcuuccucgugauuaccgccuauacggacagucacugugcauuagugcauugguagccagccgccgccaaaaacaggauggcauucuuccaucgugauuagagguuuugugagcauuuugggaugggggacacuuucucaguaaagacucuuccgccccauucacguucauucagcucuuucuaggggaaauuaaaagcugcagugauaaucccuuaaggacaacuuggaagaguauaaaaggugcaguguauaagcaauuggaugagaaagccuuuuauguggaaaguuacugaauggguggcugaggguggugugaguggggagaaagaggggcagcuuuucuuuucuaagguggggagcagcggggauaucauggcacuucaguucccuuuaaucauccagauuccuacgcugucccugccccuggugucaccuuguuuugcagugccagcuagcuccucccugccauuuuccccucaaagagggagaggggagcaaugcgauuuuugguaaggacccaguuucucgcugaaugccaacucagccagcuggcaccgaacaggccaagccuucuucagaagagguuagcaaaauccaaauuagcaugguccauuuuaaaaacuugcuuuuauuuaaagacugauucaugacaaacaguggcucccguacugaggucuggcaccccaggggcuggcauccaaccaaacacaugcaacuaauugccacccucggaugacacgcaacuaacaagcuccauuuugaggcaguagauucacuaagaauguaaccccggaaggcagcggaggcagaaaagcuccuuucauaacccuguccuaggcuaaccauggcagcagagagccugaaaaacacuuuuguuucauugcaccaacaauuuagcuccacggagggcuacaaacacggcuaacuugcugaaaagugaucaagggcacugcgaucccccucaugguuauaggaggcaggggcucugcuuuucucuuugcucaaggaaacacacaaaauugccuacuaucuugaaacuccgcaucuugcaccauuugcaaaucuaucgacccccaguacuuccccuuauacuuuaguucagaugcucucaggcuuccuuuguacaagcaagggcucuggagccaggaugccuagguucaaaucccagcuccaccauucauuaguaauuggcaaguauuuuaacccaucuaugccucaguuucuucaucuauaaaguggagagaauauuagcaccuacauuacuacgaguaggaacgagucaauguaauaauguacauaggacaaugccugacauaucaucacucuguuaugaaagcucuuugagucugagauagcucggccuuaugaagaaaaaauuucccuuugcauaagcugcauuuuagucaaaguucuugcuucccuguaaacuucuagagauucaaccucuaagccuuuguuuaccauucuuucuccucucaacuguccuuccuccauugcacagcccuguaugacuaaaucucaucauccuccaaaaccauucuucaaugccaccuccuccgaggagacuucucugccaucccagcugccaugaaucccugcacucuuggcauggccauggcaauuucugcaaacaaaugacuguguuuuacuugccuguuauauuuccuuuucuagacugacagauccuuuugagcauaauccacgaguaacuagcacauaguagauacucaaugaauauuugguaaagaaguagauggucagaugaaagaauugcucugcauaaaugaguagcuuuauacuaugguuaugcugggcauuacucaauaggcaggaugggggaaucguuucuuaaggacuuucauaguugcuuuggcccaaauuaagaguuguauuuaacuugucaucaacugaggcucauaaauaaaaucuaucaaagaaauaugucaauuaccaccuuagucagcuugggcugccauaacaaaacaccaaggauuguguggcuuaaacaacagaaauuuauuucucacaguucuagaggcugaaaguccaagaucauggugucagcagauucuguuucuccugaggccucucucccuggcuugcguauggcugccuuuucguucaccaugucacauggucuuuccucugugugcuuccuccccuaguaucuccucuucuucuucuuauaagggcaccaguugcauuggauuaggucccacccuuaugaccucauuuaacauuaauuaccuuuauuuuuauuuuuauuuuauuuauuuauuuauuuuugagauggagucucgcucugucacccaggcuggagugcaguggcgcaaucucggcucacugcaagcuccgccuccuggguucgugccauucuccugccuuagccucccgaggagcugggacuacaggcacccaccaccacaccuggcuaauuuuguuuuuguauuuuugguagagaugggguuucaccguguuagccaggauggucucaaucuccucaccucgugaucugcccaccucggccucccaaagugcugggauuacaggugugagccaccgugcccugccuaccuuuaaagggguaauuaagguuaccuuuaaaaguugucuccaaauacagucacauuagggauucaggcuucaguguaucaauucaggggaauacaauucaggccaucacaaugacauauacauauagaagcaugaauauucuguauauuacuuaagugcauaggaggaacuuaaccauaggaaguccacaagccuuugcuccuuaaguccuggcauccagaucuucauuauguuagcaaaaguucagacaauggaaacaaauguggcacucaaauacacaacuauuuuaucuagaugaaaaauuaagcuuucuuuggaauuugugggauucaguuggggggcucaguugcuucucucuuagaggcaggaaaacaucagcaccccaggcagcagccacaacccugucuccuguuaaagccauugccucucccaagaacaaaugcaaauucccagcuaaacuccugugcacuuucuaggaggaggcucacuuugguccuucuaggaucaauuuaucugaaucuuuucuuuugaaggcggaccugcagcuuuauguagcccugaaacucugaaccagcuucucaugccagcaccccuucuuuagucacuucauaauucaaauugcuguuaucagcauacacuauuuguacugauuugacuuuuucacauuguuuuaaaucacuaauuuccuauuaggcagauuccucacaucaauaccauaagcuaauggcucccaugguauuuguucauaucuuucucuuaagauacuuaacacuuuuuaccugguaggaggaugauuuauagucauaugugucuuucuugccagaccuuuuaacuacuuaagguuagaauugcaucaaacccauuguuuuaucccaaccagugcuuaacaugauauggcacacguagcagagucacaguaaaaguuugcuguaauucacauagacuuugccaggagugcauagaaggauuaagcaucagaagcaaugcaaucgcaaagguaucucguaccaucaaggggugaggccaacaucuuagaaaauuaagaucaaauaucauccuucauuuuuaauuuaaagcuucuagccaguugacccagaaacaucccacaccuccaccaugacuuaccaauuugucugaaauaauaaagaggaaaaugagaggcuauuagcgccacuuccauucuccagucaaucauuguucuaaauuauuaaucaguugaaguauugccaagaaauuuucaggccucucuccaaaaguguaaaguagucauuuucaagugaacaauuaacuauuuuauucaucuagaaguuguagaauuuauagacaagcugauuucuguggauuuucuuccccccuuuuggaugcugguggagguaagagaggucuacaugaacuacaaauaguuuccuuuccaucacucacuuauuaauaacuagaauccuguuuaaaaggaauguacuaaaauauuuucuaggcugaagcaggaggauugcuugaacccaggaguuugagacuagccugggcaacauagggacacccugucucuacaaaaaaaaagaaaaaaaaaaagaaauuaaauuagcuggguaugguggcaugugccuguggccuuaacuacuuaugaagcugaggugggaggacgccagagcccgggagguagaggcuacagugagccaugauugugccacugcaccccagccugggcagcaaagagauacucugucucaaaaauaaaguaaaauaaaauauuuccugaccaguucagcauuuauaauauuguuccuaauagcaugccacuccugacugaucauugcuggcaaaagcaaagugaucgauugucaccacccuguuuguccccaggauuaacuugguaaagaaguacagccaugguuucugcuuucguggagcuuacauucuagaggagacagugaaaaagaaagguaaauagacaaaugaaacaacuacagcaaauuuuacuaaaaaaaaaauaaaauaaaaaaaggaaaaaagaggcuaagauaaagaaaggggagguguaccuuaaauaagaugucgauaaagaccucacuagcaggaaucauccuccguggaucaggagaauccugaaacuggggaccucauaggcaguccaauccaaagugugaauaggccaugaacauuuuuaaaacuauauauucaguucuggucaucuauugaccucagagacacuagauuuccaguggcauccacuacuaugacugcaauugcugagggguaauuuucugagccagaguuguagcaugcaauuugccuugucauucucaucugaugcucauuaauagucccaacuuuuauguaagguaugugcuuucaaagguagugugauauguggcuaaaaauauugauuuuuuucuuuuacacuuuuguuucuuuuaaaaggaggaaaagugagcacuaauuuuuuuauuucaacuguaucuuuugaagguucauuaugcauauauuuugauaaucuugucuaugagaaugaacccuaggacaauuaaauauccuuuaauuuugagauguguagucuggaaauaccuacauggccguccuaggcuuuagguucauuuucuuugagaggcucaaccccauauuauaucagauauauuuacaggucaaaaggcaagauugaaacaaauuuaguuuaaagaucuuaacuggcuuuuauuugugauucuagaaucagacaaaaccucacuguauaaaaaagaaugaguguuccaaugagcugagcagaggagguuuccuuuacagcuggaaaagggaugaagaaagcagaaacaaagaaccaaaagcaaauugguuguuuccaaguuacuuuccuuguaaagguuaaagcagagggacauccuuaucauauuggcuacaacuggucuaguugaggauuuggcuacuaguucuccccccugauuucuuagaaggucagaugaaaaacuugguuuuggcuugguggccaaaacuucagcaugaguaauucuauuuugguuuggacuguugagcuugguucaguaguucaguccaaaccaauggacuucuauaaauuuuauucaacauacacgaaacaguuuuuguaugugagaucugugaaaaauauuuuuauacuuuugcauuuaaaauuauuugcuuauguauaauuugguuaauuuaauuuuuuaaauugccuaaaauuucccaguaaucaacaugcaguuucaggaauucuuaagaacugagaaaagcuaacucauaaaaugucucuaagaguagacauuuuaauaacuauuacauuuaguaauuaaucacaauagcauaaaauuucauuuauugacauaucauuaaauaugacauuguucagauugugcaauuucugcauacacugaaaucaaaguaguuuuucucucucuguuaguucugaauauuuucauaggcccuugaaaaauacauuggcccuagucauuaguuccugguaccuaaagauuaaagaggcaauagaauauguguguauucccaggucuuacauggcacuagauagugggggucuuuucccccuaaauaaaguggaugcuauuauaaccaugcaugacuccaguuagacccagaugaauguaccaaaaucacuaccauuuaaaaagcauaaaaaaccuugcccucaauuuacugugauuugcaaacucuccucugaaguuucacugaaccccacuuauaaauaucaucuugcuucuuuagcaaauucucaaaccuuaguacauaagaaucacccagagcucuuauuaaaaacagauuccugggcccugaccccaaagaaucuuauuuaauagaucuaaguggagcccagaaaucagaguuuuuaaccuucugaaaccuuaaagguuguauaagccuuuagaaaacauuaguugaugugagcaggguugaugauaacagcugguaagauuagucuugacuugagcuacugaacaacucaaguccauuuaggcuagucucucucaacccuggcucauacuagaauccccuggggcuuuuaaagcacuuuacccccaaggauucugauuucuucuguaugggcauugguauuuuuuaaagcuaccauauaaacaaauugagaaacccuaccagccuaagggcauuucugucagaaaggauuaacccacacacugcggugaugauaaggccuaacacuccuacaaaaugcaaacacugaagcagagauuucgcaagacuaaaauccaucuggagcucuugauucccaguuugugucagccucaacacacccaaguuggccuuaacaguuauggcacaagaaaaugagcccuucccuuuaguuuucaucagcuggcagaaugauuuaguagcucuauuauaaaagcaacuccauuauaauuacaguguuugaauuauaaacaaaacaagaaaaauacagaaggaauaguccuuuagucaaaacuguaaaacagaacaauuucuggcugcaguuaaaagcaaacugaaauauuaagaguaagcucuccagcccuuugauucuugccucuuucccauaggagcgacacuacacauuuuuucaauuaagcaguuugacaaccugaagaaacccacagugcaugauuuaaugagcauauacugugugcaugguaaucggcaagcugacaguuugcucauuucaaacugacaagagagcacuacacauuaguagaaagguuucuugggucucuuuucauuaaauaagcuuuacaguugaggaacauuccaacuguauuggcaaagcugucacuaaugguccccaggcaaccuuaacucucugucacucuccaaguccucaagucuugaugaagaaauugcuucuuaaaaaacaaagcacaaaaacaaaauauagauauuuaaaguucucuggauguugucaggggcaagguggagcuuucugagccaugaauccacuggugauuucacaguacaugaauucuaacccaguaugugcugguucuucaugcagaucacuuuauaaacuggaauuguuuuuagaaauaaugcccaaacuguuaaauuauucaauaguuuagaaaugauucaguguacuggaaaaaacauaggccuuggugacagagagauagggguucgaauucugacuaaaauacuucucuguggccuuggucaaauuacaucauuucucaggggcucaguuuccuaauuuaugaaacauggacaauaacaucugcuuuguaugaacaagaucguaaaagucuuucgcacaguuacugacaacacaggcauacuuaaauagagacuaguuuacccacagaaauucagaguaugggguuuuaacaaagcuaacuauagucugacuguccugagauuucuaccaugagccuuuauuggaguucuauaagaagaaaaacaguaagcuaacauucacucacaaaugggauuuuauuuaauccuacuaagauucugaauuuuggguguuauuacaccuguuuuuauaaaaucucgaaauaagaaggguucuuagaggucauaugaggaauuucugacauuuuaacuuuucugauuacaagaauaugaaacuacuguuucccucuuugcucugcuugucagaaaacucgagugaauucucaugcuaaauguauguuugcaacucuguuagcaguagcgguuagcagauuuguuuccugauuuucuauacauauguuaguaaccuuacuuaaaauaguuuauaagcuacccugaaggaaguugagauuucuuagcuaacuaguaagauccauaacaagaauccaugucaccugacuccaggcuaggacaccucacauauaacauggaaaugacauagaaaaccccagaagcaaguacagugaagccauagcuuauugcuuggguccuaugccaugaagaugaucaaacauauuagccuucuaguuacgaggaaaaaauauggaagcuucaggguccuuauuucuaaaauagggauaauauauauuucuaagaucauuguaaagauuuagagagaauauuuucaaaaucagccaguguggcauucgauacauaguaacauuuuaaaagucugaaauguugacucuaagaaauaauuguaguucuacuaauuacaaguaaaacacaaaugcauagacccuuaaacaugauuuagaaaucauuuaucccuccaaacuucacgcacugauguaaaauucugccccaggcuaggugaagauccauacuugcugucuuucucucaugucacagaguacauggagaucuggaaaaguuguccauaaauuccaaauucuuaauauaaacaugucuauuggaaauacagacucuuuuuuuuuuuuuuuugagacagagucuggcuguuguugcucaguggagucaucuuggcucacugcaaccucugcuuccuggaguccagugauucuuuugccucagccucccaagcagcucagauucccaagcagcaucaugccuggcuaauuuuuguauuuuuaguagagauggaguuucaucguguugcccaagcuggucucgaacuccuggccucaagaaauccacccacuuuggccucccaaagugggauuacaggcaugagccacugugcccaaccagaaguacagaacuuuaucaagaauacacacaugugacauuuucagguuuaauaauuuauacuucaggguacucacaaaacugggccaaaaucauggucuaccucuaugugaaauaccaaguuucccuaugucucacagccaugacuccacuggugacuucacaguacacgaauucuaacccauaaauugacuauauccagaauguagccagacauaccauaaagauguucauuuaucuucaagggaguccacaaaaauagcacuguaguuccucauaugcauacccuaacaaaaaugagucagugguguuuccccagagaaaaacgaugcugugcaguggaagcagcuuuggaaacagacagauucagauuugaaggcuggcucugcuauccauuaguuguaugacauuggacaacauaguaugaaccucuuagagccauagauucuuccacuggcaaauggaggaaacacuuugaacuuauauaacuauuguaagcagggguuauguuaugauuuaaauguccccuccaaaaauuauguuaaaauuuaacugccauugucaugguauggagaagagggaccaucaagaggugggaccacugagagaugauuaggucuugagagcucuaccuucauaaauggauuaacaucauuaugaagaaaguagguuuguuaucaugagugaguuauuauaaaaaugaguuuggcccucucauuggcucauuuucauuuucuccugcccuucugcuugccuccaugggaugacaagcacaaaggcccucaccagaugccagcaccuugcuguuguacuucccaacuuccagaaccaugaaccaaauaaauuuauuuucuuuuaauaaauugcccaaucucggguauucuguuauagcagaaacaaaauggacuaagacaaaugauauuuaaaauauuuaaccauuaguaugguaaaggcaccaaccagcauaggcuuaaugccuguucuggugcauacuaauuaaauaugaacuccauuugaagaauuuugaaggcauccaacuugauccuagaucaugggaggugcuuaaacauauacaacgcauuaaaugaagcaaacacguguuguaaaacauuacaauaaaaaacuuagcagcaguuauacugagaucucuauacucuccaauuacauuuuuucaccuguguuguuuuuauuccaugauuuuauuaaaugauuguuagcuuaaagugaugagccacuugcgucuuuugacucaugauugagacagucgucaaaaaauucuagauuugaaaagacauaaagugaucucacuuggaauuuuaucaagucuauauucauguauaauccuuaugucuucuuaauuuaaugacuccuuuauuaugacacacucuucuucuuuaucucugauaauauuuuuugucuuaaaguugaguuugucugauauuauuauagccacucuagacuuccuaugcuguuuccaugguguauuuauuuccaucaauuuauuuuaaaccuaucuguguuuuuuuauuuaaaggcuaucucuuaacagaacauagcuguucuugcuuuuuuauacauucuaaucaucucagcauuuuuuugaauauuuauuuauuuuuguuuguuugguuucuuugcccacaaaacuuauucauuuugucaaucauuugaaaguagcuugcauucauaaagcccuugggcuuaggucuuuuuaaaaaaaauucauucaucuguuuuuauguguuuauuuuuucaaguuucauuuuagauucaggggguauauuugcauguuucuuaccuggguauauugcaucaugcugagguuugggauaugaaugguagcauuacccagguacugagcauaguacucaccauuugguuuuucaaccuuuuccccucucccuucuucccugcucuaguaguccccagugucuauuguuaccaucuucacguccacacguacccaaaguuuaguuccuacuuacaagugagaacauguggcauuuaguuuucuguuccugcauuaaauugcuaggauaauggugucuggcugcauccacguggcugcaaaggacaugauucgauucuuuuuuauuacugcauaauaucccaugauauacauguaccaaauuuucuuuaucugauccaccauugaugggcaccuagguugaguccauaucuuugcuauugugaauagugcugugacaaugaacaugcaaguacaugugucuuugguagaaugauuuguuuucuuuuggaucuauacacaguaauggaaucgcuggaucgaaugguaguucuguuuuaaguucuuugggaaaucaccaaacugcuuuccacaguggccgaacuaauuuacauucccaccaacaguguauaagcauuccuguuucucagcagccucaccaacaugugguuuuuuuuuguuuguuuaguuuuguuuuguuuuuguuguuuuuuuuuuuuuuacuuuagccauucugacuggugugagaugguaucucauggugguuuugauuuguauuucucugaugauuagggacaaugagcauuuuuucauguuuguuggccacuuguaugucugucucccuuugagaaguuucuguucaugucuuuugcccacuuuuuaaugggguugguuuuugcuuguucaaucauuuaaguuccuuauagacuccagauauuagaccuuuagugguuguguaauuugugaauauuuucugucauccuguagguuguuuacucuguugacaguuucuuuugcugugcagaagcucucugguuugauuagucucacuugucaauuuuugguuuuguugcaauugcuuuugaggacuuagucauaaauucuuucccaaggcugauguccagaaugguguuuccuagguuuuccucuaggauucucauacuuugaguucuuacauuuaaaucuuuacuccauauggaguuagcuuuguauauggugaaauguagggguccaguuucauucuucuguauauggcuagccaguuaucccagcgccauuuauuaaauaaggaaaccuuucuccauugcuuuuguuaacuuuguugaagaucagaugguuguaagugugcagcuuuauuucuggguucucuagucuguuccauugguuucugugucugucuuguaccaguacuauacugguuugguuacuguagccuuguaguauagcuuggaguuggaaaaugugugccuccagcuuuguucuuuuuguuuaaguuugcuuuggcuauucagucucuuuuuugauuccacauguacuuuauaauaguuuuuuccaguucugugaaauaugguagaguaguuuuauaaacuaccuguauaaaaccuguagauuauuuugggcaguauggccacauuaaugaaauugauucuuccaauccaugagcauggaauguuuuuccaucuguuugugucuucuaugauuucuuuuagcaguguuuugugguuccccuuguagauauauuucaucuccuugguuagauguauuccuaaguauuuuauauacuucuauuuuuucaggcuauuguaaaugagauuuccuucuugauuuggcucgcaaguugaacauuauugguguacagaaaugcuacugauuucuauacauugauuuaaugaccugaaacuuuacugaaguuguuucugaguucuaggaggcuuuugguggcgucuuugaguuuuuuaggaauagaaucauauugucugcaaagagagauaguuugauuucuucuuuuccuauuaagaugcauuuuauuucuuucucuugccugauugcuguggcuagcacuuccaguacuauguugaauaggaguaguaagagugggcaucuuugucuuguuccaguucgcaaggguaaugcuuucaguuuuugcccauucaguaugauauuggcugugguuuuaucauagauggcucuuauuauuuagagguauguucuucagugccuacuuucuugaaguuuuuuaucaugaagggauguuggauuauagcaaaagcuuuuucuacaucuagugagaugauucuaaggcuuuuuaaaaauccuauuuauguggugaaucacauuuguauuugcucauguuggaccaaauuugcaugccagaaugaagccuacuugaucauaguaaauuaaccuuuugaugugcuguugaauuugguuugcugguauuauguucaggauuuuugccucuauguucaucagggauauuggccuguugauuucuuuuuuuuuauuguguguuugucagguuugguaucagggugaugcacagaaugaguuugggaggaguugcuccucuucaauuuuuuggaauaguucaguagaauuguaccagcucuucuuuguacaucagguagaauuuugcuaugacacugcuacauuuuaauuagugauuaguccacugacauuuagucugauuacugauaugauugcauuuagagcugcaaguuuauuauauguuuucuguuugcuccuccacuucuuguuuuucuuuuucuucccucugcaacuuuuggaucauuuuuuucuuaauuuaggauucuauuuuaucuuuggauuuucggugguuuuucuaggaauuaaaacguauauucuugaucuuucacagucuacuuagauuuaauuuuauacuaucucauauaaaauuggaaaaccuugcaacuguauaaauccauuugccacugccuccauucuuuaugcuauaaagucauauggauuacaucuguacauauuacauuauaaacaccacaagacaauguuauaauuuuugcuuuaacagguccuguguaguuaaagaucuuaucaugaaaaacuagucuuuuauauuuacaauuuccaaaauuuuuucauuccuucuugaagacuuaagauuccaucugguguuaucucacuuuauagccugaacaaucuuuccuuuagcauuucuguggggcaggucugcugauaauaaaugcucuuaguuuccuuuuaucugaaaauguacuaauuugccuuuacucacaaaggauauuuuugcuacacauagaauuccggauuaacaguguuuugcuuuuuuuuuuaccccucguuuguacuuuaaaaacaucauuucacuuuuucuggccuuuauaaauucugaugagaagucaucguucauuuaaagcauuguuccaccaaagauaccgugccauuuuucucuggcuacuaucaagauucucucuuuauugcugguccucaccaguuggaauaugauguaccuaugcacaguuuucuucaaauguaucccauuugggguucacugcauuucuugaucuaugcauuuauguauuucaccaaauuugaaaauuugggcccauuauuucuucaaauauuuuguucuguuucauucucuuucucuucuccuucugagacuccaauuacauguaagcuagacauuuuaauuucuguuacacaggucccugagucucuguuuauuuuuuuuauucagucauuuuaagucuuuuuuucugucuguucuuccaaaagaaaauuucuauggaucuaucuuuaaguucacuaacacuuuccuuuguuuccuccaguugcuguaaguauacucaaugaguuuuuauuucaaauacuguauuuuucaguuucaggauuucuauuugguucuuuuugcaguuucuguuuacuaccuucuuauucauuaugaguuuauuuuccuauuauuuguggagcaugguuaaaauagccacuuuaaaaucuuuguuaauucccacauuuggcucaucuuggaauuggucucagauaauugcuuuuugucuucagaaugagucacauuuuauuggguuuccauauagcguguaauuugggguuguaugauaugcaaguauugauguuauuguaugaagagcuucaauccuguuauaguuuucugaaggguauugauuuauuuguuuuagcaggcaauuaguuauacucaaauuuaaaacuauccccuggguagcagcucgaaucucaguucaguucuuuuaucuuugugauaauuugugucugcuccaucaagaauauacacaugacauauaccucagaauuacaugacgugaucucacuuggaauuuuaucaagugcauauucaucuacaauucuuacuucuucuuaauauaaugauuuacuaucaugaaauguucuccuucaucucugguaacucuuuuugucugaaaguuuaguuugucucauauuaauaaauucaagggucaaccagaaauuuggguaguguuuauauacagauuugggagcuuccccucucugccucucuucuuuccaagauucugaauucauuuuccuguggcuaugauugcccugaacccuguucuuugggucuucaaaccaaaaacacugugaguuuucuauuggaggauggccacccgaagugacauuaauuuuagccuguucucacucuaaaaguuguaaaaugggaaacucacucuggaccgaccugugcuuccaaguuuugaauuucagcuccccuccagaaucugucugcuuaauuuuauucucuaaugcuuccagguaauuucuuuuuucuuuucuuuuuuuuuuuuuuguuuuuggucuuuugguacuuuauaguugauaucugugagaauuucggauccaguagaacuuacuuagccauauuggaaauggaaacaaguaaaaacauuuaggaaacauuccuuugcauuuccuaacaccucuccucaaaauacuuaaccuccguccauucccucauuuagugacauuugaguuugguuuuaaguagaaauagaagccaggcucagggcuuccuugaucaucuugccaaguacaugagaagacuuggaaugaaaacacagcauaaaguuaaaugauagaaugauagaacaucaaucaauucuagcucuuagacugguggcauuuaaucucaaagcaaugaggcuuauacagaaucaugacuaccagugauuaucuacaugguacuuugccacguuauuuuaccuuauuucuuuggucucagauaucucuaaauccugccucauugaaaacugcaauagauaauaugccacgagaaacagaauacugaaaauccuaaaaugccaacccagaguugguaauugcacaauuccuucuaaucauaaucauuauggcuuccacuucuugaaagcuucuguauaccagccaccuugcuaaccacuuuacauuaauugucaguuaauccuucacaacuauucuuugagcaguucccauaacuagcuucauuuuacggaggaaguaaccagaguuccgagagguugaguucacuaagagcacacagcaaacaguagaacucugagucagucuuuguaaagagaagaaauagcaaagggguuuuggagacaucaggcacauacucuuuacuauuaggagagaagauagaagucuuucuaggaguaaguaggguuucuaaaacuuaaauagucuacaguccuuuuugucaguaauuauugauauuaaaaugccacccuuccagaaacaauauauuuuauauugacagcuuuuauguuuaaaaagaaccuucuagccgggagugauggcucacaccuguaaucccugcacuuuggguggcugagguggguggaucacuugaggucagggguucaagaccagccuggccaacacgguaaaaccccaucucuacuaaaaauacaaaaauuaggugggccugguggcgggcacuuguaaucccagcuacuugggaggcugaggcacaaaaauugcuuaaacccaggagguagagguugcgguuagcugagaucacaccauuguacuccagccugggcgacagcgagacuccauuucaaaaaagaaagcccuccuucagggcuuaaaacacuaacccaaacaauaacaaaaggaucaaauaauuauauguaaaggcucauaugaaaaggcacauaacaccagugcuccauuuuaccucauuucauuuacugccuuuaaacuuuguuuuccagguaaaccaucuaaacaggcaggugaccugccagagaaaaaucuggcacauuaggaaguaaagaugccugccucaucccacaacaagaugcagcaaugucucacaguucuacaacucuaggggcaauccugcccaacuuugcaaauuuugcauaaaccauggguuucaagugacuuuggaaugagagggaaagggaaggcagcacgaaggauaagcuggcugacauuguaaaguggauacaggaaacugggacuuaaccggaagcaggaaaaggaauauaguaucuuuguguucugguacauaggauuauucaauauacauauuuauuauacauguuaaauugucugagacccggaaaugagagauacuguuaaaggaguaaagaugagaugagguaacagaaaaggagaggaguaaauaugaguccuaaggagggguuacaugagcacaguccccugacgacaugcuagagauuaccagauuagugcauugcuccuacuuucuugcuauuauuauuauuauuauuauggguuuuuuuuggcagggucucacucugucgccuaggcuggagugcaauggcaugaucuuagcucacugcaaccuccaccucccggguucaagugauucuccugccucagccuccugaguagcugggauuacagacaccugcuaccacauccggcuaauuuuuguauuuuugguagagaugagguuucaccauguuggccaggcuggucucaaacuccugaccucaagugauccaccuaccucggccucccaaaguacugggauuacaggcccuuuccugcuguuuuuaaaaauacauauucaacauauccggugaaaucauucaaagaugcauacagauaagugauuauuuuacucuaacguaaagccucuuuguaagaccuacccuucacugucugucccagcauaugcccuaggacuuccucugaccaugaacaguaccaugccacugaaggagaucuguuucaacagagccuccuccugcugcuccuaacuuuauuuccauuccacuagcuucucaaagucaugcaaaacauaacaaccugacuuuguaacuguuuaaccuuacuuuuuacacguaaaaauuauuaaauauguguaacugcuggggggaggauaauauaauggcaugucagucagguaacagguaagcuacauuucauggaaaagaaggggaaugcuuucuucagaaagugaagucaucauucuuuuauuuaacugacauaauauuuauaccccaauuuuuaaaauggcagcuacaaauagaagucgaaagaggguaaauucuccaagggaaucuagcccugaaauuuuaccauuuuaaaaguucuauuuuacaaguacauaggaacauuacuacuauuauaaggauacucacagcaggucaauuauuucaaacucuuugaaaaaaaaaucaaaauuaaguaaaccuaccuuucagaagacugcuaccucuucggaguccucaguggcaggaugcacagagcuuuuauagagggucuaagcaggcagguauuccuaggauaccuacaccaaggacaagaaauucagaugauuauuucagcagugauccagauggcucuagguacaauuucauuaggaacguucaccaugaauacugagcauugccacacagguacuguuaaaagcgcagaaugaagguacauaugugauuuuugcaggcauugucauuaaucuguacauuggagacuguggcucaaaaggguguaagugguucauacaugaucacacaagaaaaggggcagaaccaugccuuaauuauucauuucugauuccuaguccaggguuguuucagccacaucaucugauccuccucaagaacuggaaaguccuggcacuggggcuuuccauuuugcaaaaagaugaggcugacccgugagucuggugggaagagucuuucucugguuuucugguggucuaugccaagucaccugucugaaguguccuguguggccaguuuacucacuuucccuugaaacucugguguccacagaaucugaaggaaucugacaagcaaagaaacauggguuuuuuuggucccacuggccugaguuugaauccuaguaauguguuuacuacuucuguguccuauguagcugcucaacaucacugaggcucacuuucuaucucuaucaaacggguauaauaauauuugaaggguacauuuaugaagaggauuuuuuuuuucuaaaugagaauaaaguaucaaguacaguuucuggcacauguuagaugcuagggcaaagugaaagccccaugacccaccuuacuugcagggauaaccccaaaguggacaagugacagggaggcuauugagaccuugcugcucauaaaucacucaaugacaaugcacuaauccccuaacuggcugguuccucacugcucugaccucuaccucuggguuuccuucauguacacuucuuugaaauaaaaauaucauaaacaccaauucauucccuaggaucucauuuagagguaaucguuuccuuuuuuaaucuaauaaucuuggucuacaucauguuacauggucagcucaauguaguaauugaaagcagaugaucauucauuuaacaaguauuuauugagacucuacuaaggugucaggcacuauucucuauagcaguggacauaauaguccaagaucaggccaucaugcugccuaccuucugguagaggagacaaacaaacaaaauacauauguaaaauacaugagugguuaaauaguucuaaggacucuggagaaacacaaaguaggaagggagauggugaguacuauggguugaauucuguucccccaaccccuccccaucaggaaaaaagauauguugaaguccuaacccucaguacuuagaaugugaccuuauuugguaauaggauugauacagauauaauuauuuaaguuaagaugaagucauacuggagaucggugggcaggccucucauccaauaugauuggauauaagaggaugaccacgugaagacacagagacacaggggagaaggaacgccaugugagaauaaaggcagagauuggaguuacauagcugcaagccaaggauugccagcaaaucacuagaaguuaggaaaaggcaaagaaagauuccccugcagauuucagagggagcauggcccuggugacacuuugauuucagacuuguagccuccagaacuaugagacaauaaauuucgguuguuuuaagccacucaguauaugguacuuaguuacugccacccuaggaaaucaauacaguguguuuggggagauuguugcauuuuugagcaaggagaucaggaaagaucucacugaaaagguaaugucucagggaagauuugaggugcaggggacaaccaugaugauggcucuggaugaagaaauucuaggcagagggaacagaaaguacaaaccucccaggcaggugcauguuuguauguuagaacagcagggaggccaguauggcuggaauagccaggggagaguggcaggaaaccaggucagagugaugacaaggagcuggagggugcuagaccuuaugggccacucuaagaacuuaggcuuuuacuuggagcaaggugggaagccauugccuacuucugagcagaggugaaccaagaucugacuuacauuuuaauaagcucucucuggcuauucgguaagaauaaacugaagaacaaggccacuuaggaggcuccugcaguuauccuggugaauaaaggugcuagccagguagcacacaggagagugaaaacuggucaguccuaugcgaaauauuuugaaagcagauccaaaaggauuugcaauagauugcagguagagauacgccugacuucuugauaguacauagaauuaaauuagaaaccguaacaacuuaacuguacugaucaucugaauaaauuaucuucucaaaugccagaccagccaaagauauuagcaacagguuuaacagacagggaauaaguaaccagaauauauaaggaacuccuaaaaucaacaaaaagaaaaagguaaacaaauaaauauuuuuuaaaaucaugauucaaagaaggaacaauggaccauggacauaagaaaagcagcucaaccucacugauaugguuuggcuguguccccacccaagucucaccuugaauuguaacucccacaauucccaugugucaugggaggaaccuggugggagguaauugaaucaugggggugggucucucccaugcuguucucaugagagugaauaagucucgagagaucugaugguuuaaaacaugggagucucucugcacaagcucucuauuugucugcugccaucccuguaagaugugacuugcuccuccuugccuuccaccaugauugugaggccaccccagcuacacggaacuguaaguccauuaaacuucuuucuguuguaaauugcccaaucuccaguaugucuuuaucagcagcaugaaaacugacuaauacucucacuaaacaugaggaaaaugcaaaugaaaauaaugggauucuacuuuauuucuaucagacuaguuaacaugaaaaagacugacacaauucaguguuguccaagauaugagaaaaaauagcauauuauucuaguuuacuuccagcggaaucaugaauugguauauuauucuauugagcaauuuuacuguauuaucaaaagugacaguacacauaugccacggcauaguaacucuucuugggggguauaccagggcuaagaaacauacacauaaggggacauauauuaaaucaguauaacaaaacuuggaaaugaccuaaaagucacccuuaaaggcaaaucaguaaauaaaauaugcuauauuuauaugauuaaaggacauauggcuguuaaaaagaauagauugguuuuauaggcaucaguguggauguuucauaaaugucaugggcagaaaagcaacacaaaggaaaauguuaacauacaaacacaauaguauguauucauuguaggucgggguccccaaccgccaggcggcagaccaguaccagucuguggccuguuagggaccaggccacacagcaggaggugaguggugggcaagcgagcauuaccgccugagcuccaccuccugucagaucagcggggacauuagguucucauaggagcaggaacccuagugugaacugugcaugcgagggaucuaggcugccugcuccuuaugaugagacccuaacgccugaugaucugagguggaacaguuucaucccaaaaccauaccccccaccuccccauccauggaaaaauuaucuuccacaaaaccagucccuggugccaaaaaguuggggacugcugcuguggauacacauauauguauguaaaaguauaaacaacggacuagucaaauacaucccaaauuuaugguagggaauuuuaggcagggguacaggcagcaaagaaaguggaggguggagggaaggacaggacauuauuggugaaaaugauuugguuuuaucaauaacuucuuuaaaaaggaaaaaaacaacacuggaagcaaaucugaccaaacaaaaacagauacucguuuugggauagugagaguacagaugaucauuacacuaguuuuugugcucaucugugcuuuuuuguuuucugcgaguaaagaaaggaggaaagggagggagggaugaauggauggaaggaaggaaggaaggaaggaaggaaggaaggaaggaaggaaggaaggaaagaaggaaggaagggaguuaccaguucuggacugcacuuaagcuaaucgcuaaucauagauggggauagaugagguuaguuuuuuuguuuuguuuuguuuuguuuuguuuuguuuugagauggacuuucacacuuguugcccaggcugaagugcaauggcacaaucucggcucacugcaaucucugccucccagguucaagcgauucuccugccucagccucccaaguagcugggauuauaggcacgcgccacuacgccuggcuaauuuuguauuuuuaguagagacgggguuucuccauguuggucaggcuggucgagguuaguuuuuuaaggaugaaacucaaaacuauguuuuaauaaucagcgugaccauuggugauuccuagcagacugucucagcguggagggcugaauuucaguucagcccgcagagggaaccaucugucauuuggaaugacaaggagcucucugccaggggaacaccagaacaccggaagcagccauggucuucacugcauccccacuggcccuggaaccaccaacacuacaggacacaggaacacacaaaguaaaccaaggguacaccauggacaucuuuucaaccuuuuuaaaagcacauugcaauuuucuagaaucaagggaacaauaugcuugauuaguucuucagcagauuuggcaauuuugcuugucauauuucucucuuuaaagcaaguuggucauuaaccuuccauguucuaggacuugagauuagguuuuccccccacaaaaugaaaacuuugcuuaaaaaaaaaagaguuugcuuuaggauaauucauuuuugcugcuaauaacugcaagauccucuuugagccaaggaggucauucuugaaaggggcuagaauugugaagaauguuccuucucuuccuggagagagagucugugaaggcaaaaaaguuugcaggaaaguucaguaaucaugaagugaaagcccaaagugaccugaauacuuccuccugggucaauauuguauguuuaaaaagaaacaaccaaaccuucaaagaaaaaucuggccauccccaaaucccaauacaugaaacuagaaggcaggaggcaccaguagaaugcuggcuuugcucucauugcuuggccuccaucacaguuacaauaguugcauaucauccuuuuguacgugucauccuaaaaaugggauuuggauugguuucuaacaauaaaacgagcaagguagaaaaggaauauuaugaauaaguuaccaauguaaauaugcuauuuugcgccuuugaauuugaguguugauaaacaugauuccacacauggaaauuagacuuuucagagcuacuacacugaaucauuuaauuugucugaguaaguacuuauaauaauguggcugcucugcacugcaauaaacaucggguuuucaaaugaacaaaugaaguaugugauacuccuuauaaauggaacugcagcaaagggcguucagcuagggagcugugcacuaaaaugggaugggugauaagaacaucucucuccagcuccacugauagugaaaggaaagaaucauauggccucugcugcuacauuuucuguuccuggacagaagcaaggcugaagccucacugugaaaugaugggggacuguugcuauuuuggguugucacaggguaacuugucacacuacucaggacacaugaggacagauaauucuguuccuccagauuguggacuugagaaugcuuuaguaaaauagcacagggauauauuuuggauagugguuaaggacauggguuugaauccugggcucuaccaaccaaauaggugcaugauuguacccaaguaaucaucagucuucuccaugcucauuuuccuauuugguaaaauaaggauaauaacuuuggcuuccucauuaaguuauuagggggauucagugagauaauuuauguaaagaaccuggcacaugauuagaauucaccuuuuuuaacauuaucauuuuaacauuaucaucacauuuuuaacauuaucauucaccuuuuuuaacauuaacauaaccauuuuaacauuaucauuauauaugucaucauuauuauuauauuuaaccuuacuuucauuuuaauccauuauucaauuuuccuucaacgcucauuaaaagcacaacucacuacauuguuuaguaauuaauuacuuuuguucauuuaacaaaguauuuauacuuuguuauaugugccaggcacauaugcuaggggcuaggguacauaggugaucuaauccuccuggaagcuauuagaggagaugggcaugagucaaaggcucccauaggaagugaaaccuuugaaacucagggaacaggucuaaaagaaaggagcaggcuaggcaugguggcucaugccuguaaucccagcacguugggaggugaggugaguugaucaccugaggucaggaguuugagaccagccugaccaacauggcaaaaacccaucucuacuaaaaauacaaaaauuagccaggcaugguggcgggugccuguaaucccagccacuugggagacugaggcaggagauucaguucaacccgggaggcagagguugcagugagccgagauggugccacugaacuccagccugggcaacaaaagugaaaugcugucucaaaacaaacaaauaaacaaacaaaaacaaaggagcagaucacucuaagagauacuaaaacaaaggaacuuaaauuaaaccugagaccugaaggaugagaaggagaacaagggauggaaugauggcuuucuugagagaaacacaacaauauucaaaggcauggaguauacagcacuuuaucauuguuaucaaaagucauugcaaaaugaucuacugaauagcucaauuaaaucuaacaacuaugugacaagcaccuacuaugagccaagcgcagugccaaacucuagaaacaccauaguaaagacagauaugauccaugccugcauccuuaccucccaacaccuacuacuauguuugaaaaccacaccaaagucaauauuuacuuuguaaccaauaaauuaccccucuggguuugaucacagagagauuucaccugcauggaaaaacuggaaugcuuucucuggucagacaaggaauguuacauaugccaaauaauucccuuucuucuuaguugcuggauaucuacaaccaaauuuaguuuauuccaugggccuaccaacuuauacuacuaaagauggccauguuucucuuucaugauuaauuguucuauuauuuguagacuaccuuuaauuuaguaaacagccucagccucaaauuauuuggaaaguuauuagaagaggagaaaaaaguaaaagaaaacaaggaaaagagaucucaaguuucuugagaucugggaauuguccaaugugcuuucuguaguauucgugguaccuaacauggugcuggauggaaagcauuuaauaacuucugauugucagauggaugaagaauauaaagcuuuccugguucaacuugggcuccauuagaaggagggaagaacugaaacucgguagaucagaauaugccuccccacaacauccuucuuuagcauaaggauuauuuugagcugauuauuuugagagacugcagcuacaggagaagaucugaaaacagaagagaaguuaccuuuuuguaaaaggauuuuacaucuauaaaggaaauuucuacucauaagggugucucccuuucuauaccaggaagagaaggaugaccaaaucacuagagacucuuaccaauggagaagacaccaacuuaaaucugcauaacaaaccuuacucauguuuaccauacuuuuccugggcaucccuccacaacugacuaucccccauacccuucuuuuuuuucuuucaguggacaaugguauuugagccugaucucaaagccaccucuuugagauuuauucauaucucuggguaucuuccacguguacaugagauacacauauuuuuaacuucuguuuguuuuucucuuguuucugggucuaucccaaccuaaggaccauaaaggguaaagagaaaauuauuuuuccuucccuacacuuacuuuucucuagucuccagguucagaggaaagaacucaaaaaaguggcugaaaaguuuagcaugauuuucauuguaaagcagcccaauaaccaaacagaagcaccacauaaaccaaaagaagagagugguaagugaaauauaagguaccauuagagauuucucucagggaauaagauucuuguaacaaaauauuuaccuuucuuauucuggugcuaguaaaaauaagagaaaugucacaauuuuaauuaaugucuaagcaacagggaaaaauauuaagcuacuuuaugacaaaauggaaauauauuuguaauucuauauccuaauguucucucaguuauuuuggaaaaacuauuaguccuuuggucucuucuacauuaggagagcaaaaagcuauaauauggccuaucuggcuaacuaucgggaaucggagaaaucaauuuaaaagaaauuuggaagacaccuacauuaucgauauuagagcaaaguagagaucugccuuguucacagcaaagcaauccaauucacacacacacacacaaaacaaauguugcauuuauggaaguauuaaaacaucucauccuuguccuuagcuuaacauauuaaugagaauuucugaauuaaucuccaaucgugaacugugucuaggugugauauaagggcaguaaauacugugcagcuugcuucaggcauguuuuaugacagauucucugacagauagaaaaucuuuaagauuaaauuauuucuguauuuuccuaagaaacucaucaguacuaacaagcauaccacuuccccaacuaguugauaaacagaaaagaaaauauuauuaagugauggcacuugaggaaauaguuaaaaggagaaacucagaacauaagauugugauuauauauaaugaggagauucucaaaauggcacagaaaggaaaggaacgaguugaagcugaaaaacguauguuuuuaggagguaaguuauuccauaaagcaauuacuaaaaugugagaguucuucucaugguucucaaccuuauacucugaaagagaacuucuuauaaugcaagacuaagagagccaauuacuucagcaccaagguacauccuaaaucucuggacuuggcaguucaaaaaaacucuuggaaaauguucuucuaaaaucuucacuaacagcccugacuuuagaaauguagacucuaaaaggaugaauaaaaacuaaccaauuagauagcaaaauggagaagagagagcacugaauaaaaagaccugccagaguucggguuguaccucugccaccagccucagacuuaguucauauuuacaauaaaaccauaaucauaaaaauuaauaauuauggaacacuuaguaugccaagaacuuuucauauauuaucuaauuuaaucauccuaacaaccuaugagggagacaccacauaagagaaaagcaguugaagaguuuguccaagaccacccagcugcucugagugauggguuaggauucaaacacgauuuuuuuggaccccagagcccaacccuuaaccacucacucugcagaauaguucagaaaccuccuaggaugaucuaaaaggcuucuuucaacaauagggcgcuaagauuuaugagacaugauuguauaauggaaaaaaaucucagguuuuugaagugacuuuguagcccaguugagcagcuucuucucuaagccucagaaucuuagauaacaacacuacuuaccuuacaagcuggccuaaggaucagagauaauacuagagcccuuagccccaaguaauaauaauaauaauaggcagcauuuauauaaugcucauuaugugcugggcaccaucuaaacauuuuuuuccccacauuaaaguaugcaaucuucacaaugaccuuaaaaguacuauuauuuuguacuuuuuaucuaauuguauaagaauacaauuagauaaaaagaaaaaaaaagaguucuauuguuuugauuccuguuuuaccaaugaggaaacagaggcaaagagaguuaaauuacuugaccuaaaucacaguuacuaaguugcagaucuuggauucugauccagacagaaugacucacuggacaacccaaaacauauuggaggcacuccuacugauacauaaagaaccuccuugccaugcccaaugucugugucacucucacccaaaguaacaaauuuaacauaaacuugggaggaugaaauacauagggaugcccagauaaccugccuacugucauuccgcagauugugccuuuaaaaaaaccaauuucaauagaaaccagcaagaaagagauacaucagguaugucagacauacguggucacaacuauuuuuucuccuuccuggcuaaucacucccuuuguguugauaaugugcugcuuuaaaucaauucauaaaaaaaaaaaaaagcacagaggcaccauaaaagucguuuuuccuguuuucaaucuggaagaaauucagucucuuauucauuuuaaaaacuauuuuaauaauagcuuuuacuuaacccaauauaucaaaaauauuauuucaacauguuaauaaaaguuaauaagagauuuuacgcuaagcauucaaaauucagaguuuacuuuacauuuaaggcccaucucaaaucagacuaaccugauuagucugaaugcucaguagccauauauguugcuaguggcuaccauauuagacaacacaguucuagaaagauuggcuuagaaaagcccugguuguugauauuuauaggucucuuuccuugggcuggucaaauuccccagaaagauaucuuucaaucuccugccuuagggguauaagccugggugccauuguucugagauuuaaguaugggaaagagcagaagccccaucauauugucuuucacuuaagccccgauuuucaucauuauacccauccucagcuaugcauggugacuccaaucacgagcccuguaguugguccaaccccuccagucuuccuccuggggaaguagggagggaggcaguugggagaggcaguucccaggcuaugcggguugggcaagaacucuggggacugguuagcaguuauuugucauucuuucaauguucuuuuaauauuccuucauucccacuuucauacauuuacagugccaugaauuccugacacguucuagaaucucaguuuagauuuuaccguuucucuccccuuuuaaaucagucccuggccuuuuaaggcagcuucuacaauuguauucugugaccuucuccucuaugauuuuuguucauauuccccuccccuuuuuuaacuaacauuuuuuauuugaaauaauuguagacucacaugaagguuguaagaaaaaauacagagaagguccauaugcccuuuauccaauucccuucaaugguaacaucuuggaaagcuauuacacaguaacacaaccaagauauugacaaugacacauucaaaacacagaauguguccaucccagggauccucuuguugcucuuuaauagccacacccacuucccucccacuccaccccuucuuaacuuuuaaccacaaaucuguacuccauuuauauaauuuuuucauuugaaaaauguuauacaaguggagucguacaguguguaaucuuuugguuuuguguuuuuuuccccuuuaaucuauucccugaagauucagucaaguaguuucauguauuaauaauucauugcugaguaguauucgaugguauggauggaccacaguuugcuuaaccauucacccaauaaaggacaucugaguuguguccaguuuggggcuauuacagauaaagcucuaugaaaauucauguaugggcuuuggugugaacauaagcuuuuguuuacuugggauaaaugcccaggaguaugauaagugcauguuuaauuuuguaagaaacugccaaaccauuuucuagaguggcuauaacauuuuacauucucaccaguaacacaauuucucugcauccucaccagaauuuguuguuaucauuaucuuuuauuuuaguuauuucaauauguucauagugauaacucauugugguuuugauuugcauuucccugaugguuaauaauguugaacaucuuuucaugugcuuauuugccaucugcauaaccucuucaguaaaaugucuggccauguauuuucuaauugaguugcuuggauuuuuuuacuguugaguuugaaaauucuuuauauauucuaaauacuaguccuuugucagauauguaguuugcaaauauuuucuuccagccuguaguuauucuuuucauucucuuaaaagggucuuaggccgggcgugguggcucacaccuguaauaccagcauuugggaggccgaggaggguggaucuuuugaggucaggaguuugagaccuggccaacacggcaaaagccagucucaacuaaaaagaaaaaaaaaauacaaaacuuagccagccacaguggcaugcaccuguagucccagcuauuccagagccucaggcaggagaauugcuugaaccugggaggcagaaguugcagugagccgagaucgugccacugcccuccagcuuggggaacugagugagacacugucucaaaaaagaaaagaaaagaaaaaaaaaaaaaaaaaaacucuuucacggugcaaaagcaaaaguuuuaauucugauauaguccaauauaucaccaauauaucauuuguuuccuguuauggauuguguuuaugugaaaucuaagaacucuuucccuagccagagauuccaaagauuuuucucuaaugccuucuccuucuaaaagaaggguucuuuauucuguuccguugaucuauguuucugucacuccauggauagccacauaguaacuaugcaauacuucuugaaacuggguagacugauugcucccacuuuauuauuucuuuuucaaaauuguuuuagcuacucuaguuccuuuguuucuguauaaauuuuagaauaaugucaucuauauaugaaaaaaaucauacugagauuuuugauaggaacugcuuuaaaccuguauaucaauuugggaaguaucgguaucuuuacuacgcugugacuuucaaaucaugaacacaacauuuuucuccauuuauuuacauuuuuaaaauuuauuucaucaacauuauauaguuuucaacaaacaaguuuuauaaauguuuuauuggauucacauaaguauuucauauuuuugagcuaaggcaaauuguacuauauuuuuaaaauuuguguccacagauucauugcuaguauaaagaaauacaauugauaauuuaaaugucuaucucauauccugccaccuuaaugaacucaauuauuaguuuuucauuuguuugcuugagauagggucucacucugccacccagguuggagugcaguggcacacagguauuggcacaaacacaaccuucuauagccucaaccuccugagcuccagccauccuccugccucagccuccuaaguagcugggaugacaggcauacaccaccaggccugguucauuuguuguuguugaggagagaugaggucucuccauauuucccaggcuggucuugaacuaggcuccagcaauccaccugccucggccucccaucguguugggaugacagucaucagucacuacacccagccacuuacuaguuuuaagaguugguuuuguguuuuuucgucuuuguagaucacuuaguguuuucuguguagaaaaucaugacaucagcaaauauuaacaguuuucuuucuuuccaucuguaugccuuucauuucccuuucuugccuuauugcacugauuagaacuuccugcacuauguugaauaggagugguggaaccagccuugcacugcuggacuagacuccauuucgucgugguauauuauucuuuuagccugaauccuguuuguuaauauuuuguucaggauuguugugucucuauuuaugacaguuauugguauauauuucucuuuuuugcacuguuuuuucuguuuuucauaucugaguaauaccagcuuccuaaaaugaauugcgaaguguucucuccuauuuucuggaagagacuguauaaaacuccuauuaauuauucuuuaaauguuugguaaaauucuccagugaggccaucugggccuaaauauuuauuuucagggaguuuuuaaaugauuaauucaauuuuuaauaguuaugggcuuuuaaauauuaucuauuucaugauaggugaaugguaggaauuuguguuuuugaggaaguggcccauuucaucuaaguuaucaaauuuauguguguagaguuguucauggcauuucuuuauuauccuuuugaugucuacagggucaauagugauaucuccucuuucauuccugauauuguaaccaaaugcagguccagaugcccacuguuuacagaguccaguuaacaagagugaggucuaguagaaagaaagucauuuuacuaaaaccaguaaaggggaaauggucagauucccgcccaaagcaaucacuuugauuuugggggaaggcagggguuuaaaaagggaaaacuugauaaggaaggcaugcaagaauuguacuaaguauaauaucugugugucuuguucugguagcuaucuugggucucagucuaccuggauggugagucaagacaucugggaauaucuuuacuuccccuuuauuccugaggauauuuucacgggcuguaggacacugcuuugauuguugauuauuauuucauucaggacuuugaaugcuuuaaguuccugagcagccauggccagguuuuuaacuagccacuuugaaguaaucucuggaauuuugcagcugggucuccaagcuuauuccgccugucucaagauuagccccuggaacuucuaagaaggcacaguaauuagauacuaguauauacuuagacaaaugugaagggaguauauauggugaaaaagggagggacguggagccuauuucuaggcugaggaaaaggcuucugcaguuuuucaagguuguaucuugaaaaccaagagaagagaaaaaaauguuuuaaaaugcauuuggaaguuaaguugccuaguuacaauauugguaauuggugucuuuucucuuuucuuugucagucuugcuagacugucaguuuuauuaaccuuuucaaagaaccagcuacucuuguuuuccuuugauuaaaguuugcaugauacaucuuuucccauuauuuuacuuucgucuauuguuauauugaaagugagcuucucauagacagaauauaguugggucauauuuuuuaaacaauucugcuaaucucuucccuguauuauaagugguauauuuagaccauuuaacuuuaauguaauuauugauauuuuagaauuuacacugccauuuuauuuuuuguuuauuuucuguuuguucucuuugugguuuucuguuuucuuugcccagacuucuuauaagcuauuugaacacuuuuuggaauucuguuuugauuuaucuaaagugucuuucagugcauuucuguauauaauuuuuuaaagguuucucuagguauuacuuuauauauuuauaacuaaacaguuuacuggugucaucauuuuaccaguuugaguaacauauagaaacccuaucuccgcacuuugcaucccuuuaucuuccccauuuauaauauaauuauuuuaaauacuuccuuuacaugcauuuacauccacaucagaauauugcaauuuuugcuucaaacuucaaacacaauuagagcucucaagaguacaaauguuuuugcuauguuuuuuucuuccuuucugauguugaagagauccauuuuuaauugucuucuuuccaauuagauaacucuuuucuuuucuuucgaggcagagucucaccgugucauccaggcuggagagugcagugaugcaauuaugcaaauucuuuuaguuuuccggcugggcgugguggcucacgccuguaaucccagcacuuugggaagccgaggcaggcggauugccugagcucaggaguucgcgacgaaccugggcaacacggugaaacccgucucuacuaaaauacaaaaaauuagccgggcgugguggugggcgccuguagucccagcgacucaggaggcugaggcaggagaaucgcuugaacccgggaggcagagcuugcagugagucgagaucgcgccaccgcacuccagccugggcgacagagcaagacuccgucucaaaaacaaaaacaaaaacaaacaaacaaacaaacaaaaaacacaaauucucuuaguuuuccuucaucugauaauauuuuuacuuccccuuuauuccugaggauauuuucacaggcaauaggauacuggcuugacuguugauuguuaucugcauucaggacuuugaaagcuuuaaguuccugagucucagcagaaacucaaaaauaauacauguaggaagagcuaaaaaaauauacaauaaaccggauccuaucgaauuuaaaugucaccaggcuacaagaaacugauucuggcagaaaaaauaaacaugugaaaaauaauuacaauaaugugugauaagugcaaaaaugcagguauguacuugucacgaugcugacacacagagagaaucagcacugcuugagagaaucagugaaaacuucucagagaugugugaaccagguucugaaaguuagguaguaaaaggacuuccugggugaaggggaacccagcacgaaagcccugagaaaagcggaaaagaugguacauuugagaaucugugagacugaaugccuggcugagguauagaacacccauuggaacaagcaagagaugcaguagaaaagacagcuaagggaaggaugcugggcuagagggccucauccucuacuaaggaguaaacuuuauccuguguaccacgaggagcuaccgaacagacgaaaauggugaguguaauauuuaaagcaaugauugcuacuauaacacucuuuuuaaaguagcuuuuccaugaauuauuaacauuaucuuuagucuaauacguaucaaaauuuaguuuauggacugguaggauguguuaauggccaauaaaaguaaaagacucagccgauucccugccuucuacacuccauuuuacacacacuccauccugccugccgaaugacuucagugucucugugaccagugagugaagcagcaugcaaugagaucauggcuagauggcagcacauucagugaagugcuucagcuuuccuguugcuucugauucccuggcauuugucagugucugucaaaacauuaacauuucuuaauguauauuuugcauuauuuacuaaaugaaaauuuuccaaugacaguggcugagaaaaaaaaaucagauuuacauacaguaugucaaguucacauucgaugccccagaaaugcccaguccccaaagaccucuagggacugcagcucauuuguugucccucucccucucccguuuauuaugcugacccucugcccagccacauagcucaccccacccccuuagaagcaucuagaguuggcucuagacaugaaauggaauagauuucugcauuuacauaacugcuaucgcacuucuggugaaaaguaguuucagaaaaacacagaaaaaaauaaacagaagaauaaaaagugucuaugugauaacauaagggcuuauuuaacuacgucuuuauuuccuuuacaguccaacuauuuuuuuuuuaaaacugcaugccaccuucaugcugccucucggaggggacuugaucuuauuuagacccgguggcgaggguccuucagcuccgugaggagcucucuagcacucaguccucuuuagaggaaagauaucuucagagccuaaaggccuugaaagaaaugacacauuuuuaaaaacagaaaaacaagcaugaaaguggcccaucagaaaugaaggugugaacuagaauacaauagacagcgaggaaggagccaaaaauccucacccaggcaggccaggauauaugcagauagggaggaaauugggaggcauuccuuugcuaauaaagaugauuuuucuucuaauuuucacaucuuucaugauguaucuuuuguuuuuuguuuucucucuaugacugcuguucuaaaauaagugggcuuuaagaauaugaacuacaguccgcauguuugccagccccauauucugcgaugaacuugacaugugaaugaaucaauucugcagaggugaaaaguuauuccuacaaaguccccaguuuuccuugugagaaagaucccuacuuaccuguaaacuuguuaauuaaaugucaaagguuuuuauaucaaggacaauaacacaagccaaccugggaaucugcuugucugaaauagguaaagagugucuguguuuauuuagaauugauuguacacuuuccuucauucucuacauagauuuuauuuucuccccacauucuucuuuuucuguauugccuugagggcuuucucuuauaauuaugugacaaauuauaucugaauuauguucaaauaagcaaggagacugagguuuucuguuaaaaacauauggccuaucaguaaugaaugaaguuuugcccauaucaugacaugacuuuauugaaggcaccaucucauauaugcaguuuucaauguggugucuaacagauuuguguaaaaugucuaaaauuaagcaaaugcaauuauaugaguuaguaucaucuuaucauguacauuuugcuugauaauagaaaagcaaaugaaaaguuuauuagcuuauuacaacagucuguuuuugauuuuuacuuuagacucuauuccucuuuauuuucuccucuucuguuucgggucauuauuuuaucuggagaacccaaaauccaauucuucaucuguauuuaccacauagaucuuuagauucucuuaccaauccaacagauuucugaauauuuaacuacccuauuguaaguugucuuguuuagaagaaauggaaucuaagauuguggcaguaaaggacaagcugucaauguguuaaauaaauuccuguugaaaaguaacggcaugcacuguguguuaacauaauuuauuagaacaauuagaacccauccuuguugucuuuuaauuagauuauucccuguucugguaauuacacuagacaagggagaauaauagucuugggauucuaaaaucaucuguagacuauguggaaagagaauaaauaaucaauaaugcuaauguaccggaaaacuuaaauucccagaaagagaucuuuuaucaugagcaauccuuuguauaaacagcauuauuucucaaugucuaugcuuaucuugcccaaaguugaaaagugaagacacuggacaaauaacagauauuuauuuuacugucagaaaccugguugggcugggccaccucuggccucuaguggcucagacauugcuucagucccuugcaaaaugccaacaagaaaccgcaaaugaaggauuuaaaauuccaugcagagcagcauaucuagcagucugaaugccuaagggaaaggaugcagggcuuuuaaguucugguccuaggugaggaaucauaaaguuccucaauuuaaaaaaauauauacaaauggacaaaaaugucuuagaacugagaaggcuacuaaauauuaaaaaaaaauuucugauauuuccauacaugaagauguuauuugcagaaauuaauaggcaggcuguaugucaggaaaguuucuggcucucagggaugggcugaggccuuuagaugugaaucgaacuacaucucugguuuuauguuuggaagaccacagggaauuccagugcuccaaggacgcuccgagggccuacacaacugucaucaagcauguuaggacauccuagagaguaguucccaaaacuucuaggcuucagaaucuugacaaagucaugggugggcauauccugcccucacggauaacccuacaguugaguagaaggaugcuggaaugcacagaauugacaccagugaaucuggaguucucuguaguaaugagcaacacaaauaucucaccaacagucccacuguuauccgagucugccuuagucaauguaaacuccuaaugagaccaugucuagacaguauugaucucccaccagaaaaaaaaaaagaacucagagugugacuucuuuucuagcuuagcccaaaugacacccuaaaacaugcucuuucauucacucauugcuaacacuuuucauaaccugagauauuuuaucaacuaggcagccaaggacccauaggcuucuucgcaagguauaugugauauuuuuuauauuuaaaacaucuuugauauucaaauagcagauaagaaaguuacuuaagcuuauuaaagaaccuagagaaauuaaaugaguguauauauauauauauauauauauauauauauauauuuuuuuuuuuuuuuuuuuuuuuuuuuucccuugcuaggcaaaggagacaggccuuuaaaaaaugaaaguccacauaagauuaaggugugaucauucaaguuaaugugggcaagauaucuaaaggagaaaucauuagcuuaagcuauccaaaggauuuuacacacaguccugugguuuaggagcagaggaucacccguacuacugugcuauccaucccagcugggaagacaugguucuuuauagaaguaccccuuaaaauugucaggggugcuauuaaguacuuaggguuccccacuauucuuaucuccagacuggucaaaucuaccaggcaucuuucugauauaucagauagauacaaucuaucauagauauaccaaagauuuauuugcaucugaguguccuguggugaggcauuccacagcaggcugugcaucaggucugucugcagaaaguaagaaagaaaggaauacaguuuaaaauucacguaggaauggaguuuaaaaacuccccaggcaaugugaaggugaguuaggacugggaaccacaagcuaaaaaggagaaccacagagaauucuuucugacuuuggggcugaaaugaagcugaccgaggcauucaggugguuccagaggcuggaaagucucauacgacagguuuuuuucucacaaaagagaagugaaauaaguaccuuauuauguuccaacaauaucaagauacaaaucuaucuuuuagaaaaaugcuaaauaaaaacacagucagagagagacuuccaccacuauaaauaguuucuuauaaaugccaccuagagacaaaauuaucauuucuaugauccuaaccaaaagagccuugcaugucuuggaaauacuuugcccucuaaagcaaccagaagaacauuccuucagucuauguguucuugugcuggauuuugaaacuuuugagcauuugcucccaaagugaaauuuaaaaggcuaacagcagggacaccuggauaacuagaaaacuuaccuauugauaucacaggcugcuucuccaaauggacuguauauaauuucuugcaagcauaguaaaaauccuauacuugcuugaaaugaaaugaaggaaagccuaucaugaauuucuuuuucucuguguuaaugaaagacacgagcacaccaugauaagcaggagagaaugaccuaguguucauccuucucuucuuguccaacgcagguaacuauaggugggcucuggguagaguauaugauugcugcauauuucuaagaaauaaaguuaauuuacaggcuaccucaauccugacacucuagggguaaggcaagcaugcauguauguauuucugguaaucaagagggagaaauagcagugaaaaauagagcuuggauauauaucuuaaagacaugccacugauuucaaaauagggcaagagcacuuaugauuuaauauaauuuuguuggaaaaaguuaacucucuccaaggaaauacagagcuuagcaaauaccuuauaaauaauacaaaggcauacuauaguguuuaguagaaucuuauucacccauucugauuuggacaaauguuaaaugagacaaacaggagaaaaguuuauugauuagguaaccgauuaaaauuuuggugaaaagcagaaguaguaaguuccagaaacaagaaauaaaucauguauaucaacaagaggaaugaaggcauuuugugcaauccuggggaauagauuuucuuagguauuucauaaaaucauugacucuagggcaggaaaaaacccuacacacauaaacccacagcauucuuuuuccugccuccacaguuguaaaggcccgaugauaaaaccuguuuccuaagacuuccccagaaugugauucaacacauuuucuauuuuuuuaaaaaaaaauuucugccacuuaauuucaugugauaauuuuccccaaugacuaaccaaauaugcuucacuauuauauaaaucaauucuuucuuaaugccacaagugaaagugcaaagguagcuaaugguuuucuucucauaaaaaucacacuuuggcuuuuuccuuucauauguaauuaaucauauuugugacaaucuuccaaacuuacuugaaauuuuucugaaucccuuucaaaucaggacaagaacuagaaaugucuauacagguuuaauaugaaguaaagaaaauguuuuucauuuucuugauuuauuucugaauucagcuugcucuucauuagcgcuacauagcugncuuauuauucgugguccccuaugacccccugaucauuuucccugagggugcauauuuauucacuaacuauguuacaaucaugugaucugcuggauuuuuucugauagucuacucuagauuuguucuaaauuaauaaaucccauuauuuuuggcuucuacuacuucuauuuauuaaauucauucugaauaugaaguuuauuuucaaaggaauucauaauucuuuacuccnngcuugguucuaacaaugaauuuaauaagaauuguauuuaaucaauguuuaaauauauuaagggcaaauuuuguaaaaauguuaguguuccaagcuuuccauuuccccacaaauuaauuuuuuuagccuuuccccuuaauccacuuucuuaaaaaauaaaauuuuuuuugugaugcagaauuaugugaacaauaagaaaaaaauaauuagaaagguaggaguaaacuaaaaacaaacaaacaaacaaaaaaaaaaaccaaaaaacuaaggcugcagacuuaauagaacuaccauagcuacuuaaggguaaaugauuaagagagagacaacgucuggcuucugagcagagcacagagagaaagaucaccaggaagaaaaaagauaacagggaauuuuaaggacaguugccauguguaaugcauaaaauaguuuucaaaauucuuggagagguaaaaauaaaauuuagauuuauuuuuuaauuauuucacuugcgaugcuaucuuaagauugaaccacauggggccccagaauuuauuuagguuauacaaauauccuccaauucugaugcugauuauuucauaugcagacuucaguuaccuuuacaugucauaaacacacauaccccagaaauaaacuugaucaucccauaaauuuucaagagcucucagccugcuguaaaugaaauuucaccauuaacucacaggucgaugucugggacaaccucaaagacugcuugaguaauuaauaaauuuauaugaaaacauuggagugaaaaugucugucagugucaaauacauaagagguaauggcugauacauaguaaugcaguuuuaaaccauuggcaacauaucuaaacaaagguaucagagaaaaauaaaagaaaaccuuguaacuuguaugauaagccucuugcauaagauuauuaagaaagucauaagcacuuacggcuuuauuccuuuucuauauagauagauugcccagaaaaacguggacugaaccucagcuggaaucugagggcucugcuugucuuuaacagcuuagcuacauuguuagagagcaacacuacauaauacagcaugcccuauucuuaaggcaauacauaaaauuuuaaaaccugaagcuaaauuaaaagguuaucacccuucugccuaauguauuauauauuuguaaaugauaucugucucuaaaaaagauguaccacaaagcaagagcauaugugaaacaauaagagagaauguaggaguuagaaacacauuuagguauguaggaaacacaaacuucaagacauucccaaggaucuaaauaaccuauacacaaauauagcaaagucauauccuaagggagaggauuugaguucuaaagccggagccuaagguaaauguugcauauagucaaacuuaccauugaagaucacuuuaaucaccuguagggugcaaguuacauugcuuuguguauucaagacugacagugaauauuugagaaaaucaguugaguuagaauaaagaaggaagcaaagaaaaguccaccuacagauauuaggguauucaaacaaccucuucuuuaagaaacuagcaaaucuccaccucugaguuuuuaucagguaggugaugaagugcaaagcuguaaacccuccaacagggcuuauuccacuguuuuaauauucacauuucauaacuuggacauaugcauuaauggauguauuugucauuguuaagauuaaguaacauaaucuuucuuuuuuuuuuucuuugagauggagucuugcucugucgcccagccuggagugcaguggcaugaucucagcucacugcaaccuccgccucccagguucaagcaauucuccugccucaggcucccgaguagcugggauuacagguaugcaccacaaagcccagcuaauuuuuguauuuuuaguagaaacaagguuucaccauauuggccaggcuggucuugaacuccugaccucaggugauccacccaccuuggccucccaaagugccaggauuaaaggcaugagccaaugagccuggcugauaaccuuauuucauaagcaaaagcaucauccacagggucugguccagagcagauacucaauagggugcuacauuuuaaucuaacucuuguuucaucagacccacaaacacauugcucuuuaaaauccuguagagaagaauaugacaaccugcaccuuuucuuuccaagauggcauuuccaguuaggguaccucugaacagcuguugcuugcacauuuuaggcauggugaagaucuacaccugaugcuggguuccuaagugggcauauggugaauccacugcacacagaagcacuucuuuaugcuuggaucacauugcagaagauuggaccccugacuggggcuaccuuucccaagccuuaacagcacaucaggcucaaaucacagggcuaucaaaugaggagauccccuuuuccaaaaaaagcaucccuaucaacucucccaggaaagcacaugaacucauguuauccauucauucuuaucuuggaaaauacacccacaagccccuuuuacugccacuuacaguaggaugccacaaaaauucagaaacuggaauccuuuuccgucccuucuccuuuccuuccucccuuucuucuuuucuucuuccuuaccuugaaauuucugccugugguaaaaccacaggaagaaggaaagucaaaugaauuuuccuauuagucgacauuucugugauacacucauuuuuuuugguccccguaugaacucccuccaggguauuucuuuaugggaauaaaguaugccaaaugaaauaaagaacuugaagcacaauuuuauccuugacauauguagagagaauauguuacuccugaauuuauggugcaaugcaacucagucacuuccuuuuccucuuuccccuaguuugcacuuccuacuuauugcugcauaccaucacaaauuuauggagugccaauggcuguggccucuaggcagcucccaaaugacugaauccagacaucauugucuucaguuccccuuuggcauuagucuauuuuccaucccucuuccuuuauugaaaucugcuuccaauuauuuuucauaagaugguuuagcuuucuuuuauuuccuuuaaguugaaacucuuuuauuucuaccuuucauuucuaugcccuccugggccuuaagcacaguucuucuacauuuacagggguuuucauuuagaaacuauugagaacuuuacuaucaaauuguacuuuuuaagauaauuuuuuugcaauuuuaacuaaaaggagauuuuuagacuuuuggaaagucauggcuccaggucucagaucucagcuguagguuuuaucacuuugcaagaugaugacuagaguuacagcacauucuuucaacccaugcccaaaacuucaaagauggccacccuucaaccccugaagauuucaacucaguguuuucagaaaauuggagguccaggcuuuggagucagacagauauggguucaaauccagccucuggcacuuaauuugaauacaaccuagaguaagucauuuaacuuuccugagcuuugauuuccuuaucugaaaaauaagaauauagauacuuaccucaccauauuguuauaaagaugaaaugagguaaucuuuguaaaauauacacaaugucuagcaggugguaagcauucaaacugguagcuauuuuuuauuguuaugaguuaaaauuuuguauauaauggauuuuuuuuccaagaaagcucaucaagcugaccuuaaguagauguuacucccaaauaccacccaauuccaugucuacauacuugagaaguuacuaaacacuuuaaaauugaaauugaaaacuagggacaaacauagauuugaaaccaaaggaauagguaaucaguuauaaauuuggauauaacauuaugagccucuauuucagaaaauacauuccuuuuaaaguauauuuacuauaguuauccaugcagacugaauauuuuuaucaauaguugcaaaaccauuuccugaaagggaaaaccauguaauuauaacuagauuuucacauguuaaccuuuuauauaagggaagaacaagaaguagauauuugcuaagagacugggaagaaagggaagagaagggagagagggagagacagagagaaugagaaugaaagcaaagaaauuugacaaggaauacuauuuggcuuuuggcccuuccguguaccaacguagaugugugauuauaccauuuaggauuguugucaauucuuuccauaggaacagacugaacaaugagacaucuaccucucaacccaaagagaauaaaauugucauuucccuacaggacuuuuguuaauacaaaaaugaaauauauauauauauauauauauaaaauuauuaugauuucaaaaauaaagccaaauaucuaaaugaaaccaugaaaauaauuagcuccgauccaacagaguaagugagguuuuuacuuuggaagauaaguaaauucuuucagagcaugagaaugaaaaauugauugauuccgaucugaucucuaaaaagagcagucugauuuacuuugguaucaaacagaccugcuucuaaaugccauuucugccauuuaccuguugggcaaauuucuuaccuaugcacuuggagucuucacccuuaaaauagguaugaaaauagguagaaaauaggcuugccaugcuuucucucucucucccuauaucccaugucucuccaaggagcaauuccuaauguaauugaucaaauucaagcauauggagucuuauuuacuaaguggcauggucacuauacaauaaacgugacuucccccacuucuacuucuucucuucuaaguugaaaaaacucuaaucucucaggucaggcuaacuauuuccuucccucuuuccugccuucuuucuaauuugaggcaauagcauccaugagcccaggcgaugucagggauucuuguuuuuaucucaacacuuucauucuuccccauccccucacaggcccccauucagaauucuuaagcaugcuauuugcuugagggggcauuuaggaagucccauuuaagaccucugccagcucuaaucuuaucucuucagagaggccuucgcugacuauccaaucuaaaguaccuaccuuuaucaguguucuacacuggaagguauugggcacaggugcaacuaauaauaaagugggugguacuuuguugccauuuccauguuagggccuuugugucugcacuucucucucucucucucucucucucucucucucucucucucucucaugcucugcaucuuuaaaucacuaaggucucagcucuaauguuaucucuucagagaggccuucccugacuauccagucuaaagcagacuccucauucccaccaacucacuccauuacauuaaucuuuuauuuuguuaauagcucucauugcaucccauuacuuucuucuuuauuugcuuguugcccaucccuaccuccuucccaaacacacuuauuaaaacaccaugaagacaaaaagguauugugcucaccacuuguuuauccagagccaggugccuguccaaaguagaugcacaccugccauguccuauggccaaccagguccaaugaauuccuuuauaaagcuccucuccucagcugacccagaacaccagcugcuauacugaaggcuuucacacuuucagaugaggugucuuuaucuuauaaauuucuuuucucuaagcagaauuuauauaaccuacucauuacuuugaauagcaucuuauucaguauaccuuauugguauuuuucaguaaacccugguauaaggcacacagcuaagugaauguccccacauaccuauaagagaguggcuagaugccuuucuuacccacagggaugguuucaaagaaaccuuuuacacucacucccauauacacacauacacaaaggaaagcucacauuugcauuccagaucaucuccaggaggagggaggagaaauacucuuuuaaaagagcaaaccuaaaauuauaaugcucuugaaaacauuaguaguuaacauuuacuguuaagaaagccacaaucccagaccaaagauagcugaguggcaucuuaaauugaagauaguuuuuaagucagagcuuagaaagucucuuggaaaucucuuuaauucccccacagaauaaaauaugguacagauucucaggagguccaauagaggcuuuccucuagcauuagaacagauccuucuuugaucaaggaucagaugaagucauuggugugaauuuacuaggcauauauuuuuucauauauaacagaaaaugucaacacuggaaucucacucagcacuaagaugcucacacuaagagguucaggaaaaugagaaugacucccagaacccaucucacauuuucuaagaggcauauauucauugaggggaacgucuaacagaaugaccuauauuauuuacaucaguacuuccuacucucacuuuuuuggccaauucugugugauuaaauuggcaaaaguucaaugcacacaaggugcaacucaauuauauuuaagaucacucauuuaugucauaaagucuuucucaaaaaacaaaagaugccagccccacagaacuuuaucaugucacauagaccccauuaaugcagucuaucaacaauauagacagauuauuauauucagggaaguucccucaagaauugccuuacaaguucaauuuaaaaaaucaaaauaaaacaagccaguacugagucuuucuaugguauaguuaaacuuguaauauuuuauacauauuuuuugaaaguagccuugauauaaauccugaaaaaagaaaaaaagcaaaguccacauuucuauaagugucacgaugauaaauuuuauguaucaacuugacugggccaugaggugcccagauauuuggucgaacuuuauuccgaguauggcugugagggugcuuuggacacacuuuuaauauuuaaaucaacagaugcaguaaagcaauugcccucccuaauguguguggacuucauccaaucagcugaaggcuugauuaggacaaaaaaaagcugacccucaugcaagaaagaggaaacuccucuuaccugauagucuucagcugggacacugauuguguccugccuuuggacucuaacugaaacacuggcucuuccugggucucaagccuguugaucauuggacagaaacuacaccauugggucuccugggucccuagcuugccaaugccagaucuggggacuugccagccuccauagucacaagagccaacuucucauaauaaaucucuuucuauacauauggauacacacauccuacugauucuguuucucuggagaacccugacuaauacaaauauuaaacccaaauaaaaacccaaaugcaaguauuaaacccaaacccaaauccaaagaugaacaacuuucuucaucagucuggcaccuaacugcaugucucuuuaugaaguauguaauauuuuuucaugagcugccauaugucauuccaucacucgcucuagaacucuuuuaggcacuuaaaacuuuguauauuauauuaaaauuuaauguaucaagaaaggauauagugagaauaaacugaaaagaguaguuacuaaugccaaauauaaggcagucuugaaaaaaagaaauauuccucuguaaucucaguacuuugggaggccaaagugggaaggcugcuugaaaccaggaguuugagacaagccuaagcagcauagugagacccuauccccuaaaaaucaagauuuuuucaaaaaaagaaauauuccauuuuuucaguaaaaauauuaaacaaauuucaaaaggcagaauggacagcuuauacauauaaacauauagggauaugaaacacauaguuaaauaucuaccuauacuuuuuauuucauuaauuuaauuggauacuuaaaaacauguacuuuacucaaauucuuaugugagcaucucaacacaugguuuauucaaauucugaugugagcaucuccaccauauaagagccuccuuuuuagcccuccaacugaguuuuccagaguuuuccacaaaacuccaacugaguuuucuucccuugguucaaaacaggacacuccuugaaucauguaugaugguguuucugaaaguugucucugaaggcacaaguaccuauuuauauaauauuagcagcuuuuucuucuaaauaaaaauauuucuuugaacagguauauauuuugaugucuaugauguauuugucucuuguauugcuuuuuaaauagacuuuucaaaaucgcuguuuggaacaacauccaacaguuggaauugugaagucauagccccuggaaucaugacuaacuguguucaauuucccugcuccucuuuuauggauccuagcagaugaccuucacgagcacccaaaacaaaccuugggugaagccacuucagcccacugugacuuccuaaagcaguauuugaaaggacccaaauauaaagcaaggucgucucuucugagggauaauaaauucagggggaagcaaaccucaccuuuguauuugaggauaucugguguauuuuagugcaauucugccuuuaagauaaagugccagcugacuuaauggcaguugugaucucugcuucauuucaucuuuuaucuaaugauccgcuaguuaguaaaccugcaaauccugaaagaaacauaaguacucuuuuucuuugcaguguaaucaccaacaauaaagcuuuauuuuuuugcauuaacauucaacugcaauguauuuaaauguuccacauacacaaaaacaccugauuuuucccaagauuuguuaaacauagucccuuugguguccuuaguaacacugcaaagaugucuucauguaaaacuuaauuugaguccugauuaccuuacugugaaaaaccguaaacaccaaacaaaaguaagcauaauauccaaaugccuaaaacauaauacccagguugaaggaaguguaaauguucagauucaccagugggacuagaauguaaacuucuuggguugugguuccuccaaaucaucuggccaccuggguaucauaucccacaagcauaugguaacacugauagaguaagcucaaaguguuccaacaccaggacauuucauggccacaucagaccaauuguauuuuucacuuccucucuuucccuaacuuuucucauacaaagcuuccuacauuuccuuuggcacuuaguaauacuuaaaugcaucuucacugucuuauucaguguuuuuagcuuuggaagguguaucacuugggauugcuuucagaugcauuaauugcaaucuagcuaaccaacagcccaacagugauuuaaacacagaaagcuuucuuuuccggauaugcaugugugcauauuuuguuuuguuuuucaugcaacaagaugucugaagguauaaucugacacugagcugguaucucauggugucaugaaugccccagccuacuucuauuuuuuuuuuuuuuuuccucugcuguccuucagugaggcuuucacuuucauugucauagacggcugcuggaucuccaaguuugacacauucucccuaggcaagaagagggggaaaggcaaaggggaaagaggaugccagccaagucagucucuuucuaaaagcuuuccagaaaguuccauccagugacuuccacauacaucugcccagccacaaaugggucauacagucuuuccuaacuguaagagagugugggaagcuggauaugagcugagcauugcugcuccaaacaaaaucagauuucuguuaggaaagaauggauguaaaguggaucuuaggaagggaacaaccaaugccuaccauacacaaguauuuguggugagcagacauggcuaagugccucuuccuaucuagggagguucagggaauuacucaagaucucuuuugugccagggaacuagggagucagucaucucauuugcuuucauuuccucaucucugaaauuuccuacuaugguauuccucuuagaacaccauuuagaaguguuaugguuuucuguucuuaauccaaaugugacaaaauguauucuccuucuucucugauaacaaaacccaaauucugacgggcagcaugugcuuagccuuagauaaugaauaaugacuggucuaacccaaucauggcgauacuauguucuuuugccauugauugguauucaguaguaggcaugugaccuagaucuaaccaaugaguggacauacacuggggggacucaugaaagauuuuucaccuuugguaaaaagucauaguugcaagaggagaaagccuuuucuucauaugccucuucuuuccuguuuuagaugcugucauguuaacgcuuugugcuuagagcuguagaagccgucuugugaccaugaggcaauagccaaaagaggaaagagccugaguaugaaagacacuggguccuuuaugauauuacugaguugccaaacuaacccugggauccucuaccuccuguuuucucauaguaauaaauaucccugugauuucagcacuaucacuuuaauuuucuguuacaggcagcugaaagcauucagaacucacauacuaucuuaacaucaucuuccauguguuaugggccaagaguauauucaagagugacuacaaaacuacauucauugucguaucccugugggacucccuuaaaguucuaguguucuguaguguacuuuccacagccuagaaggauauauguuucccucucuccagcccuaaggaacucuuaauuuaagacugacaagaugaaugaguuacaaugagggugaauccaauucaaaagacguaacaacaagcaagaaaagcaaagaaccuuguaaacacccauguuauggagugugagaguguaagcuuaaggaggcuuuuauuuuggggagaagaugcaucaccucuguuugaaugagagaaauuaaguuguaauuaugaugguguuucaguuaaauuauuugauguggaagacaaggagaccauucccaacauguuauuuagcaaagaauauggaggagaggcagaagacugugauggaaaacguucagaggccaucaaccaaaaugguaaugcauucgaggcagauaaaguugcuucuugcuagacagagguggggugagcccugacauacgucuucaaaauugcaaaaggcacagaucugggggggaaaggggguugauucaccaaaucucagaauagcagaauggcaauaacccuacuccaaggcuuccaguuuuccucaguuuaacuccuuuugcauacugcagccaaagagauuuuuuuuaaaaugaagaucacucagacuguguccucuuccucuuaaucuccccaaaggaagaaaaaaacaaugaucaauggcaaauggcaguugcaaugaagcaacaccaagaacgagcuucgugcucgggagagaacauugcauaucuuccugugguuuccagugcucuacacacuuggggaaacuccuuuaaguaaugaaccacagaaaugaccccuggaaauauaaucuucaaagugaucuuuuaaagauccaaauauuuccuguucccacucugcccagagaucuucaguggcucacuacugcuuccaugauaagauccuaaaaccuugucacaauccacaaggccuucauuguccaucccugccugccucacugucuuuaucucccaccacacucugccuucucuaugcucccaccugacaacuucuucagugcguggacccuauuguacucucucaggccucaaaaccauguaacauccuggacuuccucuucacuggucuaaugccuacucauacuuggcuucugagauuguacuucacuccacauggagauuauccacaaccaugccccacuccaaaaccagguuaccuucccaaugugauauacuugccauagcacucagcuuccuuuuuuauaauacucaucacacuugugauugauugacucucuucuccuuuacauuguaagauccauaaaggcaaggaucaugucugucucuuucugauguguaacaagccugaacauacauacaauaaauggccagguguaauuuaccauuguguggaugccaucuugggaggggggauucuaauaguucaagggcauguaugaaaaacagacucaugguaaaauaauaagaauagaaaaaaguuacucagagugguuuaauggcugggguauaccuuuuacuauuuuacuuagacaucaaaggaaaaucaguguccucccuaucauguuccaugauuuuguacaacugaguuuagagcacaagcuaagguaucagacagcauuugacagcccagcuucacuacuuaucagcugugugaggugauauaaucccucuaaucccuauaaaccuuaguuuccucaucuuuaaaauggggauaaugacaaaagcuuuucaauaaggguuugugaggauuaaauuagauaauacauggaaagcuuucaucccagugcuugccacagaguuagcaugcaauaaauguuauaaagaguucuuuauuguucugcccaucaacaucugagacagaauauaaacacaacugcuccugggccugguggcucaugccuguaaucccaacuuugggaugccaaagugggaggaucacuucaggccaggaguucaagaccagccugggcaacaaagcaagacuccaucucuacaaaaaaugaaaaaauagguggauauggugauguaugccuguaguucuaguuacuugggaggcugaggcaggaggaucaacugagcccaggaguucaaggcugcagugagccauaaucaugccucuacacuccagccugggcuuuuuaagauuccaucucuuaaaaggaaaaauaaaucaacuggaucacuagccuauaagagcuuaacaauuguuagguaguauuacuauggguguuauuguuuuguuauuuguggcaaaaaguacuagugcucaccugagcacaugacuuccuuaugaucagguagguccauguuugucuuggucacuacuccagcccagugccuagcacagugcuugacacaugguguguaugcaaugaacacuuaaugaguacuuaaagaucuaaccaguaugauagugcagauucucuuguaagcaaaugaauagagaaaggcaguauuccacagagaaggagacaggaaaaaagaacaggcuugauuuuacuaaaaagaaaaacacacuuuuaagcaguaaaauuagaaguucccauuucaauggcacaaaauagagaacucacugagaauugugugcuauaacauggucaaagcagaggccgauaaugaagggagcagcauucagaaccaucacauguauggucagcuuucagacccugaaaacucgauuaaaacauuccaggaaaccgcugcacuuucauucuaaaggaagauugugaacucuguucacauauuacaccccuucauauugcuuugucuaccaguguggccuuuuaugaagugagggcuucuuucuucuaccuugcuccaugacaaucaaacccaaaaugccuuccacccuuaaaaggaaguuuugguaagugccuuauuauaacuaucacauaugacacaaggcucaccacuaaucggagacagaugagaaugaauuacuuaaauaggacagaaauagccauucacuucaagaaggucccaguuucuugaaagucuguggcauugagaccauuuacaguuugcugucaagauuccuagcagugcucauuaccuuggcuagcaaucccucuggacuacagaaaacuuaucugaaauauauauaaucacaggcugcaaugccuaagugcaacaggaugauuuaaaaagcaccaugauaguguucccccaggacauucaucucucccugucuauucaucuuugauccagacaaaaacuuggaaugcaaucuguauauugauauucccuaaaaaggauuucaccagcucuuuaggaagaauuguuuuagcggcucuggaagucuagaacauucugcauuugugguauuuacagcuuuuguuucuauuucauaaaaauaaagccccacuaagagcaguauucaauuccuaucccaauaggaguaucgaauagugguuaagcacauguuuuuuggaacgaagcagaccuguguucaucucugggcuccucauagaccucuucauaaacuuaggcaagguauucaaccuuuuugagucucagcuauaucagguaaauuacuaugcgugcacagaagagcuuaauaaauguuagauguuaaugguauuaauauuguuuugcugcuguuuucaguuuuucuagcagagauuauuaguauucacccaugugcacagguagaccgcauuuccacccaugcacacagguagaccgcauuuccaagcuucaguggaguuacguggguccaaaugacugaguuccgaucaauggaauguggcagaagugauguacacccuuuccuggaugggccuacagaaauccucuagacucuacuccucacucuccuuuucccuucucaggcacccugaaggcuacuuguuaaagaauuuagagcuacaggauggaaagaaccuggauccuaccuaagaaccuccuaggagagccacccuucagaaacauuugcaguggauucugaauacgauuuuuuuuuuuuuuuuuuuuuuuuuuuuuuuuuuuuuuugccgagcacgguggcucaugccuguaaucccagcccuuugggaagcugagguggguggaucacuugaggucaggagcucaagaccagccuggccaacauggugaaacccugucucuacuaaaacuacaaaaauuagccaggugugguggcacgugccuguaaucccagcuacuggggagacugagguaggagaauugcuugaaccugggaggcggagguuccagugagccgagauugugccauugcacuccagccuggugaagaagugggacuacaucucaaaaaaacaaaaagauacauauauaugauauaucugauauaugauauauauaugauauaucugauauaugauauauaaaugauauaucugauauauauacauaugguauauaugauauacaucauauguauauaugguauacaugagauacaucauauguauauaugguauacaugagauacaucauauguauauaugguauacaugagauacaucauauguauacaugagauacaucauauguauacaugagauacaucauauguauacaugagauacaucauauguauacaugagauacaucauauguauacaugacauacaucauauguauacaugacauacaucauauguauauaugacauacaucauauguauauaugauacauauauaucauguauauaugauacauauguacauauauauguauauaugauacauauguaucauauauaucagguauauaugauacauauguaucauauauaucagguauauaugauacauauguaucauauaucagguauauaugauacauauguaucauauaucagguauauaugauacauauguacauauauaucagguauauaugauacauauguacauauaucagguauauauguacauauguacauauauaucagguauauauguacauauguacauauauaucagguauauauguacauauguucauauauaucagguauauaugauacauauguaucauauaucagguauauaugauacauauguacauauauaucagguauauaugauacauauguacauauaucagguauauaugaacauauguacauauauaucauguauauaugaacauauauacguauauaucauguauauaugauacauauauacguauauaucauguauauaugauacauauauacguauauaucauguauauaugauacauauauacguauauauccauauauaugauacauauauacguauaucauguauauaugacguacgucauauauaucauguguauauaugauguacgucauauauaucagauaucauauauacacauauauccuauauguguauauaugauauauguauauaugaucuauauacauauauaucauauguucuaugauauauaugauauauaucauauaugauauauaugauauauaugauauauaugauauaucauaucauauaugauacauaugauauaucauaucauauaucuuucuuuuuuuuuucaguuaagcuacuggguuuugacgaagcucauuacagcaguuagccuacuucaggguuucucagccugggcacuacugauauuuuggacuacagaauucuuuguuauggagggcuguccuaugcauuguaggguguugagcagcaucccuggccucuauccugcuagaugccaguaguaaccucuccaguagccaugacaaccaaaaaugucuccugacauugccaaaugucaccugcaaaaucgccuccgauugagaaccagcagcccacacuggccaaaacaucaccaucauugcuaucaucaucaucauaggauauugauagucuagucucucauguuccccuugaaaucacugcaaaaggacucaaaguuccaaaagagguccagcccaguuuuuuuaggagaaaaaagugaaaugacacuaaaauuuaagaaaagguaagggaucaagcaguaaacucaaaguuauaggagaccaaaaaacaaaguaagaaccaaaauaaauauaauccuuuuuuaaaaaagcuaguuuguguagucccagcuacuagggaggcugaggcaggagaauggcgugaacccgugagguggagcuugcagugagcugagaucgcgccacugcacugggcaacagaccaagacucggucucaaaaaaaaaaaaaaaaaggccgguuugaucacuuugguaaccuagaauaaaaugauuaaaacaaaaacaaacccaaauaucugggucuaggaauuucaaugugucuaacaaaugcuuauagaauaucuaccaugagauaagcauugggcugaauauaacuugguaaauaaaacagauauaaucccugcccucauagagaugaaagguaaauaaaaauauggaguuuuuuguuuuuguuuuuguuuuuguuuuuuaagacagugucuuguucuauugcccaggcuggagugcggcagugagaucauaguucacugcagccuugaacuccugggcucaagugaucauccguacuagcuaggacuauagguuugcaccaccaugcccagcuaauuuuuguauuuuuuuuauagagacgcggucucacuuuguugcccaggcuggucucaaacuccuggccucaaggaauucucuugccuaggccucccaaagugcuugggauuacagucaugggccauugcacccagccaaaauaugauggauuuuucaaacagcuuaaacacagucaugaauugaccacugcaauaggcagacuucuaaagaugucccugcaggauucccaucccugggccgggcaugguggcucacgccuguaauaccagcacuuugggaggcugaggcaggugggucacuugaggucagaaguugaagaccagccuggccaauauggugaaacccccugucucuacuaaaaauacaaaacuuagccaggcaugguggugagugccuguaaucccagcuacuugggaggcuaaggcagcagaauugcuugaacccgggaggcagagguugcagugagccaagacugcaccauugcacuccagcuugggcgacagagugaaacucccucucaaaaaaaaaaaaaaaaagauuccugucccugguuauccaauuaaacacuagauuaggugcugccaugaagagacuuagcagauguaucaagguuacuagucaaccgacuuuaacauaggaagguuaucuugaauuaucuggguaugccuacccuagucacaugagguuguaaaaacauaaguggaagguggaagaaucagucagagugagaaagcagaagaggaugcaggagcuaugcugcagagggaaagucagauuccaaacacaagaaagaaaaagauaagaugaaucauugaugguucuaaaauguaggaggcucugugugaggaccagaaagaggccugagggagcuaaggguggagcccugccuaacagacauaaagaaaauagggacuucaguccuacaaccacaaagaaccaaauucugucaauaaccugaacgaguuuggaaguugguuuuucugcagucuccaguaagaaacacagcgcugcugauaccucgauuuuagcccagugagacauguauugggcuucugacugccagauaauaaauguguguuguuuuaagucacuaaauucaucauaguuuguuaugacaguaauagaagacuaauaaaccauuaugcauuaaauaucacagaaaagaaaggguuuaagaaaauagguauuaaaguaugccuuaucaccuuaucauucaucaaucugagguuuacuaaacacuugaugggugcucauuaguggaauaaauuaaugcacucauauuuucauucauuuguuaaaaauaugcauacagugccuccucuuugauggucccugggugagguauugagguuacaguagugaaauagguauuauccucuguuuauaacagcucauaauggaaguggaggacagaaacauguacauucaacaauaaugcaaagaacauaauaaagauauuaacaucaucauuauaaaacuaucaguaaaagugugaauaagggaguacagaauaauaauuacagcugacaucuauugaguacuugucucauuucccuucacaacaagccuaugagacuguauuaguccauuuucauacugcuaugaagaaauacccgagaugggauaauuuauaaagaaaaagaaguuuaauggacucacaguuccacauggcugagaagaccucauaaucauggcagaaggugaaggaggagcaaagguacaucucauaugguggcaggcaagagagcaugugaagaagaauugcccuuuauaaaaccaucagaucucaugagacuuaaucacgagaacagcaugggaaaaaccugcccccaugauucaauuaccuccuacccacugggucccucccaugacauguggggauuaugguagguacaauucaagaugagauuuggguggggacacagccaaaccauagcagagacagacccaugauucauaccaucuugcagauuaagaagcugagguacaggcaggugaagaaaccagccuaaaguuacuaucgguaagugguggagcuggaauuuuaacacaggagguccaacuuuagagcccaugguuuuaaacacuucauugugcugucucucauugcagaagggugaggaggccucacagaagggcugagauuugggaugaauaccuucaucaagaaaaggaggagccaguagaagaaacugcauugguaaagccagagauucaggaagaagguggaugguguggcauauucuggaacagggcucuguauuggcaaggagggguggcagaugagguuggagccuaaguuguccugacuugaaagacuugaaccucucagcaguuugaauuucguucuaaagcuaucaaaagaaccuauucaagagcaugauacgguaaaucaucuucagcaacucacauaucauuuuuaacauuguuucaggggauauuaguggacacucuuaggaacgcaguguauagcccacaaguauaaugacacuuauuaauacaacuuagaaaacacccuuugaaaaugcaucaaaacccuaaaagauucgauuaacucuauggaaaugaggauaaaggguagaugcauguaagaauccagcugucuucuaucuacaaagcucuucauauccacaaccacagagacacugcucagcuucugaaucgccuuaguucacaauaaaauagaaauaaaucauaauaaaauaaaauagggaauaaaucuaucuguuggcuuugagaaaauuucucaguagcaacaaaccaacugcucaaaucagaaucccccaaaauaaauaaauaagguaccuaagagggaaugcauguguugaccaaaaaacuaaaaaauucucccauuucugucugacguugaaaaaaaucauagguauuuggcauuuuagccuaugcuguugaaugugguagccacuaauuauauguggcuauuuaaauuuaaauaagguaaaauuaaauaaaauuuauuuucucagucccauuagccccauuucaaguccucaacagccauaugaggccacuggccacuguacuggucagcacauguaucagacauguccauuguugcaggaauaucuguugggaaaaaaaugaacuacuuauuuagauaaaaguagugauuuguuagacaugccuaauaaaauucaguuuauuuuaagauuauguaauuaaauucagacuuacuuauaagagucugaauuuucauuuuaaucguuuguauguauuucauuccucuuaguaugaagagagucuauaucaagagacucucuauggagacaggagccaguuuguauuaggccccagcucugucuugggcucugugcuaggcauuucauaucuguuaugcuacuuaaggcucaugacucccugugagauaggcaugcuuauucucauuuuucccuaaauggggggcugugacaaggcugaagcaaagagagggcacaacaucuuuucaggguuaacacuugagaaacaucuauuucuucuuaaguagcucuacugcugcuuagagaaguagaguauguagacaagacaguuaaauuuuccacagaugggguuuacuuagagggagauaagauuucuuuugcacacaauuguagauuuuuuuuuaaauggucaaaauccuccuguucuagcaguagcuaagaagugacucggggaagcauucaacaaguaggaaagaagucugcucagauggaggcccugaaucagagaugccugucaucuguucccaaaggcuccaaacuccugccacaaauacacugaggguuccucucucuauaacuucuucucuuuauuuucucuggaaggaauguacuugauacuuauuuuuaaucugagucuccuuccacaaaaaguguagaggaugugcuacccagccccuaaaguuuugccucuugguauucacacuugugaagucauuuuccauguggaagagggcugaccuguguaagcaauaagaugcugcagaaauguaugacuucuguggcuagguuagaagagccaugaguccuuaaagcuuucccccuuuucucucucuugaguggcugucucuggaggaagccagucaccauucuaugaaguuacucaagcagccaguggagaggcccacauggggaggaacugaggccucccaccaauacucuccaucaagcugccaggcaugugguaccuuagaaguggaucuuacagccccagucaagccuucagaugacuauagagccagaaccacucuacuaagccugucccaaauuccuaacucaccaaaauaacaugagauaguaaauguuuacugcaguuuuaagcaguugaguuuuggcauaauuuguuaugcagcaauagguaccuaacccagaggguuuuuccagcuuugccuaugggcaagucuacagaugaaacaagcugcuuuucauauuuagugcucucucucacaauuaucaggagauauaauuaucuuaccauccaggcugugauucuugcacacaagcaccaagucauccauuauugcagucucccuucccaugcuugaugaauaacuggguuccugugauuuuuccucuuuucuuuccccauugacuguugaaauuguuugccucaacuauugagucccuucucuucaguuugccuccuuuucuuuuccuccuacaugagcagaagccaggaaauugaauguauucgaucacaaaguaugcaugacccucagcaacaugagccuacaauagucuuuuuaaugaccagaggaagguugugaggacucuuaguuaauuuguuaugaacacccacucccauaaggaagcugcuauguauuuguggaauaaauuaaauaaaaucagcaaauuugcuuauuaucuauuuccugcccuuugaacacagguuuacccauaaacuacauuuguuacacacuaacugaauauggaaagcacuauggguaaugcaaaaaauauagcuugucuguuuucaguguacucauaagcaaauauaggagacaucacaaagaugcaaauauguauucauauucacauacaugcuuaaguagacauuuacauaucaaagacagugaaggcuaagggccaaaugaaugguacacacaaguguuaacagaucuucaaaagaagauguuauggcugugagcugaauugaucagggcagccuuuaugcaggaacaaagucuucagaagguuuaacuauggcagauacuauuacagauacuacuuguuucauccaguucuccuuuagccccaagcauagagacuccugcacaucucagccucuuaugagugggcaggaucaugugacuagcucuacuuaguggggcacgagaaaaaguaacauguuucauuucuuaagucaaagaaaaaacuauguuuaauucuccaaucuuucucccccaaaaguucacaugcucugggguaacuagaggauguuaguggcucccucagccugggucuaucugaaugacuacaauaagcagagcccccugacaacuuuuuuugggcauguaccauuagcaagaacuaaaccuuucuuugugauaggccacugugaucuggggacucauuuguuacugcagcauaacuuagucucuccuaacuaaaacagagauucccaaagauggagaaaagcagagcacaguagagguagcuuauaagucaugucuuauaugaccuuucucaaugacaaaccugugugcucaccaagacauagcuuguuaugacauaucugaauagaauugaagguuuuuaaauaaaaacauaagaagguuggaaaggcagcagaaugagcuacugccugugggugaucuuuacacaucucagaauaacaggauuauugaugccuuggccagaagcauuccuuucccucuguuuucuuuuucuuugagauugcaagccauauauuuccauuuggaaaacaguauuucauaaccucuaaaccuaacaugaguccugugaaacccuagucuacaguugaauggccaaaaauaaagacuugaaauuccuucaaagcuaucccauuuuacaaggcaaugcuuucucucucuaccaagaaaguguuccugcuugauagauuccccucucuugcuguauauuacacuuacugcucuccugucacucccuauucucuuccuaguuguuugugccuuauuaaauuccacauuuugaaacaaccaauaagaaucagaaagccugaagaagcccuuucucauacaaucagagcucccuuuuuaucuaggaauaaauuauauuuuccaaucaauucaugagugggauucauugacaauauacucucuuuguaacauauuucugaaugaguaguaaauggucuucaauaaggauauggcgauacauuuuagcuaaacuguuucauaccgacauuaacuccccuguuaacuuacuuaggagucuaaagacacaaucaaauagcuguuucugacuauuauucucaaagcgaagcuccaggccguaaucucaggacaugcaugaaaauaucaaguaacaacucaaaggcccauuucagcuucaaauaccuuugaaaauucgugaguuugaggagcagagugggauagcaggcgaguggaagaggaggcuucugagaaacuuaauuaucuacauuuuagaauguuucagucuuuggccuuuuaauacuguaguauagccuggcuucugucauucugaagggauuucccagcuuaacaaaaucccaaggaaccaaccucagauuggucucuuaccuaaggaaagauucuggcaacacaacaggaaggauuuggaaaauuuaaugaagauuuugaaauaccccuaacacacuuaaauuaaagauaauaccuauuucacccaaaucuccuaacccccuguggaagaucaauucuaauuuuugaggacaauuauucauguguuauuggcuugaaguacagaauguauuaguaagucucuucaguucuaaguaacagaaaccaaaucaggcuagguuaaaauugaaggggcaucauuagaaggacccaagagugucucaaggacucagaggcaaagaugcagccaguuccccccagugccgggaaccagaaggugggcaggaacucagggaauacagcccccuucuaucucugcuucucaauucucauagggaaauaugguuguccacagaucucagguuuaccugucauaguucuagccacaugcaaggaaugacugcauaucucugaauuccaaauuucagaaagugagaccuuggggugggagauggggcacgcuuggauucggugucuaacucuaauucaaacaacuuuugccacggagccauguaguagccaaauauguuucuaaggcccaagggaccacucuuacaaagauggaagauaguucacuaaaaagaagacaugcuuucuagacuccacagccaccccagaagugccaagauaaauaauagggagccagaguuuaagcaagggccaccaucacugcaaguugucucauccaacuucucccuuuauaggaauugacaugacuucaaauauucaugucugacaccaacgaagaggaaugucuguucuugagcucuuuuucucgguucccaaggggcccucaguacccugcuuuaccauuuaguguggauucugacaaaagaacaaauuaaguacuuugauuugauucuuaauuuuuccuuauaaagacuugcaauaaauauuguggguaccuagaaauaauccaccauagugcacaacacaaucuguugacuuaccuuagcuuccauuuuccuucuuggucugacauauaaauucaccuugcugcucaauucugucaccuacuauuuucagcauguaugagcaacaguaaagugcaugcccacagaacucagaaaugagaaaacuaauauugcucuguuauaugcauaauggaucaauacagagguauuuaaacacacaaagaaaaaaaaaaacaggucagcaagacuugacuuucaacugauagagaauauuaacauguuuauggguagaaaaaguggucaguuguagaaaaauauacaaagaaaagcuacaaagagauguuggcaguggccauuuaagcucugucuagggaaaggaagccuuuaguuaauggccuucaaguauucuaauguagggacacggcaccccuacuguggaaagagaugcaggagguggaagguagcuaaggccuuggaguuucaguuccacaggcaaggcuauccuuaucaugagaacugagcagcaugaagcuaucuguagucugacagucauauuguauguugugucaaaugaaaacauagcaucacucaauuccuuuuguucucuucucuugcuaaacacacaacuaucugaugcucuggcuucccauggaccucaggccugcuuagaggauggaaugcaauagucccacuagucugugcagugggccaacugcugguuguaaaaucacaaaggggccuucuagguuaccgcgucucacaaacuuggguaauguaauuccgucuugaagagagagucccccauggguaagaccauggaccaugguaaaugaguguaccccaggagaacugcuugggaaauagucacuuagccuauucuccuggugaugccccagacauugucaacauggaccccuuggagcauuuccucguugaugucuacauuuguuaccuuacucuuaauuaaauuuucuaaaaagauggcacaauaggagcacugagaacaugauuuuuaggaagaaaaggaaucccauguaaacccguuuccaucugugguucuugccuuucuguccuuauccauagggcagcucauucuugcauaucugcagcucuugcaugccugccauuuuguaucuuccuuuuucucguuauaucagaagcauuauaauaaguuacauuagaacccguuuugcauauuuuaacauugccuucacagugaaacuauagagagcuuuaugguggcacucuagugaauauucuguucugcuucuguuacaugacuaccuuaggaaaagucuccgagaacuccugucucccaugauuaucucuccuaaucaggcuuucuacuaucaaacuacucagcaaaaggaacucaccaaccuauagugcuaccagaagucuaauaacauaacacugucaccacaacuuuuucagcacuaaacaugaucauuuuuaaaaauaguaaguuuauuagguauauaaugauacuuuccaaguuccagccuguuuauaaaggacucuguauaaauaaggaaggggcccaggaauggugacauauuuaacguguaagucaggaugcuaaaugucugacuguauuuguuuauuuuuuucugaaauggagucuugcucugucacuuaagcuagagugcaauggcacaaucauggcucaauguagccuugaccucccaugcucaagugauccucccaccucagccuccugaguagcuagaacuauaggcacacaccaccauacccagauuuuuuauuuuuugaauguauuuauuuauuuauuuauuuauuuuuuguagagacgaggucuugcuuuguugcccagguuggucuugaacuucuggacucaaaugauccuccugccucagucucccaaaggauugaaauuacaagugugagccacugugcccagcuccuauuauauuuuuaaaaggaauauacugaggaaaauacaaauggaguucaacugauaaaaagaaaccucuguaauaugagcaggugaauacaauuuacaagaucauacuucaguaugaauucaguaggaauugcauguuuugccugcugugugucccuaagggugacacacuccugaaugggacuuuaguuugccauaagccugcuuuguuuuguuugugguagaaauuccaugcuaugaggaaaugcuuucauuucuuuugauaucucaugagcgcuuguugcaaaaaacauuuguaggcaaacagcuucacacauauuaaaaacuuguagcagaaaguuaauucccuaacauaaguuguccagcucagggcucuauaauccuguaauucauuuugguuccaauaaauacguacuuucugugagacccuuuggggaaaggguaauuagauauuucacaucagugggauaucuuuccuucuuuugcucccccuccuucuuuccuucuccuuuucuucucuuuaauucuucuacccagaaaaauucucaaggagcaaaaauacauuacucucugcauuuuuauaagcuggccaguuuugcuuccuggcuuuugaacagaaaauuaugccucaaaaauaaucccacauuauucucuaaauucauuuuccucagucauuagcccauaacggcaauuuuccuuuugaaaauaaagaauaaugaucauuuauugagacaaauccucaaucagaaugauucaaagagaauacaaauuuaaugaucacccugagaacccaaguaauacaucucaggaaauaauaauaaaauuuaugauggccuuaaaauugcuuaacuccuuucaggaaacccugaauuauaggguaguaacauaaccaaggacuggcaacaacucacaaaagucuagaagaguuuugccuuugaguucauagacaaagaugcuuaaauuguuccccguucaaaaaauaaagauuauuuauuauuuacuuuccugugcaccggacacuccugcaacaugacuauaacucuugcguucuuagauuugaucuucaaggucucugaaugaugaaaaaacuuguaggguagcaugccaaccaacuuggguuuuuugucuguuuuuguuuuuggaggaggggaacaaggcagggagagagggagagggagagagagagagagagagagagugagagaucacacuaccaggagcuucauaaagaaaccugcaaugcagaaccaaaguggaugaaagcaaaaggauacaacuuuucccuccagaugauuuuacugggaggaagaaagauuugaaacuauugagugcuuuuucugauaaccaccuauggcucucuccaaagacacacauguaaaguugggcaaguuguuuucugucaugucaggaaaauauuuaguagcagucuuacaaaaguaagcacucagcgccgucccagggagcuguggauuugcugugcagccuuguuuccuucaacagguuccuuuguugcuuuguguguucucccgacaaagggccugcccuucuucuacagauggguuuaccauucucucugaaugaagacuauucagaaguacacaaaccaacaaaccauccaagcugccucuaucugaugguccugguauauccagaguacuaaauaguggccuacaggaugggaaauucacacugacugacuccacaggagacugagaaagcuuaacuggcugauagcuguaaaguccuuugaaggaacaagcacuguuuaaaauucuaaguaguaaucuuauaauuugcuaauggaaagaaauauaacccagcuaaugugugccucccauuucagagaguauguuucaacagcaaagcccuuuacaauauuuagauaaacuucgauguauagaaagugcaacagcaagguaaacagcagggcuucccgcuauggcauuuuaaaauguggugggugaaauuugucacuccuaagcaagugccuauaguaaaaauaaaauaucacuauuuauaugguauguguuaaaaauuguccacucuccccaacuacaccagaucaaaaccucuuguuuuuuaaauuaugaaauuauugaacuguauugagcacaccccuacuuaugaguuguguaaccuggggcaugauauugaaccccucugagucauuuccucaucuaucuagacaaggcuaaugguaauaccuacauuguagggcugucguuagaauuuuaaaauaauuuaauaaaauaaaggcuaguauuuauuaaacucuaaauacauguuugcugcuaucagcagcagcagcaucggucggcaaucacgccaacacuccucaaagaaaacaguucugaaaaggcugugugcauccuaggucugaagauuuucuuggucuaaagagucucuugggcuagugaccaaauccuucauuaauuucaagagcucugggaacucucugaaacugaauguggaaugguauaacuacuggucugugcacauuuuucuagaaaaccucacaucuuucaucacauuaagagguuaagaaucauugccauauguagucauuagcuuaccuuuaucuacuuucuacuucuaacggagaacuagaguccuguuuagaacaaguaaccaggacagggacagaagaaggagacuaugcaucugucacucuugcugauuagucuccacccucucccagcuucugcgggccuccucucccaagaguugcgauccuagacccaccucccaucugcagucucaaccuauccucuucuaaggacuaaucauggcauauggcaggagagauuuaagacuagcuaggucaaugcucuaagcucaacaucaagucaccucugaggcaggguguugucauggaaugaucaugaccucugaaauaggaaggucuguguuugauuuggcuugaccacuuacuggacgugugaccuuggaaacguuuacuuaaucaugucuuuugucaccuauaaaauaaauacaauaagauuuacauugugagucuaugagagagaaaugagauaauauagagaauauuuuuaaaaugggagcauaugucaggcaacaguagaugcucagcaauguucuuuucuuaccugggcuucaaccuggcacccuuggucaccuucccaggacccaaaucccucuaggaauaaacucuggcccuugcuggcuucuuuauucuuccucccaccuacauacuugaacccauccaaagaaauaggucugacuaccuuggaaaccuuuucugaugcuuacuacuuguccaacauucauuuuucuguaccauguguguagauacuggauuccccauccuagaauucuacccaccucuugggcuacccuguuacaaugugugacugacuauccuacucccacuuuccaaguuaaccacuuaauugaauggcugcccaucaacauacuccuuaaaugccaaguuaguucugucaaacccaauccacagacaagccuuauccucaaaccuuuucugcccucugccacagugcuaacugguucauugugcuuguucagcaugcagggaccuuuaauuuaaugggccucucccauuuuucacauaucaugaaaguuaucaaauuuagguuaauuaaguuuaagacauccauaguuauucgagugaaaacuugaaggcagcauaauggauaauaaugguaaaaugauaauuuuugagcucuuaguagaugccaggcauaguccuaagcaguuuaaauauauuuuuuucauaugauuuucauaacaauccuacauaguagauuaugaucauuaucucuacuuuauaggugaggaaacugagacuuagagaaguuaagcaaauggccaaaaguuaugcagguaguaaguagcagacauagaauugagaagacagcccccauucuaaauaaguaugaaaaauuucagggugucaauuuuuagcuaaggaaaacuuauucauguguguguguguguguguguguguguguguguguguguguaaaugaauagauauucauuuacuuauauaucuauuucccaggccucaaugcaaucagagaucucugaagaagugaccauauuaugaacauaaauuuuugacuucauaacuuuacagugauaaauaaccucagguuaucaggauccuaaccuuaaaccaccugagauuuuaucacuguuccuuuaguaagcaagggauuuuucaacccugagacagauaaaaaauagauuguauggucaaugaaauccauuauauucauacuuuuugguugaguuuagguaauggaacaaucugagaauuuuguaucaaguauuugugauguuuaagaggauuuaucauauuuaagaaucugacagauugccccugcaauuagaaguacaauugauuacugacuucuaauuuuagguuaaaaaguuuaacagaauuugauguuuuuaaguaguacugagauguuuaaauaacugaauuuauucuuuaugagucuaguauauuugauucaaaacauggcuucaaagcuuagaaagguuuugcuuguuaagguugugagcuuguacugccaaguauucgaaguguuuacaaagaaaguaaaauuguuaaauguguaaaguuauuuuaaaauauugaugaauacauuuaacaaguaaauacaaaaguguauuuaaguagacauuauucuuuuauggcauucauaaauucauaaauugcacaagauaaccugaguugcucuaaaugcuuuucaaacuuaaguuuaggggagcaacaucagcaagauggcucacuagaaacuccagcacucaucccuuccacagugacagccaaaacaaugaauaaacaacuacacuuuaauguacauaacugaaggagagugcuagaauacaucaaaggaguaacagaaacccuggugagcacagaaacucaggacagccacaaagagaauggaaggaaacaucacaacuccaccacccuauccccagcugagaugagccagaaacccagaggaaacuuucccuauaggaaaaaggcaagcaagaggauuccaguagccuccaccaacaccuuggacacccacaguccucacuacuggaguccuuguagucuucacuggcacuaaguccagcugagggagcugccuacaggccacacagccacacucaccucagagaaggaacuaauacugugcucuauucccuguagcccacauggcaacugugcuauaucaucuuagaacuggaacuacugcugaagugugauuuucucugagggugagcaggcuugacaccccugccuccauaaggcuaagcugccuccaaaccaccccaaaccaguggccacagccaagcugccagcagcuguuaaugccuuuccccauggagccaaacagugaaaacugcucuaccugcccucccucaccuucaccugcccucucccuucaccugcccucuugugcuagagaugaagcaauacauucccuccuggggaaacagugcuuuggcagaacagcuccaucugcuucucuccgcugcaacuguacacugcuucuaggggucugagccaaaauggcacaguaucucccaaggaaauagugcuuugguaggacccuguaucccagguaaauggugccugggccacacagaacagucaugccugaguuaaagugucacauugccccuuggggaaucauugccuuggucaaguuaaacaacugugcaucccagggcugagcugauguaguaucuugugucccaaggaaacagaguagaacaugaccuaagacagucuacccuacuggacaaucuaguacccugcuuuccugaagcuggacuagcccacuagagucugaacugcuaagaccugcuguuuccuggggaguggacucaucacugugcuacucccugcccuccaggacccaaacaauacccaugcucagucauucuaggguacuugcugccacugcgccuggccacauggagucugggauacagauaugccccaccauuccaaggucuaaauuuaccacuacauaguucuucauucucagggaccuaagcugccacugaacccuauuggcuuaggcuccuaaauuauagcuguaccaugcaugcugugcucaaaccccuaaaacucugcuucuuucccagagcugagccagggcuguauccuauuccccagggguagaaucacagcuacaaccugacccacugaaucaaagcugguaggggcugccuaacagucauagauucuggcucugugggaaaccuauauuugacccagcuacagagagugaaccuguaccccaggacccaagagccacaauaggcuugugaaacucugauauuagcacccugacuccauagccacuucaaguaccaaucccuggaacucaaagcaauggaacugcuuguaggccauguaagagggauccucuuguuuaauuauccccauugugaggaaaaucagaauaggaggaccccaaaagcccugccacugaggacauuaacaaccuauguugucacugccacuaccauaccccuuuuuuuuuaauuauacuuuaaguuuuaggguacaugugcacaaugugcagguuuauuacauauguauacaugugccauguuacugugcggcacccauuaacucgucauuuacauuagguauaucuccuaaugcuaucccucccccugcccccaccccacaacaggccccggugugugauguuccccuuccuguguccauguguucucauuguucaauucccaccuaugagugagaacacgcgguguuugguuuuuuguccuugcaauaauuugcugagaaugaugguuuccagcuucauccaugccccuacaaaggacaugaacucauccuuuuuuauggcugcauaguauuccaugguguauaugugucacauuuucuuaauccagucuaucauuguuggauauauggguugguuccaagucuuugauauugugaauagugccgcaauaaacauacaugugcaugugucuuuauagcagcaugauuuauaauccuuugaguauauacccaguaaugggauggcugggucaaaugguauuucuaacucuagaucccugaggaauugccacacugacuuccacaaugguugaacuaguuuacauucccaccaacaguguaaaaguguuccuauuucuccacauccucuccagcaccuguuguuuccugacuuuuuaaugaucgccauucuaacugguguaagaugguaucucauugugguuuugauuugcauuucucugauggccagugaugaugagcaccaccauacacuuuuacagccuaagucauucaggcauccacaguuacuguugacacugaaugcagcugaagaaacugcauagauacuauaccacugaaccuaccuggaaacaaagucaccacacuuuuccuaauuagcacacuaagauccaacuacaggugaaagucuuucucugcaaaagccacucuagaaagucuggaagaggcaauuuuuccaccaaaugcauagacauugauguagaaacacaagaaauaugaaaaagcaaagaaauaugucaaugccaaaggaacaaaauaacucccuaguaacaaacccuaaugacaagaaaaucaaugaauugccagaaaaggaauacaaacuaguacucuuaagaaacucaacaagauacaagaaaauacagauagacaauucaacaaaaucagaaaaagaauuuauuauauaaauuagaaauucaacagagauagauauuauaaaaaauaauucaauuaauaaaauaaaaaauacaauaggcagcuucaagaacagacuuaaguauagaaaacaaucucugaaccuaaaaauagguuauuuaaaauuacuuagcuagagagaaaaaaaaauaagaaagaaaaagaguuuuuaaaaaagacuacaagacuuauaggacaccauuaagugaacaaauuuucauauuauggcaguuccagaaggaaaagauguauuaaaaaaaaaaccuaauuuaauuaucuaauagcugaaaauuucacaagucuggauagagauguguauauacagauccaggaaacucaaagguucccgaauagauucaagcccugaugcacauuauaguucaauugucaaagucaaagacaaagcaagaauucuaaaaacaacaagagaaaugugucacaguacauuuaagggaauccccauuagacuaacagaagacuuucagcagaaccuuauagaccaggaaagaacagaaagcuacauucaaaguacugaaggaaaaaaacugucagucaaggauacuauauccagcaaauauauccuuuagaaaugaggaagaaauaaaacguuucucagagaaguaaaaacagggaauucaucaccacuagaacaguuuuacaagaaauucuaaagggacuccugcaucuggaagcaaaaaaugauuaucacuacuaagaaaacacacaaaaguauaaaacucacugguagaggcugagcaugguggcuuacgccuauaaucccagaauuuugggaguccaaggugggcagaucaccugagguugggaguucaagaccagccugacuaacauggagaaauccugucucuacucaacacacaaaauuagcugggugugguggcacaugccuguaaucccagcuacuugggaggcugaggcaggagaaucacuuguacccaggagguggagguugcagugagcugagaucgugccauugcauuccagccugggcaacaagagugaaacucaucucaaaaacaaacaacaacaacaacaacaacaacaaacucacuaguagagcagauacacagaaaaaaagagaaaagaagcaaaacuuaucacuacagaaaaucacuaaaccacaaugauaaauaauaagagaagaaagaacaaaggauaugcaaaauaaccagaaaauaguuaacaaaacgacagaagcaagucaugacuuaucaauaauaaccuugaauguuaacagaauaaauuccccacuuaaagacauagacugacuuaauugauuuaaaacaaaagaaaacaaaaacaugauccaacuauaugcuuucuauaagaaauucacuucacuacuaaggauacauacagauuaagagcaaaggaauagaaaaagauacuccaugcaaauaaaaauaaaaagcgagcaggaguagcuuuacuuguaucagauaaaacagacuuuaagugaaaaaacuguaaaaagagacaaagaggaucaucauauaaugauaaaggaaucaauucagcaagaagcuacaacaguuauauaugcauccaacacuggaacacauugauauauaaauuaaauaguauucaauccaaagggagagauagaccccaaugccauaauaguuggggaccccacucucaucacuggauaggccaucuagaaagaaaaucaacaacgaaacauugaguuuauacugcauuuuagcucaaauggaccuagcagacauuuacagaacauuucaacugacaguggcagaauacauauuauuuucaucagcacauggaacauccucaaggacagaucacaaaggccacaaaauaagucucgacaaauuuaaaagaagugaaaucauaucaaguaucuuuucugaacacaauggaauaaaacuagaaaucaauaacaagagggacuuuuggaagcucuaugaauacaacaugcuccuguauaaccaaagacucaauacagaaauuaagaagaaaauuuaaaaauuuaugaaaauggaagcacaacauaucaaaacuuaugagauacagcaaaaacagugcuaagagaaaaguuuauaacaauaaacacaucaaaagaguagaaagacuuuaaauaaauaaucuaacagugcaagaacaaaaaugaaaacaagaacaaaccaaacccaaaauuaguacaaggaaagaaauaacaaagaucagaggagaaauaaaugaaauugagacuaaaacuuacaaaagaucaauuuuuaaaacuuuuuuugaaaagauaacaaaauuaacaaaccacgagcuaaacuaaccaagaaaaaugucccaaauaaauaaaauuagaaacaaaaagagagaccuuacaacugauaacccacauauacaaaagaucauuagagacuaguacaaacaacuguacacccacaaauuggaaaaccaaacagaaacaaauuccuagacaaccuaacaagauugaaccuagaagaaauagaaaaccuaaacacaccaauuacaagcaacaaguugaaucaauaauuuuaaaaauguucuaucaaagaaaagcccaggaccugauagcuucacuacugaauucuaccaaacauuuaaagaagaacuaaugcccauccuucucaaacucuucuagaaaauaaaagagaagggaauucuuucaagcugauucuacaagaccauuauuacccugauaccaagccagauaaggacacaacaaaaaaaggccaaaaucccugaugaacaucgaugcaaacauccucaacaaaauacuagcaaguugaauccagcaucacauuaaaaagaacauucaccaugaucaagugggauuuaucccagcgaugcaaggacgguucaacauaugcuaaucaauaaaugugauacuucacauuaacaaaaugaaagacaaacaccauaugaucaucucaauagaugcagaaaaagaaaagaaaauucaacaucccuuccugauaaaaacccugaacaaacuaaguauagaauaagugcaccucaacauagugaaggccauauaugacaaauccauaccuaacauuauacugaacagggaauagcuaaaagcuuuucuucuaagaacuagaacaagaccaugaugcccacucccaccacuguuauucaacauaacauuggaaguccuagccagagcaauuaggcaagagaaagaaauaaagggcauucaaaauggaaaggaagaagucaaauugucccuguuuacagaugacauaaucuuaaauacagaaacccauauaagcuguaccaaaacauucuuagaaugagacaacaaaaucaguaaaguugcaggauacaaauuaacauacaaaaaucaguaccauuucuauacaccaacaaugaacuagugaaaaaauaaagcaagaaagcaaccuuacuuacaauagcuacagaaagaaaauauaaaauaccuaggaauaaaucuaaccaaggaagcaaaagaucucuacaauuaaaugacaggacacugauaaaagaaauugaagaucugguuacaaaaaaaggaaaauaucccauauucaugaauuggaagaacuuauauuguuaaaaugacaaugcuaccaaaaacaauuuacagauuugauguaaaccuuuucaaaauaccaauaucauucuucacaggauuagaaaaaauccuaaaauuuauguggaaccacugaagaccccaaauagccaaagcaauccccagcaaaaagaacaaagcuggagguagcacauuaucugacuuuaaaauauacaagaaagugauaauaacuaaaucaucauguuacuggaguaaaaacaaacacauagaccaguggaacagaacagauaaaucagaaguaaauccuuuaauuauagcaaacugauuuuugacaaaaugccaaaaacauugagugugcaaaggacagucuauucauaaaugaugcugggaaaacuggauauccauaugcagaaaaaaugaaacuagaccucugucucucacauauacaagaaucaaaucaaaauggacuaaauaauuaaauguaaggccucgaacuauaaaacuaagaggaaaacauuggggaaaaugcuucugggcauuggucugggcaaagauuuuuuggauaagaccucaaauauaaaggcaacaaagguuaaaauagacaaaugggauuauaucaagcuaaaaagcaucuguacagcaaaggagacaaucaacagaaugaagagacagcccacagaaugggagaaaauauuugcaaacuauccauuugacaagggauuaauaaccaaaauauauaaggaacucaaacaacucaauagcagaaaugcuaauaauucaguuuuaaacugggcaaaagaccugaauagacauuucuuaaaaggagacauacaaauggacaagaggcauaugaaaaaaugcucagcauccguaauccucagggaaaugcaaaucacaaccacagugagauaccaucucaccacaguuauaauggcuacuaugaaaaagacaaacaauaacagaugcuggagaggauacaguaaaagaggaaugcuaguguacugauagugggaauauaaauuaguacagccauuauggaaaacgguauggagguucuucaaaaaaacuaaaaauaucuacaaugugacccagcaauccugcugcuggguauauaucugaaagaaaggaaaucaggauauugaagagauaucugcauacccauguuuacugcagcacuauucauaauagccaagauauggaaucaaccuaaguguccaucagcuauggaugaaaagauaaagaaaaugugguauauacacacaaugaaauacuauuccgcuuauuuuauacaauuaagccuaaaauauauuuuaaaaaauaauaaaauccuauuugcagcaacauggaacuggaggucauuauuuuuaugugaaauaagcccaacacagacaaauauuggcugggcuaaguggcucauaucuggaaucccagcaauuugggaggcugagggaggauuauuugagcccaggaguuugagaccagccuggguaauauggcaagauucuaucucuauaaaaaaauuaacuggcuguccuagcuacuuggaagaccaaagugggaagaucgcuugagcccagaaaauugaggcugcagagggccgugucugugccauuuuaacuuuacuccagccuaggugacagacugagacccuuucucaaaaaaaaaaaaaagaagaagaagaaaaauaauaagaaugacagacaaauauuacauucucucacuccuauguggaagcuuaaaaguguggaucucauggagguagaaaguugaugggugcuacuagagccuggaaaggguggcaagaggggugaagagagguugguuaauagauauaaaaagacagcuagauagaaggaauaaguucuaguguuugauagcacagcagggugauuauaguuaacaauaauuuguuacauauuucaaaauagcugcaagagagaauuugaaauguuccuaacacaaagaaaugauaaauguucaaggugcuggauauccuaauuaccuugauuugaucauugcacguuguaugcauguacuaaaguaucacaugagccuauaaauauguauaauuauuauguaucaauaauaaaaaacauuaaguuuaaaauauaucuuuaauaaauuaaacuuuuguuaaaagcccaaauuauaguaaauaaacccuucugcauacaaaaagugaucuauuagccacugaaaaucuuauaagagaguuuuuaugacagacuuaugagcaauaauaaguauuuuaaaauauaaaucagaucaugucaugccuuggccuaaaacucuucauuguuuaacaguuacucuuaugagaaauuccagucucccagccaaggucuaugaaacucuucaaaauugacucuuguccacuucuaccuccucaccaauuaucaaccucacuaccccagucacuuuggccuuuuuuccucuuucugauacaucaugagcuuauuauggcaacaagucuuuuauauuuguuaacuucucuaccuggaguacuuuucccaaaauauuuugcaaggugggcucuugcuugacauuuaacucucagcucaaauaucaccuccuccagaugccuccucuaauuguccuuuacaccaauaaccucugacacauucauauguuuuacagucuuaggaauauccucaaugccugacuuaccauauucauuuauuggcucccauauuuauuucccccucucccaaauaaaauaaaagcucaaugagagcaauaucuugucuuuccuaaaccauugcuuggcacauauuaaaugcucaauaaauaucuguugcacaaaugaauaaacuuaaauaaauaaaacacaucuuugccuuaauaccaaguuauuuuuaaaucauauccuuauguaauaucgaauccauaagacucaauuaucugggguuuauuugacaaauuugauuaucuuauuuggggguuaauaccaugaauggcuaaaaauaggccaauugccaagcagagcacacaagcaaauaugaucccuccccaggaugcuugccauccaaauuacaagcauugaaaaaucuuggcaaggcgccuaugcuaauaagaaagugauccaauauucaugagaagaacuugaaaaacuauuauuuuugccugcaaucuucuuggcuuuuccauaauuaauaugucauuaucaucagaaggcuaagagaucaagagugguaaaagcaaccuuucauguaauacucauagggacaaugguauuuagcaaauaucacauugacuucugguaagagaaauaauccagaaucugugguugcuagaaaccuaguauauggaaaaaauagaggggcaguuggcaucaagacagaaagguaggguuuuaaagcugaucuagagguagaaaaaaacacauucuagagauuccugaagaaacaaauuccaaguacucauugucaugaaaaacgguaugauggaguccuacccucugucuguauuguucuuuuuuaaauagaucuuccugguuaggucaggaagaagcuauucuugaaugccaguuaauacauuccuccauuuacucaacauucuaucccuacaccaaauuagcucaguagaaaggcuaucuagacuaucuacuaccuaggucauaauacauuagcaaccuguacaaaugucuuuucagaguuucaguuuauagcaugccgugguuuguuauccagggugaaucuaggaaacaauuagaucuauaaucucacagcaaacuucauuugacuauauuugcaaauguuaucaacuauguuauuuuuuuaccaucauauauauaacgauugauauaaaaaguuuuucuuacaguuaggaaaaauuugucucuccugacaaagugguauucuuccuuuugcaacuaauggcaguuauguaacuugcuucucuuagauggccuuggccaucuaagaagcucagagcagaacuaacuuguuuaggucgucuagaaugacuucuuccgaucccuauuuuucucugcuuaaacuuguuguucaguucuguuaggacuuuuguuuuguuuuguuuuuuacauauaugccuuuucucauuaguugguuaaaauacgcuuuuaaaguguauaagauaaaaauaguagagccagacacggugccuuacgccuguaaucccagcacuuugggaggccaaggugggcagaucaucugaggucaggaguucgagaccagccuggccaagauggugaaaccccaucucuacuaaaaaauacaaaaauuagccaggcgugguggcacacgccuguaaucccggcuacucaagaggcugaggcaggagagucgcuugaacccaggaggcagagguugcagugagccgagacugugccacugcacuccagccugggcaacaagagugaaacuccgucccaaaacaaaaaacaaaaaaaaagaguaaauaauuuugaaauuuuaagcucccuuuuaccaaaaaaggguucugacuucuggccagaauguaguaaaugucaagaaaucagucacagcugagguagugccaggaauuuggugugggggacaggaggagacaagcaaagacuauuuaaaaacaaugaauuuuagccugucuauaaguacucuuuucuaugaaaacauaaaaggaaauuucccuuacaaauguugauugauaaacaugaacgucuauauggaaaauaaugcgauaucugagcuaaaaggacucuuagugaacucugauccaaucuccuugauuugaggauagggaaaaguguaaucccuaaaagauuaaaugauauuuccaaagaaacaacaaguugguaauuaaguccggccugaaaucuggggcuucugcuucccagguuaugagcuuucuaacacuccaagaacugugaacccuggagggaagguuguaaucugacuuuaacuccugaggacauguggauaugcccuucaggguccagggacauuuggguugcacauuaacaguuaaaauaugcuaaagcaccgcauuuucuccaacuccauucaaugccuaagguuuauuguuuguucaguuuuagccaacuauauuuccugaguguuucaaaaggcagcaagguggcgaggauacaagggaaagccgcuacacauucaacauaggaauacaaagauuauaguagaauucuacgcaucaaauuccaauucaaauuucuucuggggucagugucaguaucucccacuuccuccugacacauccugagcugaagaucccuuuuaaauuuucuuucuaagaaaaaaaaaaauauagguuuauugaucuccuuuaaaugauagcuuuagaauaacaugucaaauuauuucuguuucuugacuuauucuaggaaaaaagacaaagaaauaagauauucauauaaaugaaaaguuucacagccggcaaccaacuaauugguauauauuuaaacacauuuaagauauuacuugauuacauucaauaggcauaauguccauauaagaacaaugguuuuguuuggaacauauaaaagugauaguucuguaacauguauuuauuuaacuuuuuauuuugagauaauuauagauucacuugcagugguaagaaauaauauagacagaucuuuuguauccaucacccaguuucucccaaugguaaaucaagauauugacauugauacaauccaccucagauuucaccauguuagauauaaguucuaaauuucucaucaaagaauaaauaugccaguauguucaauucuuugccuucuacuuuuaaacuuaacuuccucguaaaguaaccuuuuucgauuaccuacuccaccccgacucauuccaauuccuacuccaccccaacucauuccgaucaccuacuccacccugacucauucugauuaccugcuaccugcucugcccugacucauucuccacgcugcauaaccauuuuuuuucccuccaaagcacucacccccucacucucuuuaaauuagccaauuggaauuaguuucgccugcguggucuaauccuagccaacaggggaacgacacggcagcaggggccaugugccucagggauaagaacaccuuccccucccuuguccaagugugcgcucaccauuguuccaucuguaagggcguacccuucuguagaaguaacuugccuugcugagaauuaaaagaaaauuuuauauucgaugccguuucuuuugcggcaccgaaacuuuauauauaacaaccacuuugacauucauuuauauaaagaucaauuuuuaauagcuacaaucuauagagcacuucuauaugccagaccaacugcucacugaugaacaaacauucuucuaguucauuccuacaaaaaacaauuuaccaguggaggcaauagugaggacuguagcuuagaagcuuucaugcuacaauguaguauaugcuacaguguaguacccuauagcuguaugggugguucauuuuaaaaauuguauaugcagccauuccucaauaggcucaaaauaaauauugacagaaauagguaaguaaaucaaaagagaaaaucaaagccaggaaucaaaagaagaggcaaauuggguuaauaugauucaauuuacgucugggcuucuugguagacaggacaaaaagguaaacagaaugagauaugcaauccuuuuugucaaaaggggaaacucauauugauccuuuaagauauagauguuuaaaaauaugucuaugucugugcacauacccuuaugcuagcuccagcucaguuuuuuaaaauaaucuuuucagucagaguuuaugaacauccaaauaaaacugugucaacacaugcuuaauacaucaguaaaacuauuuuuaauaauguacucuccuauugaauauggguugguuuucugacuugcuauggcccauugagugcacagaugucacaguguucuacuuccagguaguccuuaacaaggcuggcagcuucuacuuugaaacuuuccaaaaaauuagcuuccaugauguaaaaaaaaaaaaaaaaaaaaaaaaaaaggccaauccagaauacuacaugauaaacacuugugaagagacugaggucaugugcacagcaccaaugcacagauacgagugaauccguugaucuuccagggcagcauagccgaaagcugaaugcagccuagugauugacccagccuacaccaaauggagcggaacaacuacccagccaagccacgccccaauuccugaccuacagaaccuugaaaaauaaugaaucacuguugguuuaagcaacagaaguuuugagguagucuauuacacagcaaucaauaacugaaacaauaacccaaacugauaaccugaaaauucauuuuguaaaccugcaucuaaacuugguacaauaauuaaacauuuucugugcaaguagucccucuuauaugacuagaauguguggaaugccuaggagcagcuuuuccaaaugaauucaucaauaaacauaaaacauaaaaugaacugcucuaguuuucccagagauucugccuagaacagacugcccuaggacagaugauuaaguuaguuuggguccaauucaugacuacauaacauggaguuaguuaugucuuaggcuacgucccuucaggcaacuuggagccucccaggguuaaagaagcucugccaaaacucaaaaucaauagggccauuuaaaugaugacauccccaguggguaaagauauuugacuccacacaucaauggcaugagcuacugucaugggcauucgucaauagguugaagaucucauuaaagcuuuuuaauuucugcuuagugguauuaggauuuaauugaugccaaagacacugccugucacuauacagugauguuguggcagucaguagagaaugucuuacacacaguccuagaagaccuuccuagaaaggccagggcaguucuacuggcugcauuuccuggcuugacaggcuacugcuacuuuauaguagcucucucuauguuguucuaccuucccaucauccgugcacccaucuucuuuuaccagcaacccaauuuucugaaaaacuacuccaucuuuauucuuaguccauguugcucagaaggguuugauucuacccacagcuucaggcaugggcacaccacccagaucagguugaucacccuggacauauaacucaagacagugucaaugagaucaaaacuuugaacucucaccaauacuauuggaaaugagaaacucuauuguuucccacuggguugcuaaacugguagaauggaauggguauauauaacugacagccuuuuugccauuccagggagauaaacccuaagaacaaacaaugcauagaucacuugaucuucuggauccagcaguucuagaagucauacgugucuauauuuuuucaguauauaagccaauaaaauaucauuuucaucuaggcuguuuugaguuguauuugcuaucucuugcaaucauucucagaaacugccaaaagaugggcugcugcacaacuaugggaugauggaaugccauuuauuuucugggacagugcaauuuauuacaauuuauuacacucccuuucugagccauagaucagaaaguacccgggcguuaagacaacagcacuucaaaaaacaauaucauacuugaucuucauaaaguuaagugagcaaacaaggaaacuaagacauuaaugagacaugugguucaaaagucauccaucaaaucaaauauggcaccaagacuggaaaccaagucuucaugaaaugcgagguuucuguugcuugaaucaauggaccuuaaaggugauuuggucuuauggcuccccaaugucaguccauggauugggaucuguugccagaguauguucaaaucaucaauaguccacagaguaaugagaaaaauaaagaaacuuugauagguuuuaauggagcaauuucauuucacuuuuaaagccugaaauuucauccuuccagguuuguuugguuuuuucuuuugguguuaacauauccucuuuuugaaauaauagcaauaguagauguaaaucaucuuuuuuggcuaaauauaaaguaagcaagcccauagccuccccuggaaggcacugccauuguuuccaauacucucagcuuuaacacugacagcuacccuugcucucuuucucacugacacccaccaacucaaccagcccucucccaccacacacccuuucucaggucaccucugugcucuccacccuuggagcuuuaccucuggguaauucccuugucuuuuguaauguauauuagaguguauauuagaguguaauguauauuagacgucuauaacuccugcuauuacucugcucagcaccuucuuaggacagaagcagcuauccuuucuccugagaaggugggaaaaaggcaaauuaugcauacuuauaaauaaauauuuguuggucucaaacaaguaaauuuauaaacauugauacuaacauuacuggaagcauaaaagcauuagaaagacauuaaaugcccuacaguagagugaaaauuaaauucugccaucuaggagaauaguauuuagucauuaaaguuaugauuauaaauacuuuguaauaauaugcguaaaugcauaugauauaagguuaagugaaaagauacauaacuacaaaauacaacuauguuaaaauauccaugcauggauuaaaaaaauacagcuuuaacugcauaguggaguuaccgguaaugucuacuuuuauauuuauagaaaucucuguuguccagauuuucugcaauggguacauaugacuuuugaugggguucagaacaugcuaccacaaaacauggcaccuuggcauuuugaauauuuuaagcugaaggagucugagaaacagcaugugcuggaaggacucucugaagcaggucagaagccccuugugugagaggucccucccuaaacccagagaaaaggagcauccuuaucucugaagauggagggacacacggagaagaaacuccaggaaccagccuugguaaguuuccccuaguuuacuacacuuaguucauaugcuuuuccacaaguuuccacucuucaucaaaccuaguauaaaagcacucagguuuaacugauucaucagauuuuccuuccuuaugaaugcucuagugacacauaaaacuuguauuaaauacauuuguaugcuuuucucuuauuaaucugucuuuuguuauagagcccuagccaagaaacuaaaaugguuaaagggaagauuuuuccuacacuuuaaaguguacaaauauauauuuauuaaaguuaguuccaauuauuauguagccaauauuuacugauuacucuacucuguagaugccaagaaagccauacucuuuccugauaguuuccuuugugugacaagauuugccacagauguaggcaauguugguauuauacuuuucuugacagcuagaauaacuucugcuaagcuaggcaaccacaucucuccaagccauccuuaaugccuaaugacugccacugcaccugaccuagcuccagggcugacccuuucauguuuaccccaaggccaugcccaucugggaaaccaccugggcagguaccuuccaaccaaauuaaagucaaggauuccauccacuaucacuaaacuagcacaaaccaagagagagaaaucaaggcaccacauagggguuaggacaaguaaucaaagucagguagaaaucccagaagggugguauacaauuuauauuucccuagugaggcccauucuagaauaaugggaaagguucacuguugucagaaugccaagaaugaauucucugaaucuggccuucccugaaaucaacacuuagguucugacaaccucuaaauucauccucacuaacuacaucaaacauuuagcaugcuuuuuauuguggggauggggguugcuuuuguuugauuugguuuaucuggcaucugaaacaaaagaugggaaaggaugacauucauucuuaaccucguguauaguuaaccacaucaaaaaaggcuauuguuagauacaaauaaacguuaacauacauuaguuccaaaaggcuaaagccuuucaggugaacauuauuggacacuuucuccccugugccagacaaaacuaugcauggcuuauucccagagucaccccguccuuuccaaggcauucuaugcugccucagggaugcaaacaauuaugguacuuccaggagagaaggagcacauaaauucugucaccccuugaccccaggauccaauuucacagcaaugggugaaaggauuuuuuagucaagagaugaugugagacgcacagauaccccuuggagucauuugggugacagcauuaaagagaaugaaaugagcuaucuugaaauggaggccaagugcagucacugcaucuggaaaguuaggcuccuugauauucaaagcucuggggcucggcaaaaaauucaaagagcuuuuaguauucaaaacaaaacaaaaaaaaacaaacaaaaaaacaaaaaacacucuuuaaaaaauuaaaauauucaaaacuguggaaaacuugcaagaaucauaucaugaacaucccauacugucuucccaagauucauccauuugcuauuauuuugccauauuugcuuuaucucuuccuccuccucugcuccccuucccucaaacaaacaaaugaaaagugguuuuugcuaaaccauuucgguguaggugugaacauuaaaagcuucuaggaauuacaguagucucucacacauacaaugaucaaaaucagggacuuuaacguugauagaauacuaucuuacacguaguccauauuuacuuuucuucaaucccgaguguccuguauggccacuuuccuccagucuaggaucgcacuggcuuuuagcugucaugucucuuuagccuccuugaagcuggaauacuuucucagccuuccuuugcccaucaugucauuaacauucuugaagaggacaggccuguggcuuuucagagaaucuaugcuggucugacuguuauaugaggauuagauucauaguacauguuuuugaaaggcauacuaccuaagugauagcauauccuucucauugcauuacaucaguuggcaccugaugaaacuuggucccauucuugauguguuaaccuugauuccuuaaauaagguguuuucugccagauuaccucacuguauguguguguaugugcagguauuccucuuuuucccuuuuauaauuaauaauguaugggaagacuuuuuucugacuguguaaacacccugcuaaucaacaagcuuucacucaaugguuuaacaccuauugacaauucuacucugaaucaauuauuacuauaauaguuguaaaaaagugauuuuucuaacucuauuauuucuuucacagcaauuaguugguuuucuagugcaagaaacagcugcccuuucucccuucuuuccuuccuuucccuccuuccuuccuuccuuucuuucuuucuuucuuucuuucuuucuuucuuucuuucuuucuuucuuucuuucuuucuuucuuucuucuuucuuuugguuauaucuuacucauuugauucuuaagugucccauuucaagcugguuccugugucauucagacagguccucauuuuuuuuuuaaucaguuuuuauuuucuggcacaacaaaauguuccaggcuuuucuuguccuuucccugcucugaaacugcaauuagucauugcucuaagcagggguccccauccccaaccuccaggcugcagacugguaccagucuguggccuguuaggaacuggcugcacacuaggaggugagcagcgggcaggggaaccuaacugccugaucuccgccuccugucaggucagcugcauuagauucucauggcaacauuaacccuauugugaacugcgcauacucauuaugagaaucuaacuaaugccugaugauuuuagauggaacaguuucauccugaaacuauccccgcuccccugccaccgauggaaaaauugucuucuaugaaaccggucccuggugccaaaaagguuggggaccacuguucuaagggcccuuauuuuuaguggggaaugcuauuuagaaagcaagagcugggcacucaguguguucacugcugcuaggaguguuauugcuugcaggcccuuuaagaggacaaguaagaauuauaaauauauauugagucaugucuuccuauugauacuucuaaucuccauccaauagcucaggcucuuccuugccuuuccccaauccacaguuguacugcccuccuuccacagugauaagccugacuccccacaaaauaauacauuuacuuaauccuacaauggauacaaaguaauuucagaauugucccacaaauaacacaaccaagaacaaauguauaaaguucaagauuucuuuccaguacuucuguuguuugauugaaggccaugcccaucugggaaaccaccugggcagguaccuuccaaccaaauugaagucaagguacugcauucaaaauaacuugaaucaguauuuuuuuccuauguguaaucaugucauccauuugauauauaguuagguucauuuacucuguacucaauuucccccaucuuguuauuuaauguuauuucggaauauacaaaccaugaacaugguuucaaacucaaaacuauauaaaaagguauucagagaaguacuacaucacugucuuccuucccuaacucuucuaaugcuauucccacccuguagaugaccaauuucauaucuucuaguuuauccuuccuguguauccuuuugcaaaaauaaucagacacauagauaaagacauuuuuauuuccccuucuuucuaccugaaaugcagcaugcuauauauagucuuccacauuuugcuuuuugcacuaccaauaucuucuggugaucacuccaaucccgauucacagggaucuuccucauccuauuuuacagcacacuacugcauuaauguauuauggcucauucaaacaaucuccucauuacaacauaaccacgaugaugcugcacauauuauuaugagagaaguugaacauauuuucauauacuuaaggacccuuuuuuaucaauuuuugugaacuuucuaggucuuugcugcuuuucuaucggauuuauggucucuuuagucuccucaacguguaguaacuuucuauauauuagcaauauuagcauuuuaucagaaauacaucuugcaacuauuuccuccugguuuauuacgugugguuuaugguuuuuugccaugccaaagaggauuuuguuuaauuucuaacuuuacacaaucagauuuuacuacaucugaaguuugaauugugaaaaaccuuuccuugugcuuuuccuuuuuguuauaaagcaauuucuuauacuggcuaauuuuuaaguaucccucauuacacuauacaugggaauguauguaagaagaaaauccuauuugccuacugaccgcugggcaacuucaaaacugcaugaccuuuauuucugcaggcccuucauuuccuagcugcaucccuuucauuuucccuaaccccagguuuccucagcaggccagcuucacuagagagcuguaaacuaaaccuaaauuacuaaagaacacauuacucacucaucauaaccauaggaaucuuucucuagagcaaauaagaauuaguaguacaaaucuguuuuauaaucacauacuuucacaaagcaagaaucaccaauaguauacuuuauugucucucauugauggguacauuuucucuuauuauuuuuauuaucaaauaauccauguuuauuuuaggauaaaauuaaaacuacagcuaggcaaaaacaaaucaagauguuggaacuguuaauauuuuagggcauauauguaaacacacaccuauuuaaaaacucucuucuuuuuauaccuauuaaaaaaacccucuguucucuacuauacuugcuauuuuguaaucuguuuccauuuucauuuaauauaaacaucuuuccauguuacuaaguugucugcaaaggcauuuuaaaaggcuacaugguauuauacuguauaaagacauaaaauauugaaccaaauauugugcucuuaggauuuaaaaaaaauaucguaaacaacucugagaaaauuuacucagacacacaccuucaugaauuuguucaaaugcuucuuuaagauaaauaccuaaauguggaauugcaggauuaaauaguacacaagauuuucaggguuuugauauacguggucaaguugccaccagcaguguaugguggguucccuuuacccacacugaacccacauuaguguuaucuuucucuguaauccuuuuuaucuccugauuuagcaagacuaaacaacaguguaaaguucugcaaaagcaccagauaagcaaauuuagaacaaaacauuacugaugucugcccaaaacucuguaaaccuguuccuaggcucuaagcugucuauugaaauguccuaagaaaccauuucacucagagaagaacauuuuuuucacucuuccugcacagcucagucuuuacgauguuaaaauccuguacaacuuccuaacagcccuucacauucuucaggagcccgaguuugguucugguuauaaaugcauaggauagaucccauacgggaagcauagaccuaagaaauuuauggaaaggaauuuaugggaaagcuucucucaucagggcuguaccaauuaaaaauccauaaauaauucucccuugucaguuucuguauaaacacauuggccuuagaaauuuuuacuucagguucuagucuaauggccuacacuucuaaauuaugcuuuuaauugaaaaacaauaacaugcauuuuuuuuccagaaccaucugugcuuucccaagaacauguaacuacuacagauaaauccgcuacuuugaacacccuaauuauccaguuuaggguuccaaaagcuuaggaaaauaaugccauuccugaaaaacaguacgugaucagaaacacuugcuuuaaaauucgauauuuggugugugaagcuucuuaacaaguguuuauuaaacugcauaauuucaaagccuggagugguauauugcaauguuuuccucggaguugaucacauuugcauaucuuuuuacacuuccugugaaauuaauauugccuuuuguaucucgaacuuagcuaauauaacuugccauuuuuacuuuucacugcuaugaguaauauaaagugaacccccaaagggaccccugcaacgccuacauaagcuuuauucucucacuguuguauuuuuucauaugaauauauuaaaucaagauuaauaaaccuuugcagaauccacugguccugcaaaaaggcaagauucauaacgguaaaggcugcucagcaaauaaaggaaaccugcuccuaaaacuggagccaaaggccgggguucauggagcucuugucacauccaacagugugccagagacucuucaccucacaagaagucuuucaacagucacucaauaauaugugcaaaaguggcuuaaccaccaggauaccaaaacccagccggugauuaucaggcugccuuggcucagggauacaucuuugugagaugccaaaaacugaccauaaucccaggauuuuaaaaauuucagcugggcuuauggggauggaaugugauaauaaagaaacaggaugguaggggcugaggaaaaguggaacaugaugagaggcuccuaaaagcaaaucaaacacagaaaagggaaaucucucugaacacugcauaccgcacugggcacaggaguccucaguugagcaucccccacucauugggccccagcagcuacuuugccuagcuaagaaucugcucaaagcucagggaaaccuaaauggcaauacaaagaaagaguugggggcagcuucaagauagcaggcuacugguacaaauacuuugugaggucagaaaggcucacuaucaugacuuguacugcugucauugauucuccuacuucaagaucaucuccaacuuggucaagaggcagaguaauggggauucagggccacaguuagggugcagcaaaugagguacaaaauuuaaguagaacuaaaaacaaccucaguagccaggugugguggccaugccugaaguccuagcuacaugggaggcugagauaggaggaucacuugagccuaggaguuugaggcuauagugcacuaugauuauaccugugaauagucacuguacuccagucugagcuacauagugagaugcccauuucaaaagaaaagaaaaaaaaaagaaaaauccucaguaaucaagauaauaauacuucagugcaaucuuuuuagaaaccaaaaaaaucauggugaagaaaacacaauuuuaaauaaauauuaaugcccugccaaccauauuugagccugcauggacacuucuaccuacauuuuuaauauauuuuaaaaauuaauuuuuuuggagaaccuuaaagucauugaagaaauacugaaaaauuggaaaguagguauauuaaaacuuacaauauuaaauguaaauauuuuauuuauacuaaaaucagaauucauuauaauuucacuuuccugacucuaaugggacaaaguaauuuuauuuuuauguuuugagauagagucucucucugucgcccaggcuggagugcagucgugcgaucucagcucaccacaaccuccaccuccuggguucaagugauucccuugccucagccuuccaaguagcugggacuacaggugcaugccaccacgcucggcuaauauuuguauuuuuaguagagacgaaguuucacuguguuggccaggcuaggggacaaaguaauuuaaacauguuuucaaaacuuacuucuuuguuugucuucuuuucaauggaagaauuaccauguuugacauucucuuaucaccuagugacaaucauaaaugauuuuuaauuaaacaauuuacuuucuuuaaauuaauuuuauuuuguuuuuccuuagcuuuaggcuccaaaauggcuuggcacuguacuaauccuuauuuaaaacuucaauguuuuguucaucauggauuuuucuggcauuuauuugauuuuugaaaaaaauggaauuaaacuauuugucuugaucacuaaguauguugacauucucuuaaacugugcauuaccuuguuccauccaaaucaaagucaaggauguagccaucucagacaaauaacauaacaaugacuuuaaguguggaaagaagccuaagaucuuuuauuaagugaaagaaguauguggcagaauaauauguauaguaugggcucacuugcacuuaagaaaggccagaaaaacauuuuaaagaauaacucuaagucauuacacaucaaauaaacauugacggcaaaagguaaaaaguguaguuacugaagcaagaguuucuaaaucauggugcugcaaaauaauacacuggguguccaaguagcaguaacaacuaaguauuacccucugcuaacaucugauaucuuugaaagauugucucuacaauaaugucauucucauucacuuguagcuagguacuuuuuuuuucuagagaaagagaugggauuucagcauguguacuaggaugacaagcaaacacuguagguucaaggaaguucaugggcaucucaacaauaugugugguggugaaaaauacacugagaaccacucaucuagcugcuacugauccuauuccauaagcuaggaauacgucauaaguacuguuuuguccucgcguuggggauuuuuguuuuguuuuguuuuuuuguaccuccucaguauccuccucuguuaaguaauagcauuuuuguuugcuuuuuagccagguuuauggagguauaauuuaaaaauaguaaaauuuacacuuuuaguauauauuuauaugaauucugacaaaugcauauaguuauauaacaaacaccacaaucaagauacagaacauuucuaucaucccaaaaaguucccauguacuuugccauagucaaucuuuacccuaauucuccagccucuggcaacugcugauuuguuuucccuauaauuuugccuguucaaaaacaucauauaaaugcaaucauaaaccauuuaugucugacuucuuaguguaaagcauuugagauucauccauuugaugcauaucucaguaauuuaugccuuuuuauugcugaauggcauccuauuuuauggauauaccacaguuuauuuauccaugguaauaggauuuggauuaugauuucacaaaucacccauacuuccuuucaggucaugugguuuauaaagggcugacccgaaaguuccagagaugcccauagccaggccugaucaaauaacauauucagucauccugauaauauggaugguuuagagcugggcacaugguuugauguaacaauuuucgauucaagacaacugacagaacuauugguaagaaguuacugaugguauaauggaaacuguuucugguagcuauugcaccaccacaagggagccccaacuugaggauaauaaagccaacaggaagcaaagugcaacuaaguggaugagauaccuuccuaaccuaguuugagcaccuggauccagacaugccuaaagaucuaccuguagaccugucaguuacaugaaccuauaaaauuccuucuagccuaggccaauuuugauuauaucccucauuccugaaacuaaaaucucuugacucuacagcauagaaagaaaucuuucaucaaggagguuacaagagagucuuggaaacaagacacaaaaaaugguuuugacaucagacaccccaacuuuaccacuuacuacuuccuaaguauacaaugucaagaauucucuuuacuccuauaaaccuguauuuccucauuuccaaaaugcagagaauaauuccuuacccauucuaaaauauuaucuugagaaucaaaaaaacuaaguugguucaaauacaaaagaaaaauaaaauguaugauuauuauacacacaaaauaauuuguauaugaaaaggagauauuaagugaugacggugagagagaaucaagaggcauuauaaggaucaaugcagaacuccagugcuuauauaaggaucaaugaacaauaauuguaacuagagguauuucuugaguauauucuuguguuaggcauugugucagguauuuuaccuacauuauaucauuuaacauucuaaauaucacuaaaguaacuuuuuaaacccauuuuugauuaggcuuagagaacauaaaauacuuuuuaaguuaaaguacuaacuggcagaggccaaauaaagaccuaaaucuggaccacugaaacuagugcacacuucuaaguuagauggaaggcaugaagcaaacacuuuggaaauuaaaauucaguuauaaaaaccaucacaacacaauuaauuuagcaacuacauuccuuuauacauaauugugccgagugcaucuaacucauuaagauguagaauguuuaugcugucauauaauauuaucacaugguaauaaaugaaguugcacuauaucucuaaacaucuggauuucagagccaauuuuacacauuuaauucagcuauuuggugucuuaaacacauagcaaaaauacacaaggaaaaaaugauuguacaucuggcaucaagauggcuccaagaauuggacugccaaugaggaagucagguuuuucuagccuauauccucuggaggauaaauacccaaaauaguacuguuuccaaaguaaccaaaaucaagaaaggagacuccacaaaggaaacaagaaugaaaaagacaggccuagcccuuuucaaaagcugagccuucccucccaggauccaagguacuuaggguuucucauaccugacaaccuauaaacgagaaagaguaucacuuguuuguccuuccauuucucauuuuccagcuuuggugcuuaucagguucuccagagguagcaaauuuguaagacauuucaucuauuuagauuuucauuuauucauccauccuuucaguuacucagugaugacuucuaucugcugagcccugcacuaaugauccaaaauucccaaucuuccugccuaggagagauagggagagguagggaauauggcuucuccauuuucuccuuuuccuuuaguaaccaaccucuacuggaauuaauccuuugaguucagcugggccuugagauccaacaugauuuguuuuaaaaaucaaggcaacuauuaauguaaaaacaaaacaauacaaguauuaggagaaaacaugagagaauuucuguacaacuagauguggggaaagccuuucuaacuauaacucaaauccaaaugcaaaaaaaaaaagaaaaaaaaaagauugagaauuucaauuaccugaaauuuuuuaaaauuugcauagcaaaaaauaccauaagcaaaaauaaaaaauuaagugcaugauaggagaaaauauuuauaaaauauaucacagauuaagcuccaaucacccuaauauauauuuuaaaauucuuggccaggcgcaguggcucacgccuguacuuccuagcacuuugggaggcugagguggguggaucacaaggucaggaguucaagaccagccuggccaagauggugaaaccccaucucuacuaaaaauacaaaaaucagccaggcacgguggcaggcgccuguaaucccagcuacucaggaggcugaggcagagaauugcuugaacccgggaggcggagguugcagugagcugagaucacaccacugcacuccagccugagcaacagaacgagacuuggucuaaaaaaaaaaaaaaaaaaauucuuaaaacccauuuuuagaauaagaaaaauagaaaaacaaguaguucacagaugauauaggaauugcccuuaaacauaugaaaauaugcuuaauuuuacuuauaauaagagaaaagcaaauuaaaacuacacuaagaauuauaaccauauuacucuaacauaagagguuaucaauaggagaaccugggugugguguacacaggaacccuuuacuaucuucacagcuuuucugcaaaccgaaaacucuucuuaacaaaaaaguugauccaaaaaaaguacauugagauacuauuucuugccuaugagauugucaaaaguugaaaaacuugacaauauacucuauuagcaaacagaguguagagcaacaguuccucucaggcauugcuaguuagagugcaaaaggguauaaccuguguaaagggaaauuuggcauuaguuaacaaacuaugugucuauuuccuuuucuaucuuucuacauaccuaucuauauauuuacuuaccagcaaugucaguuacagcauucacccugaacauacaccuucaacuguaugaaaaaacguggacauaaaauuauucacuguaguguuauuuccaguaaaaaauacuggaaagaaucuaaaugccauccauagauacaaucaauaguaguccuuugugugaacaaccaauauacacauagaacuacuauucaacuguaauaaggaaugaggaggaucuuuauaaaauuauaugaaauaauugccaggauaaaaaagcaaggugaaagaguauacauagcaugcuaacuucuguauaaaaaggaagcguauguauauuugcuucuuuuuauaaugaagacaugaaggauaaaccagaaacuaaugaaaauauuuucaaagagcgugaguaaaaauggagcuggaaggguagggauggagugggacuuucuugaacaauuuuuuuuucuaguuuugacuugaaccagguaaguuuugacuugaaccagguaaguuuugacuugaaccauguaaaguuuuacauauucgaaauaaaaaauuuaaaaaggauuuauaaagcaaaaccuaaacuugcauacaggcaggacauaaauggaucuaaugauauaucacaucaacguaaauaaucacagaggaaaaaaauaaauucaaauaauuucugaagacaguauucugaauguauauccuuaguggaauauuaggaaaaaaagaaguccaaauaaaucuugaacuuuacuuaauagauugauugucaggagggguauugauauaguaauucugaaacuauuuuccguguacuauaggauagagcaaaugaaucgauacauuaggaucucacuguggaauaaaggagauacaaauaugaaaugagggaaagugcggaagaauccugugauguugaauuugaaugguugaguuguacaugguaacauacaugcaucuaccuaucugucuacuuaucuaccuaucuaaucuaucuaaucuaccuaucgccuagcggcaauggcaccccaguagcaaugaacccaccuagcggccaaaacuuucuuucuaaauuccauucuccaguaaagggagacagggcuugacugauucuugauugggguagggaaaauguaagguaagguugauacaucuuuuuuuacuccaggacauacucaaagacugauggagauaugucaaaacgacauaggaacuagcaucaggggaucccacuggcuaaaugacagacaauuugagccucacaaaagaauaaggagcuaaguauaguuauaucauuuuguggaacuucauugagcugugugcuuauaauuuguguauuuuuuuguagguaugcuguauuucaauaugaaauguagugucuuuuuuuaagaaagcugugauacaagcagcaaauaagacauauaauuuacuuuagcagaaaggaagaccgugcucuaugaauaaauuguucugauuacacugauggucauccauccuacuauggaaacagagguggagaccucuuuugguaagaaacaacgucagcccagaaauguauaauaauacaaagagaaaaacaucauuaggcacaaaucaucgauggacaauagaacccaugagugaaagguucuugggacacaaaauaguuacccagucucaaaguaucaccccacagauacuaauuucaaggcaaaacaaaacacaaaacaaaaaaaaaccuuaaaaauggagugaccugaagaauauccaagaugaaacagcaucaccaaaacuggcacaaacaaauuauaugacucugcugugauccacugugaagcaggcaacauuaccuagauaguacuuuggccuacaaugaggaacaauuggacagauccacauugugugguauuccacaaucacugggucggaaucuucaaaaauacagacucaugaaagagaaauaaaaggcaggagaauauucuagauuaagaggguccaaagagacaaaauaacuaagugaaauguguaauccuugauuguauucuaaaaagaaaauggaaauaaggaaaaagagacauuacaagguaugagggacauuaauggaaacauuugaauauauuagauuacauaucaauguuaaauuucauguggagagugauaacaguauuaugauuacauauucaucuuaggagguauaaggugaaaugucaggggguaauaugauaucuaugacugaaaugcaaaugauuuuuuaaaguauaauaaaugagagaaaaaaagccaaugaacaauuacaacaaaauguuaauaacuggauccucaagggggaagaguaauugggauagacuguacaaaaauuaaucaaagauaacuagcauauuuugaaugcucacuguugucaggcccuauuuagagagguuugcaauacuaacucauuuaauccuugcaauaacucuaugugauugauaccacauauauccauuuuacagacaaaauggaaaccuauagaaguaaaauaacuugcccaggcuaguaaguggaguagcuggaauuugaaguuaauaaauuuagagucaaaguuuauuaucauauccacaauacuacucugcccuucaaauaaauaagucuguuuagaggagcaaacacauuaaucacaccaaucuuaugauuacaugcaacugauaucuccugugugccuaaugcagaauucuggaggguucaauugguuccaauuaguucuuuuuccuguaccagaaaagaagaucagcaauaacuggaauucugggguggcauggaguggggguguuaaauuuuacaaacacagcauccaaaaauaguauguucagucaugaguauuaucuuuaaaauagagaauauaaagaaagucugaagaucaacauuuaaaucaaagaaaaaagaacaaaaguacaggugcuuugagguuuagacuaugcugaaaaugccauuauagagcaguccauuuccucaguagguagccccaaaagaccccugacacaguagaaauuauaucauuauacaauuaaucaguuuucuuucacaauggcacaauggggugcccucuuuaacucaacagaguaaccagcucaccaacaguaucuagaaaagaggaaagucacagaauggaaaaauagacacaaaaagcuauggagaagagagacugaaacagacaaaggcgguuguacuauaaaagaaagcgagaaauggaaagggaaaugucagcaaucuaagguuaaaagagaaaagaucaggauauaaaaagauguagaagucucuuaugaaaaaaaaaaaaaaaaagggaggggaccagugaagagauagaaaucaugaccagagucgaagcuugaaaacgcagggcaacacacaaagagaagcuguaauagcagagccauucacucaaucauucauuucacucauucauuuaaugccuaacauaugaaggguacuuuguggagcuuugagagacacaaaaaugacuaagacaggaccccugcccucaaagagcccagcuguuccaaauauucucauuuugguaugcuccaauuuuuaauguaauuuuaauuauuguugucacaccuuagcuaauauuuucauacucaacauguacuuccagaaauugcagcaacuauaccaucuauaaaagaggguaaucuuggcagggagcggcggcucacaccuguaaucccagcacuuugggaggcugagauggguggaucacgaggucaggagaucgagaccauccugcccaacauggugaaacuccgucucuacuaaaaaugcaaaaauuagccaggcaugguggugugcaccuguauucccaguuacucaggaggcugaggcaggagaaucgcuugaacccggaagguggagguugcagugagccgagaucaugccacugcacuccagucugggcagcagagcgagacucugucucgaaaaaaaaaaaaaaaaaugaggguaaucuuaaauggauggcagcugccauacagaaugaguucauucguuguggaacggaaacauguuuacauuucugauaugcugauaguauauaaugcaguauugugaugugguucucuguauauauagaugcugucuauacuuuuuuuggauacagcacacuccacaucauucuauuuuauuuuuaucaucccauuccagagaggaggcaaaggacaaggaagucuaaaggauguggaaagacaaauaaggaaguuaaaaaacagguuuucauuuucuuuacaauuucccagagggcuucuaugacaaaaagcuguacugaacaacggaaugcguauuugucauagaguagcugagagugaauucuagguaaacauacaagggagaggcuccuagacagauaccauugccuaguaccuuucauuuaaaagauaccuagugauauaugacuugggaaaaccagaaauugaccucccagccugccucaguauauggucuuugcucuuaccaagguuggcuugcucccugaaaagaccugaaaauucaaguuugaaaagguguuucauauaccuaauuuagaacacaccccuccuagaucuauaagaguaggugagaagcauagaaaugaacaccuauuauuuugaaugcucaucuucugauuccuuuaaugcacugucccgcccuuuacccucuccccaaaucuuugugguucuuuugggauuucaauugaggugccccaucucuccgccagagauaggaaugugacucaaucuaaccaaucaaaaucuucugggggaaguguaugaaucugcaguuagagagaaggcuuuccgagaucuugggcacuuaaauucacauaagucugaagcugcuuagagauauuucuucccccaccacaaagacugugacugaagaaaagaugaagaccacauggagaagaggaggacugugaggggggugagagcagaggcgaauuuauccugaagcuacuacaucuuaagcuuacaggucuuucucucuuuuuuuuuuuuuuuuucccagacggagucucgcuuugucgccuaggcuggagugcaguggcgcaaucuuggcucacugcaagcuccgccucccagguucaugccauucuucugccucagccucccgaguagcugggacuacaggcgcccaccaccacgcccggcuaauuuuuuguauuuuuuagcagagacgggguuucaccguguuagccaggauggacuccaucuccugaccucaugauccgccggccuuggccucccaaagugcugggauuacaggcaugagccaccaugcccggcccaggucuuucucuagcgauguguucauauggucauuuauaaucuucuuauagagaaggcucuccaaacuguaugagcuuugggccacaaaauccuagauucaccccugggagagacaguugugaagauacaauaaggcacacauagccacccauaacagaagccagugucaccccacuggaccugcaauuaugugagccaauauucacccuuucuuuuuaucuugggauaauccaaauuugguuuuacccacuuacaaagggaagaaaccggagauuuuaaagauagaaauaaagucauggcucguaacuugcuggcaggaaaaaaugagaaccaaugcuguuuuugacuuucagaguaucuaucauaagcuaucauuuuguuuuuguccgcauuucaguaugugguuuaaaaggaaguuccaacaucauauuuguaacuaguuauaaggaaccggcagggaacagccuccagacauuuuucaaauauauuuuuccuuuaacuggcuauaaaggacaauaaggauuaaguuggcaccacaaaaagucgcauuuaaugauacccuuuuguguguuacccauuuaccaaacauggauuuuuauuucugcauucuauagaauacuuauucgccacugagaguuccauuuaaauucuuugcaugcacacacacacacacacacacacacacccuuccaccaccacuaccaccaccaucauuuucaucaucaugugauuucagaagagcagucaugucuacaguaaagguauuugagagcuaaacaaagccuccuggcuagagauccugguaucuuccuuuaaacccagaucauucaugguauggguucccugcagagcacugguuguggccccaccaagcacugccauuuccagcacugucaguuucuuuaaccuucaagagaacacagaagagucauucaaagccagcaagugaagagauguccuggcagucuaauuucaaacaggccucauaccagagucuuuuuuaugguuuuuaaaagaaguauuuuaugcugcucugaugaaaaccucuaacaguaguagcuucugucugacaaauaccauagagaaugaaacaauaagucugaagcaaagggaggggguaaaauuauuuuuguuucaauagccaacacacaaugaaaacaagaaacuauagagguuuaaagaauaaccgauauuuauucugguaaagacuuuucucauaucagcacuuuaccacuguaagaugcugacaauaauuaugugaauguugcuauaaaaaaauuaaaucucccaucucauggguuuaaagguguuuccgccucugccuuacacacacacacacauacacacacacacacacacguacacacacauauuucagguaccucugucaggaucucccaacucaauuauacugcauggaggaaaaauauguauacuacuacuacuagaauaagaauaaacuaguaaacaaacaaauagaauacaauguaagcugcaguacauguaaucugaaggccugaagcucaugugugcuagguuuuugauugagcagugguggggguaaacguggcacagcaguuaucagccuggacuguggaauccgaucauaccgggaaaugaauccuggcuuacucauugaguaaccugguaacugaaccucccugaggcccagguuauucaucaacaaacugaugacaguuaucccaugggguuauuauagggauuaagugagaaaauguuauauaaaggugaggaguggcagaauaugccaccccaaaauaugccacuuuggcaugaggauuauuuugagcugaaggcaguugagaagaagcagauaugagagaagcucucugucuucccccuauuugccacaaaacaggauauagauuuauaaaggugcccuccccaccuaucaggaaagaaaaaguuaaucaucagagauaacucuagauauucacuagccagaagagacaccagaggaaucuauguaacaagcuuuacuaacuagcccuuccauuaguucccccauauauuuaccuucucacaauuugcagaaacucaaaguccuuuccuuugucuuaccauuucucuaaaaauuuauugcucuuuuuuaaaaagcuauauaaggucacauuuuaaucaccccuuugagucacucaucacuggguacuuccauguguaugugcaaguacauguuaauaaacuucuguuuuuucuuauguuaaucugucauuuuucacucuacuuuagagggccacagcuggagaaccuaggaggguagagggaaauagauuuaguacaaagagcuuagugcagagccuguuucacaaugaagcacucuguaggugaaagcauugccaugauuaaugauugccacaaagcauccauguugguuaaacagacaccaugccuaagggcauauaaugacucugaggaaagcuagacuugaagaaaacacgacuugcccagccaaguaccuuggucaaaacacauauuuguuugacucuauaguguugagacuugaguaucuaauauacagaugaaugagccaguacagaauuugaaauuucaacaaaaaggcaaguauaaucugccugauaauaauaagcaacuuguaaaucuuugaauggaugggcuugccuguuuucacccaugcuacucaaacugugaaccacagaacagaacaucaguuucaccuggggacuucauagaaaugcugagucuuaggucucacccuagaccuucuguauuccagaauuauaauaagaucuccagaugauuuguaggcauauuaaagucugaaaagcacugcuguggaccacaaaauuuaauguacugcuuaucccacuuuggguguguuucugugaucuuuacaacuuaauaaaccacccccaaaaguuagugacuuuaaacaacaauuuauuuguccugcuucuucaauauuggcagggcucagugagacggcucaucucugcuccauaugguguugacugggguaguucaacacagacugcaagaugcaagcuggcuucccuucauucacaugcccuuggcugaccuggcugggacaguugggggcuggcugggccucucuccaugucuuuguuguucuucaggaccucuuuccaaauggaguggucucucuccugcagcaugaucagacuucuuuaagugauggcaccaggcuccaagacagugaagucagccaucuuaaagucuaaaucuggaacuggcacugugcauuucugccauuuucuguugaucgaauugagucaaaaggcaaacaaaugucaaggggagaaaaaagacuuuauuucuugacgggagaagaggucugcacagacaguguggaaggauuuguuagcaacaguuuuugcagacaagcuaccacagaguaucuguuacuuuucacuuucuucaucucucuguucuccugauuggucaaacagccacuucauuucaauuacacaacuauaugcgaggucccauugggagcauaaggaauuuuaagacaugauaucucccaucaaggagcuuguuauaauacaauugguaaaauaaggaauacauaucuugaaauuuuaauaacaauaaaauacuguaauaauaaaauauuuaaguagcagugccagauaauaacagaaaugauguccuaaggccaugaaccauuuauuuaauuaaucgugcacacaauaaccauccugaguguucagaagagagaauggaaggggaggagaauggccauggaaggacgguugugcagugaguaagacuugcauaggaaaaugaguaagguuuucaaaaaaaaaaaagguccaaugaaauacacacaaaggauacaacagaaucaaggagccaagggaauggggucauagggacacaaggccaugaaugaguaucugcauguucuucaaugaugauuaucaauucaauguuccugaaagaauuuccugccucauaacguccaccuuuacuucucccuuuagauauguucauaagcuauuuguggaauccccaccagcaauauaaccuuguauuaauaaugaaggguuuuuaugaaccuuauaaauuuuauuauaccuuguagagagggugggggaacaaacaaacagaaauguaggcauugccaaauggcaacuuguaaacuucacuauucauuguguaggaacuaacacuuuugguauuguuaaguagccuuguaaauuucacucucccuuagaaaauaaaaauggaaugaaaggugcugcuuagaagaaacguauaaauuucaaucuccacugcaggaaaauaagcucugauuacacuacauaguucauacaccucaauguuccgaacacuuguuuuuuuacagauucauguauaaugacuugguuuuccaacaacagagagugaaauuuacaaguuguuauuuaacuuuuuuaggaguguauuuuucuuccaugucuuuuuuuucuucuuugccccuacucacaccagaaaccuaauaugagcaaugggauuucugaauaguaccauacauuaauuccuucaauaacaaugauuaaaacauuuuaaacauuguucucagggccuccugauaccacauauaaaaguggggaaugacacagcuuuuggccacacaguucaaaaaauugcucuuuaccuuguuggggaagaagagggcuuauuaaaaguuuauaauaagcaguauuacuaguauuuaacuucuauuuguuguugaaaagaacugagccuauaauuucagaggcuuccgagcauuuucauaaauauacccauuagauauucaauagccaguggauuugaaugauuuugccauuuauucgaacagauagcuguccuggacaggaaggauagaagcauuggaagaaaguguuagaacuacauuuccauaaagucaugacaagaaauaaagaaagaaggggagucaccaccucaauacuagaagugucagcacaaugauauccucauaaaagguguucuaaaagaaacuuuuagguguucuaaaauaaaguuauaaaugccauaccaagaaauacugucaaaacaaaagucaaguacaauacagcccagaaagaaccaaauacaucuuuacaucagggaguaaaaauauacauagauauaauauccacaauugucuuaauuuauagcuuuuaaauagauaauauacauacaaagugaaaaauugaaaccacaccaaaguacguugaaaaaugucuucccacucaugcuguuaaugaucucuguacccucuucaacauaugcauaugugaacauauacacacauuuuaaauuuccaugacuacaaauaauggcauauucuaacccauuuuucacuuaaaaaugucauagagaugguucuguauagacccauuuuugugauggucuaauuuuauuacaaagauuauaaaguauagauauuccauaauuuauuuacagauucuccuauugcuuggacacuuaagcuguuuuuaaucauuuguuguuaaaugcaaugccauggcgaauauuuuuguacauagaauuuugugcaccugcaugacuauaguucuaaaauaaauuacuagaaauggaacugcuaggucaaaagguauauaugcauucuauuuugauaguuagagccaaauagcuuuccaaagacaauauaacaauucaugcuucuauucaugauaccaauacaucuugcauugaaggaauuccaaaacaaccaaaaguucaucauuuuucugccaacugauccuuucucucuuaaaaagagucgggguaaaaaucacccauuuuugcuuauaaccauaggcaguuauaaucauuauugcccaagauucaaggccauuucauuacccacugcaucaccauccucacugugguauaauucuaacuggucagagagaccuuuaauuugcagaccuucucagaagacagauuaucugcauucugcagacaucugcagaaagccauccacaagugcauauuucauggcugaauauuuuuacauaacaucagcuggaacccaucguuccagcauucucgccaagugucacaaccugcucuauuauaucaauaagcaguuucaauuagucauuuucuucccauggugacgacagcuauaauagcaugcaguagucugaugaaguuuguaauauaaaguggagaugggaguauuaaaaggaagagaauacagaauuagaaucgcauaaaaaaauccaucucccaaauagucauuuggggaaaugacaacauuuuugaaacaguguucaagaaugaauacaaaaaugcaauuacuuuugaaaagucagauaaauaaauuugccaugggaacacauucuugccccagauagaacccuaguuuuuacuggcuaauuagucauuaagcaccaucucaaaaacaacuguauaugaaagaauauuggguaaauagaaauaaaacuuaaggcuuaacagaauuguaaaaugaaaauaaaugccaacagagaauacuacuuugaaagcauuggauaguaguaaauaaauuagaaggaaugacacaguugcucugcccucaaaauuuaucccuaaucuguuacuacuuccuacuuugugugcuaagauuaccaggcuccaaaccaugcuugccuucccuggcacacagccagagccuucugacuggccaccugccucucuucuuguccccuucagccucuucuuuacacagcagcugaaaugauuuucuaaaaaauauaaaucagaucgcaucauuuccuucuuuucagcccucuacugguuuugcucauaauuaaaaucuaaaaucuuugccauggcuggcaaggccacauauggaauccaucuaccacuucuuucuccucccuacacuggccucuaucaagcacauucccaacucagacccucaggucuugcugcuuccagcuaaaagguuagacccccaaauauucagauguuuuuccuccuucacuuuauucagguauguccucaaaugucaccucaucacaaaggauuauuugaccacccuaucuaaaaaauaacccaaaacucuuuaucaaaugcaugcagauuuacuuuccuuauaucauuuaacuccacucgacauuauaugauguaguuagauguauaucuguucauucuguauauccccuacuagaauguaacuucaaugaagaugagaagaagcaaagauaaaaaagugcaucccaaccagacagaaaaacauacuaugacugugaacuacacccauugauaugguuugguugugugcccaccuaaaucucaucuugaauuguaacucuuauaauucccacaugucaaaggcagggcuagguggagauaauugaaucaugggggcacuuccacccauacuguucucgugguaguaauuaaguuucacaauauuugaugguuuuauaaaugggaguuccccugcgcaagcucucuugccugcagccauguaaggcaugccuuucuccuccuuugccuugcaccaugauugugaggcuuccccagccaggugaaacugugaguccauuaaaccucuuuuucuuuauaaauuagccagucuuuacuagcagugugagaacugacuaauacacccauaguugagaaaacagcaucuaccugacuuugguuaaauucauucaacucagcaaacauuuacuaaacucuuauuagauaagaaauuccagaaacauaggucccagugucuaucuguuauauaguuuagagacaaaaacuugcauauaauuugggaggcaagacaugaaauauaaacuacugaaaugacaacuaaaaagaguuaaugaucaaaagccaacaugaguagggcaggcaauaagugucagagaguucugaggaggagagauuuguguaggcugagagggugaaggaaugguucaaaaagaaggcuggagaagaucugggaaaggaaaccaggaggaagaaggcauuuggggugagagcacagcaggggcagacacauagauuauaccaguguuccccaaacaucaaagcauggaaccuugguguuacaugguccacugacaggacaaaccaaagaauaauaaaguuauaucucuuuccauuugauuuuaaucuuucuaauacaugcaaugaaaaaguauuaauucagcauuaauuguuaaacaccuuaguaacacuugccaaucugaauggcauuauuuuacuuuuuauuuuuuguacuucucuuuaaacuuuuacucccuauuuaugauaagggcuuuuauuuauggaauaacauauaauuuuauucauauguaaacuucuauggguaaaaaaaagggaguugcuuuaauggcagucaaucauggacuaaauaucugggucacuaccuacccagacacaaagcagagucaaccuuuaaaguaagcaaagggggcucaguggaaaagagaagaaaguuaagcucuugucaagaugaugcagggggccucaugucaggcuaaggauucuggaaaauauucuguaggacugugguuucccaauuugcaacaaggucaaauuccuugaaaacacacgcguuauauuugaguguggcaugcuucuuauuuucaagacagcaagaaauauggcaaucuucaauuccauuauaccauuucauuauacaaacuuaaacacaaaguggaaagaaguaaauacaacuuuauacuauaugugaauuacaaaagcacaaucacaaccacaguuuuuuuuuuuuuuuaaagcugucuauaucuauuaugauaugggcaagaaacagaugacucacaaaauacucaaauaggguaaucugcagaaaugcuuagaaaguguauucaugguguggagaaaccaaggauuaaugcaauacccagggacaaggcgggagccuacuuauagaguucacagagaacugcccaagcaaagagcaaagcagagaguggguaggaaaggauaaauugaagauaaccaauauacaaacaaggcuauuuucacauauuucaaauacuuaccaggucuucgaauacuuuaccugucuaaucacgagcuguauauuuuuuauagggaauaagagugcauaggccaggcgcaguggcucaugcuuguaaucccagcacuuugggaggccgagauagguagaucacaaggucaggagaucgagaccauccuggccaacauggugaaaccccaucucuacuaaaaauacaaaacuuagcuaggugugguggcaugugccuguagucccagcuacucaggaggcugagggaggagagucgcuugaaccagggagacagagguugcagugagccgagauugcaccacugcacuccagccugggcgacagagcgagacuccgucucaaaaaaaaaaaaaaagagugcauauagcauggacuuaaaccucagcuugccauucacuucuaugugaguuucuuaagcucaaugaauuuaauuuuuucaauaaaaugggagauaauaacaguauccacuauaaggcuggugugagaagcaaaugaauaaauguauguaaagcacuuagcacagcauuugccuauaauaaauaugcaugcuuugggaaaaugggggagggucaugugagcugccaaaauagugaagagaaauuuaugagagaaaagcuuaagauugcagaaauuaucaauuuaaauugcauuagcuuaguauuucauaugaguuguccaaaacaucccauauuauucaacuauuccauuucauugauaaaauacuucaaaggcauacaaagaaggaaaauagucuagaucgguagaggcaggugggguuauagugguggugaucagugguaguggcagggaauagacaguaaaggccuccuucagaagguaauauuuaaaauaagaccaacugaaacauaaaaggaguuaacuaagugaggugaaaagugccccaagcagaggaaacccaacaugccaaggaccuggggaagaggaaaccuccuggauucaacauauuccacgaucaacauguggaagaguaaacaaggcguggggagaacugcagcuggagcgguagaaccuuuucagucauguuuaaagaauuuaaauuacauuuaucccaaggguaaugagaagccuuugaaagacuuucaagcaggaaaaaggcaugaucccaugaucggauuaucaucauuagaaaaccacuacuaaagagaacagggaggcauuagagaguuuugaguuaaggacugaacaagaaaaauaauguuucaaauuucauuuuuauuauuuuauuguuuacaaaaauuguaaacugccgcagacgauuucucugagggcuaacuguauaaguauagguucauuugguaacucacucauuccguaagauauuuauuaagcaccuaaugcauacaccggaacugugcauagauaggggacggaggagaaaacucacaaauaagcagucuaaaaagugcuaagacuugaaaggcaaacgacacuucugagugguggguaaaauuccaaagguggaccaggcagugucuuugcuaaaacauuuuucgguauggcugaaccauaaaaugcaugggccguauugaaccacuccuuucacaagaauuuacugagcacugacuauaugcugguauuguauagcuuuggugacauggugguguaugagaaaucacuuaaaauauaauagcaauaacuuuuuuauuguaaauaaggcuggguugauuaucaagagugcaugagaaagaaaaacagagaagugaagaacagugccuucacuuaaggaggguucgaauggcaauaaaauacuuuuaauuaaaacuucucugcugagaauagacagccuuugaaagcuuguguaaacauaaaugaacuacauguaaauauauucaugauauuauagcuuuuuaaauaacauuauaacuuuuaaaaugucaaauccuuugaauaugaaaugccauccccucuccccaaaaacaugaccaccaugaauuauccaguugaucuuaaaucaaaagccacuuacuuaaaagugaaauguucauuccuuacacuuacuagaaaaacugcuucaaauaugaucagaccuucccuuugucuucagagaauuccgcugcugaaacagacccaacaagccagccaagguccaucuggggcagcuuagggaaggggcaagacauguucccugcccaacacuaucuuuuccaacuuagccccugaucaugccaagacaucacaguguaauaauaguaauuuaauaauguagucggccaggcucugcccacaguagaaagcaugagaaaauaaaugaggcuugaaagcuaaacagagagaaacuucuccaggcacugccugcagcagggagauaccugguaaugaaauacccacugaucuccauucauuacacaggaggcaaaccuuaaaagagagucuagaaagguggaucucucaaaauagaaauaaauaaauaagcucaccugccaugguggggucucugaaaaugacuuggaaggacugccuauagaauuuuuguggggaugcagcaaaguuuugucagaugucaagggagguaauuauucccgacuugcuugggcacauuugcuggauaaauuggccucuuuaccuucaucuccccaugcgggcaccagauaaagaaaccguguuuaaacucuacaguguucucucuggcuuuuaccaugaaaaagaaauaaaaaugcauccugggugcuuggcaaaucagcccagugucagauggggacccauuaucuuugaccuucacauuugugccccuugggacucacagaaaauccucaaaaacucuuuuggguaaagauauaugaugucuaggagguacccaccuucaggagaaagaaauugccuuugcaauauaaaaguugcaaaaguugaaguuagugauuucuuuauuuuuuauuuccauuuuugucuaucugcucaaauuuuuaaaauuuaccuacaaaugcuggaagccuuguuuacucaaccauguuaucaacauguuaagcuaucagccauuucucucccuucccugcuuuccucuccaaucaccaagacaacacuaacauuucuccaucuuaccuucuuuaaagaaaaauucuuacaguuaacugucugccaucuacuaccacuuccagaaccaguaaugaaaugucagaggaggaacaguuaauuaaaauuguggaauccuacuuugcauccucucacagucaauacauguacaauuagagaugccuuucagcaugugguauaacuaguauaaguuaaacuuugaauaacacuugaucauuaaaaauaaaaaaucauuaauguuaagcaaauacgcaguaaacaucuugcuucauuggccauaaaacuccuuuagcucagcucaacuagugugguagauuuaauauugggauucacuuagauggugcuuuuuaguaagaaaccaaggaacaugucuacaaucugcaagugguuuaugggaauaaaaacugugccuaauuaucccacauggguuuaccuaaguugucauuuuuuuacaaaauuucucaaguuucuccacaaacguuuagggaagaaaugacauagaauggugguuaaggguucagacucuggagucaaauguuguguguguuucaucccugccucugcuacuugcuaaacaugacacugccauaaccauuuuucuucauuucucagagccuccauuucccuguagguaauaugaagaaaacacuauucauucacagggcuacugugaggaugaaaugagauaauguacacaaagcauuuuaaauagugaccagaaccuuguaaagauuaaguaaaugcaagcugguccuccuaauugauaccuuauucauucaauaauuauacuuccuaaaagagucugguaauuauguauuuaaaacauauucacgagguggagccaagauggccgaauaggaacagcuccagucuacagcucccagaguaagcaaugcagaagacgggugauuucugcauuuccaacugagguaccagguucaucucacugaggagugucggacagugggugcaggauagugggugcagcacacugagcaugagccaaagcagggcaaggcaucaucucacccgagaagcacaaggggucagagaauucccuuuccuagucaaagaaaggggugacagacggcaccuggaaaaucgggucacucccacccuaauacugugcuuuuccaauggucuuagcaaacggcacaucaggagauuauauccugcaccuggcuaggaggguccuacgcccauggagccucccucauugcuaggaaagcagccugagaucaaaguguaaggcggcagcgaggcuuggggaggggccccugccauugccgaggcuugaguagguaaacaaagcggccuggaagcucgaacucgguggagcccaccacagcucaaggaggccugccugccucuguagacuccaccucugggggcagggcauagacaaacaaaaggcagcaaaaaccucugcagacuuaaaugucccugucugacagcuuugaagagaguagugauucucccagcaugcagcuugagaucuaagaacggacaaaaugccuccucaagugggucccugacccccgaguagccuaacuggcaggcaccccccaguaggggcagacugacaccucacacggccggguacucuucugagacaaaacuuccagaggaacaaucagucaggaacauuugcuguucaccaauauccgcuguucugcagccucugcuggugaaacacaggcaaacagggucuagagugggccugcagcaaacucuaacagaccugcagcugagaguccugacuguuagaaggaaaacuaacaaacagaaaggacauccacaccaaaaccccaucuguacgucaccaucaucaaagaccaaagguagauaaaaccacaaagauggggaaaaaacagagcagaaaaacuggaaacucuaaaaaucagagcgccucuccuccucgaaaggaacgcagcuccucacaagcaacggaacaaagcuggacggagaaugacuuugacgaguugagagaagaaggcuucagacgaucaaacuacuccgaccuaaaggaggaaguuugaacccauggcaaagaaguaaaaaaccuugaaaaaaaaauuagacgaauggcuaacuagaauaaccaaugcagagaaguccuuaaaggaccugauggagcugaaaaccacggcaccagaacuacgugacgaauacacaagucucaguagccgauucgaucaacuggaagaaaggguaucagugauggaagaucaaaugaaugaaaugaagcaagaagggaaguuuagagaaaaaagaauaaaaagaaaugaacaaagccuacaagaaauaugggacuaugugaaaagaccaaaucuacaucugacugauguaccugaaagugacagggagaauggaaccaacuugcaaaacacucugcaagauauuauccaggagaacuuccccaaucuagcaaggacggccaacauucaaauucaggaaauacagagaacaccacaaagauacuccucgagaagagcaacuccaagacacauaauugucagauucaacaaaguugaaaugaaggaaaaaauguuaauggcagccagagagaaaggucggguuacccacaaagggaagcccauucagacuaacagcagaucucucagcagaaacccuagaagccagaagagaguggaggccaauauucaacauucuuaaagaaaagaauuuucaacccagaauuucauaucuagccaaacuaagcuucauaagugaaggagaaauaaaauacuuaacagacaagcaaaugcugagagauuuugucaccaccaggccugccuuacaagagcuccugaaggaagcacuaaacauggaaaggaacaacugguaccagccacugcagaaauauaccaaauuguaaagcccaucgaggcuaggaagaaacugcaucaacuaaugagcaaaauaaccagcuaacaucauaaugacaggaucaaauucacacauaacaauauuaaccuuaaauguaaaugggcuaaaugcuccaguuaaaagacacagacuggcaaauuggauaaagagucaagacccaucagugugcuguauucagacccaucucacaugcagagacacacauaggcucaaaauaaauggauggaagaagaucuaccaagcaaauggaaaacaaaaaaagcagggguugcaauccuagucucugauaaacagacuuuaaaccaacaaagaucaaaagagacaaagaaggccauuacauaaugguaaagggaucaauucaacaagaaaagcuaacuacccuaaauauauaugcacccaauacaggagcacccagauucauaaagcaaguccuuagagaccuacaaagagacuuagacucccacacaauaauaaugggagacuuuaacaauccacugucaacauuagacagaucaacgagacagaaaguuaacaaggauauccaggaauugaacucagcucugcaccaaguggaccuaacagacaucuacagaacucuccaccccaaaucaacagaauauacauucuuuucagcaccacaccacaccuauuccaaaauugacuacauaguuggaaguaaagcacuccucagcaaauguaaaauaacagaaauuauaacaaacuaucucucagaucacagugcaaucaaacuagaacucaggauuaagaaacucacucgaaaccacacaacuacauggaaacugaacaaccugcuccugaaugacuacuggguacgucgcgaaaugaagacagaaauaaagacguucuuugaaaccaaugagaacaaagacacaacauaccagaaucugugggacacauucaaagcaguguguagagggaaauuuauagcacuaaaugcccacaagagaaaucaggaaagaucuaaaauugacacucuaacaucacaauuaaaagaacuagagaagcaagagcaaacauucaaaagcuagcagaaggcaagcaauaacuaacaucagagcagaacugaaggagauagagacacaaaaaacccuucaaaaaaucaaugaauccaggagcugguuuuuugaaaagaucaacaaaauugauagacugcuagcaagacuaauaaagaagaagagagagaagaaucaaauagacgcaauaaaaaaugauaaaggggauaucaccacugaucccacagaaauacaaacuaccaucacagaauacuaaaaacaccucuaugcaaauaaacuacaaaaucuagcucccucucccucucccuuucaucuccgucucccgcuuuccacggugccccccucccucgucuccgucucccacuuuccacggucucccucuguugccgaggcuggacuguacugccacgaucucggcucacugcaaccucccugccugauucuccugccucagccugccgagugccugggauugcaggcgugcgcugcuaagccugacugguuuuuguauuuuuugguggagacgggguuucgccguguuggccgggcuggucuccagcuccugaccuccagugaucugcccgccucggccucccgaggugccgggauugcagacagagucucgcucacucagugcucaauguugcccaggcuggagugcaguggcgugaaccuccaccucccagccgccugccuuggccucccaaagugcugagauugcagccucugccccgccgccacccugucuaggaagugaggagcaucucugcccagccgccaaucaucugggaugugaggagccccucugccuggccacccagucugggaagugaggagcaccucuuccuggccuucaccccguguaggaagugaggagcgucucugccuggccgcccaucaucugggauguggggagcgccucugcccggccgccccgucugggaugugaggagcgccucugcccggccgcccugucugggaggugaggagugucucugccuggccgccaccccgucugggagguggggagcacccccgcccggcagccgccccgucugugaggugggcgugcccccacccggcagccgccccgccugggaggugaggagccccucugcccggccgccaauccaucugggagguguacccaccagcucauugagaacaggccaugacgaugauggcgguuuugcugaauagaaaagggggaaauguggggaaaagaaagagagaucagauuguuacugugucuguguagaaagaaguagacauaggagacuccauuucguuuuguacuaagaaaaauucuucugccuugggaugcuguuaaucuauaacauuacucccaacccagugcucucugaaacaugugcugugucaacucaggguuaaauggauuaagggaagugcaagaugugcuuuauuaaacagaugcuugaaggcaguaugcucguuaagagucaucaccacucccuaaucucaaguacccagggacacaaacacugcagaaggccacaggguccucugccuaggaaaaccagagaccuuuguucacauguuuaucugcugaccuucucuccacuauuguccuaugacccugcgaaaucccccucucugagaaacacccaagaaugaucaacaaauacuaaaaaaauuaaaaaaaaaaaaaagaaaaguucaaauaaaguguaugaaagaacuuuaaaaaaaaaaaagaaaaaaaaagugcgaaaauuagccaggcaugguggaguaugccuuggggucccagcuacucaggaggcugaggcuagaagaucacuugagccugggaggcagaggcugcagcaagccaugauugugcuacugcacuccagccuaggugacagauggagacucugucucuaaauaaauaaauaaauaaauaaauaaauccuauuuuuaaaugcuaaaaaaaaaaaagaaaaucuagaagaaauggauaaauuccucgacacauacacccucccaagacuaaaccaggaagaaguugaaucucugaauagaccaauaacaggcucugaaauugaggcaacaauuaauagcuuaccaaccaaaaaaauccaggaccagauggauucacagccgaauucuaccagaagugcaaggaggagcugguaccauuccuucugaaacuauuccaaucaauagaaaaagagggaauccucccuaacucauuuuaugaggccagcaucauccugauaccaaagccuggcagagacacaacaaaaaaagacaauuuuagaccaauaucccugaugaacaucgaugcagaaauccucaauaaaauacuggcaaaccgaauccagcagcacaucaaaaagcuuauccaccaugaucaaguuggcuucauuccugggaugcaaggcugguucaacauacgcaaaucaauaaacguaauccaacauauaaacagaaccaacgacaaaaccacaugauuaucucaauagaugcagaaaagaccuuugacaaaauucaacccuucaugcuaaaaacucucaauaaaugagguauugaugggacauaucucaaaauaauaagagcuaucuaugacaaacccacagccaauaucauacugaaugggcaaaaacuggaagcacucccuuugaaaacuggcacaagacagggaugcccucucucaccacuccuauucaacauaguguuggaaguuauggccagggcaauuaggcaggagaaggaaguaaagggcauucaauuaggaaaagaggaaauccaauugucccuguucgcagaugacaugauuguguaucuagaaaaccccaucaucucagcccaaaaucuccuuaagcugauaggcaacuucagcaaagucucaggauacaaaaucaaugugcaaaaaucacaagcauucuuauauaccaauaaaagacaaacagagcgccaaaucaugagugaacucccauucacaauugcuucaaagagaauaaaauaccuaggaauccaacuuacaagggaugugaaggaccucuucaaggagaacuacaaaccacuacuuaaugaaauaaaagacgauacaaacaaauggaagaacauuccaugcucauggguaggaagaaucaauauugugaaaauggccauacugcccaaggcaauuuauagauucaacgccauccccaucaagcuaccaaugacuuccuucacagaauuggaaaaaacuaccuuaaaguucacauggaaccaaaaaagagccugcauugccaagucaauccuaagccaaaagaacaaagcuggaggcaucaugcuaccugacuucaaacuauacuacacaaggcuacaguaaucaaaacagcaugguacugguaccaaaacagagauauugaccaauggaacagaacagagcccucagaaauaaugccgcauaucuacaacuaucugaucuuugacaaaccugagaaaaacaagcaguggggaaaggauucccuauuuaauaaauggugcuggggaaaccuggcuagccauauguagaaagcugaaacuggaucccuuccuuauaccuuauacaaaaauuaauucaagauggauuaaagacuuaaauguuagaccuaaaaccauaaaaacccuagaagaaaaccuaggcaauaccauuuaggacauaggcaugggcaaggacuucaugucuaaaacaccaaaagcaaugguaacaaaagacaaaauugacaaaugggaucuaauuaaaauaaagagcuuuugcacagcaaaagaaacuaccaucagagugaacaggcaaccuacagaaugggagaaaauuuuugcaaucuacucaucugacaaaggacuaauauccagaaucuacaaagaaucaaacagauuuacaagaaaaaacaaacaaccccaucaaaaagugggugaaggauaugaacagacacuucucaaaggaagacauuuaugaagccaaaagacacaugaaaaaaugcugaucaucacuggccaucagagacaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggugauuccucaaggaucuagaacuagaaauaccauuugacccagccaucccauuacuggguauauacccaaagauuaugaaucaugcugcuauaaagacacaugcacacguguguuuauugcggcacuauuuacaauagcaaagacuuggaaccgacccaaauguccaacaaugauagacuggauuaagaaaauguggcacauauacaccauggaauacuaugcagccauaaaaauugaugaguucauguccuuuguagggacauggaugaagcuggaaaccaucauucucagcaaacuaucgcaaggagaaaaaaccaaacacugcauguugucacucauagcugggaauugaacaaugagaacacauggacacaggaaggggaacaucaaacaccggggccuguugugggguggggggaguggggagggauagcguuaggagauauaccuaaugcuaaaugaugaguuaaugggugcagcacaccaacauggcacauguauacauauguaacaaaccugcacguugugcacauguacccuaaaacuuacaguauaauuuaaaaaaauaauaaaaauaaaacauauucacauauuuacguauucauguauuuaaaauauauucauuuauuuuacacuaugugcaacucauuuuucuacuuaagaauuagagagaugacauuucggaggccccuaauuccaaaugcugccgccuguuuuuaguacagaucuguguuaagcaaaggaaaaugaagcggucaaaucgccucagaagcuuccggcuuccaccccuguuuguaaacgaaacuccauauuagucaaacuacacuccccagggagcaccuguaaaagucccugauuuacagaaguauuuacuuuaggguauggaguuuguuuuuucagguuuaucucugggagagcuuggugaagcugacaguccagcaauuuuauuaaacuguucaauuucagcauuuuuuaaagagcauauauaaagaacaccggcaguagcuauuuaaauuucccaguggaugcuagaaauaauaaaaggacacuuaaaugaccauuuuugagcagagccaacagcauguguccuaauuauccaacuaugugaaaaauucuguggauuuuuaccagagcacaagggugugauaugcacaauucagaacacuaacggcuaccucacuaggguguagagaacuuuucaagucuaaauauaaggucccagucugccaggguaaguuuuucugcuacuuucccucuugaugaacuuguuagacaugauaaauggacaacaugguaagaaguugauaugguccacugauaagccucugaugaagaacaaguaaauaaaaaaccauugugcuaagugcucuccuucauuuauucucacgaucacauucugagguagguauuacuaugcacauuuuacaggucaggaaagcaaagcucacacaggauaagugccuuauccuacaguuuaaguauccaagcugguguucugauuuuccuccacucaccucuuccuaucucuucuccacccaccucuuccuaucucuucuccacccuucucugcccugcugguggucucuuccuuacugaucucuacagacucaucucccgugcccuuugguuucuauagggcuaagacaauggcaggcagcauuaagggaucagagaauuggaggaaagagucuggggguaucuauuccccauuuccucucuccuccccucacacugcacaacugagacuuuugacaagugcccacauuuuucuagcuuugacuauaauuucugucaguggcccuuuuucccuaauuccuagcuagggcucucauuggauucuuguaauucuguucucugucuuugcuccuucagacuuuccauaguugcuucaccaucuuuuuugguucccuuaaaucuacccacaccucugucaaucuucuguucauuaaacucucuuccaaccucucaguuuuggugucauccacuuucugcuggagaaaggaggguagccccuagcaguugguaccuccuccucucuagcuucccuuucaucuacccacaaccaaccacucacccuucccuuguagccagucacaccacaagcaagucugugacucagcaaacuggcucccagaaacaaacccuaggagcauaauugaagaugaacccaaagauacaguuauaaguaugcucguggagaauuuguaauuuuuuaaaaaaugguaguuaucuaagaggacuugauuaaucaaugaagggacauucauaaaaugaaaaauuauaaaugauuaaaaauaauaccauaacuuauauuucaugacaugaacauauucucaauauauuaacuucaaaagggaagauacaaaguuguguguagaauaacucaguuuuucuuuguaaaaauuuuguauacauggggagaaaaugguccaaaagagaccauccaauagaaauacaguacaaggcacauaaguaauuuuagugucaguaguuacguuuuaaaaaguuaaaagaaaccagugaaauucauuuagugauauauuuuaguccaacauaugcaaaauaauauuuaaucauguaagcaacagaaauuaauaaugugauauauugaauucuucuuuugcauaugaagucuuagaacuccgguguguaguugacacucagagcacaugucaacucagucuugcuacauuuuaaaagcucaagagccacaugaggauagugacuaccagauuggacagcucagguaagccucaaaagcggguguguagaguaggaaguugaauguucuucacuuucuuauuauuuuucuccuuuuuuaccauuaccauuuacuacugaugcaugucaccucugcaauuagaaaaacaaauuauuuuuaaacacuaagagcaaggcuuuuuucuucugucucuggaacacuuuuuggcucauguccuuugcaauucacagacuacacacuuacuaguauagaaaggugcccuccuuucuuccccucccuuuacauuuucuuuggauagcuaccuaucuucagcccucaggcauaagaguaagaaucaaauguugauuuucuucagaguggcugcugagccagcucccacucuccaguggugugacccggaaucuaucaggccucacaccacuguuuuagcagcucugaauggcuuguggaagggcauggaauggggccagaaacugcuuaauuugagguuaauuaaauagugaugacaagccuuaaucuccaacuugucaucagauuguaaacacugauugcagcugcagcaaucugcaauaaaccuauugagaggaaucuugaccagaaugaaauaaguacguugguuacccagaugaggcugggagaggugagaucagagaaaucuaggcuuuugcaguaccaggagaaauggagaccugaaaagagggaaauucaugggcgaaugugucaauucugauuccuguacagcccuaucaaaaaaaagaaaaaaagaaaagaaaaaauaacuggaucccaugcaccuggaaauuggaaagaacaagggcagaaauauaaaaccacuaaacuaaggaccuggaaaaagcugaaauagcuuuacaucuauuagccauugaugagguuuccaugaaaaaauaugucugagccacugcaugcccugaggccgcuggacagaugguuauaccaccagagugagcuacagcaguggcuuucuagagugcaggcaaggaugacaguuacaguguguuaggucucuacugugucucaagcacaucacauguaacguauaugauaauucucaaaaguacuuuaugagguagcuauuauuuucuccauuuuaaagaggagaaugcuaaaucucaaaggaguauccuaccuugcuuaaguacauguaacaaauggguugaacccagacugucuaaugcccuaaugcaaauucuaaaucacaagaaucucugccuccagcuuugaggcaauguugaagugggaaaggggaaagaauagucaaguuccugaagaagaugggaaaaaaugagucaaaaaucuccaaagaauagggaagcacaaagggcugagguaacaaaugccagaugaguaaacauguucauaacacugcaccccggaaagugccccuccuggcuccauuuucauggagaaugcuuucucauucuucaagauccagcacaaggccaauuuucaccucuucugugaagccuuccccaaaccuccuagugagagaggcacuuuaaaaaaauaugugagaugcauugagagacagauggacaccauaaaagcugaacucaauauuacaugugaagaaaauuuacaaaaaaaucuuaaucugagugucagaaaaauuggaguagugaaagaaccauuacaguuauugucaaauaguuaauuaacuauuauguagguuuaaauccauguauucuuccuuaaaaccuuuuggaacaagauaaaucauucucauccauucauuuauucauucccuagcacugugauaacacuagagaaauaacaaugaccaaaaacagacacaauuccacucucgagguacacauguuuaaaagggaaaacagaguaaugauacaaaaaucacacaaauaaauggacaauuaugacauguguuccaaauaagagguaaaugagauguuauuauuuuauccaggauacaggacuggaaucauuaaagagaauacacagggaaauaagcugcaguucauuauuuggaaaaaguuucaaacaauccacacagaaauggccccacacaugagccugcucucuucugggcauuggaugugucccggcugaggcagggaagacaagggugcauccgucgauaacuucucaagucucuucugacucuaagaaacugugacccuaucauuccaaacaaaauauuuucucagauaagaauuagaauuggcuagguugaauuuccaggagacuuaggaaauauguacagagaauaaucacuuccuaaauagagaggggagucaagcaaaacugagucuucuaaacugcucgguagcauucuccuucucuucgcacauggacacacuucugcuuuaugcacugcccugacagcuuccugaggacagaggcugauggucuugcucaucacugaaucaucaaugcguggcacauauuaaauauuuguuaagugaguaaaugaauaugguacuaaaaugugcauacugacagaaacuuuuuucuguuguggcccuuguaggugaacuuccuugaauaauuaaugaacaugaaagucagucaaucacucaccuccugauuaauagucagggucccuuguccaaacagccacuuaguccauuaaaaauuaauaauuuucuacagaauaaauauaugcuguacaugguacaucaaggguuccacuuuuaauacgcaauuaaguaaugcagaaagacuaggaaucuauuaacuaagaaagagcuccaugaacuugcccuccaagucaucauucauuuacuauccauuucucuuccaauuuuaaaaaauuauuuagccagaaaaaaaguaguucugaaaacagaguaaauaacaacauguugucauauuuuggcuaacauuugcaggccgacacaauguguguuuguuaaagauuugagauaugcuauuccuucugugaaaugacgaauacauuagggcagaucaauacaaaacugaagcucuauauguaaaauguuaagggucuauucauugaaaaauuaugagccauguuauagaacuuaggucagaguuaaauuauugaucuacauucauuuuuccccuuuccaugugacuaucuuuugauuuuuuauaacauacauuauugccuauguagaaaaugaauccucuucuucuagagcuagugugucuggugacugacaauuuucuaaaauuaacuguuguguugguagcauuuagauuuguaaauugaacuccccuugcauaaacauuuaaacauugaaaauaaaaucuguaaacuuugguagcaugaacucaaagggaaaagaggauaauuuucauuuuuuaauacaaagaaagcaaagaaaaaaaggaaagguuauuuuucuuaacaucauucuacuacuuuaugguucuugauacauuucauugaugaggccaaauuguauucaguugacuuuuuacaaaugacuaaacuguauugcuaagcaaagggauguaaucaacacuuugugagcugaagucucaauuuucagaccuaaagcuuacucaagauguauaaccucaaauucuguaagcagguuagaugucuugaaauacaaagacucucauccccuaucagcccccaaagugacaaaggaaugugucuucaaugaagauuuucucucaucugcugaaaagggaaaaugugcaaauauuucaaagaaauguagauuccacagacccacauuaauucaugaaaaaggaagcuaauguaagaguucuuaguaggaaugaucuuugauuuggggcuguauuuggucaguaacuuuugccuacuaggagaauauuuucucuuuaacgaaguaguaucagacacagagggcucuucauuuucucuaauggagauacaaucauuuagauucgugcuccaaaugaggcagaaauuaccccuaauguguaguuugaacauuuguaucaaaauacagugaaaugcuguuucagagucugaugagaaaaauaugugagcucacagaaugucugccucucucaggugcagaaguggucuacugcuuuuuuuuucuuuuuucuuuucuuuucuuuuuuuuuuuuuugagauggagucucacucugucacccaggcuggagugcaauggugaggucuccgcucacugcaaccuccaccuccuagguucaagcaauucuccugccucagccuccugaguagcugggauuacaggugcacgccaucaugcccagcuaauuuuuguauuuuuaguagagaugggguuucaccacauuguucaggcuggucuucaacuccugaccuugugauccgccugccuuagccucccaaagugcugggauuacaggggugagccaccacgcccggcccucugcuacuuuucuucacauugucacugcaggaaucaccuggcucuagggggauaucccacagucucacauaaauaccaaucccugucgcuggaacaagggggucccagccucacagaaggccugagggacucuguuucucuacaggucagcuccaaagcagagggcccuuugcaccauaaaucaaugucauccacagaaaacuccaggagaaaguuaaauaccagcagcaaacaaugucucuuguguagcagucucucaccacuguuucugcuaggugacaaaagcagugagaaaagcagaggaagcaagggcugaagacagaaaagucaaagaauugcagaacuugagaguuggaaaggggcagaguccaaauaggaaaagacuuaagcuuccuacuguguugugcuauguagaaugcuguaugaggaagggcagcaggcuuucuccccagaagcccagcugaaagucauccacacuuuacaugguccccuauaccaggcuucagcccccuuggccuugguuuucucaacacacaguauggaauccauuucucaugagauggacuucauuaaacacacucaugagaccaacauauaaaaccagaaugucaaaguaguagucuacgauuugcaguauagcuguugcacagaugucagaaagaccaauacauucauucccuuccuguaaaugucuucccugcaaaaccaaauccuaaucaggcagcaaucugacauguaaggaaucugaacaagaggaguucaucugaugaacugaauguuaaacagcgucaggggagauggagucaccaaugggaaagaauacccaaugucccuuggcugcagcucucuacauccauugccguaacagaaauggccuugccaauagaaaaacaauucuccaaguuucucacaggaggucccguccccuccaaagagagcuacauguguauucuuuguguauuuuuaucauugagaaacauaauuugaaugggaaagccuuucuuucguucuaaaaacccugcaucauuuuucucauugcagguuaaaauauguucauuguaaauaaugaacauacggaaaaggguaaaaguuauucuauuucuuccgcccagaaaacuauagguggauaaucuuucagucuguuucuauguauacaucuuagguuguccauauaaaauuaucauuuugcagauaaaaagcagucaauuaggugcaauucuacaugguccaaucucauauacauacgcacauuacauuaaagucaaaugacaccuuaacuucuacuuuguugcuuuucuuugaauuaacuagggcucauauacaguuuuccauguuacucgguaauaccauaauugauucucuugcacgcacuuguuuaccaaaacuucucauuauuuccuuagggaauauucacagacauagaagugcuugguuaaaggauuugcacacacacccauucaugcauauacugucuaagguugcucucaucauuaacagcagaguugaguaguugugaccauacuaccaaaaaaccugcaauauuuacccuuuaguccuuuacagaaaaagguugccaacccugaccuagaauccauaauuaacuagauacagaauccagacauccauucaacaauaggacacagacuuccuauuuuuaaaaaauucaccgugacuacaagcagaucugcauuuaaaauauuuuauucccauuaguauuuuuaauugguccaaaugcucuaugugauauaacuucacuaucauuagaauaguauuaaagaauacuauuagaaaaauguagcuccauuauuuuuacuacagaaauuauuauaaccgaagacauaaaugcgaaccaaauaaaacaaaauaaguuguaaaaauuccuuucuucaacaauugcauaauaaucuauaauacacauagauauacauguucuuaaauauuucauguaaaaauugguuacuauuuaauaauuaauuuuagaaacauuaaaagaaauuuaacuucugggucuuugauuugaaacagcuaagaauuuuagacugguuuccauuuuuaaucaugaucaagacucagaaacguagcuaagaaaaaucauauuguacuuuuuauugaaaaggaaucacacagaccaugucugaauuauuauaaaggcuucauuaauuagauuuuaaucuacaugacuauaccauaugcuaaaaaaccauccaaacaaacucuaugaaacgguuuuacugcuauuacuuaaagagccauuuaaaagaauuucuacgggauaaagacugggugauuuaucauaguuuuaugcuccuuuaaucugcuccaucuucccauuguaaaauaaauauugguuuuaaaauaaaugguucugcccagguuuugaugagaaaaauugcccuguaaaucacaagcucacgugugccaaacucuaaguccaauguuaacuagccuauucugaagaaaaauaagucaauuuuauagaacaaaaucuaaagaagacaauuacuuaaguguauuuucaaagcugcaauguaauuaaucugagauaugagcuucuguaccccaaguuuuuuaauucucaaaauaagaacuaguggauaucaaacugguccuccaacuggauuuuuuaaaaauggguucuguacuauaguuuuuauuauauucuuuccgaauccaauauacaaguuauguaacugaaaauaaauacaaugaggguuauaugauaaugucugaggguuauaugaugacaucuuuaucaaucacuuuuuucauacacagagagccaaaucaauuuaauagucagguucuuagaauauuucauaguguucugaaaaauugaccuuacaguauacauauuuuccuauaauaagcauagugguuaaaaugcucuggaaguuaugaaugguuuaaagcagugcuucacaaacuauuuaggauguaaaacuaguugacuauauuuuucacuccaauauguuguggguuggugauacuuuuauaaaauacaauaaaaauugcacuuggauuuagugguagugucaaacugcuaugacagucucuaaaccagcacuguccaacagaaauaucauaggagccacaugucugauuuuaagcuuucuaguagccacauuaaaaauguaaaaagaaacaguugaaauuaauuuuaauaauauuuuauguaguccaauagauccacaaccuuauuucaauauguaaucaguauacaaauauaauggagauauuuaacuuuuuaaaaaaauuaagucaucaaaauccagcauguauauuccacuuacagcauguccccauucagacuggccacauuucaaguacucaacagucacauguagcuaguggcuguugugugggaaagugccauuuuaaaccauuacucccaaacucugcaccucccucuucaugaacugguccacauacaacacuuugaguaguacugucuaaacuacugcucccuuaaaaauggcaccuucauuucucuucuauaauuuucuacucuguguuuuaaauugagggcuccauuccagauaaguccaacacuuaaagaaauuaacaaacucaugauugcagcuaacuuuauacauccuuucaggaaaggaauuugcauuuauaagggauggauacggagguccccucugcucucccuucucuagaagcaaucacuauucugaaugauauugguuucuuucuuuccuauccauguuuuuauacuuuuucuacugacuauguucuuaggauuuaaauaaagcaaagagaaaauuuguuugcacauugcugagauauaugaauuuaaugcguuuagcucauacaaauccugaccauauuccauggcaaccacugaaaccgaaucacacaccuuucuacguuugcacccucugauccccuauucguccuucauaccacacugcuuugauauaucauuuucuuucugcucuguauuuagacucuguuccaccuucuagccuggauaauuucuacccauugagaucaaagcuuaaauaucacuucuucaaguaaccuuuguugaucugcccuuugcccugguaaaauuagguucccugucaaacacucucacuuuuccuauacugcacuuaccaaaauuguaaauaguuucuguuguuguuguuguuuuugagauggagucuugcacugucgcccagggugguacaauggcacaauuggcucgcugcaaccuccaccuccuggauucaggcaauucuccugccucagccucccgaguagcuggauuauaggugcccacagccaugccuggcuaauuuuuguauuuuuuaguagagacaagguuucaccauguuggccaggcugaaguaguuauuuuuuuuacugauuuguuuaaugucucucucauucauaaaaauauguuagcaccagcauaauuaaaaguauacaguagguauccacaaauauuaauugagugaaugaaugaauuuucauucucagaagccagacuuaaccuggucauuauguuucucaaucucuagucaugacacuagcuuacaauguguauaucauggauauauauacauaggguaucccuguuaauuagaagguauauuuucaagaguauggccauaaagaaguuauucaugguauauucuuuugaccuucuauuuucaauugucucuauauuuagcucccauuuuucauuucuaauacuguuuguauuucucucucucucucucucuuuguucuucucucuuuguaguugaucaaguuugacaagugagaaugugcuguuuuagucuuuaaaauaaucauuuuuugcucgguugaucuucucuacuguuucuuuguauucuauuucauuuuugguaauauuuuuguauuauuccuucccucuacuguauuuggguuuacucugcuauuuuauuuauaccuuuuuaauugaauccuuaauucccuaacaaugucuccuuccguuucuaacguauacauuuaugagucuauaaauuucccucuauauaccucuuugugucccacaagacuuaaaguauguacuaauuucuaucaucauuuuucuuugacucacaaauuauugacagguacaguuuugaguuuccaaauguauaaaguuuugaaaaguaucaguuucuaaucuccugcuuuuuuccucugaaauaaagaauuaguaaauauaauuuuuauucaucagcauuaagacuuucuauguguguauauuaucuguuaguggaguuugaaguucuauauaugucuauuuguccaagcuaaccgguuaugugguuuaaauauucuuuaucuuuucuaagcuucuuagcuuguuugauuuaucagugucugagagaaaaaugguuaaaacucucagauuaugauuauauggguuuucaauacuucuuggugacugugucaauuuuuacuuucuauauuuuuaaaaggaugcuacuagguaauguaggcucaggauuaacucuuccuggugaauuguucuuuuaucauuaaauaauaacucuuuaucuguaauaauauuuuugcuuuuaaaguauauuuuguccgauauuaauagugucaccagcuuucauuugaaugauauuuauaugauguauuaugucaauuucaucuauuuucucuuaaucuucccaugcuauuauccuuaauuggguuguuccuuguaaacaguuaaagagaguauagcuguucucucuauccaacuuaagaaucuuugccugcagacagauagguuuaaucauuuguauauuggcuuugauuacugauuauuuggccucauuucaacuaauuaaucuacagcuuccuaaaagucaguaauuauggccucucacugaaccaaguacugcauaccauagcaagcauugcuguaucuaucuuacacucauaauuuagcuguucucaauaaauaauuuagacacauuggcaaauaauauucucuuaaagcuucaagcucauaaguacuuauauauauaacacagaaaauccccaacuaagauggcuaauccacuacuacucuuauuucuuuaccuauaacaugaaaauaagugaauccacuugucaucuaccuccaauguugcuguacuuuccucuucaaccuccucauuuuuaaaaauuucuaucgggaacagcucucauucugucucuucuaccuuucuucuucccuaucccagucucucaccuguuaccuugacaauugaauuaguaucuuuucucucccugccuucauccuaccaccuaacaauccaauguuuccuccaguuaaaugagggucgcauaguauaaguuaagaaauuugaacuuuacccuacagcucaguguuucucaaacugaacccaaaggcacaguaucauagcuccaaacauucuaugagaauaugcuuuagguuuuuaugguuuuauuccaauuaauguccugaagaaucuaaaugacaaccugauaauugagcuaugcuuuccaaaagcagugccugaguuugucuuuuuuuuuuccuccaucaacucuguucuguucucaguaucacuggaaccaaacaaucacuuuaaaugacagcuuuuaacuuucagugugucagugagcacaucuggcugcuagguuggcauguccuaaugcuaaaauugucccaugucugcuauugugcucuucuugaagauaauuugcaauggaaagauagugucauggaauaagacuuuaauuuauuaaguuauuuaauuaauggagacuuugauaugacaucauaaaaacucauaguguggcagaguaauggucuauuuuaauuguuaugggcuaaugagaaaagaacaaaggcagaauuaacauguaaaugaugcguuuauaucaaaugaaagccaaaugauauuaugggacagugcaaaaggaaguuucccaauuuuucaaauagagaaaaguggugagaaaauugagucaucauguggcucugaguaguagaggcaugccaaauuaagagucuuugccauaguagucagcacacuuuauugaugaaacauuaauuuaucaaauauauguuaaauacuucaucaauaaacagugaguguuaaacacuguucuaggcacuaaggauacagaagucauaagauagucaacucuccagugucacggaaguuauauucugacaauaaaaagaugaacaugaauuuauaauacaacaucagggagucguaagucuugugaaggaaaacgaagcagggcaaagagauggaggaugaugagggaggaggaaagcuacaguaggcaagaugaucaagggaggauucucugagaagaugacauuugagcagacaccuaagugcaacaggaggcaaaggcauacaaauaucucggggagaagauuuccaaacaaaagcaagagcaaauacaaagauguugagaagaacagcaagaaaaccaaugucaacagacugcagggagaaaggagagugguaugagacuagguaaaaagaagagggcugaaucuugaagagccuugaggucauagcaaaaagccugaauuuaauucuaaggaugauggggaguuacuacagguuuuuuguuuugcuuugauagagucucgcucugucacccacacuggagugcagugguacaaucuuggcucacugcaaccucugccuccuggguucgagugauucuccagccucagccaccugaguagcugggauuacaggcauccaucaccaugccccgcuuauuuuuuguauauuuaguagaggcaggguuuugccauguuggccaagcuggucucaaacuccugacaucaagugauccacccgccucagccucccuauuacaggguuuauacaguucaugcagaauaccagaaagggagauggggacuguggggauggauacagguaggcuuguagauuugcuagagaaaauaagguaguuucuucugauuguuucucuuucuccagugaaauaagaagugagacaaucaacugauugagagagcuggggauggccauuggagaguugagguacaggugaagauauaaaauaguuuucucagaaaguagaaguauuagguaaacaaugcaggaucaccguguagaacagaggauccacugcagucagcauaguuguguguccuccauccauccacacucaggcccaaaguagguggaaagcugaaugagggucauaguuuugccagauaagaaugacagagaaagaugagcaaaggaguucagugugcauguaaagaagagaagaaccauagcaucugagcugagcaaggaggaaagugaggauacaggaggaugacggauuguacauaaauccuguaagucaacagauuggaggccccacaggaucaaagaacuguuggaguagagaugcuaaugucaccugaggcagcagcccugaaaagauaggaagugguggucagagagugggaugcugugaaacauacuuugaagguuagcauggcauuucauaacaagggcacuauuggcauuuggggaaaacaauucuucaucgugcauaacagucucauguacugaaugacauuuagcauccuuaacuucugcccucuaaauaccaguagcacuccuuacauuugcaauuacucccuaggagagugguacuuccuagauugugaaccauuggccugggguaugacuaugagguagggagagauauuugcaagugagaaacucagggaccugauagaccagguaugaguauucucuguggauguuuuuacugagaaugaugaguauaaagacagggcgcuggggggaacgucuucaauaaauacagaggaguaggcuguagaagaguuuuauggcaugugcuuuaaaagccucugcggaggaagagaaaaggaacugucuagaagugacaaugaacaauaccagaagacaccaacuccacugucagacacugagaaaaaaacagacaccccuggagagggugauggggaagccuccuuaagaguuugccaagaguaucaagcagcuauccaaaagaacuuucugugaugauggcaauguugauaucuacgccauccuauaagauagacaauaggcacauguacuucuuagcccuugaaacgaggccagugugucugaggaugugaauuuuuuacuuugauuugaacgaauuuaaauguaaacagucagauguggcuacuggcuaacaaauuggauggggcagaacaguaaaaggugaaggaagcauucagaagacaaaauucuucuuaaucucugagucuugaggaaaagggcaagggcagguaugagucuagggaaguuuguacauuuguagcaggaagaggugaggagcaucuaauagcacaauagcaucagcauuuccaauaagcaggauuccaaaaauucauuuuaauuuauuucagccuccucucagacuaaauucuauaccauauuguuguggaagacccuuaaaaaaaacccucaaauauuuaaaauaucaccaucauguaagaauuauuucuucuccuaagaagcaucugguauuaauagacuaugacuaucgcguguuuucuaagaucuaagugucccuucccuccaaagacuggcuaucuauaucuaacaaaggaaaauguaacauuugaaaauucccuguuaaaagauuuuguugucauuuggaaaucauauuucuugcuguuugcauuucuauuaaaaauauaaagaaauuuguucuuugguaucccaaaugaaguaaaaguauucuaauugguugcauucacaagucuacaauuugcggcuuaacaaaauuauuuuugaaaaggucauaaccuguacccacaugcccacccaaccacacacacagacauccagaauggucuugugaucaugucuucagaaguuuggcugcaaaguuacaagcaacaacuguccaucugcacccaccaaccuagugaacaaugccagucugggacccaaggacuauuuacucaacagaagaauuccaacuucaggcaggggauaggcgaaguccagauaacaucuagauauuucuugacauugcauuugauuggaaauaaaggaaaaguaaagcauuucugguuaguuucuguuucuuagugucucuaguucccauuuuauuucaaucaaaauaucaaaauacucuuuagcccauagaggggacagaguuccuaguuuaauaaacccuaaaauauauaauuaagauaaagccucuguaggguuacucagcacaacacuauaauugcucagauucccuaguggauucuccagucaauuucucugcauccuugaggcaaaaucuuuuccuuaauuguccucacuuagaccaggugcuagguguccuuccuagccugcaggucuuacaggcccauucaucccuaagggggucuuauauauuaaccuugcuucugaacucuaagcacuggcaagucaggcagaaggcccaaaggaccuaacagcccauagguaacuacaauguugguaagguggauucugccagaugccagccuuggauccauuuugggucccuacagauuuaugcuucuacuauaaugaauuucauaauuucuaguaugugacccaggguugaacuaagaaguuauucuugcuuuccccuuuaguuuucccuaaugggacuuugaucaacaugaaaacuaaaaauauccuggugcuagaccauuaacacuaguuaacuauuccagacuguggccacugucaaagacagccaucuuguaauugaauuccacuggggacaagaagacucaaaacagaguaggugaauggauugcuuaaaguccaucucagcuacuaaggagaaugaagagcagcagaaacugaauuauuaauucccaacucuauucacaagcccccucugguggaggaaguauuaguaaugaaacagcuauaacaauaaccaaaauuuuuuuaaaagagaaaaggcaauccacaacaaaacaaucagccccugcagaaaugagagucaaguguagugauuagcaaauaugagcugcaaccugaaaaccacuuacagaugaagcaguaugaugaaugauuuaccaaaaggucaacaccgcucuuuugucuucaucacccaucaguuuuccaucgcccucaauuugucuggcacauaacagaaagcagggcauaaaauauuccccauaaaaauuaaccuuacuuugcaacauuaaaaaaaaaaacuuauaguuguauauaguugaagcguaggggccagcuucucaauuaguacuccuagcauacaguagaaaaagcguugacacuuaaagcccuauuacaagagguaauguucuuagcaaguuccggaacucucugcccuauucuugccuugcugacccacuauucucaagcgaaggaaggggucaguaaucccccuaccaaauaccacaccaaugguggcaggaggggagcaugugacagcauuuccccuuuuacucuccuggaggccaaacuucuuugcaaucucugcuuuuagcuagcguggaugccagccuuucaaccuugcuaugccugcaauacuuucugacagaugagcuaugagauguaccaccuucccacucccauuugacaaccuuuguacaaaaagaaacacaacgccaagggaaaguauauuuuuaggcaugagggauucugaaaaugaacauaucugcaaacuucuagauccccuuaaccagaccugaaaaagacauuaaucuauuuuaacuaaacugauuaaauugauuuaaucagaaagcgggucacuucccuccucccuauccugucgcugaauuuacuaauuguuucuccggcuuugcccaaucaauaagauauuuugcaucuugcagauauaauguaaguuaucaguuauuaaaaauuccucuucccggucucugguuaaaguggguaccuaaauaucugcuuauuuauuuacgucguuguuauuugcagauuucuuuuuuaaaaaaagcagaauuaaaaugaaagaaaaggucaaaagaguuuggaaaaaaagcuaucuacagggauguucaucacugcaucauuuauaauaguaaaacuuggaaaucuuaaauuuccaagcaaaagaagacuguucaaauuaauuaugguauagccauaaaguggaauacagucaugcaucacauaaugaaguuuugaucaaugacagaccacauauaugauaucgaucccauaagauuauaauggagcuaaaaaauuccuacugcuuagugacguuguaguugucauaaagucauugugcaugcauuaccuuuucuauguuuagauaugcaacuacuuaccuuuguguuacaguugccuauaguauucaguaaagugaugcucacaagaguaugaaauugucuaaugacacaguuuucauuaagugaggcaugacuacacuaugcagacauugaaaauuaagugguggaauauuuaauaacaaaaaaagauuugugguacuauuaaggggggaaacacauugcaaaacaguagauacuguaauaucauauuuauugagagcuguuaucuuuguauaccauugguuugacaaacauucauuggucagccaucuuccauucauaaccucuucucuccagcauuccuugcacuugggaauuguucuauaaaauaaaauauuaaagaagaaggcugcuagguagggcuuuuuuuucuuuuuuuuuuuuugagacggagucuugcuuugucacccaggcuggaguggagauggagucugacucugucgcccaggcuggacugcaguggcacgaucuuggcucauugcaaccuccgccuccuggguucaagugauucuccugccucagucucccaaguagcugggauuacaggcacgcaccaccacaccuggcuaauuuuuuuuuuuuuauuuuuaguacagaugggguuucaccauguuggccaggcuggucucgaacuccugaccucaagugauccacccgccucggccuuccaaagugcugagauuacaggcgugagccaccaugcccggccuagguagggcuuuucuucuugucugauuaaaaggagcggauuuaucuaacaggucucuuuuuguauuuauccuuuaucuuuccaaucuaaacauaacgucuggaggaacagcagcuucauugugaccaugaagacaaaaaaauaacacgcuaagaacaguagaagagaaaugccaaaacaucagcucuagauuauccucuaaagacuuggagaaagucacuauugguuggauuuucuuuauuuugcagcugaacacauuccugauacacaggagauucuguuuuuguuuuuugcuuaucuguggcuuuuauauuuucuaccauaguauguacuguuuuaucauaagaaaaaaauacuggauacaagaaaaagggucuuuuguauucuucaagagaaaucuagaggcugugaguuggagucucaaaucauccaaggaacaaaagcacaggcaaagaagacaugccaauaauaaaauucuuagagcugcuuaacauuauuaauauuuucauucccuucaacagaaacuguuuacagcuauuaguauuacuguuuuucgagucauggaacacuuaagaucuacuauggugucaggugcuacuuaaggcaccaaguauccaaacaauaaggcagcccaugaccaaaaggaaccguaacaagcaaacgaagaggaaaaaccuagcaggguaaaacacacugccuaacauugcucagcugguuaauggugaagccaggacuggaaugcaggucucuugacaccuaacgaccuucaucacccuaucauaugcuuaacccacuuaccauuuagaagaaagaagugcagcuugcuaccagcacaacgcucucggagcaaacgggaaauggguuaagcauuaauaucuggcuaaaagauguaagaaaaacucuggugagaguauuuaaggagaaugaucuagaugggggucaaaaaacaucagagacagaccuuguucuucauuaacuaguauuuauaguuauagcaggauuguuuucccuaaauaaagggaaaggucucuuugaguggggcagaaaggauuccacuuuuuggcugggugcaguggcugaugccuggagucccagcacuuugggaggccaaggcgaguggaucaccugaggucaggaguucaagaccagccugguuaacauggugaaaccccaucucuacuaaaaauacaaaaauuagcugggcaugguggcgggcaccuguaaucccagcuacucgggaggcugaggcaggagaauugcuuaaaccugggaggcagagguuggugagcugagaucaugccauugcacuccagccugggagacaagagcaaaacuccguccuccccaccccccccccaaaaaaaaaaaagagauuccacuuuuuaucuaucuauaccacaccgaaucagucgaucaauccacugaccacagauuguaaucucggccaaccacuauaguggggaaagaaaacauagcagugcaaucagcuguuggauaccacaggcaacuugacaagucagugacaacuuggccuauuuauucaucuuuuaaccguuuguucuggugucuguguagucacaaucaaagaauagucccuaggaauccauggaguuucauugaaauggaguuagggcuuuggaucauaugcagaaucucaguacuauuccaggagaagggcagccacauugccucugaauggccaaaacauaggguagugaagagugggagaauaugccagcccgaaauaugccacuuuagccuaaggauuauguggagcuaaaggcacauuaaaauacaaaacaaaacccagcaggugcaagaaguguucucuaacccuccccuuuuucuuccugaaaacaugaaacaaaacccccauauagaagacguccagcuauaccagaaggaaagucucauucuuaucaucaaggaugggaaaaugagacuaggaaaagucuguacaaacagaucuuguuaaaauaauucuuaucuuccuuuagccuuuccacacaguugaguuacuuuuccacaacugccucucuuuguucaaccuaauauaaaaccaucuagguuuugccacuucuuugagucuucauuuccuuaugagguaucucaugucacauaaaacuuauauuaaauaaaugugugugcuuuucucccauuaaucuaucuuauauucauuuaagucuuaggcccagcugaaaagaaaacccuaaaagaguguacaauuuugccuccucuacaguauccaucuugaaagcugaaaguucacucucaauaugccuuaagaauaagaacaagugggggcauguuuuuuagccauaguuauucguaacccaaacaaacaaguaaaggauaauauaagugccaaaaauauaaauguugucuggauucacacauaucuuauuugagugacugucauuuuauacugucguaaucuguuugcaugucugucuuuccacuaaacuauaugcucccuaaacgcaaggacgauuuccuuucaucuuugcuaagaauguccaagccuuccuccuuccaaggcucgaacuggauuccaacuauaaaagucuauaaaauaugacagcuauuuggaccgaaauccuucauuccaaacuauccuacuuaaaaaaaaaagucaacuuuuuaacauuuccaaaauauccugaagggagggaaaaaucacacauuaaauucugucaaguaacauuuaccuccucaagcccugacuaaucggaaaugacuggacuuggcagcuccuuuuaucacguggucuaucagcuaaauuuagcuccuguugugccaauugaaaaaugccaacaucccuucccaucucauacaacaucccaacccgccaaugacucuagggucucucuggcaaucuggugugaccacuccucaucagaucaaaauauaaauuacaaaccaaacuuaaaguguccaaguagccccauccagaagagcaaugaugaaguuagaagagacgaagacgagaagggugccagauucauuacuauugauucccugcuggucuuucaaugucacggaaagauguccauuauaguucuaugaagagcauuuggcucaguuuaaacucuuuuguuuucaguuccuuuaaaaacaaaaaucaaccacgaaggauaaacaacuagaaauuaauggagcccaaaggguuucugcagaaugagaagccuucaucacugcacccuaauuauguaaaucugcuccugcagaguccaguacauuuauuuauuaagucucaccacugccauccugguaacccagagaagaagccaaucuauaaugacucaagccacauuucaaaauagacuccaaaggacacaugaugucauuugcuaaaaugacucaauccagauggaaagcauucugaccuauacauaauugauugaccuuugcuaugcuuuccccaguuauuuauauacuaucauaugcaugaauguauaucagugguauuuacacuuggcagcuacuuuuaagaacacauuauucaauugggauuugaagcuuuuuacgaccauuuccugaccaaacauucauaaaugacgaacaaggaaagauguuaucuuaaaaauaauguuuaauaggcucuggagaguuuagagaagcuuugcuacucuaguuauuuuaaauuacaggggacaagaucuauguacauaaagcugaguucaaacccugaaacugaggauaccaaaggacauuuuauuuacuuuccaguuuggagcucaauaaugauaguaaaauaugcuguacagaaggcauggaauguuuuagauacaugugagaagagcaucaacuguggugaagguaguuagagacaauaacaaauuaucagaaucuaaccauggauuucauuuuccaaaagagguuagcugcaaauuggauaauacccagauaaucaagauaguuucaagaugaucauagaaggggaggcagauagauuagggaaggcaaauaugaagcaagcaugucuuuacucccauuaggaauacccaaggcagacauccauaacugauuacugaauucuuaaccacagagcccucacuuggcucaaaauacuuuuccaauaguacuccaggcaaacaccaucaaccaaacagacuuguccuaauaacauaaacagagaaaguuguaucuuauuuacugaucaaauuaauucuauuuauuguuaccauauacuccaagauucaaucuaaaacuaaacagguuuuuaaauucaaaauuuaaagucacaucucugaauccuaagaaaacguuaagucaaaucuaguaguuuuccauacuucaugguaggcuagaaugacccuuaauguaaaugaaaagcaagcaggaaagcuaaacaggagaagaugaaaaugcuuauauguucacauaggaauauuauauagcagugaaaaggaaggaacuacggccacaugcaaccacaggaauaaaucuuagaaacagaaauccaaguggaaauagcacauggagaagacuacauacagcagugcuuuccaaguagugugccucaguaaguggguuacaaguguucccaauccccuuaguucuggggugaauaguaccuggaguagccaaagucuugugucaagccagagcauuuauaucaggagguucuagaauauuuucaaguucuauguaugccaugauggaagaaguuaggaagcacugacauacaauaauucuuuccagagauuaaaccauuauaaaaccauuuuauaauacuuaaaaacuaaaauguaucugcuuaggcauauauauacauauauauauauauauauauauauauauauauauauacacacacacacauauauacaugugacaaauuuauuucaaaaugauaaaagaaaagcaaggaaaacaugaauggauacuucauccaguacauccauucauucaguauaaugguuacuguuggaaacaauaggcaggagaugaguuagguacaaaaacacuucaguagaugguaauguuacaguucuuaagguagauggugguucauggguguuuaguuuauuauacuccaagcauauuauuuuauaaauacaacauguuauauacuacuuuucucaaaacaucaagguuaagaaggaaggaaacuuuuuagcugauucugagucaauuuuucacaguugaaucucaauauggcaauucaagaauagauacaacuacuuuuggaagacugaaacucagaggucaagauuuuguccucaugcaacuagaauaguccaaagguuucuaacagucaacucauguacccuauuuaaugauuacaagauuuuguucuaauccaaauagaguauuaaugaaaaauuguuguaaaccuaaaguuacauuucccuacugaaacaaaaacaucacaaaacccauauguaagccucuuaguuaagauccauuuaguuauaaaaaacaaaacccaaccugaaguguucaaguaaaaggauucuggaugaggaauuagagguauccuacagcacauaggauagcaaguacagccaggccuuaugaagaaccagagccaggguguaggcagccuuucagauccgagguugaaacauucucucucucuugggcugcagguucuugugucucuacuucuuucuggaaccuuuacuuuauugucccuaccuuuagcugugcuuuuucugcuuuggcaucgacaugaccaaauauuuguaucucuugugauuuaaguuuaaaccaaguagugcccugaagacaauuucaaaaugcccagaggggaaaaagaaucuaauuaacccaaccaaggucaaaaucugucuacaccggguuuaaucagacacagcuguacauaaggaguuaccaauuccaacaacuacaggggccaggcagguaauuaaaaguaugaugcugaccagguguaaaaccagaagcuggaagaaaagggucuuacaacaaagagaacucaugcugccucuccacuuuggauauguaauaauagaaauccagauuuucauugaaauuucuugauuuuuaaaauacaucuguauacguuaggccacaggcuucuacugucagcguccuacaaaaaaugaauugugaauauuucaguuucggggggucacacugggcaaaccugacuuagauaccagcccuuuggguagaagagcaggucucacagaagggcucauggucaggcaguacugcaacaaagccuggauuaugcacuacuuuacacacccuccccaugaaauacacacaucagcuaaacuucuaaaaauaucuuguucaaaaucagauacuaagccgggcagagauaaucaucauguagcuuuguauggguucauaguaaaaagcauuaaaaaacaaagaaaucacacaaaagcaaacuagagccagaaaaacacagcaccaucuucuucuuuucuuucuuucuuuuuuuuuuuuuuuuuuuuuugagacagaaucucacuuuguugcucaggcuggagugcaguggcgcgaucucagcucacugcaaccuccgccucccggguucaagcgauucuccugccucagccuccugaguagcugggauuacaggcacgugccaccacaccuggcuaauuuauuguaguuuuaguagagaugggguuucaccguguuagccacgauggucuugaucuccugaccuugugauccacccgccuuggccucccaaagugcugggauuacaggcgugagccauggcgccgggcccaucuucuuuucuguccacagccaaaacauccugccacaaaaggaccauuuguuacaaaacaacugcauauucuuuuuucaguuaacugaagguaacacaggcccuccugugucaauuucuucaccauacaaaacugggagacacagaagucauagcuuaaguaagugucacuuccucucggaagcccagccugagucccugaucuuguauaaggcaaaugucccuuuacaaagcaccuguuucccuugcuguggugccuaaccacagcacaacugauauuguauaugcacaacugucuauuuaucucuuccacauaggugagcuucuggaaagcacagauacugucuaauccuccuucucuguucuuaacaccuguuuguuaaauaaauacauucuguagucagacaugucaaaaauuuuauuuuuuaauuuuuagcagcuaauuuuaaaaaugcugaauuuagacuagauuccuccuuauucuuuuguacgcacuuaaaaauuuucaacaaaacacuuaaaaucuuuuacucagaaaagaacuacacauaucacucugaauuacuacagacucaauaucacauuguuguggggcuuucaagaaucugugcuuauauuuaagcuaaaaauccuucacagcaccuccugucaguuuguagauacgcauagauuuucucaauauaccuguauugauauagauauaaauauaccugguauagaauaaggcacgguaaaauucucuaccuagacauaaaacccauauauuuaaacuuaugagaaaucuggagaaguacaguauauacauguccagcaagacuuauguuccauuuuaaagaaaugagccuuggcaaauuucccuagcacugagaacuguuuagcaagaauuaauuuuuaaaugaaauaagcuaaaaauaaaauagauguaguauuauuuauacuuaagucuuguucuuuagcaauuauuaaagguuacacugguauguuuuaucauugguaacuggacucaaguuugaccaaauguuucucuuuacccaugaaaaauaguugcaauguuccaauuuugacugccauuccaggucuuugguggcccuucaucaagugcaauuugguagccuaaaugauaugggagggacagagcauaauuucauggcaguaaguauagcugagacagaaagguuaaacaagguccaugucuuuggacacuugacccuaaguuaugacagauuaacuuuaaaagacaauguuuuaucuugaacagaggggaguuuugucuucuccuuccagcuagguggaaguauuuggcaaaugucuucuuuggaaagaauuauuuagcaauggaauuauaaucggaauuauuuagcaauggaauuauaaucaauguaguaaggacagaaaaagcaaacuaaggacaaaggaauaaaugaagaaaugacagccacacuugccaaggugaauuccauucagggaauuugccaaaugaaaaggauauuaacauuaacuuaagcagguuuccuuacuucaggaauugucugucuuuaauauucauaaugguccucaugaauuuuccaaaggauagaguaugcagcauuuaugauuauuuaaaggcuuuauaaauguaacugcucuugggcauaguggugcuaucaggcagaccuagguugaaauucuggcucugucagcggcugugauuucaugugcuaauuucuuaacucuuaugagccucaauuaccuugucugaaaaaucagcccuuucauuuauauuucaacagaacuucugcccuugaugucccuuugaaguuauuucccauaauuagucacagaucauagcaucaucagcugcaaucaucuuaucuccauucuauuaacaaauuuacauacauucuuuuguauguucaacaaacagcauaugccaagcugagcuggcaacuggacaaaaacauauuauaugugguuucugaacacccagagcucacuaucuuguuggggagaaaggcagugaggaaauaguaaugcagagcagugacaggugcccauaagggguucgccuaguuuggagaggagaaaacauuugaguugaaaucugaagagagaaaaugaagccacuggagaugaagaaaacaaacuuccauggggcugagggaacaagaaugugcaaaugcucugugggaggcagaaagaaagagauuuugaggaggaaaaagggcaguguaguuugcgugcaaaaaccaggugagcaagaugggagaaucaggagaggcuuuuucuuuuuuuuuuuuuuuuuaaugucaacacuguuugguguuuauuuggugagccugagggcaauuuucauucucauuucuuuuucuuauugauuauuuccaacccuuucaacagugaacaugcguugcuuuugcaauuacaacaacaacaagaaucccuauagacaaagcaaaaaauauauacuuuguaauguuuuuaaaaaacaaagauuaaacuacacuaaaauauaaggugauuaucucugaaugauaaguuuuggggcaguuuuuuuuuuacccucaucacugcuuuccgaauuccaaagguaaaaagauacuacuugaauaagaagaaaaauaaagagaguuguguuucaagcuuucccucuucccuucuucccacccuaucuaacacuuggaauaucccaugagggucuccaacgucagcaggaacuaagagccaagagucgacugagagaugacuuucuuucucuuucuuuuuuguuguguggugaagaaagaaaucauaaucugacgucuaaagagcacuucacuguugcucuugguuggacucuaaaucacauugggaaaauuaaaacuacaaugagaaacaucuuacaccagucaugaugacuauuauuuuuucaauuuuauuuuuauuacacuuuaaguucuaggguacaugugcacaacgugcagguuuguuacauauguauacaugugccauguuagugugcugcacccauuaacucaucauuuacauuagguauauuuccuaaugcuauccgucccuccuccccccaccccacaacaggccccgguguguggccccggugugugauguucuccauccugugucuauguguucucauuguucaauucccaccuaugagugagaacaugcaguguuugguuuucuguccuugcaauaguuugcucagaaugguuuccagcuucauccaugucccuacaaaggacaugaacucauccauuuuuauggcugcauaguauuccauguuguauaugugccacauuuucuuaauccagucuaucauuguuggacauuuggguugguuccaagucuuugcuauuguaaauagugccacaauaaacacacgugugcaugugucuuuauagcagcaugauuuauaauccuuuugguaaacacccaguaaugggauggcugggucaaaagguauuucuaguucuagauccuugaagaaucgccacacugucuuccacaaugguugaacuaguuuacagucccaccaacaguguaaaaguuuuccuauuacuccacauccucuccagcaccuguuguuuccugauuuuuuaaugauugccauucuaaauggugugagaugguaucucauugugguuuugauuugcauuucucugacggccagugaugaugagcauguuuuccugugucuauuggcuccauaaaugucuucuuuugagaagugucuguucauauccuucguucacuuuuugaugggguuguuuguuuuuuucuuguaaauuuaaguucuuuguagauucuggauauuagcccuuugucagaugcguacauuguaaaaacuuuaucccauucuguagguugccuguucacucugaugguaguuucuuuugcugugcagaaacucuuuaguuuaauuagaucccauuugucaauuuuggcuuuuguugccauugcuuuugguguuuuagucauaaagcccuuacccaugccuauauccugaaugguauugccuagguuuucuucuaggguuuuaugguuuuaggucuaacauuuaagucuuuaauccaccuugaauuaauuuuuguauagcguguaaggaagggauccaguuucagcuuucuacauauggcuagccaguuuucccagcaccacuuauuaaauaggaaauccuuuccccauuucuuguguuugucagguuugucaaagaucagauuguugucgaugugugguauuauuucugagggcucuguucuguuccauuggccuaucucucuguuuuuguaccaguaccaugcuguuuugguuacuguagccuuguaguauaguuugaagucaaguagcgugaugccucuagcuuuguucuuuuggcuuaggauugacuuggcaaugugggcucuuuuuugcuuccaugugaacuuuaagguaguuuuuuccaauucugugaaggaagucauugguagcuugauggggauggcguugaaucuauaaauugccuugggcaguauggccauuuucacgauauugauucuuccuacccaugagcguggaauguucuuccauuuguuuguauccucuuuuauuucauugagcagugguuuguaguucuccuugaagagguccuucccaucucuuguaaauuggauuccuagguauuuuauucucuuugaagcaauugugaaugggaguucacucaugauuuggcucucuguuugucuguuauugguguauaagaaugcuugugauuuuuugcacacugauuuuguauccugagacuuugcugaaguugcuuaucagcuuaaggagauuuugggcugagaugauggggauuucuaaauguacagucaugucaucugcaaacagggacaauuugacuuccucuuuuccuaauucaauacacuuuauuucuuucucuugccugauugcccuggccagaauuuccaacacuauguugaauaggaguggugaaagagggcaucucugucuugugccaguuuucaaagugaaugcuuccaguuuugccaauucaguaugauauuggcuguggguuugucauagauagcuugcauuauuuucagacacgucccaucacuaccuaguuuauugggaguuuuuagcaugaagcauuguugaauuuugucaaaggccuuuucugcaucuacugagauaaucaugugguuuuugucuuugguucuguuuauaugauggauuauguuuauugauuugcguaugugaaccagccuugcaucccagggaugaagccaacuugaucgugguggauaagcuuuuugauguccugcuggauuuguuuugccaguauuuuauugaggauuuuugcaucgauguucaucagggauauuggucuaaaauucucuuauuugguugucucacugccaggcuuugauaucaggacaaugcuggccgcauaaaaugaguuagggaggauuuccucuuuuucucuugauuggaaugguuucagaaggaaugguacccgcuccucuuuguaccuccgguagaauucggcugugaauccaucugguccuggacuuuuuuugguugcuaggcuauuaauuauugccucaauuucagagccuguuauuggucuauuaagggauucaacuucguccugguuuagucuugggagaguguauguguccgggaauuuauccauuucuucuagauuuucuaguuuauuugcauagagguguuuauaguauucucuggugguaguuuauauuucugugggaucaguggugauauccccuuuaucauuuuuuauugcaucuauuugauucuucucucuuuucuucuuuauuagucuugcuaguggucuaucaauuuuguugaucuuuucaaaaaaccagcuccuggauucacugauuuuuugaaggguuuuuugugucucuaucuccuucaguucugcucugaucuuaguuacuucuugccuucugcuagccuuugaauguguuugcucuugcuugucuaguucuuuuaauugugauguuagggugucaauuuuagaucuuuccugcuuucuccugugggcauuuagugcuauaaauuucccucuacacacugcuuuaaauaugucccagagauucugguauguugugucuuuguucuuauugguuucaaagaacaucuuuuuuucugccuucauuugguuaugugcccaguagucauucaggagcagguuguucaguuuccaugcauuugagcgguuuuugaaugaguuucuuaauccucaguucuuguuugauugcacuguggucugagagacaguuuauuauaauuucuauucuuuuacauuugcaaaggagugcuuuacuuccgacuauguggucaguuuuggaauaagugcgauguggugcugagaagaauguaucuucuguugauuugggguggagaguucuguagaugucuauuagguccaccugcugcagagcugaguucaauuccuggauaucauuguuaacuuucugucucauugaucugucuaauguugccaguggaguguuaaagucucccauuauuaucgugugggagucuaagucucuuuguaggucucuaagggcuugcuuuaugaaucugggugcuccuguauugggugcauauauauuuaggauaguuagcucuucuuguugaauugaucccuuuaccauuauguaauggccuucuuugucucuuuucaucuuuguugguuuaaagucuguuuuguuagagacuaggauugcaaccccugcuuguuuuuuuuuuuccauuugcuugguagaucuuccuccaucccuuuaguuugagccuaugugugucucugcaggugagaugggucuccugaauacagcacacugaugggucuugacucuuuauccaauuugccagucugugucuuuuaauuggagcauuuaguccauuuacauuuaagguuaauauuauuaugugugaauuugauccugucauuuugauguuagcugguuauuucgcccauuaguuggugcaguuucuuccuagcaucaaugguguuuacaauuuggcauguuuuugcaguggcuguuacugguuguuccuuuccauguuuaaugcuuccuucaggagcucuuguaaggcaggccugguggugacaaagucucucagcauuugcuugucuguaaaggauuuuauuucuccuucacuucugaagcuuaguuuggcuggauaugaaauucuggguugaaaauucuugucuuuaagaauguugaauuggcccccauucucuucuggcuuguagaguuucugccaagagaucuguuguuagucugaugggcuucccuuuguggguaaccugaccuuucucucuggcugcucuuaacauuuuuuccuucauuucaacuuuggugaaucugacaauuaugugucuuggaguugcucuucuugaggaguaucuuugugguugucucuguauuuccugaauuugaauguuggccugccuugcuagguuugggaaguucuccuggauaauauccugcagaguguuuuccaacuugguuccauucuccucaucacuuucagguacaccaagcagacguagauuuggucuuuucacauagucccauauuuccuggaggcuuuguucauuucuuuuuacucuuuuuucucuaaacgucucuuccggcuucauuucauucauuuguucuucaaucacugauauucuuucuuccacuugaucgaauuggcuacugaagcuugugcaugcaucacguaguucucaugccaugguuuucagcuccaucaggucauuuaaguucuucucuacacugauuauucuaguuagcgauucgucuaaucuuuuuucaagguuuuuagcuucuuugcgauggguucgaacauccuccuuuagcuuggagaaguuuguuauucugaucuucugaagccuucuucacucaacuugucaaagucauucuccauccagcuuuguucccuugcuggcgaggagcuagguuccuuuguaggagaagaggcacucugauuuuuagaauuuucagcuuuucugcucugguuucuccccaucuuugugguuuuaucuaucuuuggucuuugaugauggugacguacacaugggguuuugguguggauguccuuucuguuuguuaguuuuccuucuaacagucaggacccugagcugcaggucuguuggaguuugcuggagguccacuccagacccuguuugccuguguaucaccagcggaggcugcagaacagcaaauauugcagaauggcaaauguugcugccugauccuuccucugaaagcuuugucucagagggguaccuggcugugugaggugucagucggccccuacugggagguaucucccaguuaggcuacuugggucucagggacccacuugaggaggcauucuguccguucucagaucucaaacuccgugcugggagaaccacuacucucuucaaagcugucagauagggacguuuaagucugcagaaguuucugcugccuuuuuuucagcuaugcccugacccuagagguggagucuacagaggcaggcaggccuccuugagcugcggugggcuccacccauuucgagcuucuaggccgcuuuguuuacccacucaagccucagcaauugcggacaccccucccccagccucacugccaccuugugguucgaacucagacugcugugcuagcagagagugaagccccgugggcauggaacccuccgagccaggcaccagauauuaucuccuggugugcccuuugcuaagacaguuggaaaagcacaguauuagugugggagugucccgauuuuccagguaccgucucucacggcuucucuugacuaggaaagggaauuccccaaccccuugcacuucccaggugaggcgaugucccgcccugcuuuggcucaugcuccgugggcugcacccacuguccgacaagccccagugagaugaaccggguaccucaauuggaaaugcagaaaucacccaucuucugcacuccucacgcugggagcuguagaauggcgcuguuccuauucagccaucuuggaaccuccucccaugaugacuauaagggaggcuuuuaaaugguggaaaugaaugguuuccaccaggacaguggcaagauucaauuaucauuuuaaaaaucucugucaagcuacaguguggaaaauggauuggaaggagacaauaauggcugcaaggguaucaauuaagaggcuauuguagcaaggaugauaauuuaaacugcaauuggaacagaagauaugguaaaaugugacaaaucugagagauauuuagguugguaauuaauuggguaagagaacugugguacauuuuacacauaaaguccuaaggugcaguauuugauuuggucuauaaauuguacuccaaaucagcugaugcuuuuauaguuagagagaauuaucucaguagacguaauacuucucuuucaaaaacugucaugguucuuaaucauauuccacaauggucaguauggggauguuuaugccucauggaauagagaaaucaaaaauuuaaaucuauauuugauguuaaauauaaauaguaucuucuuauaaaaauacauuaccauuacucuuagcuugauauauuguaaauugcuuuauucaccuccucagccauuuuucaucagcaguaguauaugugcucccuguuccuggcagugauucacuggaugagaacauaaauguauuugugggaauauguaugaacguugcucugggaacaaaagaaacaguucuguuauaccacauuggugguaaucauucuuucccaaaaucauugcuugaucccuuaaacaaacaaaacaaugugaaauaacaagcauugcaaauaccuaagacuuugguguauugacugccuaucugucaaauuugacaggaaggauuaaccaugguuucaauauuuacacuuggauuuugaaagacuagauaccaaguugaugacucuuugaaaauaauauagaaaaguauauauaaauacauagguaaaaaggaugggacaaaagugucaaugguuacugcugaaauaugguuuuggagugcaaguauaggggauuucugcuauucauuuuaugcuuaugcaauguuuaaguuuuaggagcagguaucaguuucuaagaaaaaucgaaaaaagagcagauaugaaaaacaagaucaauaaaauaguuucacuguuuaauaaugccagguuagugagaggcaacauucaucauggaaacuaaaugcauuacacuagacuuucacuauuuauaauuauuuuucuaggaccaugaucagacuggcccacgguauauaaucuacaaauugacuacugauauuguaagagggcucagccauauucaaauaccaucuauuaaaaaaauuaaauaugcuaauucgccacuacaauuuaaaauucaacuguagguaaauaaaaguaaauugugccaauaugcauguggaauuacuugcuucugaucaacuaaaaaaaaauuaguaagaaaucuggugaacaucguauugguaaacaaaaacaauuuuuaaaggaaaguggcaagauccauguccagucugauccaagguguugccagaauggcagcccgaguugagagcagaaauguguuucuccucacaccuuuccaacuuuuaggcuguggucacuucaaacuaagaagcaaaucacaucuuagcccauguaguaaugagguuauccacacuagaaugcauaaacgucaccuuguggcuuguuaaaaacacagauucuugcccaucacaagauuauauuaaacugacuagggucucuaauauaaugaugaauaaaaauggaaauaauaaacacauuuaugaucucaacaagaaaauuguuaauauuucaaauuaaguaugaagucugcuguaggacuuuuuuuuuuuuuuucgagauggagucucacucugucacucaggcuggagugcaguggcaugaucuuggcucacugcaagcuccugggguucaaacaauucuccugcuucagccucccguguagcugggacuacaggcaccugccaccacacccagcuaguuuuuguauuuuuauuagagacaggauuucaccauaguggccaggcuggucucgaacuccugaccucaugauccacccgccuuggccucccaaagugcugggaauacaggccgcccugcccggccccugcuguaguuuuuuaaaauaaauauuuaucugauuaaggaagcucagcucuauucccauuuugcugagauuuuaccaugaaugaauguguuugucaauuuuuuccccuuaucuauugagaugaugauaugguuucucaguuuuacucuauuaauaugguaaguugcauugacugauuuucaaauaaucagcuuguauuccuggaacaaacccaacuugauaaugauauauuauucuuuuuauauaucacuggauuugauuuaccaauguuuuggcuaggauuuuuuuuucauuuaucuucaugaaaaaaauugaacuguggauuuauuuucauuuaauaccccucaucuuuggggucaagguuaugcuggucuaaugaugugaguuuacauauaacugauauugcuucuuccuuaaauguuuggaagaauuugcugguaaauuuaaaugggcucuuuuuugugggaagauuucuaauuaugaagcuaauuucuguaauagauauaggauaauucagauucccuaaaaauauaucaaauuuaguuguauuuuuaaggaauuuaaccauuucauuuaaauguucaaauuuacuggcauaaaaucuuacuaauaucuuuuuuagugcuuuuuuauuucugauuauuauuucaauaauuucugcucuuaucuuuauuuucuucuacuuucuuugcauuuauucuguuucuuuuuuagauucuugauacugauuacuagauuacuaauuuucaggcuuucuucuuuucuaagaauuuaaggcuauaaauuuccauauaaaaacugcuuuagcugcaacaucaaagcuugauauguuauaucuucauuaucagaaauauuuuuaauuuuuguugugauuacuuucuuugaaacauagggaagaaaauauuaccuaauuuccaaauauuggaauucuaucauuaucauuuuauuacugauuuccaccuuaauacuacugugaacagaagauaaacucuaugguuuaaagccuuugacauuuguucagaagugcuuaugucuagguauauauuauauuuacuaaaucuuuaaaaauguauaugcuuauuugguuguugcaguguucuauacauaagauuaaguuuguuacaagugguguuugaaucuucuauauguuuacugacuuuuuuguuuguuuuguuuucagacagggucucccucuauugcccaggcuggagugcaguggcaugaucacagcucacugcaaccucugccucccaggcucaagugauccucccaccucagccuucugaauuuuuugguuuuguagagaugggguuucgccauguuuuccaggcuggucuuaaacuccuacacugaagcgaucugccugccucggccucccaaaguguugggauuacaggugugagcuaccaggcccagccguuuacugacauuuugucuucauauucuauuaacuaccugaagagguaugguaaaaucccaacuaaggcugaagauuuguauauuucucuuuuucagugcuguuauuugcuuucaaauauuuugagaccaugcuauauguaccuauacauauagcuaugucugcuucuuuuggaauacuguguguuugcacaauguuucucuuuuuacaacuuugaaucuuuauauggauuuauauuuagacuguaccucacauaguuagcuuauaguugucuuguuuuaauaauccagucuaauaaucuguuuuuaaauagaaguauuuaguguuuuguauuaauauaauuaagguuauauuuauauucuuaucacuaucuuaauauauucuuuauuugucucacaguuuucuguuccuaaauucucuuuuugucuucaauuaaucaaauauauuuuauauuauccauuuucccccucuaucagcuugguaacuguacauucuuuaagugguuacccuggaaaugaaaauaugauuucuugacuuauuagaaucuaccauaauugauacuuuuauccugucuggauaaggauuucacauuauuuuaacuucauuuaauccacucucauucuaccuguuauuguuuguugccuuuauuuuaauuccacaaauauuuuauuuuucaagcuuuuuauuauggauaauucccaacauauacaaaaauagacuuaauaaucuaaugaaacguucauauuuaucauccugcuuuagcaaucauuagcucaugaccaaucuuguuccaucucuauccccauccauuuucucuccaaauauauuauuuuaaaacaaauuccaaacaucauauuacauuucuuaugacuauuucuguauguauauccaaaagaugaguaugcuuuuuauaauauauaacuaugaugucauuaucacacauacgaaaaaauaaugauaaugggccaggcgcaguggcuuacaccuguaaucccagcacuuugggaggucaaggcagguggaucacuugaggucaggaguucaagaccagucuguccaacaugguaaaacccuaucucuacuaaaaaaguacaaaaguuagccgagcaugguggugugugccuguagucccagcuacucaggagucugaggcaggagaaucacuugaacccgggagguuucagugagcagccugggugacaagagugagacucugucucaauaaauaaauaaugcauaauaccaucaaauacucuggaaauacucaaauuuccaaaugucucaaaugugauaaccauuuuuauagguauuuugaaaucaagagccaaauaaauucugcauacugugauugguuuauuuguccuuuaagcuuaauuuaaccuauugauucucccucaaucuuuuuuuuuuugcccccuugcuaucuaugcauuggagaaaggggcuuguuggaacugaaguuuuccacgcucugauguuuuuucccccauggguauuguauuaaauaaaaugcuuccuagcuguaauuucuguuuguuugcaguuagaucuagaggcaugcagauucaaguucauuuguuuuguuuuugguaagauuaccucauggcuagugguuuauguucuuuucucuuuucccauaaauauucagggccuggauccguuaauucauuaaaauaaaaaaauaagaauauuacacuuuuaaaacauuuauuagcaggaauccuauuaucaagagaaaauucccccaucuauguuuacuuagucauacaagagauguggaacaaaugcuugauuuuuuacauuuguauaccauuuuucaaaacaacaaauugguucacuaacaucuuuccaugguaaccaaucgguuauaauuauucuuaauguuaugaacucauggauauaaaauauuugaugaauuugcaucugcugcaguuacugucaaugagugcuuaaauuguucuaucuuuaguuauaggacuuacacuccacuaaacauuacuuugauuguuuuaaacaauccauauucauagacacuuacuuauauauuuauacuuuuugguguucuucaugcccuccuucauuuacaugauuucaacugggacuauuuccucugacugaggagcuccuuuuaauaguuuugauauagauaugcugauaauuaauuaucuuaguuuuaauuuucuaaaaauguccuuuuugaaggauguguucgguagguauaaaauucugaauuggcaauuacuuucuuuuggcacuuuaaccauggcaucccauuguuuucuugguuccauuguuuugguuuaaaaauuagcuuuaugucucauuggugugccuuugaaaauauaucuuuuuuccuuuggaugcuuuuaagaugcauuuauuugucuucaauuuuuaagcaguuuuacuacaauaugccuccauauuuuauuuggcuuuuuuuuuuucuuacacaguuucuugaauccauggcuugauguuauucauuaauuuuggaaaauucuuuacugcuauucuucaaauaauacuuaugccccaucuucccugaaaucuccucuugggccuccaauugccugacacagaccuuuacacuaaccaauaugucucuuauaaaauuuucuuuauuuuugcauucucuuuuccacucugcuuuaaucuggauauuuucccuugaucuauuuuccagaucaugaauccucucuucuguugugucaacucuauuauuaaaccuaucuacuuaguuuuaaauuacacuuacuguaauuuuaacuuucauguuguacauuugauuccuuucauaggaucuagaucucuggugaaauucucugucucuucuugaacauauuaaucucuuaucugaaacagauuauagcuauagaucuuauagcuccaauuucucagucacuuuuggaucuguuacuuuugguugguuuucugucuugauuauuggccauuuguucuuguuuccuggcaugccuacuacuuucuagugaaugacagauacacuuuuuauggaaauuguacaaguuuugaaugauguuaucuuucuccaaagaugauuugauuuucuucuggcaggcagauagaguacaggaaaaucaucuuaauccaguugaggcugguauauuuccaguuugcucuuacccuagguuguaguucuucaggggccucaaggaccuugaguauuuccaugguccuacuucuuugaaagcccugaacucugugagacacugagacugcuacaauaucugcuuugccauuuacuccuguaucagauauuuucagcuuuauauuuuguugucucucccugggaguguacaaaaaggccucaagggaaaauuccaugcaguauguugaacuuacaucucuguggcuccuuuccucugggaucuuguuuccuccaguccuuuguugguagcccugaacuccacuggucaggaaagaauuuaagcuauuuccacuuuagaaacuaaaaucuuaaguuacgcuccuuguugauguauucaugcuuuuauuuucccugauuuuuaauauuuuaaaagcuggucacauucucaucauuuugguaugaucacaaagaaacauguaguaauggaaaacaaagaaguauugaccuucacuaggcaaucaacccucagauaaugucaggaaaucugaagcuuucucaaguaggaguauggaagaguggagaagggagauguguuauuuaucacagacaauacucagcacaauuuuauugcuccuuggggaauccaaagcuuuuaaagaugauauuauuauuuggaaggccuccagagagcacuaaguauuaaaaauagcaccugcauucugcuaagucaaaucaccuguuuauuauccagggugaugaaaaucauuuaauaaaauauuacagacgcuuguucaaaaucaugcacacaauucauaggcucagagacauuaaugucuaugccuggcucacuacauauuuguuaaauugauaacucagguggacauuaguuaauauuaccacuuuuuaaaaauuaaugauaucaaguuauuugaaauagccaguagaaaaccucugcaguaacauuucccauuuuuccucauacaaaauuuacauaaaaccuuugcuuuguaauagccacuaucuuuuuucuuuagagaaccuucuccuccuccugccuuuagaauauaaauauaagaaugugacucaggucuggucagucccuguucaucccauuggccagaguuauugguucagaaaugagcaugugaucuacauuauuccauugagacucaguacuuggauuuuaugaacacuacuggaaagagaauugcugcugguugguaaagggauagaaugaaagauucaaugugguuaucaccacguaaugaagaccugccuaagacugaagccaaaacuacuuaaaacuucucaguuacaugaaucaauaaaugcccuuuguugccuaagccaguuuauuaggacuggguuucagaccuggaaccaagaguucuuacuaauauagcuauaccaaaaaaguguguagcagcaaccaagucugucaacaagagugauuaacccucagguuuaagaacaaaacugaaaagacgcaguagcauuaggaacauguuuuuguggugauaagauuuauuccaguccacugauaauguuuuacuuucccaccuacauuuacaggaugcccaagacaugaggccugaaauuuaucaauaauaucaaauaacauagccccauucuugaaguuccaaaguuagaguauuauuggcauuuuucaccuauuccucacagagcuuaguuauuuggggaugaaguaaguuacagaaguuuccaaaaaagaaggaaaucucuauguguuucauguuuuuaaaauucugucuucggcuuuggcuuaaguuaugguuacugaugguagcuguaaguaauauucccaggagaaaggcugcaaauaaaaugagaauuccucagcaucuuuauuguccuucaaguggacacgaauucaagcaggugcacauacugaggaucauacauuucuacucauggcauuuaauuaggaggaaaguaaaaugugcagggccagaacuuuaaauauuaguuuaauaaccuuuaugcaccuaauuucugaaugauuuucuuacucucuggagaggcaucuaaugucagacaguggcauuaaggugaaauuaaggugagucaugguaacugaaaagccaugaggcaggcacaugucagaauuauuaauuuuaaaggauauaugaaauauuuucuccucugaaaauaugcccaguuaauguaugcugaacuugaaguauggcuuuauuucccucauucacaacuaaucacugucuccaggaggaacagacuaaagagagaaagauuacaaaagaaguauagccauuucaaaauccccaaacaaaugagaaaucaaaagaacaaugacaagcuuguugguuauguagaguaaaauuuuuagugugccaaucauggcugauaccauguuuugaccaugucaaaauucaucaaggcaggaguuuucaaaccuuuuuugaauaugacccacagugaaaaguauuucuauaucuaucuguaauaugacuguguaugcauauacauuuacaaaacucuuaccaaauuaaaugaacucucauauuuucuauucuauauaauuucacuaaaagcaaucccuaaauugucucacaacucaccaguagcuuacaaguugauauaaaacauauaauuugacauauauuccacaucuuaggcuaagagaauuacacauauucaaaucauuaccaaugccaauuucagauuaagacuguucugaaaugaaaucaaaucaacucuuucuacacaguggaaauucuuagaccguuuauuaacuucacuaaauauuuucauaaagcauuugaagcaagaugcuuucuucaggauaacaccuccaaacauacuuuguaucuuucguuuuucuuuuucuuuuuuuuuuuuuuuuuuuuuuuuuuuugagacggaguuucacucuguugcccaagcuggagugcaguggugggaucuuggcucacugcaaccucuaccuccuggguucaagugauucuuuugccucagccucccaaguagcuggaauuacaggcacaugcuaucaugccuggcuaauuuuuguauuuuuaguagagacaggguuuuaccacguuggccaggcuaaucuugcacuccugaccucaggugaucugcccaccucggccucccaaagugcucagauuccaggcgugagccaccacacccggccucagaacauacuuugaaacaacccaaugcaagcucaccaccucaaauccagauccaaagacgacacuaucuuuaaaacaaacaaacgaaaaaccaugucucuauaaaaaggaaugaaacauaaugucacagggugauauucuaaugagacaaagagguagucccauuaucuguuuuguuuuaccuggugguaucaacuguuguuucaucacuguuucugugaagaacauguuuucuuaaugaacccuugagaaggacagugauuugaugaaugaaagaugugacacaugaaacaaaauauuccucauuccacaccuguguauauaauaucauuuggcucuccaaauuaucuuaaaguuugaaucucauuucuuccuuccucaauauuuucuuuuaccauggaggcagggacagcaaagaaauguuuccucuccagauccacuauuaacugaaaauuccagugcucugaauacuuguuuuuuuuuuuuuauuuuuaaaaagggaccugaauuucuauuaaaggauuuccuuuauuaacuccugcugaagaauuuacauauuggcagguuggaaaguaagcccuguaggaaagaaaucggacuuguuuuucaucaucaacaugacggucugaugauggguguaugaguuuccuguugacacccaugucacauuuacugaauuacuguugagaccacaggguagacccagcuuauacaauucuuuugucuucuuucugcuucacagaucauucauaaucacacacgggguaaaaaaugagggagcgaaaauuguguaagcuaauuuucacuguugcuggaagcggaagcaaauaguucucagagcugagagugaaccuggguggugaagagcagucagcauuaccgguggcaaguucagcauucugaccaaaaugagccacucugaacccugguguucagucaauggcgguuuccucaaauuuguccuuaaaaguugaaauguaucauacuucugcucagccacccuuaagaaacuugaguguaugagugugugugaaauacaaauaaaaccuacacagcuauugucuggauugaacaaacaagcaaaugugcucaguuuuccaaacaauugcagaugcuguaauaauucagaaaagugugugcugagcagugggggaugcuggcaugcucuguuagaaucauuguggcugggugcggugguucacgccuguaaucccagcacuuugggaggcugagaugggcaaaucaccugaggucgggaguucgagaccaggcugaccaacauagagaaaccccaucucuacuaaaaauacaaaauuagccaggugugguggcgcaugccuguaaucccagcuacucaggaggcuggggcaggagaaucacuugaacccaggagguagagguugcagugagccgagaucucgccauugcacuccagccuggacaacgagagcgaaacuccaucucaaaaacaaaaacaaaaagacagagucauugcuaaccauguugcuuagcacaauuuuggaaggaggcaugaugcuggcacagaaaacccuugucagaaauuccuauuccuuaauuuuaugcucuuucuuucauucuuuucucacuucauugucauacaggcaagugaaaaagaguggaaagagaagaggcggugucaaaggaaaagagaaaaaauacaccugacuccuguuguuuaugauugucuugucaguuaacaccugggcaaucaucaaccauguacuuuccuugagccagguccuuaaagaacccaagaugaaggaaguagacagaagcagcuuuggggugguuaggguagugcuucuagaacuuuaacguggcuacagauuucuugggagucuuguuaaaauguggauucugauucuagaguggggccucaaauucugcuucaguuggugaucuuguuaaaaugccguuuccgauuaugggguggagccucagauucugcacuucuacucuuagggaaacccaagccucaggguuagucuuugagccuggggcaguggccuauccugggccuuuuucuuuacagguauuucacuugacuacuucuccuuuuuucaggggccugcaguaaagagaaauaaagcaugacauagucugaaaagcacugguucuagaaucaaacaaacuuggguuggaauuccaacucugcaacugauuugcaaucuguguggucacaggugaguuuuuugaaucccucuuaaauucauuuucuccaucuauaaacuggguaugccauuuuuuaacucucagggcagcuacaaggaacaaaugagaucaugugcaucaucagguagguucacauucauuaugaaaugaaugacuaaagagccuaaagcacaaccguucuaucuacagguaauaaaaaggaagguagggugcaacaauguuuaaauacaucuuuauuuuucuuaauaccaugacuuuggcucuuccuuagaucuacagcuauggguuguguagaguuguaaccacauuaagccaagcaugucuucccauuucgaauacuuuucugacuccagaaauucauucucugaucaugcuuucaguaaugacaaaauccagaacagauuggguuuuugaaaauauuucuugcuauaucaaaugaggaaaauuugaaaauauuucuugcuguaucaaaugaugaaaauacaucugaugauuuacuugcccucaauuaauucaguucuuaggcuugcucuucuggacuucucuggcuccuguuuccaacaacagauuucccuucuucucaagcuccccucuucccagucucucuccuccaaucugaaauugggcucccuuugcucccauaguaaauaaggcaaaagugucccuucauucccaugugauccagcuggggaaucucaguuucucuaaaggaaucaagaagauacuucagaguuaaccagaggaauuaaagaaaaaacaguuaaugccagccuucuccaaccuucccacaucagcagacugaacaaagcgcucaaaacucaggguuuaauaaagagggaaaaaggaggaggagcuacuuuauuggguguaguagagacaaagagggaaauagaagaaaauugugaaguagugacauuagcugccauguccuaccuccucuggcaguucuccagggcagacagggcuggcagcggauggguguuauaacuccuauggaucaugccugacccuucugggcccgucaugacuucuguuuagaugacacuaaagggucucagggcagcaucagagcaggaaggaugugccaaccacagaagugccaacucaugacaagaaucauugcucauucagggauugcugccccugccaucacccccucugucccaggaucugcauuccgcuguucucucuccugcaagcugugacagcagaagaggggccuccuucccauuagcucauuuccaucucggacuuagucaaaggaauaaauuauugucagcucaucugucuuauuagauugagccacaugauauugccauguuguugcuccaauacuggcaauuucaugugauucaaccucaucugcuguuuagagaaaggaaguuucacugcuaugaaaaacuaaaccauuucuguggcugagcuaugcugaccagaacagaguuaucucaaauucaucuacucaaaagcugcauauuuuaaacugaaaugcacugagcgucuuccuuaucccuacuuuccacauuucuaagacaagauaaauucagcaacauucuuuagaaaacauuccaucuccaacagcaacuaucagucaaacaacagggaaucauugugcauuuacucuguauaaagcauaagaaggauaaaaaaaauaaacacaacaucuuuucugucccuaaggaguaacugacguagcugaagaaagaagaggggaaaaacaccacaaaaaauguaaagaaugaagcaacaauauaaggaaugucacaagacagaccaugaucauuugcuaaaugaguggaauggaaaauaaguacagugaguugagaggcaggagcaaucaccuagaaucugaugugagccacuuucuaucuaauuuagcucaucaaucaccucacccucccaccuacuuacugugggaaguuaucacagaaaaugaaaaucuccucucugccuacucauaacucccagaugucgguuccagaaauguaugcccagcaggucucagaccacucccacucauuuauuggguccaucucaggaaaagaugggggaauggggacauuuacacuggaugcuuuucuuucucuaggugaagucagcaugacacaggaaaaugggagaaaucuaaaugugugugccucaauauaaacuguagccaccugguagccuagcacuuuuccugacuucaugacuccuuuuaauucugaauuucaaccuuucugagcaguugccaauaguaaaaaaaaugacauaaauuuaagcauacuacaaauaccuguuuagauacaaaugaggucacauuaacaccucacagccccccuauuuuagcaauucccugcgugcucucacucacacaaucucccaugguacccugcucuuccucucugcugagggccucccucuugaggacaaugccuagccauggacccugucucuaguguccuccuggagaaggguguuuccuuucccagggggucauagccaagggcucugcaaggcagcagcagcccuggcugccccaguacuucuggcaugaaagccaugcugggauguuccaugcagaaaugcagauaauacccuucugcccaacacugucacccucuacugccuggguugaauaaaagugaaaguuugcuaaggucccaaggcaacaucucugaccaggccuuuucuccuucuccccuuucuuccuuccuuuuuuuuuuuuuuuucuuuuuuuuuuuugacagagucucacucugucacccaggcuggagugcaguagcgugaucuuagcucacugcaaucuccaccucccagguucaagcaauucuccugccucagccucccgaguagcugggacuacaggugcacgccaccacuaccagcuaauuuuuuuaaaauauauuuucguagagaugggguuucacuguguugcccaggcuggucucgaacuccugagcucaggcaauccacccgccucggccucccaaagugcuaggauuacaggcguaagccacggugcccagccacuucuuuccuuuuuugagacagggucuugcucuguugccaguacuggaguacagugauaugaucauagcacacuguagcuucaaacuccugggcucuggugagccucccuucucagucuccugaguagcugggacuacagguguacaccaccaugucuggcuauuuuuuuuuuaagagauggggucuugccauguuacccaggcuggucucaaacuccuggacucaagugauucucccaccuuggccucccaaaaugcugggaugaaagccauugugcucagcccucacccuccacuucuaauccauaagaaagacgugucaauuuuaccuacaaaacaucccucgaguccuccccuucacuccaucucggcagauacccuguugguugcuuauuaauuaccaucaccucuuaccugggccucuaccacagccuccuaauguccugcuuccacucuugcccuuccaguucauucugcacaaagcagcaagagggaucuuguaaaaagacuaaauggaucaugucuuccuagacuuaaaacccuucagugcuuucccugcuacacucagaauaaagucaaagcccuuggcccuggccuacggggccuuccaggacuuggccccagccuugcucuacaggagacuguccagugaagguuauaaacucaaaguccacugcuucccaugagaagccugggucagaauucugggucuucuguuuaccaugugaacuguggagcuuugggccagcuucuuagcuucccugcacuucaguuccuacacauggaaaguuacauaucucacuggauuauuagaaauaaagugagauacaacguauacagugcuaggaauauugccagucaauaguaaaugcuucauaaauauaaucagccuggucugcuuucauuucuucgaacacaucuuuuccacuucagggccuuccauuuguuguccuuucugcucagaaugcucucccuccuccccguuuguacagaaaggccuucccugacuaacagaucucaauggggacucucccugucucacucuguuauucucuguugcaacucuucauuuccuucguaucacuuguauccugugauaaacugccauuauuuucuuucuuuggcuauucacugcuuauugucuuucccuuccaugagacuuuaaucuuuauaaguauuaccauugaauuccaguacuagaacaucauuuugacucagggauccuucaagagcuuccaucacuauuuaaauuuuuacagugaggaaguggaugaaucuuacuaaucucucaucucauggucuauuuccauuuggcuuuuacuuaaaggguccucuuucuguggaggucagaccaacucucuggggcaggguuggacaaaaaacaccaugauugacucagucuccccaacuccccugaaaguacauauaagcuucuuuucaaggacuccuugccuucuuggacagauauuuaacuaaguaaccucugauggcuccuuuuaucucaauccgauuuaccuucucucuuguguguguguguguguguguguguguguaaugcacacacuuacuaagauguuggcuuagcccagaguccucagaaagcacagccugaggcaaaaucuuacauaauccuaauuuauuggaaugugccauccagggaaggaagagggagagaagaaggaaaugaggaagggacggagaacaagcagauagauacaaggguauauuucugagcuggcugccacuguuacucagcacaacugaugucagaucuccaggacccaucuucugaggcaggcugugugaaugacagcuccuuuggacaauaagucaggguaagaaggagaugaauuccagguugcacauacgugggagcugagccaucuagugcaucacaggccucaguggcaacaugggagcccugggggagaugacaggcugacuugagagaaugggagcagucacuguaacagccuuuggcccuuggcagcaacaaugucagcagcauuagugaccuggcucuguaaccaugagagcagcacaaaccaggcaagcauacagaucuggaggauggccuaaacuaagucucguacugauggguaggaaggugaugacuguccaaauguaguguuugaggauggcaagcaugggacauauaggcucaccacuccugaagcuugcacucauggcagacaucuuuguacuuuguacuuugucuggcugagcccaaguacagccucaaaacacuucuucauacagagcuguaaucagccacuacaucacaacaguaaugcaaaugaugacagcauaagauaaaaaaaauuguaauucacaccugaaaugauaaagacaaaaacaguauaaagcuaaugaaaaugaugaauuucagaaagugaaaaauccaccaaagggaagcccuuccagagcaucuuccaucuaacccagcuccauagcccagaaaucagcgucuguggaucuucuugauauugcaggaaaagagaaugccauucaaaugacagcuuuuccagaacuggaauucuauguacaaccuagcaucacagcucucaucauucuguauuugaugacaguuuuguggguuucauaucccaaaaugauaccugccuaauucacagagcaaaguuuauuucauuuaaagcaguucugaucaggggaaaauguuucauugugguguuauaaggaauugaucugcuaauguucuucuuaagcuuugacauuaauuacagagaagaugcaucaucauuucuacugacccuucauuccacccccaccuaccaauacacccacccaaauguucagagcuuuguauaugugucuuaauaaucugucauccaauacuuggcaagugaaaugugcuaucauaugguaccaagaauguucgcagcucuggcuaaaacuucacuggaucugauauuuaagccuuaguggugaucuaacauaggcagagaacugugcuaagaacugauagaugcagaagugaauaaaacacugccccuuucccuuagaguaguaaguuccaaacuaaaggauagaacccaauagugggucuugacaucaacuuaggaaauuguaacgagaaauuuuaaaagcuacaauagaauugaauauaguagaacauaucucaaauaauaauaaaggguauaguuucaugaaggggugugugugugugugugugugugugugugugcauauacauguauuucuuucuguaggugaucuaacaguuugaaagccuaaguuuuccaaaggugaaaaccaucauucaaacacauaaugauaaaaauuuacguauagagaaucccuggagucaugcagaaucaacauucaguaugcauacaggauggcagagauuaguacuaagggggccugauauucaggcaauggugagaaucuagaguuugccuucuaaagcccacauuccucauauuacucucugcucagaaaccacuguaugugcccccaucacuacagaacguaauccaagcucaugaguauggcauugaaggaccuccaagcuuauuucccacuacucuucaccuccucccacaccuucuugaugccauacuguugcuauaaucauuuuugccauuuugaauguguucuguguuugaauacguucuguguuuuuuuacuucuggacccuugcacaaacucuuccuucaugcuggaaugucuuuccuucccuaucugaccacuaaaguaauauacuuacaguggucagccuuuguuuugucucuccagcaagcuauccgauccuccuucugguaauaauauuuucuuuccuuugagaaacucccugaaauuucauggguucuguggucaaucauaaugccccacugccuauggccacaggagaagcucugugacaaacauacagugauugguugaaaaaaacaagcaugugaccuauggcagaacauuauacucuaucucauguacagacggguacaauuccuucucugaauucuaacagcagcccucaaaauacagugagcauaauaauuaccuggaagacuugcuaaaccacagauugguuccacccccagaguuucugauuggauaaauguaaauuauggccugagauuuugcauuucaaauaaauucccaggugcguuagcuuccuccuguugcuguaacaaauuaccacaaacuuaguggcuuaaaacaacauaaauuuaucuucuuacaguucugguggucagaagcccaaaacaggucaagguguugacagggcuguuccuucuggaggcuccaggguagaauccauuuuuuugguucucucagcuucuagagguugccugcauuccuuggcucauggcccuucucuugcaucacuccaaccucuuacugcuguccucagaacuccuacuacuaacgcuuaccuccugucucccccuuauaacgacccuugugguuauauuaggccuacugagauaauguagaauaaucucucauucucaacccccuuaacuugaucauaucugugaagucccuuuugccauaagagguaacuuaggccugaguccuuucaccugaggauuaggauguggacaacuuugaggggucauuauucagucuaccacaccaagugaugcugauccugauaguccaggguccacacuuugaaaaccaaugaauuacuaucacuaucaaagccagccuaguauuuuauucuuuagucugucugccucccacuagauuaagagguugcagaggcuggaauagaucuuggccuuuuuaaaaauugcuuuaauucuauguacauucuccuuucugaauacugguaaauacaucuuucaguuaaacuggaggaauagguaaacagucugaaaugcugauagaaaagaaaacugugaagauaaaaccccaaaguggagagguauugguuaauaggauuaucuggauuccuuacugccaacaguaaaucuuucuaccuaauuaugcucccaaauuucaaauuucucuauugcugacaacuaucgccauuuugaugccccccaguuauuucucauuuuucucaaaccaaauuuguguagcuggccagccuauccugaguucuaccucaugggcucuggaugucagagauagcuucaccacacacucaagaacucaagccagaaauuucaccagcaucauaggaauagccgcugacaguuauucccccacugauaugugcuuggcaacguucugaguucucugugggcacuuacucauuaauucuuaccauucuugucuuguccauuuaaaaaauaucucccauagugcuuuacauguagcauacauacacuuuauaagucuacauugcuugguucauucaguagaccauaagcuccuugagggaagggaugggucuuauucaucaucuuguugccaggaugaaacuaugucacuuguaccucauauuacauuugcaguaaaauguuagagagaugagaccauaugugagcaguuggaauuaagucagucaaguugaaguggggucuaacaucaaauugccuugaaaagcaggcagaacuuaaaacaugauauaauaggcaucucagagcuagugcaaaauccuaagcaagagcauaaagcuaauguugggagcaggccccccaaaaucuggccauaaacuggccccaaaacuggccauaaacaaaaucucugcagcacuguaacauguucauaauggcccuaacacccaagcuggaagguuguggguuuagggaaugagggcaaggaacaccuggccugcccaggguggaaaaucacuuaaaggcauucuuaagccaugaacaauagcaugagcaaucugugccuuaaggacauacuccugcugcaguuaacuagcccaaccuauuccuuuaauucggcccauaagagauacuuuuaguuaauuuaguaucuauagaaacaaugcuaaugacugguuugcuguuaauaaauauguggauaaaucucuguuuggggcucucagcucugaaggcugugagaccccugauuucccacuucacaccucuauauuucugugugugugucuuuaauuccucuagcacugcuggguuagggucucccugaccaagcuggucuuggcaagcuaaaaucauuuuauagagccaaaucaguaaguccccaguuuagcuuagaaacaaucagacaaggaccaaaggcuuucuaggagguaugauucuuugaagagacaagggagauugaaauugaguccauaaaauucucuuccaucuuccugauucuagguguugagguaucuguccuuuguucuuggugauuuacuauaucugauugcaacuuagaauucaaacauuaggcucugccuucuuuuccauccggauucuaaaaucaauaucuuuacuaugacgcuuauucccaggauuaauuuaugaaauuguaugaugugcuuugaagacugaaggcuucuuagagagagagggaaugucaccuuguacuaucaaaccaguauauuaaacaguuacugcuuuaaaaaucagauguuuguugguugagaugcuauuaaaucuuaaccuacaaaaccagcacaugaucauuucaaugguacaaaggcaaacuaaauauagcagaugacaauugcuacaacauaagagaaaaaauguaauguaauauuuuaaccauuuaguuauaugccacaugaaaauaaauucuuauaaagaauaaguuuuagcacuugccccauuugugugauaggguaccuaccaugugccaagggcugugcaauacugugaugaacaaaagaaucccuacgugauggagccaucaaucuaguggacaggauggauauuuaauaauuaugaauaauuacuacauaaucacaggacagaauaaaaugaaggauuuccaagagcaaugugaacauagaaccaaauauggagcauaucugaggaaacaagaggcuguccagaggagaccauauuccagcugagauuuuaagggcaaaugagagcugacgagcagcacagaaggggaaagaaucuuccagcauuugaucggcaugauacauaaaaggagaguagcagggcaugggcugggaaccuggaggccuguucaagacuguucagccuugacaagguaaagggcaagaggugauauauuuguuugagcugaaucucucagcauuuugcaucucaagucuccuaguuuuaaacaacuuucuagagaggaggcugcucuuuauagaacugaguauauggaagacagccuugagaaccuuaaauucaaugcacuguguagaauauaaccaugauucuaaacgauacuuguuaaaaggcuuuuuuuuuuuuuucaaauggccauggcuuuguuaaaaaaaaaaaaaaaaaaaaaaaaaaaaacaagauaauuugguaacugaguagagacaggacagguuuuucuacugaagucuuugguuuauggauacaccuauaguguuggaaggaagcauuuguauuuuaagguaucuuuccuagguuuguugcuaaguucauggacagcauacccccaugaagaugacaacacaguucuucuaagacauuauuuauuuauguauuuauuuuuuaggcagagucuugcugaagugccauaggagugaucacgguucacugcagccucagccuccuuggaucaagugauucuccugucgcagccucucaaguaucugagaccacagguguguaccaccacacuuggcuaaauuuuuuuucuuuuuuuuuuggagagacaggggucuugcuuuguugcucagucugguccugaacuccuggccucaagugauccucccaccucagccucugaaagucuuuuaagauaucauauuacggaaacuuuaauuaagcucuugcuacauauaagacacuuugcuuaggauucaauguauaucuuucauuuaaccuucacaacaacucuaggagguaggcacaauuauuauucugcuuaucaacguugucaacugaaguuagaaagguuaguaaaucuuugaaguucacacagcaagucagcagugaggcuguuaaucccuccccacuguuaaccaggaaaacucuacuucuguuaaauucugaucauuuuuugcuaaagggguuagcagugcuuuugacucuuuuauguuucccuuugauuuaccaucuaaugguuauugcuacaguguuuaauaagcaaugcauuaucccugggcaguggaaguaauaucauuacucagagacgguaaacagaaguuugcaucugugcacugccuggagguggaagcaucaauaaaagccugagguggaaggaagagaugaaugugcaggcuugaaucagaggcaagggacgcaauuugaugugggguaauaagaaauucugccuaggcuagcaaagaaacacaauccuuuaccacuccuagccucaacugcacuguuagauuucuccuaacacugcuuuucuuugcuccacaggguacaacagucccagccccgcccaucacacccacaacccuuauguacgcccaagggugccuggcaugcaagauucuaagagcaauggguugcaagucccuuugacaaaguuugccuggggaccaggaaauuuaagucuacauccgaggaccaaagauauuuaaauuaaaaacuuccuaccaaauccaacagcagcuaagagaguggcgaaugcgauauuacagaaauuggucugcagccuccaaaugccaaaguggcagcuuguuauuuaugauaagauaaggagcagcucguuacuaaagauauccaugucaaccccacgcauugagcagaacaaaggaucguuaaugauuccugggcuugucauguuagaaugggguggcgaugauaaaagagcaucuauauaugcuuuccuugugacauuucuuauuuuuaaacuccaauauaaaaauauguguuaauuguuaugauuugugucacaugcuaugcuccagggcuggacaggaaacaguguccccauucuaguauuuuuauaauaagcaauaaacaaacaauaaacaaugacaacaagaagagaaccacuuuccaggaucauaugauuaguucugacauuugggaaauugcuucauugccagaagucaauucccgcgauugcgagcaucuuccacacauaaaauuaauaaugugcccagcuccccuccugccuucauuuuauuauaugaaauuuggaccucccacagcauguaaagucacauuuuuaaaauaaaacuuucuuccuuuauaaaauauauaaggaaaugucuuauagaguuacacagaccuuugaaaacauacauuuuuccauuccuuuguuuauucaggcaauacccguuugaguaccuacuaagcgccagguacuuuucuagagugaauaugacaaugagggaaaacagacaauuauuaauauuccaaaugaacaaaauaaguuugguaguaguaaguguugggaaaaaaauaaaguaagucaacgugauagagagacagguccuuccuaauggggacggggguggaggggcggucagagagggacucucuaggaaggugacauuuaagcaacaaguugaauuacaagaaggaaucagccauaaaaagaucuggagaggagcauuccuggcagaaggaauggcaaaugcaaaggcccagugccggggacaagccgggcuuguucaagaacagaugaaguucaaugacccgagggcauugaggagggcccaguggaugcgggaugaggucagggagugggggcaggagcagaucagguggggccuugcaggccuaaugaagacuuaguauuuuauauuaaugacaaggacagccaccgaagguucaaaucucggaaaugauagauucuauuugauauuuuaaaaauuacagcugucugggcgucaugggggaagaaaauggacaaaauuguguuccacucaaagauagcauuucccuuacagaucccaaggcccugucuuugucaguacggguagugauuaagaacauagugcuagucagaaaaccuagguuugaauccuugcucugccaucaauaugccaugugaucuuagggacuccaucaaacuuacuaaagucuucacgugaaaacuauaauaauaacucuucccagagucuuggugaaaauuaaaugagauauaacacauaauacagaguaguguuagugccuaguacuugauacauauaauaauagcuguuguuguuauuauuauuauuauuauuaaaauuaggaagaagaaagagaagcauaagguaaagcacucagcaacuacucugaucauucaggugagaauacagacuuaugggagacaggauggagguuuccaucagcauagagcaucucugugcuccaggcccuuggacaaaugucaccucuuuaauguccugaagacauuagguagaaucuagaccaaaacagaauucuggaaaaacuggaaauaauucagaugcucaccaacaggaacaugaaucuugauaucauggaugcaacucacaaauauguugauugaggaaagcuagacaggagagacuacaugcuguguaauuccauuuagaugaaguucaagaacaggugaaacuaacugcuguugguagauaucaaagcagugguaacauuauaagggaccguauuuggaaaacauuuggaaagagcacaagggagccugccagggugcugaaaagugcucuauaacuugaucuagauggcaguuacaugauggauauacauauguaaaaauaucaucaaaccauauacuuaaauuagcauacuuuauaaacuuuuacugauguauguguuauaccuuaauuuaaaaaaauauguauuucaggggaucagaaagucagcuacauaaauaaacaaauggugacugcucucuucaggaaaacgaugaccucaggacuacuuaggagccaguuaauuuccaaagcuacuucccguuucuaaguuaaacagcucugcacauaaugucagccacagcaauggcaaagaaccgcagggcaggugaugaaaaagcucggcuuagcagcaggacaauggggaaguguguuaaacugggaccaugaccaacuucccaaaacccucucuggugauugccagugccugcuuaaugccuuaccuuucaauugugcugaauuugucugcauuaaaugaaaguucgagggggcaggaucacuucuuuuuuguuuuagaaauauagcucaaguaccugugugcucuauaaagaauaaaaauaauaacaggaggccguggaacaacugaaguauggaacauguauuuagaaaguacuuucuggcauuucaauaaaggaaauucagagggcuuccagcauaagaacaggauccgaauggauucauuuuccugauagagugacccaacccacaaugcaaagucauuaagucccaucgcguggcauuaaaaaaugcuuuuaagcuaagaucagccgaaaaugugcccagggcagauuuuuauggccauaucaucacaaccugaaauucaaauuggugaacuagcuagaaauacaugcucacuagaaugguucagaguuuuucugcaucuaucucagugaaaaauguuagcaaaggaaaccuuauuuuccuggaaaaacacuaucaaauaauaaaacaauucaggaccaguuuucacaaaguaauaacaggccauacauaauugauugccuuuagucuucgucucuggguauuacaaaucacaguuacuagcgcaucgaacaagcuuucauuccggauucagacuguccgucuuggcacugccugaaacggcuugagcaccuuuauugcacacuuuacugcauuguucuucaguugcuucuucagugaaguucugcuauacccaacaauguuauacccuccuucuuucuguguguuuacugacugucccugaugguaggcaaaaaguaacuucuagaagggaacugauuuagacuuaugaucucaccucaggcuugcaaggcaauacacaccacccagggagauaaaacauauuccuaugaaaucauauccuaacucucuccauuaaaacucuagaacugcacuaaaagcaggaaagauauacuaaaauuauaccaauucuuuggcuuaccaaacaucaggcagcugcauccauaaaaaaaaggaauaaauaauucauuccaaaacucuuuuuugcacaucucaaggcucauaacauugguuuguaggaggaggucugaacgagggccuagaaauucugaguuaugccuuggcuauaacaggaaccugaucccucuaucuuacucucccuuuguauguacggcuaaugauauacaccugggcugccagugacaguagccaugagccacgugccuauugagcaccugaaaugugaguagucugaaaugagaugugcugugaguauaaaauacacacaggauuucagagauuuacuaccaaaagaagaauauaaaauaugauucuuuaauaauguucaaauauuaauuacaugcuguacaugccgaaaugauaauauuuuaaagauauuggguuaaauaaaauauacuauuuaaauuuauguuacuucuuccauugaacuuuuuuaaugugguuauuaaacauuuuuuuaaguuauguauguggcucacauguauuucauuuggaugacaaugaucuagauauucugaauugcuaugaaagcuaagauucucuccuuguggaaauggguaauuacaagccuaacaguuacgcaugucuuaaaggauggagaacgugggggaagaggaagcaaucaagucaccaaguguauuacauauuuaguuauacuucaauuuuccuaagcacauuacaaaaagaauggaaagaaggaagaaaaacaugcacaguccuucacccuccugagacagaaaugagacugaaaauggacuuugaaaucaaaccauuucagauuagaauucugccucuaaccucaguuucuccauuuguaaaauggaagauaagcauacucaccuuuuagagaauuaaauaagaucaugccgaucaaguacuuaaagcaacauugggcacgguugggaauaaagaucuuggcaccggagauguugaaccuggagcggaagggacauugagaccaaaauguccauugggcaaugggaaucugagccuggagaccaauaaaaagauggauagaugcaaguguccuagcaagcaagccgcacaggugagaaaacacuaaaaccaggaagggagcuggugucacauaagcagcucacacuucauggaaacaucacagcugcagcugagcuccagccagucguucccaugaaggaauaauaaugguacaguguugccagguuuuccaauuuucuaagagaaucuagaaauccagcuuuuuaaauguuuagaaauuuuaaaaaauuuaguuuaauuuaaaaagcacucauuauuccagagagaacccacgggaaaauaguuuaauaccagccaggcgcgguggcucacgccuguaaucccagcacuuugggaggccgaggcgggcggaucacgaggucaggagaucgagaccauccuggcuaacacggugaaacccugucucuacuaagaaauagaaaaaauuagccgggcgugguggcaggcgccugagucccagcuacucgggaggcugaggcaugagaauggcgugaacccgggaggcggagcuugcagugagccgagaucgugccacugcacuccagccugggggacagagcgagacucugucucaaaauaauaauaauaauaauaauaguuuaauaacucugcugcugccucaaaggucaacaagguaacuuguuagauuucuaccauaugaaaguuaacggggaucucagaugaaauucccacaagcccccaaacaguugagcugccaaagaugaagagggagauuuaccucuuccuccucccagcucuucaugcuguaggaacacaguugcugcgacuacaggugucccagcggucuuucccucuccccagaccgugaccuggauguuaugcagaauguuucaaagagagcugcaaaagcacaaggacuuuuuacaggagacacgugacauaaaccaaggugcuacuccggcuauuauccauugcccgcuuuaggucucucuggaauauugucuguuuccauuucaggcacucucagcuacuacccauuuugguuaauaaauuaucauauuguguaaauguauacaaucuguaagccuggaagaacugucuggaaaaaggauuuuuaaaauaucacacuaaaaaaauaaauacuaguggccucucuguaucuauuguaaggaguaaaaggauuuacaccugaaaaauuaaaauuacaguagcuacucuuuccucaagugguucuuagcaaaugcauuuuaaagaggaugacuuuccagugaacacuuuaauuuuaauuuaaccuucccagaaaaugaagugcuuuguguagauucuuuugguuuuauuuaaggcauaaaaauuaguucugaacugugauaauugugggcuuaggaauguaaucauuccaagcaccacuucucacuugcuuauaagcccuacaggucuugaguugcuguuuauugcuaauucgaaguuggcaaguuauuuaacugugaagcugaacuugaagucagagugugacgagauggugggagguagauuguuuuguuuugcuuucaacagguuauccaaagcccggaugcaaaaugcggugcaagacacgguucuagauaugugcuccucuaacucuuaaucuuaauuaaaaugggaugaugaaauguucuaaagguggaauaaaauauuacauuaaucuauaacucuaucuugucaaaccaaccacagauaggauacagguuccuaucauccacccuuaugauuuuguucuuaauuguggcauuuuguuguugcugugaggacucaaccuaaauacuauugcuucuauuugauuguuuaaaggaaaauaauguaacaagcuuuggucaugaaaaaucguaauguccauaauacaguagaugcagcauuucuaaacauuuuagaauuacguguuugaauccacgaccacauacucacauacauauaaucaacauuaaccaaagggucauauggcgauuuuuuuccuuuauaauaaagagauccucugaaacauuuuaagauaaaugaauuccugcuuaaguaugggugcauuugaagugagaaugcuuugaauaaaguuaucauuuucacacaccacuaugccugaaaguuaugagcauucagacagaaaucauugaagaaaacuuaauaaaaauauguuuggcauaugccguauuuagugugaucaauaguguuuaguaauucaagaaaugaauuaaaauuucacccucauuuugccacuccuaaauuuccauuugaaaaacaauaagagaaauuauuaacucccugaauauuucuaaugggcuucucagcauuauugaguaaaacuaacuccacauugcaggccugugugcugacucagguuuccaagguuucucugggaacucuuuggucuguuguugcuguucuuuauucuuuauugaaaggcauuuccuagugcauuuccuaauuuuaggcaccuggcuagacuuuggggaugaaacaauacauguggcagaaucccugcccuugggugccuuacccucuccuucauacagcaucuaauggauccaaaaccagggagaaggugcaccucacagccacaggcugcaacagagaaagguaaagugcugguacuaccugguuuguguuugucugucugucucuuucuuuucuucuuuuuaguaggugucaauauuuuacauaaagaucuaaauuucugacuucucuuaaaaaaaaaaucagaagaucuuagcauacuggaccagaaagacuacuuggcaacaucuggcugaagcuguggggugggaguguugagggggguguggauggugcacuuuuccuagucaucucuggaucaaaacuggcucuaguuugccaguguucccaccacucccuauaguuuuauacucacucauauccauuaccugcuuuguccucguauuacaguauuuacauuacugaccugcaagaaguaacuagcagucagaaagccugauacuagcccuuggucugcugcuuauuaaauauaugaccuagcaugaauucgugaauugcauaaugccuuggagccucaguuuucucuuaaaaaagauuaaagacaaaacaaaacaaaacacgccuucucuggcacugcaauugcaaaucuccaaaaagaaaucuauggagggguuuccaaaccuggaaagcauuaggccaaggaauaauauuauuguaauuuuguuuucagaagaaauaucuagaaaaucagaaauaacagccuauaucugauuauaccuauaaagaucacaaagcacucucaacugaauuaaaucucaugugaccucugagauaaauaucacuuuagccauuuugaugaugaagaaacucaggcugaaaaggaccaagggauuugccccaacaccaaaugcugacauuuuuaaaaagucaacuuucaagauaguucccauaauuuuaacaccuaugaagacacuauuaacaacugacaucacaugaugaaacaauaaccaguaagaugagccaucacuuuccaaggauauacucuggauagagaguagcagcuucuuugagcuuucguuuguuugcuuguuauucaagagcaacauuuuuuaaaggguauuacauguuguaauauaaaggaaauauuuuaaguaaauauuuguaauagguacucauuuggacuucuaauaaacuaguaggguuaaagcuuuugaggacgcacuuucucauuaaauguuugucaacauuacauuauuuucuuagagauugucaucagcaaguaacuucuaugagaaacaaauguccuuaauuuuauuaaagucuacuuuuauuaauccccucccuaccccuaauugagcuaauuugaaccauagugccauucagaaagaaauaugagaauucaucuggcucauugucacauacauuuuuuccacaaagaaccuaauagaguuaaaagcuugauuuaaacaugaauuaaagguuuaucauuuaccuuuaggaacaaacucuccauaggaauaguaagcucuuuuaaugcauuuacauuuuauuaggcuuacagacauucaauuuauuggugucuuuagguacacauuuacugcauacagucaaauauauaacaccuucauaguaacuuuuuuuaaaaagagaagguagacuuauuuaaguuuuuucaugguucaccauaauucagguagcgaagucuaaaugaacaagcagagggcagaugagugacuuuaagugcacaggagaucuccacauaguaauuuagagacaccgugggaaauaaauaaggagauacgugaaagaguaaccagcucuuggcaggacauguauaugacugaguaacaugcaaacuacuguuuauacauugcaaucagcuggcagccaagcaaaaagcuuauagaugaguaaggacacugccacagccauguuuuuguucugaaccuccugauuaaacaaauaaacucagacuagagagccacauggagaauacaaugcuagggauacaauacaauagaauacaauacacuuagcaugcagggucuaaauauuaacagcaacugcagaagauaucacugcagauuugaguaaacuuucugaaacaauaaucuacaaaaccagcuguguuuggugauggcucuucauaaaaacaaacaguugcaagaaaucuaacaggauuccaagcuacaguucuuagcuuauagauuucaaacacuggagagaaaugcauaacaucccagcuuuuuauucuccaaagugaagauuuugaaagcaaauaggauuacuaucuaguauggucaucauaacauuuuuuaaaaagacauuauuauucuggaauaggaaguauaugaucuccuuacaaugaacaauuccauguagaaaaagauagaauaucugcaaagcacuuuugagguagguuaagguccugggaaacagauuccucaugcauuuagcuugaagaaagguuuaaaaggaauucuuuagggaucaacaccugcagaaggaaagggaaauagaggaggaagcaggugagcugaaggagaagucccaaugguagcuuguggggaauaaugaagauggggugccuuagcgcauucuggcaguuguaaaaaauaucauaaacaacagaaauuuauuuaugauaguucuggagacugggaagcccaucaagguaccaucagauuugaugucuggugagggcccacuucugguucacagaugauggcuucugucuguccucacacaguggagggacuagcaagcucccuggggccucuuuuguauaggcacuaaucccauccaugaggguggaaccaucacaacuuaaucaccucccaaaggccccacuuugaggguuaggauuucaacauagaaauguuggggguacacaaacauugagaccauagcauggaauguccugagugagggugagaagggaggggccuuuuuacccuccagugaucagucacuggaagcaggccaccucaugaaggagguaugccuuugggagaggguugucuaugggcagcaccacagcaaguagggugauaagcccuuagcuccuaaaggaggaccugagcagugcauuacagaguccaugcgacacuucuguuccaggcuagauaaaauauuuuuaagcucuggcuguaaggacagucaccuuuaagcuuuuaaucuuagacaaccaucauaauacaagggcuauuugagacacaaugguaagacauuaaaaggucaaagcauauaaugcucuuacuguccaucagauaacaucuccaggaaaaucaguccugcugcucuuugauaccaaauggcuucuuagguaucagaucugcuggcuuguucugaaaaaagguagagugaacucauuuuucucuacuccuucccucuaaauacccuggaaguuauucaacgggaagugauaaagaacucuaaaaccuggaaaaaaaaggagauagaaacugacuaggggccuuagcacuugagggacaacaaccuggugaguuccgugggguuuccuuuuuauuuccaauauacccuaugccggguuccagagacggcugcaaccccaaaacagcaacagggagagccugcucccucuggucaaaugaccaguaaagaaguccaguagagaccuaguggggaagccccagccccagccccuacucuaccacuagggcagcgaugggcagugaggcccuaggccaucccaaccauauaucugacaaagaauuacuaucuacaguauauaaauaauucucaaagcucaacagaaaaaaaaaacaauaaacaguuagaaaaugggcagaaaauaugaagagacagcucaccaaagagcauauacagguaguaagcacacaaaaaaauauucgacaucauuagccauaagagaaaugcaauuuaaaaccacaaaaauauuguuacauaucuaucagaauggcuaaaauaaaaaagcagugauaacaucaaaugcuggugaggaugcagagacacuagaucacucagacauugcugaugggaauguaaaaugguacagcuauucuagaaaauaguucagcuguucauuuuaaaacaaaaaauaaauuugcuauauuacccagaaguggcacucucgggcacuugucacagagaaacgaaaacucauauucacacagaaauuuaaacaugaauguucguagcagcuuuauuuguaauacccaagaaaugaaaauuauccaaauauccuucaauggauaauggucaaacaaacugugauauaacauaacacggaauauuucuuagcaauacaaaggaaugaacuauugauacacaccuggaugaauaucaaggaaauuaugcuaaguaaaaauuaaagccaaucucaagaagauacauacuauaugauuacuuuaauauagcauucaugaaauaugauaaucauagagaucaagaauagaguagugguggcuaguuguucagaaugggguagggaauagguguugacucuacagggguagcaugagggagucucugaugaugggacagugaaguaucuugauagugguugugguuucaugaagcuacacuuaugauaaaauugcguagagcuacacaugcacacauauacacacacaaaugaguaccugcauaacuggucaaucuaaauaagcucuauggauaugcauuguacuaaugccaauuucuugguuuuuauauuguccucuaguuaggcaagauauuaacauuggggaaaacuggaaaaaggguacacaggcccucccucuacauuucuuuguuuguuucuguguaucuacuguuauuucaaauuuuaaaauuuacuuuaauugacaaauaauacuuguauauauuuagggggugcaaugugauguuuugauauaugcauacaauguagaaugauuaaaucaagguaauuaacauaucuaucaucucauaauuuauuuguggugagacauuugaaauuuauacucagcaauuuuaaaauaugugauacauuuuuauuuacuauagucacaaugcugugcaauagaucucaaaaacuuauuccuccugacuaacugcaaauuuguacccugguuuuugcuuuuauuuuugagacaaggucuugcucugucacacaagcuggagugcaguggcccaagcacaguuuacugcagcccaaucuccuggguucaagcaguucucccaccucagccucccgaguagcugggacuacacgcaugugccaacaugccaggccagucuuuuacuuuuuguagagacagguucucacuauguugcccuagcugguuucaaacuccugggcucaagugauccucccaccucggccucccaaagugcugugagccacaggcaugagccacaggcauuagccacugcaccuggccacuuuauacccuuugaucaacaucuccccauucccucucccuaucccccagccucuagugaccaccauuccacucacuacuucuaugacaaaaauuaaaguuuguuucuuuuuuuuuuaauuaggcccguugauugcucaggguaagaaaucguaauaaaauucuagguauuucuuccuuugcaaugugccagcaucugcaucuaucacuggaaaguggauugcaaacccaucucagaugcccacaccuccauuaaccucuccuacucccggcccaauuuccugcuccauaccccuucugauaguugcuugccuggaaucccuucaauggcuuagcaaacucuauggcaguuccuggguugcacuucaacacuuucuugacccuggcccaccucuguuguaaucccuuucucaaggucuggugcaauuaagaaugcugcugaaaggguuuuuguuguaguucgugccuaucaaacacagacuauucugauuacuuguggcauuuugcagugauauaaaauuaaaacuaaagcacaggagaagaaucuuagguuuuuauauaaauaauuuauugucuauaaauucucccaagaggaaucuaugucagucuacagaaagugucucuccauugagacccauaccauuugccuguaaauucagcacacugauagccauuugcaaucugcaaaagaaaagccaucuaucuaaaggggcacgccacacuguuauuccuuuguaauauuaagaaauuuauccuaauuuaaaagauaacugaauucuuauucuuuuacaaauuagacuuuaaaacacagccacugaauugaccaagcacuaccaagcuuuuauccuacuuuuauuuaaauguacugaaacauuagugaugaaagcuuucauuuaaagaauucugaugauucuaauauucacuuauaauguccauuuagcuaccacauuguguuuaugccccuuaaaagcugaagcuaugacugcucuaguacugaguucuccagugcuuaucauuaauuaaaagguaaaacacgauuaccaggguaucugcaaucaagcuuucaauguaagaaauaucaauauccaguacuugagaacauuuuggaaccaauuuuaauagguaaaaaaguccaaagagaagaaaaaauguucuuuauuauuucaaauuaaaaccagaucaguauaucuuacugaaaaguugcaauugcccaugccuuccaggcaucugccuaguuuuucucuuauagcagaugcuaaagaagagaaaucuggcauguccauuucuguaauauuuacagauauaacacaucagcaauacaucaguuugguuuuuuauggaagcuaaccucaagaagcaaaacaugcucugugaguguacuuguguacuuacuucagaucauccuuaugcuugggggugggcagacagauuauuaaauaaugacuguacugagugucuacuaagcacagugguguacuuguguugagggcaccgagacgaauagaagaaucccuacccuaaaggagugcaaaaucuaguaucggagccacaugaauauugugcaagugaaagaaggugagcacagauuauguccauggugaaacaaaaguucugaauaucuguugagacugauaaaaauagauccugcuaauguuaauggcaaaaauggccugagugucuuuagcuccccaaucaacucuaccaguauccacccaagccaccccaaauaaaguguuugcccaguguacauaugcaguuucaaaaaaguugcccgguuucuccucuucuguauugguaggaauugagcaggacacagauggcccacugaaauuagaauaauuugaggaagguuuaauaaagggacuauuuauaaaacuuuggguaguauguaggaaaaccauaagggacauucaacacucuggaacuguuaucaucacacgacauaaagggagaaggggaaggagcacugaccagaacuuggaaagagaaagucugguggagaggucaaccucgagaagagcuaucugcuuugauagaggaacauagccagcucaaagggaccccacagggagugauccaaggcaacuaauaccuugaccucacucuccuuccauuuuccagucuccugcuuggguccccccauuggccagaaggcaaaaaaacccacugaugaagcauacaggucagcagguggaaaaggauagcaucccugauuccugguauuaagaaaaucaaucagccgccaaccgcagagaacugcugugaaaauuaaaugauguaaagcacauuaugcacucaaacauaccucaaacauaguaaguaaaugagaaauguaaguuguuaaauauauaauaugggauauuuuucauuauacaauucaauauagcaauuaucuaugccucccaccauuuucuccccacaugagagguacagcagagagggagaagaaccaauguuuccuggguggcuaguaugauugcagcagagugcuaagcauuugcuauauaucccaucuuauuucauucucccuagaaagaaugugauaggaauuauuaagcucuuaggaaaggugaguaaaugaagcucagauauguugccuauaauuauugcuuauaauuaggaucucagaucugucaaauuccuaagcuaaugacuucuccauuauuuuauguagaugggcuaccuguccauauuagauaauuuuauuuuuaucacguugaggggaauuagagaaaaacuugcuaaaagcuaagcaucuaacuuagggcuugccacagaagagauagucaguaacugcuauauaugaugaugaggaggagcaggaugauaaugauugugauggugauggugaugguacuggugauggugauggugauggugacaaugauaauuauggcagcggugacaaaugauggugguaauagugaugauaagaaccacccuacuuuaaccuaggagcaaagaacuucugcaacagacacgaagaauuccuuaaauaagguuucaguauauaguugaaguaguggaacugauaaauauuuguuaauccuggucccucaauccaagaagaagcuuuuucagagcaggcuguguggugcauggcugggccacuaugaauuucgguuucccugugugugaaacgcaauaauuauauauguggugccuagagcugaugugaagaaugaaaggaaugcauuuagaacacuuggaacagccuggagcacagcgaacacuaggucaagauagccacuuacugucggggagguuaguuccaacauggcugggcucucagcaagucuucuuuugaggaaaggacccagaaguggaaauggccccucuccuuacuagcuguguccucacccacuccacucaucuacacaguuuagaaucugagggugaaagaaggaagagcaggcaagggaaggcagcaguggaaaacagcucuugggugguaaguagggagcaggaagagcaguuaccaccaugcuuaaaacaagguuuuuaaaaaaaaaaaauugccugaagucacauuugaaaauaaagagcuugguaaacaugcugauggcaaagagaacuuguaaaacaguuucacuugaaaaaggccaagguuaaugguauaauuucaauuuugaaccuucuuuuaauauggauuagugcucucaaauaugggauuugacauuaagaugccaaaagaagacucagaagguaaccucaagcaguauuuuuuaaggaaauuucuuccuuuuaucauuugaacgcagcugaacaaaaacguuauuaaaaauuauucugucauaaaaacagcaacaucaaugaccauaacaaaugcuaaaaagcaaaauuauccaugaaauuaaaaauauuucacgaauccaaggugagaaauauuuuagggaugacacuuggcacuugagauuuauguaaugagacauuaccaacuuuuauguauaaaauuuccuuucugaaaaaaaaguaugaaaaaucaaaagaaggcaccaaaaaagucccccacugauuuggaaaacauauucuuuuuuuuuuuuuuuuacaauuaacugcauuuggagaacugcaucacacuuuuaaauaaaauauacauaacacauuuucucuuuauagaaaaaccuuuacaaacccuuaaguuugcugaauuacugcugaaaaaguauuuuugaaauaaaauauacagaaugaauaaagcaucuuuacuccauucuucggaaauuaucuagauacaaauauauacauggcuaaguucaaaaacuuacauaguagaaaguuuaauaauuugaucuauaauauuaagcuguugauacuuucgauuggaaagaaggaggggaaauagugaaagaaaaauuaaccacagaauauauucuuugcaguuugagauauaaaauguuuuaucauuuacauuaaugugcauaacauuuuaauauuaauuguugccucuuucaucuugcugucuuauuuuuuaaaagcuuaucauagaaaagucucuauaugaaauuguucauccaaacagauaaaaaguuggaauuauaacugggccaaugaaauguuguuguuuuguauuuuauugcuuugcuucuucuuuaguaaucaucuuugcagucugucuaaacaauucucugugcacugacauuugcaauaauguguuuacaucacaaaguuagacccugucauucgauggaacaagaggcuguauuuuguagcccccagacacucugcauaacuuacucccucuuuggccugagaguguaaucguuuuuucaucugccauguuuaauuaccuuuacaggcauuaacaacaguuuacuagaaaucgauggaggagcaauaaauucauuagguucaguggagguaagaaguuucauauucuuuuucucaggugaauaccuauuugagaacuacuaacuucaucuuccauaaaccuaaaaaauauaauauaugauuuucaucugucuaccaguucuuaaucuccuaccaaagauggagucacaacacaaaaucaggagucaauaguuacaaugcuuucucacucugacacaaaauuguguaacuugaaggaaacguggguucccuuaugcaugcaaaugcccuaugcgacuacagaauguguucccuacacuucagaagcuguugauguuccacucagaucucuguaggaucccuuuuaccaguuuggugucccauuccucccuacagguguugcugcccaucuucuccaaagaauugcccuugagugaccagagcaacacccagagguucuggggagauauaucacuaaauucggcccccacccaggguccauagcuaaagacugaauggugggaagggaagguacaaaagucuacacuccugucucaaggcagaacugacccuguaguauguuucaugcucccaagacuccccaugugaucagguuaauuucaccugaaaccacaaccuugguagcuucuuccacuuccuuauacuaauucccucacucccuuccugguuucucccaagagcccucucuuacuaaucaccugcacacccaucuccaguucuagggaauucaaccaaagacccuguagaagcaaacauuacagaacagacaggcauacaaaugguuuuccaguuuuugcagguaaucaauaucucagccauuuuaaaagguacuguccacaguguuuuauaagcacaaguuggggauggaggggaaucacaugccuguuauguaauugugugaaaagaaguuccuaagaucuacaaagucacaucauuugcagaagucacuaacugauuccugcuccagggaaggcugcaguuggcaagggcugcccuucuuggcaggugucaggcagggcucugcacuacaauucucccugcauugggagaacaaaaggagucuggggcuaggaagaaaaaaaaaaaugacaagcgaagcauuaaacuacaaacagcucuuugaagccucccugauagaggugguuguguuugugcaacaguuauuggguugagucuaauaaugaaaggacagaucaccacuuacucugugaugucaguaaugaaagcuaucaaaacuaagccugagugggccugacugucacccuguaaaucuaacguggacagcuuaaugagggagggacauuaucuuuucucacacuccaauuuuacucacauaagaaauguggcccacauuggcaauuaacuugagagauuaauuaaauccaauaacaaguucaguucccuccauagugcauucugauaucaugugaaggcaccaacaugcuaugggcacuuagcacauguuaaaaaauaauggaacuaauuugggcuuuuugugugugugugugugcggaaaacuggcagcuaaccgccucaguaaauuaauuccacaaacugauacagcuacucgauaguucacacagucuuauuuccaaacucugcuuuauuauccugaaacucccaagaaacauugcccaauaauuguguuucuucccucagcaauuuuacucaccaguaguauuuaacauauuuuauugggcccucugaagaauaaggaggcagccauucagacaaaacauaaacucugccccagcuuaagaagcaauagacugggucccauugugucucuuucaaaacaacggcugacacugacaaggaacaggaagagcagcaggggugcaggcaugagcuucacuuagcgucagaaggccacgugauauauguucugguucucuuucuuuuggguucccuaauucguccuuaguuccuguuuuuguguuuucuucucugaaacgguaaagugcuuuccuccacuaccauauaugaaauuugaucuuaagaaauaggagucuucaaauuugaccaauuggccaaaugguuauuaaacugaugccuuagugaaagucaaugaaauuguuuuuuaacugguugcuguaaaaucauauuccuauaauacagaucaaauucauauacuagaguuauuauauagauacuacauaauaauaaugccuacuccugccccacugcucccaaaucaaccuacucaaagaagugcuuccuaacaaucucacuaccaaggacuccuuuuauuaugauuugagaauggaguacauguuugaaaauauuucaucuauccaagauuaacgauuaauucauuuccuuuuugguauuauuaagaaaaauacauauccugucugauggaacuucuaauaaauaaauaaugaaauuacaacaugaagguaaccuaaucuuugacaaaaaugggaaauauaauauuuggguagccuuucauaguuacugugguuacaaauacccuuuaggaaauaacgaaaagagcuugaagguuucuuuucuauuuuggagagaauucuaugacaaggugauauuuuagaccuacccuaauagucacuagugcagaagauuuacauuaacaaucuuucauacagccagaaguuucaucuaccuaaguggcaccuugaaacuagaaagagaugguaaauaacaacaagccucaauguucuaagaauaaucacaucaccugaagcaugguaucucugcgcauaucuucaauuauuaccaaaaaugucuaugcuauaaauauacuugaugacaaagcauuccuacacuugauuaccaaaaaaaaaaaaaguaaaugguaaacaacugauugaauuuauuggaucuggggugaucuuauauuuguaucaaacuguaaauacauuuaacucaacugauccaauauuagcccauuaguccauauuuuccacuuaggguauuauugcagaccuacugauaaucauaauggcuaacaauauuaagcucuuacaaaaugcuuuacaugcauucauucauuuaugugacucaacaaucccauguaauaaguacuauuaccauugucauuuuacagaugacaaaacuaauguuuagaaagguuaaguaacaugcacagccacacagcaucuggguuuaucugcugcuugguaaaucuggacuaaacaaccaacagggaucaggcuugauauucuguuccaccugauggccaaggaagauacugugcaaaugccugcacauuuguccuuagacuacaagcuuucuuucaguccugucagcauugacacugccaauauuuuaagaaauguauuuaaagucccuucugauauuucuuauaucaccagcuaaacugcacacaaaauaaguuaauugguucuaagguuuaccuaaauauuucucauuguagcagaauuguggaaggagaaguagauaauaucaagaguugacuguuccauguuuuauagaaaguaagagucagaaaaaauauaaccuaaauaauuccauugaacucucaguauauguaggaguaauggcauaaugauauauuguuguuauaauuauagguaaaagauaaauucuuggaaaauaauuuuaauucacauucucuaacaugagaaauuucucuucacuuaagguaaacuucgaauguuuccuuucuuuccacaagguggaaaucuugaaguaaugggcuacugaaaaaccagagaaauuauaugcacugacuuacuuauucauucuuaauuuuagauuauaaaaguuuucuuguguagcuuagagaauuuuccaaauccuuuauaacugugguuguggaauuccacaauguugaaccugaauagauuccuauuuaugacaaguuacaaauuucauuguagaaacguaggugcaaaagacauagauuccaaagauuuaccacuuucaguaucaaauaauuuaccuuucauuuuuagcuugcucucacauaaaaauugauccaaaaugcuguuuuaggaagaaaccagcccucauaaauucuugaugaauccagaucaccaauaugaauaucaguuauugaaauccucagaacauauaugaaggggauuaacacuaaucaucaacacacuaaauggcccuaacuuaggcuguuacguaccuucauucuucugcuuuauacagucuauaacuguauaaagucuuccaacuggaguucauggaaucagauauucuuaaaagaauacauuucaagauccucaacuuuuuuccuaaaauugauaugucugaaaauguaucugcaguaaggguaucauggggaugacaauuucuguuuaaagaucucgccuuuucaucugcaaacaauugucaaagaauacauugcuccugagaaaaaagucccaugagagcaaagcaaaaugggaaucuguaaaaaauacaauggcgauggugucuuauuucucucaggagcagacucacugcaaaccuccucaccauaucagccaaucuauuucagacugagaacucagaagugaaaugacaggcaugggaaggaccacaaggaaguuuaauugaaugugaaaacccaaguugaaagaaaguaggccugaccuagcugauugauucagcaaauaaguuuuucaaaauaaacuauaaaguggacauuuuucauaaagcuaaugaguuaaaucugcaguuccaaggcuuggaggaaauacacuacucaaagaauguacuaagcaagagaaucuuguccaaaaauuaaaaaucauauuugcagagguauacugaaauuuggaauauuucaguuuucccaccucugagucuaucagauucaauauggcaccucuaagagaaagaggaauagguauaauuaaugggcauuugagaagcuuugguaagccuuugguguacuucccaggaaaaagagaaauugaauaucuugagugacugagcaacaaauucuuuuucaagacaguuuuucucucaauaaaauugaaguagaacuaauugaguugucagaggaugaaucauaaaaaaaaauuugaugagaaauuacuauaugauuuuuggcauaaaacuggcaagaaguuuuaaaaaauucaaugacauaaaaauaccuccaaucucaucugcuuauguaugugagaaagauuucucaaugcuuauaucuagaaaacugaaaaauugggauugugcuaaauccuguuuuguuuugaaacaaauaauauuugacuugauauaggaaugaauuaaaaaaucaaaaaaagcccugacaaucucauuauuaggugagguuucaauaauuuuaacuuuuauauuuaauaauuguuaauauauaaaaaauauaagaaauacauauuuuuuguuuugaucaaucuugugcuaauaauagugauaaaagcucaauccagauguaauuuuugaaauguagaggauuauaaauucaaaauuuuuuuaaaaaauuuaauguucugagacuauaugaugaugcauaaaauauuucaagcauauuacauugauaaaauucugugagacaaaugaaugaaauaugacuuauagagaaaggaauggugcacaauuuucaaugaauaaagaauuuguuuuuauauuguuaaauugacaauagugagacucaacucauuauaguauuuagauuccaaacggauauacuuaaaaaauauuuaacaauuuuuaaaugucaauaauaagccagaaauuauauucuuugcaacucuuuaaacuuauaacaaauuggaagccuauaguuuuuccagaagucuuucaagguucagggagcaaaaaaagaaagaagaaaaaaaggagcuuucugcuuuguuucuccugccuuguuauuauuucuggaauuagaagauaugcuuuccuggccccacuuucagauuugcucuuugauccacucuccccuuagaaauuggauuucugaauagcuaaggucuccagaucacugaauuguggauaugauaaacuuuccaaacaaauaugauucuaauuauuugcuuuacccuaagacucauuacagcguucuuucaaauaacaaucuucuccagugcuuuugaaauaugguucuauaauuauaaaaauucaccuugcauucuauuuacaggcuuuucauuuuauuuagguccaaaauacaaaugcauugcuuugauucuguagcagauuuuugagaguaaucccuuuuuaagugucuuuacaaauauguuaucuaguccaacaaggcaaaaaaggaaaauagaaaagaagggagagagaaaaaagaggaggugaugaaaugccaucaugauaucagagaaggagguggauaauuuaaagcagcaaggcccuuucaaauagaagauggcuaaauuuuaucacuaauucacaauaggauuagaacaugaauuaaauuucauuugaaaacaaagauaccuauugcuuuauauagucccugccucaacagcaauaccagccugauuucuuucacaguuuucuuucugagacaagaaauacccuaauaaaacaaagggaaaaauauauuucccagugucuaaugaucuuuauaaguccuuugaccuuuccauggaccucaguuuucuuaucuguaaaauaagaaaguugauuuaaaccaguuauuugaggaggggcaagagacggggcaaggagggcagaugagaagaaucacaggaagggaugaauuuuucgacagaauacccacacucugcaugacuuuccagauuccuacucaagcugcaccacuaucccuauggaugcugagaacuccagcugugggaauuuguguucucuccuuggaagaggacaaauggccggaaacaccaugcauaacuuuaaagaucccuuccagcaaugagauaccaugauucuucggcuaugacuagaaaacauauuguuacucauguauuucuucucuccuuuccuuugucucuggcaagcaucacuauuugcuccuugcugccuagaacaguaugagguauauaugccuggggugugaaaggagagauggagggagggacauauuuacagcagcuaugaugcucaagagcuauauuaaucuguagcucuguauuuucaugacuucacaacucccuaagcuuaaaaauauauauacguacauccggcugggcgcaguggcucaugccugcaaucccagcacuuugggaggccgagacgggcagaucaugaggucaggagauugagaccauccuggcuaacauggagaaaccccgucucuacuaaaaauacaaaaaaauuagccaggcgugguggugggcaccuguagucccagcuacuugggaggcugaggcaugagaauggcgugaacccaggaggcggagcuugcagugagccaagaucgcaccacugcacuccagccugggugacagagcgagacucugccucaaaaaaaaaaaaaaaaaaaaaaaaaaaaauauauauauauauauauguauacacauccuuauauauguauauauauguauauauaugcauguauauauguguauaucuauacauacauccauauacauauauauauguguacacacacauccauauauaugacauuuuaaaagauccucuuuucucucaucuugaaguguguuaaaagguaugcguaaaaaggagcuacaaaacaaugagguuacuagauaagguacuuuuccugaaucaaagaagcuccuagacaaaauggggccugacuugguggucagcugucagagugaaacuuaauuuaacaguaacaauagacaaaguaugucagacuaagugcuucaucgacaaucugaacaauuuucaauaaaauggccuugaugucaguuagggcagacaaccccagguagagaaagacuacucgggaaaaaaaauuaagaaaaccuucugcagauucgaagggggauuuuuuuuuaucccucugaccagccucucuguauguaacuuucagugguucuugccuucaagagguuuucccaccacagugaggggcugagggagauguuugugucccuggaucuagugacuuguuuucauggcucugaagcccacagucacucccauuuagaaaauauucuauauccuuuuggauuacgcuugaucucuuuuuaucuaauuaauuacaucucaggaaccaagaaguaauuacauuaagaacuuggaggcaugccuucaggaaugucacuauggcuuucuguuuguuuguuuuaaagcaaaucagcacucuggaacuugguucagauuagcaauuuuaugcauucagcuggauacaaugcaacuccugguuauuagaauaagaaauaaggugaagaacaugaaggaaugugguucaaucucucucucucuuucccuuccuuucuauuccacuuuaguauagcaauuacaggccucugaguuuggguuuagcaucgugaugguaggcagguauuuacuuuuuuacuugagggucaagugggaugaaaagcaaggaaaaaaagccaggacaguccaaggacuggcacaugucaaagcacagaggaacaauacagaucuucagaggaacuuuuuuucuuuuacuuccuuuuuaaaaaacuuugucaguguaguaaguggugaagacuauuugcuaaaguguucaacaacauaacugcucugagauuucuccuucacuaggcuacucucuuaggccucugugaacaucugugccauguguacaggccacuuccuaacaggcccaaagaggauguguuuucauaaaaguuguaaacacauuuaagaaauuaucugaagcucauaagccaccugauuuccuaggcaaggccucucaucacauuaaccauauuuuacguaaugagcagaugggcagaauaaaaccagagggaggagaaguggaggaaaaggacaguaaugagugaugaaauggaaaucacgugauuaauggaacauagauuuuaaaaaguaaugaagaguuuaucccuaggguagaaaacagggaacaacaaaaauaaguaccacguugucaaaacaguaaaauaagagaguagaacaaagaaacagagcaagacaaagaaaugcugguuuuaggauaggccuuauuuuaaagacacaggggauuuuggaacuuaccauuuugcagcuauuuguuuaaacaaaaauaaauuuauguugccugguguccuaaaaguuacuuaugacaacggucauuaauagauaagagccugcagcuauccggguacaccaacaccagccuuuguguuuguucaacauuucuuucugugggaaauguaauuuguagcauaagaguucacaagaacccucagcuccauggcuccaucacuaaugaaacaaguccuggauuuucauagcaaccaucaagcauaaauuuggcuccccagagcaugugaacuuuaugugugaauuacuuaugugugugcacaaacuaaaggcaaauucaugugaagcauacaggcaauuuacaaacucuaucuguucugaaagucugcacaguaacaggaacacagacagaaauaacaaaauggguguauauguccagguuucuccacaaaagaugaccuguauacuugcaagggcaaaauaucacaaaaacaacccuaaugcaagaguaguaaugagagcaacuaaaaauaaaauacagaggcugggccugguggcucacaccuguaaucccagcacuuugggaggccgaggugagcagaucgccugaggucaggaguucaagaccagccuggccaaaauggugaaacaccgucucuaacaaaaacacacaaaaaauuagcaagguaugcuggcaggugccuguaaucccagcuacuugggaagcuaaagcaggagaaucacuugaaccuaagaaguggaggugcagcaagcugagauugcgccacugcacuccagccugggcgacaagaguggaacuucgucucaaaauaaacaaauaauagaaauaaaauagaagauaaugacugugugugugcacuuucauuauuuugaauguuagugcucaaaggaaagcaaauuuaguuagaaaacaagcugauagaaaaacaguuucagagauucuuaagagaacuucaggacacauuuaagaaccaugaaggcugguaacacaaguuuugaaaaaauuaggccuuguuucaggacaauuuuguuuuucccauuucuaggaauccgauguaucauucacacaauuuguauucccauuagccuugauuagggacauaucugugcucacauuagacucccugaauacagggaccaaaauucauucaauguugccacuugggugucuaauaugcugcaaaaaucucuaggaaagauauaaaugaacaaauaaaugauaugcugagauaacauugugaagaauuuggcaaugaggaggggcauuaucuucuuccauaaagacauugauuuauucuuuaauaucacucagaaucacaagaaauaaucagcugauacagaaauggaacagcugucucacacagaaguggcuaaagagaaaaaauuuccacaaaauacuggaaaagaugguaacaaaucaaauuucaaaguugggcagcccuaccaaaaagagaaaaagaagauacgagaggagucaauagugacagcacuacugaaauucaaaaauaggacuugaggucuaagacaaacugauaaaaauuaaaauaauggcaauuacucauugaacauuuacuaugugccagguacuauauaugcaugaucuaauuuaaucuuuauaauaauccauuuagguaaguacuucuaucauccuuauuauacagauagucaaacacgaugauaaaaaguaaguaacuuucucaaagucacccaccuaguaagugauggaaccaguacuuuaaaacaugucugucugacuccuuaaucaaugcaacacuaagauacaugugacuaaucaaggaaaaagaaagaguuuugauuuuuguuucuuuuuccaauuuagaaaagaugaaggagaauucuagaaccuucacuucugagcaaauagcaaaccaacuugcuguugggaauuuaagugucaugcacauuaccauuuacauuaguuugaaaaagaaguaaauguccaacuuuuaguuucucuaaacaguuauucuaguuuuccuaaguuugaccccaaaagggauuugacugugaaacaaaacucucuguaguucucagauaugguuagacagucagaugcccacaaguaacagccugugcagaacaucaacacaguauaucaccccagcaaggaaaguucaaaggaaagauuucuaaggcuacugagauaaaauggaauagaaucuuuccaguauauuucucuuugcuaucaaaccaaauuagaaaagacuaauuuauacuaaauuauaaaucacagcauuucuaauuuaaucacugucuguuuuuuuaauuuuuguucuuguuuuaguuuugcauuucuuucacccaugggauagauacacauucucacuuaagccccuguugaaacuauuuccauuguccccuagauccucauucuacuuuaaugugucuaucuucaguaaaacacaacugauaaaccugaaagauaauaaacuggacagacuagcacugagauucuaaaugagauaaaccggcagucauccugacaguaauggaauaaauaaagcaugaauaauuacauuaaaagacaauuucugauuuaaacuuugcuuuuccuguuuuuacacaguagaaaaaauuaggcugucuggccuuccuuaggagaaaucuuucuuagaaggaaugugugcuuauuuuuaaaucuaucauaacaacugauauaucagcaacaauguacccauauuuaccucauauuuauauguaugucuucucuauuauaagcaauauguuaugaaauauauuagagauuaguucaaagaguugagauugguuauaaagaauuauauuagucggguuuaaaacguauuuggaaaguucccaguauaaaauaguuuaguuguguuauuuuccucuugaugucuugaauguugcaagguacuauucuauggcugguaggggcaugcaacaggugggaguaaggaaggaaacagcaagccaauaauaaguuuugaaaauaagcccaaucauuaaguauauguugagucucuucauuaccgugaauaggaagucuaauagauugccauaugcagaaacagagaaaaugcuguuuuaguggcaccuaaugagguuccaaaaaugcaguaacuuguagauucuuucacauucauacucuguguaauauaacgcuauauagcacacuuagcucucuuuauaccuugauauuuuaaugcaaacacagauucuuuucucuauggcuuuaaacauuacacaggaacaagcucccaugaaccucuuucacauuccuacucagagcucucugugaaaagcugucauuucuuguucuauucaagucagacuaccuagucuccaggcacaaugguaaaaggaaugucaagguaacaucuucauuuauucauaugauuuucucuuuuuuuuuaauuauacuuuaaguucugggauacauguguagaacgugcggguuuguuacauagguauacacaugccauagugguuugcugcacccaccaaccugucaucuacauuagguauuucuccuaaugcuaucccuccccuagccccacaaacccugacaggcccuuuggguauaaccuaguaaugggacggcugggucaagugguauuucuuguucuagaucuuugaggaauugccacacagucuuccacaaugguugaacuauuuuacacucccaccaacaguguaagagcuuuccuacuucuccacauccucuccagcaccuguuguuucaugacuuuuuaaugaucgccauucuaacuggugugagaugguaucucauuguaguucugauuugcauuucucuaaugaccagugaugaugaguuuuucuucauauuuuuguuggccacauaaaugucuucuuuugagaaguguuuguucauauccuucacccacuuuuuaugggguuguuuguuuuuuucuuguaaauuuuuuuaaggucuuuguagauucuggaucuuagcacuuugucugauggauagauugcaaagauuuucucccauucuguagguugccuguucacuuugauuucuuuucaaggaagcacuaaauaugaaaaggaaaaacugguauaccauccacugcaaaaacauaacaaauuauaaagaccaucaacacuaugaaaaaacugcaucaccuaaugggaaaaauaaguagcuagcaucauaaugacaggaucaaauucacacauaacaauauuaaccuuaaauguaaacaggcuaaaugccccaauugaaagaugcagacuggcaaauuggauaaacagucaugacccgugggugugcuguaucggugcgcuauauucaggagacccaucuuaugugcaaagacacacaaaggcucaaaauaaagggaugguagaauauuuaccaaguaaauguaaagcaaaaaaagcaggaguugcaauacuagucucugauaaaacagacuuuuaaccaacaaagaucaaaaaagacaaaguagggcauuacauaaugguaaagggaucaaugcaacaagaagagcuaacuauccuaaauauauaugcacccaauacaggagaauccagauucauauagcaaguucuuagagaccuacaaagagacuuagacuaccacagaauaauacugggagacuuuaacaccccacugucaauauuagaucaacgagagagaaaacuaacaagaauauucaggacuugaacucagcucuggaccaagcagaccuaacagacaucuacagaacucuccaccccaaaucaacagaauauacauucuucucagcaccacaucgcacuuauucuaaaauugaccacauaaguggaaguaaaacacuccucagcaaaugaaaaagaacagaaaucaggccgggcgcgguggcucacgccuguaaucccagcacuuugggaggccgaggcgggcggaucacgaggucaggagaucgagaccaucccagcuaaaacggugaaaccccgucucuacuaaaaauacaaaaaauuagccgggcguagcggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaagaacagaaaucauaacaaacugucucucagaccaaagugcaaucaaauuagaacucaggauuaagaaacucccuaaaaaccgcacaacuacauggaaacugaacaaugggcuccugaaugacugcugguuaaauaaugaaauuaaggcagaaauaaguaaguuuuuugaaaccaauaagaacaaagacacaauguaccagaaucucugggacacagcuaaagcaguauuuagagggaaauguauagcacuaaaugcucacaagagaaagcaggaaagaucuaaaaucgacacccuaaccucacaauuaagagaacuagaaaagcaagagcaaacaaauucaaaagcuagcagaagacaagaaauaacuaagaucagggcaaauuugaaggagauagagacacgaaaaacccuuaaaaaaaucaacgaauccaguagcuggguuuuugaaaagauuaacaaaauagauagacugcuagccagacuaauaaagaagaaaagagagaagaaucaaauagacacaacaaaaaaugauaaaggggauaucacaacugaucccacagaaauaaaagcaccaucagagaauacauaaacaccucuacacaaauaaacuagaaaauauagaagaaauggauaaauuccuggacacauacacccucccaagacuaaaccaggaagaagucgaaucccugaagagaccaauaacaaguucuguaauugaggcaguaauuaauagccuaccaaccaaacaaagcccaggaccagauggauccacagcugaauucuaccagagguaaaagaggagcugguaccauuccuucugaaacuauuccaaacaauaaauagaaaaagagggacuccucccugacucauuuuaugaggccagcaucauccugauaccaaaaccugacagagaaacaaaaaaagaaaauuucaggccaauaucccugaugaacaucaaugagaaaaucuucaauaaaauacuggcaaacugaauacagcagcacaucaaaaagcuuauccaccacgaucaaguuggcuuaaucccugggaugcaaggaugguucaauauacacaaaucaauaaacauaaucccucacauaaacagaaccaaugacaaaaaccacaugauuaacucaauagaugcagaaaaggccuucaauaaaauucaacacuccuucaugcuaaaaacgcucaauaaacuagguauugauggaacagaucucaaaauaauaagagcuauuuaugacaaaccuacagccaauaucccaccaaaugagcaaaagcuggaagcauucccuuugaaaaccagcacaagacaaggaugcccucucaccacugcuauucaacauaguguuggaaguucuggccagggcgaucaggcaagagaaagaaauaaagcauauucaaauaggaagagaggaagucaaauugucucuguuugcagaugaaaugagugcauaucuagaaaaccccaucgucucagcccaaaaucuccuuaagcugauaagcaacuucagcaaagucucaggauacaaaaucaaugugcaaaaaucacaagcauuccuacacaccaauaauagacaaacagagagccaaauuaugagugaacucccauucacaauugcuacaaacagaauaaaauacccaggaauacaacuuacaagggaugugaaggaccucuucaaggagaacuacaaaccacugcucaaggaaauaagagaggacacaaaaaaauggaaaagcauuccaugcucauggauaggaaaaaucaauauugugaaaauggccauacugcccaaaguaauuuauagauucaaugccauccccaucaagcuaccauugacuuuauucagaauuagaaaaaacuacuucaaacuucaaaugaaaccaaaaaagagcucauauagucaagauaauccuaagcaaaaagaaggcaucacacuaccugaggcaucccgcuaccugaucucaaacgauacuacaagauuacaguaaccaaaacagcaugauacugguaccaaaacagauauauagaccaaugaaacagaacagaggccugagaaauaacaccagacaucuacaaccaucugaucuuugacaaaccugacaaaagcaagcaauggggaaaggagucccuauuuaauaaaugguguugggaaaacuggcuagccaaaugcagaaaacugaaacuggaucccuuccuuacuccuuauacaaaaauuaacucaagauagauuaaagacuuaaacauaagaccuaaaaccauaaaaacccuagaagaaaaccuaggcaauaccauucaggacauaggcaugggcaaagacuucaugacuaaaacaccaaaagcaauggcaacaaaagccaaaauugacaaaugggaucuaauuaaauuauucauacuauuuucauguuggacaguauuauaaaagccaaucaaauuggagaaauaacauaguauauuuuacaaaauguaaauuugugaugcaagcagaagagcuucugcuacucaugagaguuauauucuuguuacccaagaauauaacuucgcaucuuuucaaaacaaccuacacagaguaacucuuaaaaaucugcuagugagggggaaaaggagggagaaagcaaagcuucaaaggacuuucuaaagaaauuauaauacuaagacuuuuauaugacauucaacccuguuuuccccccuucucccccaacaaaauaaccuagccaaacaauagagaggcaacguuuaaauacaaacuuucuuccacucaacacuagaaaacugguaagauuaggucuucaaagaggcugagcuaagaauucuccuaagcuuuaaauuuccugcaaaggcugaguuuuauuucuuaagggaagagcuucuguuuggcuuuucuuuuucuuuuuaagaaaaaaauucuauauaauuauagguuuauuguuacauuuguauguaugagcaaaguacaggcaaagaaagaaaaacauugucaagaagcugguuaugacuaaauauauaaagauggaauagucuaacaaugccaguugaauaaauacuguaacaaaacuguaauuuaaaugaagcuaccaaaauauuucaaaagacaacgcauuuuaugauuuuaaaguuuaucuucaaaaugaaauaugaucauagcuauuaacaauaugcuguaaaauaaaauaugcuaaacauugcuucuguuaguaaccacuaguuucucaggaaacauucuuuauagagcaacucugauuaauguacaagugacagcuuuuuuuuuucugagcacuaaccuuacaguauaccauuguuuucaagacaguguuuauaaaagcuguaaagauacguuuuagacauuaccuugucuauaucuaugaacugucagcaaaaaauaucccuuuuucaccuucucuccacucuccauuuccaguuagacauuguguuuucaucccuauauagcuugccuaccuuaaacagaaaaaugaccaacauauucuuaugugcaaaaucugaaaacauuucuuucagaauaauaugaccuguuagacauccgaagaucaagacagggauaaagauuuauuaggccaaaccacacaggacuuauauguuaugggcuguaggacagagcguauuaaauuauuucccugaucacacaacugaauguaaaaggcuaaacguuucacugauuguggucaaauaugauuguugcugcaguagaguaaaggccccaaaaguacccuuaguuaggucagugaccaaaugucacucuauaugauuuuguucuucacgggcaaugucuccaaagugcuaaaugugugaaacuccagcuugaaccaaggaaugaauuuuaguuugcucuuacccuuugaauggauaagcacauugaacaugaaaaucuucucucuuccuuaucaacaaggcacuaacagaauucagauuuacagaucagacacagaaauauggaaaauauucuuaauguuagaucaaauacggaauuauccaauaaauaaauauugaguuuacaaaccaucuaaacuuugacucuccuacuucccaucuaccaaggaagggagaaaaguaagaaauggaaguuaagcucaaauuacucagguacuguuuguuaauauaucuggugacuaucuuaugugagggaaaaacuggaauaauaggaaaagguuuggugauucuacguagcuuuugugacuguaguucuagcuccuaaguuuuacuuuccaaauagcuaagggcugcuguucucaaaagagcuacccuuucuaaauucaggaaauaacaauggaaagaaauaauuguuaaauaaaaguauauguugauguuuacccuauuauauauuauuuucauuuuauauguuauaugcacaaaaauuuauugguacauauuucuaaauguuaaaaucuugguucucugggugauaggaucauacaucauuuuuaucuuuacaucuauacuuuugugcauuuucugcuguucugcaacaagcaugaaaugauuuuaugcucagggagaagaaaaaagccaucucccaccacuacgcccacuucaagaagaagaaugaagaguaaaagaggagaaauaugguaaaggagucagcuuuguacucucugucugcuguuuuuugcuuccucucauuucugcuuuccuuagcagaagccaagaguguuuggggggccuaggucugaggccagcuccaccucugaccaguguaccuccaauucucuccgagccuugguuuccucuucuauagaacgacaauaauaaugguacucacaagaagucaagaagaaacaggauaaugcauguaaagcuguuaccauggcgccuggcucaaagagaauacccaccaacauugcugcacuuuuuuucgccagccuuaccugaucauagaaaucuuaagauuuauaaaauacuuuaaagcaaacuuguccaaccugcagcccacaggcugcacacagcucaggacagcuuagaaugcagcccaacacaaaauccuaaacucucuuaaaacauuaugagaccuuuuuuuugcaauuuuuuuuuaagcucaucaguugccguuaguguauuuuauguguggcccaagacaauucuuccaauguggcccagggaagccaaaagauuggacgccgcugcuaaagcuuacaaugagcuuuaacaaacaguaauuuaauuuuuaaacugauaguaaaaagcagagcuagaauucaaaccucaccuucccacauccuagcucugauaaccaaacaccacuuuugaguuggauugaaacaguugccuacuggagcugccucccugaggcuuaccugcaauugguaaauuucaguaacuuugcauaccagcuguuaaacacagacauuauuuuaaauuauuauagaauuauacaaauuaaaauauaaaaguuacaauuaaauaaaaauauuuuaaauaaauaaauauaugaagcucgucauguccuuauacuuuuuucuuuuuuuugagauggagucuggcucuguugcccaggcuacagugcaguggcgcaaucuuggcucacggcaaccucugccuccuguguucaagugauucuccuaccucagccuuccaaguagcugggauuacaggcgccugccaccauaccuggcaaauuuuuguaguuuuaguagagacaggguuuugccauguuggccaggcuggucucgaacuccugaccucaggugauccacccaccucagccucccaaagugcugggauuacaggcuugugccagcgcacccggcccuuauacuuuuauuaucuauacucuuuaagcuuauuugcaccuauuguauuuguagaguggaaacacuacauaauagagugcuacauguaucucuuccuaauucacuugcaguaaauucacauugguagcuugaaaucagccaaacuggcaaaugccacaaaucaagacucaauaucauuucguugacuugagagugauggagaauaugcagauuaacuuaaagugugccauaucuguggcuguuauauucugaauaacacacacacacaaauggagaacccauucuuccaguauuauaaacuaucauacaauauguaugacagaaagaugauuauucaucaguugcaaacauagacuggcuauggauauaagaauuuggcaaaaaucaaccaaagcagugugugagaaucuacuggcuauccaggauuuacaaucaagaguagugauuauuuuauucauauuuauaaauuacauguuacauguccuuuauaucaguaaaauuaauaauaaacacacaugcaagcaugcacauuagggcaugcaugcacacacauacacauauuuuuccuugagagccagcuguuaaacauuuaccagcauaccacuaaauugaccauuauuuuaaacuaagaggaaccuagaagcucuuaagcagagcccuaggcucaucuucaaaucacuaagguuggguuauaaaugguuuuagcuucagguaaggcuaccaaauuagaucauuguauuuaaauauacuauguuggcaauuccuauccugcacaaugaugaaguaggcucauagcuucaaguuccaccauuauuacagaaaaauuuauucuauggaaacgcaacuuagggaaagucaagauagcuuucuacaauucacaaaaacuauggagacauacaaagaaguaagauauggcuccuuccugccuccaagacaguugagcagggaggacaaacacauaaaccuauaauauaaaaggcacagcacugauagauacaacgugcuaugggaugacaagggagagaucccaugaguuuacacuucagguccugguuaauggcaccagucucaccugccucaaaagaagcaagggcaaggaggcagguuccagggagaaggagaaaccuauaaaguauggcauaauaggaagaaggauucuagaaucaggcagccugugcucaaacccagacucuuucacuaacugugugaacacguccaaguuacuuggccucucuaagccucugcuucuuaaucuaaaaaaggagaauaguaacuccugacccagagcacuguagugaggaucaaauaagacaacaucugugaaacacuuaccccagugccccauaauucaaaagugcucacucaaugaacauuaccuacuacugugaugguuguugauagccuugagaguugaaauggcugacuuuggggacuaggagggugcaggaacuagacagagggauuccaggcagaaggaagaaaauaagcaccccccaccaacaaaaaaaaaaagaaaaaaaaaaacagagauuacauacaggggcccacuuaguaguccugagguaguagaauauuccuggaggucuaggucaggcacagcuacagcaaauaaagacugaggcuagaccaaggcucuuccagaaugguucaaauauacacucauuccucaugcucuucugagaaaaacgaaacaaaaucaggcuuuuaagaugauacccuuuuucuucugacagguacuguaaauugugucucugauauauuuugaagagccuauaagggaaugauaaaucaggcaauauuacauauauucaucaguaccuuaauuguuguuaaauacuaacaacaccuaaaauugaucuguaccaagauuuacugcucugacaaaaaaccaccuggaaaagagcacaugauaauuaagaacgaccaaggguuugaagcaaucuaacgcguaugaacaagauuuaaacuccuccccgagggaauaacuaggugauguuuauucuguagaugaacaaugugauuauaacaauggaagauugaugagauuuuuuuacugugggaaucugauuuagccggcuagcucagauaauaggaggaugcaaaacuaagccauccaguaccacuuaaaaauucuuugugagggacacaucuucagugaccugaaaaaaauggacugcaagucaggcaggcauauuaggcagcuacaaacugucauacaaaaaaacagcauuuaccaaaaaguuucuaaaugcaccacaacugaguucaaccaaauuagagagaaaagguaggaagagaauuacauucuuaucagaagcaaaggaauuuuuuuuucuuuugguggucuuuugggccuaccaacuguuauuugagucuaacagguuauucuuaguaaucccucuuguccaggaaaagaggaacugcuuggucuauuuuaauaaacacacaaacuaaaagcaaggcaauauuagucuuccagagccuugcuaugaaaaguguaaagagcuaucaccuaggagcuuguuagaaccucaggcucuugggcuccacccuagaccugaaucaaaaucuacauuuuuguuuguuuguuuguuuguuugagacagggacucacucuguggcccaggcuggggugcagugguacuaucucagcuaacugcaaccuuugcgucccagacucaggugauccuccuaccucagccucccgauuagcugggacuacaggcauguaccaccacgccuggcuaauuuuucuauuuuuaguagagacaggguuucuucauguugccuaggcuggucuugaacuccuggccucaagccauccacccaccucagccucccaaauugcugggauuacaggcgugagccaccaugccuggccagaaucugcauuuuuaacaagaaccccagguaauuccuuuaaaguauuagaagcaaugcucuaaagagacauucauucguucauucaauacguuugcgagaucugcagugucauuuaugguauguagccacuagccaaaugugacuauuaacauuucaguuaguuaaaauuaaauaaaauuaaaauucaaggauuuauuugcacuaaccacauuuaaguucucaauuagcacauguggcuaaugucugccauauacauuuuaaucaucacagaaacuucuauuggacacaucacugaacaaagaagacaaagaucuuuguacucacaaaguuuagauucuaguggugggaaagcagauacaauaaacauaagugacucaguuaaaugguauguuggacggacaguucaaggcuaaggacaaaaauuaaaaaacaaagcagccuuagagggaucaggaggauggaaagacaggaauuuuaaauauggcaggucugguaguuucaaugaaaaaguuacauuaaaggagaggcaggccgugagcugcccgggaugggggcagggggguaguuucaaaggguaaagccugugcaaaagcccuagggcaggucuguuuccauaacagcaagggucccauguggcugcaggagaguaaggggagaaggcaaguaaaaugguaggagaacagaggaguauggauccuggguauggaaagggcuuccuuauccauugucaaagauuugagcacuuacaugaaacgaaauaagggguccuugcaguguuuugagcagacagguaacaugcuucaacccgaucucaaaaguuauucucguucagcaaaaaaugacuauaaguaaaaguuauuauuauuuuuuaauucaaggucauguucagauguagaaagauacuaucugcaguggcaaaaugacuuuguuuacaaguuuugguaaccaugagaagcuuguuaaugauacacaaacaaguuauuaaaauuuaucacuguaaaauucagauacuuuuucaaaauccucuaugaauaugcagagucacaaggucuuacagguuaccacccagaaccaguagccaucuuugcuauaaaacuuuucagcaaauccugaggaaugcaaaaucagaguugcccaauugcccaaaagguggaacucugcuugagugucucaaccugaaaauuuguugauuacuuuauagagagaaagagaugaaaaucuguuaaauaguuucaauuuuuucuuuuuuaccccaacucauguaaauugaauucaucuacucuaacaucccaguuaaaugucaaagcuuugggaaucaagguagggauuuuuauuuauuuuucaaaguucaguucccagaaacaaugacacauuuuacccacaagugagaauguuguuaucuuguagguaauccagcuacuguucuaugaacuguaggucacuguagccugucuacaaaaugccaucaucagcuucaaggccuguguucacuaagacagccacauggaaguuauacugaacaggcaacccuaaaaugacugagcgccaucgccugagauuuauucccugaggaccaccaccaacugugauccagccagaauucuggcaggaaaauaaaguaaguucaccuucuguaaguuaaaucaaaugaacaauaaaucaaggcauguugggucauugggaacuaacugcucagaugcucauggccggugagugaaucaacuggcaucauuuuaaagcaucugggcauagcauuuuugagcuauagaacauaagaggagauuuuagcaaccaaauuauuaccaacgucagugauuggaguccagaacuggagcugcuuugauaguucauucguguauuccuucauucauucaacaaauauguguugaggaacuccuacagguaaauaauauucugucugcuaaaaauacagaacuuuacauacaguaaacuuguccacaugaaacuuaaaguuucaguuuuaaccuccucauggcucccucuuggagccaggaaccuuccagagcuaggagaccucaagaggucuuucauggaugggaaggauucagagacuguuuuagagugauaaggaacauaagguguacuaccagaaggugaaucuucacaggguaagagguguauguaagcaguaaguuuuauauucucuauccugaagccagagcaccuaagagcuucuuucauuucccucauccacccacagaagucaccccuaagaacugaagcauucuucaucccaccucauuucuggcacagcaaaaccagaaggagcagggaaaacacauucccagaggccagacauauuaagauacuggaaguaagcaaaggggcuaauagaccuaaacaaucagcuuuggggaaaagaagauccucucuguugcaaacagagcuaaaaggaacagccuagaacagagccuacaagccaaagacaguauauuagccaggcuucuccagagaagcagaaccaaugggauaaauguagauauacagaaagagauuuauugugagggauuggcccaugccauuauggaggcugagaagacccacuaucugccaucugcaagcuggaggcccaggaaagcaggagguauaguuccagcccaagcccaggggccugugaaccaggagagucaauaguguaagucccuuuggaucaaaggcccaagauacaggagcucugauaucugaggacagaagaagauggauauaccugcucaaacagagacagugaauuugccauuucugcacguuuuguucuauucacguccucaagagauugggugaugcucagucgccuugaugagggugacuuuuacuuagucugcugauucacaugcuaaucucuuccagaaacacccucgcagacacacccaggaauaaugagcauaucucuuagcccagucaaguugacacaaaauuaaccaucacuuguguccugccacguauuuuuguuaacaaagcuuuacuggaacacagccaguuauuuguuuacauauugucuauggcugcuuuugauauaaauucuacuguccaauauaguagccacuggccacauaaaaugugccuuauccaaauucagacaugguguaaggguaaaauacacaccagaccucaaagacugaguaggaaaaaaacuguaaaauaccucaucaauaauuuuuuauauugauuacagggaaaaaacuaauauuuuuaauauuuuuggcuaagugaaauauauuauuagaauuaaucucaucuguuucuuuuuacuccuuguaauguggcuacuacaaaauguaaaauuacauauggggcuuacaucugugguucacaguauauuucuauuggacagccuggcacagaaggaaagacuccaguauguauacagacccuggagacaaguugaauagaaaaacucuguucuuacucuaccuuccacuuuaugucuguuuuuaauacuccaaccccaggucuuucuuuuaauaauuauccuaaauuaacaaacacacaaaucugaaauucuugcaggucacuauugcugaaaauucaacagaagaaaaucuguguauaucagaauuucacacaaagaugggucaguggcugggcugcauaguggauauuugcugccuaccaacauucuuucuacuauagcaagacucuaagcaaacuccacaaaggagacacucugaaguuucaugaucuacauagaugcucaacuaagguaccaagucauuuaaugaagaaauaauaaucucuucagcaaauugugcuggaacaacugaauaaccacacaugccaagaauaaagcuggaccccuuccucacaccauauauaaaaauuaacccaaaauggagcaaugaucuaaauauaagugcuaaacuguaaaacucuuugaagaaagcauagggguaaaaucauuacccucacauuuggcaaugaauucuuauauaugacaccaaaagcacaagcaacaaaagaaaaaauagauaagugguaccuccucaaaauuagaaaccuugguacaucaaagacauuaucaaaaaaaugaaaagacaaucuacagagugagagaacauauuuguaaaucauauauuugacaagggucuaguauccagaauauacaguauaagaaauucuuacaacucaacaacaauaaaaacaaacaaacaaaaacaacaaaaaaaccagguaauggguagaggacuuuaacagacauuucuccagaaaaaacaugcaaauagccaacaagcaccugaaaagaugcucaucauuagucauuagggaaaugcaaaugaaaaccacaaugacaugcuacuucacaccuaauaggauggcuauuauuuucuuuaauggaaaauaacaaauguugguaaagauauagagaaacuggaacucuccaacaaugcuggugggaauauacagugacuuagccacuguggaaaauaguuuuguaguuucucaaaaauuuagauauggaauuaccauguaccccagaaaucucacugguagguauauauccaaaaggauugaaaacagguucuaaaacagguaccugugcauacauguucauagcagcacuauacacaauagccaaaagguggaaacagcccacuuguccaucaacacccaucaaugaaucaaaggauaagcaaauuguaauauauccauacaaugcaauauuauucagcccuaagaaaggaauaaacuucugauacaucuuauaaccugggugaaccuugaaaacaugccaagugaaagaaacaagacacaaaagaucauauauuguaucauuccauuuacauaaaauauccagaauagguaaauccacauagauagaauacagauugguggcugacaaggguuuggggaaaugaggagaagcugcauugaaaugaggaguuuuauuuuagaaggauggaaauguuuuggaacuggauagagaugaugauugcacggcacugucagugaguuaaacgccacuggauugcucacuuuaaaauggauuuuuuguuauaugacucuuaucuuaauaaauuuuuaaaucauauauuuuuugcauuucacaugucacaauucugaucuuuuaaauguaaaauacauuuuacauuacuuaacuauuucuaguccucacuucuccuccaaaaaaauuacauuacaguugacacuagauuuuguuaaacuacccaaaauuuacuuugcauauaucccucuugugcacaaguuagucagaauuaguuucuguuguuugcaaucacauaacuuuaauugauaugguaccuuaguaugucagucagggagccugaggucuaauucuaggucugcaucuaauuagcugguaaucucgggagaaauuauuuaaauuagcuuggcuuuagcuuucucauauguaaacugaaaggauuagacuaaauuauuccugaggguuuaaaauuccauaaaugacauaacaucuccuuuuaaaauauuauccaagaagaaguaauugucagauagugaugaugugacauuuuuuccaguaaaaaguaaauuuggaagguaggcccugcuuuuacucuaguuagucccuccaccucacucuucuggcuccucaguaauguuuagcaugcauauuccaauagauaaaaucccucaaagguguucaguuucauuucucugaugugaaagggcaaaucaaaugaaaugguuagagacaaugcucaaaauuuaaagcuguaucuaaguuucccaacucgauuaggccauucuuacauugcuaugaagaacuaccugagacuggguaauuuauaaagagguuuaauuggcucacaguucuggaggcuguacgagcauggcacuggcaucugcucggcuucuggggaggccucagggagcuuugacucauggcagaaggcgaaauaguagcaggcacuucacauggggaaagcaggggcagaacagagugugguagguuccacacaccuuugaacagccagaucuccaaaacucacucacuauuguggggauagcaccaagggacugaugcuaagcuauucaugagggaucagcccccccugaucuaaucacccccuaccaggccccaccuccaacacuggggauuaccauucaacaugagauuugaggagacaaaacauccaaacuauaucacuaaccgaguguucagauuguaguauagaaacuauccaagggcacuucaaauguuccucuuaucauugaaggggcugaacaauaauuugacccaaaagcuuggcauucugcuuuuacuagacuaggcugguauuauaaugaccuuuccuuuugaaaaacaauagugguuucuaucuguugucuuguaaagaugaguuuuauauuauuaagaauaauaaaagauuaaaaaauguuuuaagcauuucauccagaagcuacaaagcauuauguuggggaaguuugaggaguuuauuaggucaaucuaggcucuaauauacucagauuauugauuuaaaccggugagcacaauaaaucacacuggucauggagguggcaccagcugaaagugagaacacagaucaauuacccgagaguucugggcuuucucacugacuugccauuaaaaaauuaccuucgugguuucaccucaaagaucagucugcuuuguuuuuuuuuuuuguuuguuuguuuuuuugagauggagucucgcucuuucgccuaggccggagugcaguggcacuaucuccgcucacugcaagcuccgccucccgaguucacgccacucuacugccucagccucucgaguacuugggacuacaggcacccgccacugcacccggcuaauuuuuuguauuuuuaguagagacaggguuucaccguguuagccaggauggucucgaucuccugaccucgugauccauccgucucggucucccaaagugcucggauuacaggcgugagccaccgugcccggcccagucugcuuuuuuuaugcaaacuuugaccgcuuagaaaagcgcuacaagacuggagugguuaugcuuggcucuggugucagagugcuuggauucuagcuaaaauccacccagggagugucgcuuaaccuuauuuucucuccguuuccucaacuguaaagcaagaaaaauaauaguguuucccaaagccuggcacauauaccacugggaguauaccagaugauauuagaugguacaugagugguuuucuucuucuguuaacaauuauguguuuaauucccagcauauuaaaauauauauaauuagcacaucaaaugcuaugguuugaaugugucacccaaaguccauguguuggaaacuuaauucccagugcaacagagguggguccuucaaggggcaauuaggucacgagggcucuggccucaugaaugaauuaauuauguuaucagagaaguggguuaguuaucaccagaauggauuccugauaaaacgaaugaguuaggccuuuuucccucacucaugugugcaugucuuuuauccuucugccauuggaugacucaucaaguaggccuuugccaaaugcagacccuugaucuuagaugucccagccucuaggaccaugagacaaauacauuucuauucauuauaaguuacccagucucacauauucuauuauagcagcacaaaagggacuaaaacaccacacuaaaauuauugcguaggacaaaucuaagucaaggaaaagaagugcgcuccaaacaguccuagucagucagggaaaguucuuuacagaaaaagucuaguugacaaauggaaaauaauuaacagaauuagaaaucaugauuuuugcaauuacuuaaugacauaauugauuuaaguaacaaucaucaauugaagaaacaaucacaugaaaaauuaauauggaacuuuaaaauggaauagucagucuguuaccugccaaaaccaaugaugaaucucagcuucaauaaaacagguucugaauaguggaugcuuccuaauaaacguaguaaagacacccucugcaaagcauucuugccaaaaacauuuacguuaaaucaaauuuagagacagcaucccuuaagaaaaaauaagaguggugaaggaacacauuaaagaagagcauaugaaaccagaaugugugacuuccuacagaacaaaagauccugcuucuauaacaagucuacagugggaauggaggcaggauuucucuagguuaagagacuuaaggaacauauguaauauaauguuugaauuuguuugaauaugaaaauaaggaaaaacaguaaaugacauuuucaagucaguuggggaaguuucaauguggagcuggauuagacaauaccaaauaauuacuguuuauauugcuugauauaauaauggcauugugcuuaaguacaaaaaugcccauauuuguuacagcugcauucugaaauacaucagaguaaagugaagugaugucugcaauuugcuuuaaaauacuucagaagagaaaaagaaaggaggggagggaaaaagacaauaugaagaaaauguaguaaaaaucuugaugauuauugaaucuagguauacaaccugcuugauaauuugcaggacccagagcaaaauaaaaaugcagggucucuuauaacugcuuaagaauuucaaaacagugacagaagaaccaaauaaccacauuaaaccaaaugugggccuucauaagccaugggcucugaacaacucucaggcugcaugcacaugaagccugcucuauguguuagauaauauggaaauuaauugcacuauucacucuacuuggugcauauuuggaaaacuuccauaauaauuuaaaggggaucacuuaaaaauauauauauauaaaguaaagauuauaugaggaaauagcaaaaaucaggaaggcuacaauuggccgcaauuuccaagauacugauguaaucaugaaagacacucaauguggugccugacacacagcaaaugcucagguuagcuccuacuacuguugcuaccaccagcacuaccauuuugacaaagacuacccuuguaucuaguaagaaacaugaacguuuuauagagauuacuacaacaacauuuuacagaaagguuacuuuagacaucgugaaauccuuacugggagaucuacuuauauacagaaagucuuacaauucuuaccaauauuucugauuguauuuugcucccuugugcccuauauucuuuaaaacuugcgagggauuuccaucaaugacagacuggauaaagaaaauguggcacauauacaccauagaauacuacacagccauaaaaaaggaugacuucauguccuuugcagggacauggaugaagcuggaaaccaucauucucagcaaacuaacacaagaacagaaaaccaaacaccacauguucucucucauaagugggaguugaacaaugagaacacauggacacagggaggggaacaucacauaccggggccuauuugagggguaggagucugcggggguuagcauuaggagaaauaccuaaugcagaugacggguugauggguguagcacccaccauggcacauguauaccuauguaacaaaccugcacauucugcacacauauccuggaacuuaaaguauaaaaaaacaaacaaacaaaaaaacuuguaagggauaucaacugugggccacaacagcacuuagaacagaauauuauuacuaacuugaagauucuucugaaagccagacuccucuuuguaauucaagugacaucacuuacaguagcaaagaaagagcaucagaaugaaauaaguccuugugggucucaaucauggugaauaauacugugguuuuucuugaaugagaaagggcauuugcaaaccucaaagggguuuaacgaaaccuuacucuccccuuuaaauguccaaauuaagcuucuuuggaauaaaaccuucucaaaagaaagcaaauguaaaaguuagauuauuguauaugaccuaaaacauuugcugaaucacaauaaacacauaccagcaucuacuauagccuguuaccuaaaucaaguuucacagacccagagaauuccuccgccuuauuuuguuuuuuaaacauuggauugaaaguacuauugaggaucagcaugaucagugcaaaccuuauuuugcacaaagagcaauuuaggaaaaauggauaaggugauaggccaccaauuuauuugucuauccagaaugauaaugguuuuauuaaaucccuuaaagaaagaugaauuuuuauaagcuagacuaucuaauuuguuaaauagcacaucaaucugaauauugucacuguuuuuuaaaauacucuaauguuaauauuuuggcauguuugaauugaggcaacacagaguuuucuaaucguuaaucuuuaacuugaugaagggaucuacacagaaugaagcagacuacacacggcccaaggguaguggagaugugugugguaucuguugcuucuauuaaacauuugcacaugaagcauggguauaugcuagcagaagaacacuuucagacaucccaucccuauucaguuauccuucaaaucauauggcaacaacacaauaagagccacuuauaccuuauucccccgauggaaacucuuugccucuucagagagcccauaaccagcugagggcccaggccugacugguaaccccucagggagggagcauguccauaaaucagcaauauagcagagauggggcuucuuauccuuggcagccauuuucccugccuccccuuccuccccuaggacauccccucucugcccugguaugcaucuuggacacuggaugucucaacucaguuuagaacuuacuaaaacaagguuuaauaaccucauauuaaaauuuucaagacuggcugggcacgguggcucacaccuguaaucccagcacuuuaggaggcugaggcaggcagaucacgaggucaagagaucgaccccauccuggccaacaugcggaaacccugccucuacuaaaaauacaaaaauuagcuaggugugguggcacgccucuagucccagcuacucaggaggcugaggcaggacaaucacuugaaccugggaggcagaaguugcggugagcugagaucacgccacugcacugcagccuggugacagagccuggcuccaucuaaaaaaaaaaaaaaauuuacaagacuaccgagaauccgcaccuccuaagaaauggagaucaagucugugcgagucaucauuccucuugggucucuugauuuaucuaucaauuagcaacacuauuugaccuucuaccuaugugugaucauggauauuaaucagcccuucuuuuuacugauauaauuccuacuuuuucagaaaucugacaaacucacaauugcugauaucuacccuuuccuccuuacgaagauagaaaugcccaucuauaauuuauagacagguaugauuccacaauuuaaaaaauaaagcaaaaaaaaaaaaaauccgcucaacucaaggcuuauacaucacugauucccucaaugcccuuacuuggaaagcaguaauucuuuugagcuaauaaaaugcauguuaugaaccagaacaauaccuuaaagauauaacaaaaguaauuaugauaauaaugaaaaaagugagaauuucaaaaucuuuguguaguucuugaaaguauagugcaguauaaugugagaacugaaggcuguuuaccaaaaauucauauaucucuccuucuaaauauuuauuauuuuugaacagacccgcuuguguggccaggugacuuuagccaguggcauaugugccaauucuguuaaguauuuuaagaaaugguuuuaccuucuuucucuuucucucccuuccaccgucuggauguagauagcacuacggaccuagggaaaggcagaaacacaagaugggagacauaugaaauaucccaggaagaaaacucuuuugcagaagcacugauaccagacucuuacguaaaugaaaaaaaacuuccauuuaguuuaagccauuauuacauuuuggagucuauaaugcuaaagcagcuaguaucacccugguuaauuaaugaaguaaauuaaaugguuaaaagcauauaaccuaccugggacaucuuguagggcaguaagauggaaguuaaaggacaacaggauugaaacuuaaaguguucaaagaugaaaucauaagcaguauggaaccucggagguaaguugggguauaaaagaaacaaaacuggccaugagcugauuauuuuuaaaacagaauauggguauaugagaauugaucacauauucucucuaguucuguauauauuugacauuuuacacaauaaaaauuuaaacaggcagggugcaguggcucacaccugugaucccagcauuuugggaagcugaggugggcggaucacucgaggucagccguucgagaccagccuggccaacauggugaaacccugucucuacuaaaaauacaaaaaauuagcuagguguggucguggguaccuguaaugccagcuacuugggaggcugaggcaggagaauugcuugaacucaggaggcagagguugcagugagccaagauggugccacugcacuccagccugggugacaaagugagcaucugacucaaaaaaaaaaaaaauuaaacacuuuuuuuuaaaaaguaaggauaccuggaguucccacuggccuaggaagggaauaucugagcaucaaaaagguuaagaacagaaacaaauuaaaacauacaaaauuuuuuuuagaacaacagggagagguuccaagauggccgaauaggaacaacuccugucuacagcucccagcuugagugacgcagaagacaggugauuucugcauuuccaacugagguaccggguucaucucacuggggcuuguuggacagugggugcaccccauggagugugagccaaagcagggcaggcauugccucacccaggcagugcaaggggucagggaauuccguuuccuagccaagggaagcugugacaaaugguaccuggaaaaucauaacaaccccacccuaauacagcacuuuuccaacugucuuagcaaauggcacaccaggagauuauaucccgcgccuagcucggagggucccacgccuagcucggagggucccacgcccacggagccuugcucucuguuagcacagcagucugagaucgaacugcaaagcagcagugaggcugggggaggggcauccaucauugcugaggcuugaguaggaaaacaaagaggcccagaaacucaaacuggguggagcccaccgcagcucaaggaggccugccugccugccucuguagucuccaccucugggggcagggcacagcugaacaaaaggcagcagaaacuucugcagacuuaaacgucccugucugacagcuuugaagagagcagugguucucccaccauggaguuugacaucugagaauggacagacugccucuucaagugggucccugagacccaaguagccuaacugggagauaccucccaguaggggccgacugacaccucacacagccaaguaccccucugagacaaagcuuucagaggaaggaucaggcagcaacauuugccauucugcaauauuugcuguucugcagccuccacaggugauacccaggcaaacagggucuggaguggaccuccagcaaacuccaaaagaccugcagcugaggauccuaacuguuggaaggaaaacuaacaaacagaaaggacauccacaccaaaaccccaucuggacgucaccaucaucaaagaccaaagguacauaaaaccacaaagauggggagaaaccagaguagaaaagcugaaaauucuaaaaaucagagcgccucuucuccucgaaaggaacgcagcugcucgccagcaagggaacaaagcuggauggagaaugaauuugacgaguugagagaaggcuucagacgauuguuaguaacaaacuucuccaagcuaaaggaggauguucgaacccaucacaaagaagcuaaaaaccuugaaaaaagauuacaugaauggcuaacuagaauaaccaguguagagaaguccuuaaaugaccugguggagcugaaaaccauggcucaagaacuacaugacacaugcacaaguuucgguagccaauucgaucaaguggaagaaaggguaucacugauugaagaccaaaugaaugaaaugaagugagaagagaaguuuagagaaaaaagaguaaaaagagaugaacaaagccuccaaguaauacgggacuaugugaaaagaccaaaucuacaucugauugguguaccugaaagugaugaggagaauggaaccaaguuggaaaacacucugcaggauauuauccaggagaacuuccccaaucuagcaaugcaggccaaaauucaaauucaggaaauacagagacgccacaaagauacuccucgagaagagcaaauccaagacacauaauugucagauucaccaaaguugaaaugaaggaaaaaauauuaagggcagccagagagaaagguccgguuacccacaaagggaagcacaucagacuaacagcggaucucucagcagaaacucuagaagccagaagagaguggaggccaauauccagcauucuuaaagaaaagaauuuucaacccagaauuucauaacuagccaaacuaaucuucacaagugaaggagaaauaaaauccuuuacagacaagccaauacugagagauuuagccaccaccaggccugccuuacaagagcuccugaaggaagcacuaaacauggaaaggaacaaccaguaccagccacugcaaaaacaugccacacuauaaagaccaucaauacuaggaagaaacugcaucaacuaagaagccaaauaaccagcuaacaucaaaaugacaggauuaaauacacacauaacaauauuaaccuuaaauguaaaugggcuaaaugcuccaauuaaaagacacagacuggcaaauuggguaaagagucaagacucaucagugugcucuauucaggagacccaucuaacaugcagagacacacacaggcucaaaauaaagggauggaggaagaucuaccaagcaaaaggaaaacaaacaaacaaaaaaggcagggcuugcaauccuagucucugauaaaacagacuuuaaaccaacaaagaucaaagagacaaagaaggccguuacauaaugguaaagggaucaauucaacaagaagagcuaacuauccuaaauauauaugcacccaauauaggagcacccagauucauaaagcaagaccuuagagacuuaaaaagagacuuagacucccacacaauaauaaugggaggcuuuaauaccccacugucaacauuagacagaucaacaaggcagaaaguuaacaaggauauccaggaauagaacucagcucugaaccaaguggaccuaauagacaucuacagaacucuccaccccaaaucaacaaaauauacuuucuucucagcaccacaucguacuuauuccaaaacugaccacauaguuggaaguaaagcacuccucagcaaauguaaaagaacagaaauuauaacaaacugucucucagaccacagugcaagcaaacuagaaaucauaaucaagaaacucacucaaaaccacucaacuacauggaaacugaacaaccugcuccuaaaugacuacugggcacauaacgaaaugaaggcagaaauaaagauguucuuugaaaccaacgagaacaaagacgcaacauacuagaaucucugggacacauucaaaguaguguguagagggaaauuuauagcacuaaaugcccacaagagaaaacaggaaaaaccuaaaguugacacccuaacauuacaauuaaaagaacuagagaagcaagggcaaagaaauucaaaagccaacagaaggcaagaaaugacuaagaucagagcagaacugaaggagauagagacgcaaaaaacccuucaaaaaaucaaugaauccaggagaugguuuuuagaaaagaucaacaaaauugauagacugcuagcaagacugguaaagaagaaaagagagaagaaucaaauagacacaauaaaaaaugauaaaagggauaucaccaccgaucccacagaaauacaaacuaccaucagagaguacuauaaacaccucuaugcaaauaaacuagaaacucuagaagaaauggauaaauuccuagacacauacacccucccaagacuaaaccaaaaagaaguugaaucucugaauagaccaauaacaggcucugaaauugaggcaauaauucauagccuagcaaccaaaaaaaguccaggacccagauggauucacagccgaauucuaccagagguacaaagaggaccugguaccguugcuucugaaacuauuccaaucaauagagaaagagggaaucaucccuaacucauuuuaugaggccagcaucauccugauagcaaagccuggcagagacacaacacaaaaaagagacuuuuagaccaauaccccugaugaacuucgaugcaaaaauccuucauaaaauacuggcaaacugaauccagcagcacaucaaaaagcuuauccaccacgaucaaguuggcuucaucccugggaugcaaggaugguucaacauaugcaaaucaaaaaacguaauccaucauauaaacagaaccaaagacaaaaaccacaugauuaucugacuagacgcagaaaaagccuucgaaaaaauuugacaggccuucaugcuaaaaacucucaauaaacuagguauugaugggauguaucucaaaauaauaagagcuauuuaugacaaacccacagccaauaucauaccgaaugggcaaaagcuagaagcauucccuuugaaaccuggcacaagacagggaugcccucuuucaccaauccuguuggaaguucuggccagggcaaucagacaauagaaagaaauaaaggguauucaauuaggaaaagaguaaguccaauuguugcuguuggcagaugacaugauuguauauuuagaaaaccccaucgucucagcccaaaaucuccuuaagcugauaggcaacuucagcaaagucucaggauacaaaaucaaugugcaaaaaucacaagcauuccuauacagcaauaacagacaaacagagagccaaaucaugagugaacucccauucucaauugcuucaaagagaauaaaaugccuaggaaugcaacuuacaaaagaugugaagaaccucuucaaggagaacuacaaaccacugcucaacgaaauaaaagaggacacaaccaaauggaagaacauucuaugcucauggauaggaagaaucaauaucaugaaaaugguuauacugcccaagguaauuuauagauucaaugccauccccaucaagcuaccaaugacuuucuucauaggauuggaaaaaacuacuuuaaaguucauauggaaccaaaaaagagcccacauugcuaagucaauccuaagccaaaagaacaaagcuggagccaucacgcuaccugacuucaaacuauaccacaaggcuacccaaacagcaugauacugguaccaaaacagagauauagaccaauggaacagaacagagcccucagaaauaauaccacacaucuacaaccaucugaucuuugacaaacaugaaaaaacaagcaauggggaaaggauucccuauuuaauaaauggugcugggaaaacuggcuagccauauguagaaagcugaaacuggaucccuuccuuacaccuuauacaaaaguuaauucaagauggauuaaagacuuaaauguuagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacucaagagcuucugcacagcaaaagaaaccaccaucagagugaacaggcaaccuacagaaugggagaaaauuuuugcaaucuacccaucugacaaagggcaaauauccagaaaucuuccaagaacuuaaacaaauuuacaagaaaaaaaucaaacaaccccaucaaaaagugggugaaggauaugaacagacaguucucaaaagaagacauuuaugcagccaacagacacaugaaaaaaugcucaucaucacuggccaucagagaaaugcaaaucaaaaccacaaugagauaccaucucacaucaguuagaaugacaaucauuaaaaagucaggaaacaacaggugcuggagaggauguggagaaauaggaacacuuuuacacugcuggugggacuguaaacuagugcaaccauuguggaagacaguguggcaauuccucaaggaucuagaacuagaaauaccauuugacccagccauccuauuacuggguauauacccaaaggauuauaaaucaugcugcuacaaagacacaugcauacguauguuuauugcggcacgauucacaauagcaaagaccuggaagcaacccaaauguccaacaauagacuggauuaagaaaauguggcacauauacaccauggaauacuaugcagccauaaaaaaugaugaguucauguccuuuguagggacauggaugaagcuggaaacaaucauuuucagcaaacuaucacaaggacagaaaaccaaaaaccgcauguucucacucauagguaggaauugaacaaugugaucacuuggacacaaggcaggggacaucacacaccagggccuguugugggguugggggaguggggagggauaccauuaggagauauaccuaaugcuaaaugaugaguuaaugggugcagcacaucaacaugguacauguauacauauguaacaaaccugcacauugggcacauguaccguagaacuuaaagcauaauuaaaauauauguauauauauuuuuaaaauccauaacuucauaaugacacaugcaugaaaacucauuagacguuaaugaaugaaugccuaauaacuucuaguugguaaccaauguuaccaaauagaaguuauuaggcauucauucauuaauuaaaaauuaaaauaugauaaacaauuaauuuccugccuaugugaacuguauaucagaguaaccaaaugguugauaagaaaaaguuuuuuuauagaucuccaugaauaaaugcaggagaaaugacacaacuagaaaacugcuauuuugcauccccuaaugauauaagaccuauauccagauauaggaaacuacuaugaguggacauaaaaccaucaguguaagcaugauagggaacuugguaacagaacagucugacaauaccugaaugaacuaacucauguuaucuucacuaaaaggacauauaucauuauuuccuucaugcugugaugaaauaggacauacauagcaccaucuaugaaguauucuugccuaaaaaaucucuauaaaaucuagccaagacuccagacuaaauaccagguuauaguggugauuggguucaggacaugcuuuccuaaaauaugacaccuugguauuuaagaaaacagcagaagcgggaaggucacucucaccuucugccguucucuccugaagcaggucaugaaccaauggaaggauuuuuuugagcguccccuggagcaggucauaagaccauuuuagaggugcccuccuuauacauggaggaaaggaacauccuuaccucugaagacacagggacacagagaagaagcugaacaaacaggccuugcuaaguucccucccccaguuuauuaccauuagaucacacucccaaucauauguccaaucauacuucaccucuucccacucuucaucaaaccuagcauaaaaaguacacgguuuaaccauuucuuugggccuucauuuccuuaugaaggcucccaugucacaugaaacuuauauuaaauaaaucgguuugcuuuucucuuguaaaucuaucuuuuguuauagcggcuuccaucauaaaacuaggaugggaauaaaagguauuucuuuucccauacagagaaauaaauuaaacacugccacaaaaaagcgaacagccaucuucaaaauauagagcaaaugauccaguuucucucacaaaucaaaguuauugagaggaaggggauaagaggacuaauuaaaaaaaaggagacaagcaacauaacaauucaaugcaaugugugaaucucuuuuagauucugacuugaacaaaaccaucaacaaaagaacaauuagggaaaugcaaauauggacuggauauuagaaaauauuaaggaauuauuauuaauuucauuaaaugugaugauggcauggaauuuaaauaaaggagguaaggcccuuaucaguuagagauaucuacugaagaauuuucaggugacaagauaugauauccagcauaugcuuuaaugcgcucaagcaaaagaaaagaaagaacgaaaaaauaaaauggggacagaggaaguaagauuggcaagauauugauaauuauuaaagcuggaugaugcacgcauggguguucauuaugcuauuaguucuacauuuguguauauuugaaauuuuccaagauacaguuuuuuaaggcacaagauaggagucagacauugguuggaccagcccuuucacuuccagcugggagaaacugggcagaucacuacagccugcacauugcccuccuuugugucaucaagugcacagauauuucuucuaagaaugcuccaauacuauuccuuggauuuucuuccgagccauagacaccuauuuugugaguuuugaugcuucccuuucaauacucauacacgugcagacaaacaacaguugucccaacugcuaccuaucugaagugauuauaagugacuaucaauuaugacauauaucccaauuucaaagauuaaaaugugaaaaaaaugugcguuaaaaaaaucuaugaagaaagagaccuggagaugaaguuauaauaaaaaugucuaugacaaugagauuuucugaauaccuacaaggcaucuccugcuuuggcuccauaaguaccacuaucucuguuuguuuguuuguuuguuuguuuguuuguuuguuuuugagacagggucucaaucccucguccagacuggagugcaguggcaggcacuccccaggcucagaugauccuuccaccucagccucccaaauagcugggacuacaggcaugcgccaccacaccuggcuaauuuuuguauuuuugguacagacgaggcuucaccauguugcccaggcugaucucgaacucuagccucaagccaucugcucaccucagccucccaaaguucugggauuacaggccugagacaccaccccuggcuucuuggguuauuuugacugacauaucucacuggcuaaaauacuuccauuuuucuagaagcuacggcaacuaccacuggguuggcaaaugacaggcccuggaaauguuucugauagauguuuguugcaugaauaauaaauaugcaaauuuuaagccaaaaaagaaauauaacacaugcaaagagauguggggagucucgugcccuucuguauaaaguucuggaagcuaauuuuggaaacucuaucaagaaguugugugugacuauuuuuccaaaguagagucaaaauucaugaggcagggcaaaaguuacacugcaucuaaugaugaguaagaaugcacaucuguucccuggagcugcucucuauacacauauucuaguaauuuccacacaccaucagaagauagaagauggagaaaaccaguaaagauauaaucuuugagaaaagacuuuuguuggagccuaaacauaaacuuuuccuucaaguccauguccugagagagguuuguaaaugugugaccuaaaugaggcuaccacugaauuuuguuucccaauaucccucagagaggcuauaaggcauauacaaauucuacuuaaaagcaaaucaugguaaacauuuauuaaauuuuauuacgcaccaaguaccacacucguguucuucccaggacugccaaaguuggcugaacccugaugcaguaacucugcagauguaccuauaacaucucaacuaauccuagcagcaacccugcaaagaacaguaccaccuuacuuauauuuucaggauagagaguaugaccuuuagaaagacuugcuaacuggcccaaguucgacagccgguaaauagcauauccaggacucacacccacggcuaugaaaaaucggugcuugcggcuuguguuuuucaccuaaauacacaaguguuacaugaaugaacugugauggaggaucagcauuguuccugccaaccacacccaccugcagucuagcgcagaucaauacuuuuacaaagugcaaugaaaaugaaucacuggggaauaaaggcauucaaaguaaaagucaaaaguuguuauuggagucaacagacaaauuuaugcuguuauugcccacgaguuucuaaauccuuacucucaauuuauaugcuuauuuuguugcauacuggcaccaggacaaggaccacccuuugaguagugcugcacuacacuuuauuguuagauccaugcuuagaaugaacacauuuauaauaagguuccaagaucccuccaccuauugagaggcugguaauucuuuuagauguuaauuaaucuauuuuuuuuuaaaugaagaugacuuuuagcauuuucuucuuuccuauaaagauucaucaagauaucagacauagguuccaaagucaacaaaaauaaagaacuugugaaauuuucugcugcuguaugauacaacugcugugguauuuugauaaauauuaacagaaaaugugaaacuuugaaauauguuuccuuaccaagggaacaaugaauaauaaugaaaccagggaaugaggacuagaagcaccaggugcccccgccucccauccacugcagggaaggacucucuuccaaauccacccugaaaagugaguggcuguugggaaacuaaaaaauguacuuaagagaucucaaauauauggugacacauggaauucuucaaccugccaugccucuugagaaguucucagguaaauaacaagaaugaugcccacaauacauucacauacauaaaaaaaauguccuggaaagaaaaagaggaugggagaagaaguuaaugauucuuggggcuuuuuaaaaaaauuguguucggcugggugugguggcucacaccuguaaucccaacacuuugggaggccgaggcagguggaucaccugaggucaggaauuugagaccagccugaccaccauggagaaaccccaucucuaccaaaaauacaaaauuagccgggugugguggcgcauggcuguaaucccagcuacucaagaggcugaggcaggagaaucacuugaacccaggaggcagagguugcagugagccuagaucgugccauugcauuccagcaaccugggcaacaagagcaaaacuccgucucaagaaaaaaaaaauuguguuuaaaguuucaaguuaauuuuuuuuaagucaccauagcucauauggccuugguaugaguugaugggucaaacccauagcuucucuggcuacucaggaaauuaguaaaggagggcaaggaaaggcacaauauggaagagagaaauuacuagacaagaaucagcaaucuggagcgaacccaaucuaaaggaaacaauuagaaacuggcacaggucccaaaucaauaagcagaggugacugugggcagugagcauaauggcuggguaaugaaaacuaaaaugcagguaagcaagcgcugggaaaggagcagcugaugacagggucaucuguccagaggcuugaagagaccugucugaacaggcucucacagcccagcuagucccugaugucacagccugugugaauaaacagcacuggugugguauccccaaacuucauaagaaaugaagucuucauggcucaccuugucaaggccagagaacaaucccaacaggaaaaacacuucuuacagauuaugcaguggauucaaagagcacuggaacuguauuucccauuagcucuaauggagguugugcuaauaaauuccccagcucugggcugaacagguguaauucaguaauguagcuauaauugagugaugucaacucaauauaauuuguaauguuuuuguaacaaauuaucucuuuuuuuuuccagaaaaaaaggcaucugugauuccauaugauaaauuacuuuaaaagggugacauacagugcuaaugauaaagaucuuuaauugauagaaauguuaauaguagcaucagcuaagaauuaucuuugcugauucuuuauacacaguaacauuuuaaacauaacaagcuuucguuuuugaccaaccaauguuuuugauuugugacucaugguuuucagauauuucuguauuucaucaauauaacuauucuacuagagagguucuguauaaacccugcaauuuagccauucccuucccugcacaguucccaagccagaucuagacauuucuaccucugugccuaagagaacacuggucuccuggucuggauggacagcugucuccuccucuuccauguaccuaagaaugaccuguuggcccagucaaaacccuccuucuaugaagcuuuccagaccuauagccaggauuacucuuucacacccuauaccccugggacacuuuggggucccucuauuacauucuuacuuuucagacccccuuguacaugcuauuccucugcugcucucccugguuagggcccacucauccuugggguuucaguucaacguuauaccucaaggagaaccuucccugcuuuggaacagggcacauuacacgugcauuugcauaccucugcauuccuuuccuuuguugcacuaaccacaguuguuguuaguaucuuuuguuuguuuguuuguuuguuuuucaggaaaaaaaggcaucugugaugcgucucuuuuccacuagggcuaggcuuuagacaaggucuguguugaguuuuccuaaaucuaguagcaaggacaugaugcuccauaucugaagaaagaaugcauggaugaaugaaugaacaaacacuaucucugucugucucucccuaccucuaucuguccucuccacuaaacuugaacucaaagguaauacagugcucauuguagccacaauaaugccuaauuagggucucguccauaauagagaugagaaaaacucaguugaaauaaauuuaauuucuccuacuguaguguuaacaucagguuagucauagagaauucaguucccaaagcuuauaguguuuuucaccauaugcuauccacugacccucaucaagcuccaaccacgugcuagccccucugcaagauacuguggaagagaagugaaugauauuuagaaccaaguacucuacaguuucugggugauucccauguauaaccacauuucugcauucaugccagauacugggggaauucaagguuaaucaaacacagaugguguccucaaggagcucaggaucugggagaagagauaaaagugaagaaaaaauaucaugagguggaauccaugagugacauaaaaggagucccaauacagauucuagguguucuaaugagggacagagagaauguaggcuuaaguggggguauuuuuuuuaaguuuuauuuuuaauuuuuguggauacauaguguauauauuuauggguugcaugagauauuuugauauaggcaugcaauguguaauaaucacaucaggguacggucuccaucaucucaagcauuuauccuuuguguuacaaauaauuaaacucuuuuaguuauuauccuaaaaugcacagauaaauuguuuuucacucuagucacccuguuguguuagaaaauacuaagucuuauuuauucuuucuuacuauuuuuuguauccauuaaucuuucaguggggacaguuuuuaaaaugagucuuuaccuguugggugggauggcucacgccuguaaucccagcucucagggaggcagaggcgggaggauagcuugagcccaggaguuucagaccugccugggcaauauagcaagacaccaugcuccacaaaaagggaaaaaaaugagucuuuacccaggugaagauugggauuagggacccagccaaaaggaagcgagguugaagagcaagaguguuuauuccuugguucaauagaucuuugucaccuacugugugaggcauaaauaaaccuaaguccauucucaaugcagcuuacauucuaauuguggagacaggugaaagcaaacaaacaacaaugccagguuauaaugagugcucugaaaaaacagggcagaguaagaagcgaagcugaugagagugcuaccccagacaagguggucaggggaggccuucccaugucaaugacacugaacaaugacuugaaugaagcgaaagagugagccauguaacacgccuugggaagugcauucccaacagagaacagcaauccucuccacagaggaaggacagaugacccacaccuuuuucaaacuggggucucugagcauguucuuagggaucugaauguucuugaugagacuuuuuauuuuugguuuuauuuagauaauacucacuuaaaauaguucaaguguauucugcaucagcuacauagcaccuaaaauacggguaccagcacaaaaguuuugugacuccuuuauguuugcauuuauaauuguggugguaucagguauugcuguuuuagcugucacaagcaaaagauaaaaaaaacaaacuuacuacuuaaauaauguguuugugccucaugaucucagaguagggguggaguacauaugaauugucccaguaauagcagcuggaaguguuagggaaauugagucaucacacagccuaggcuaacacaaacaugacaagcuguguagaaccuuugacauaacagacaucccguauugauguuuccagagaugauucuguuuaaacaaauaauaucauucaucuuguuaaugcaauauuccucauuugaauuuaguuuugucauuuugauugcauguaauuuguaaacguguuaugguuucauauuugucuaagaaccacacaaagaaauucauaccuacuuuuguauuuucaugugguucaauaauccaauaacaaaaacauuaaguuaacauuggggguucauaagacuuuuuuuucccuuggaauggcauccauauguuacucaagguuggucacagugaaagcuggugguggaaaaggccuuuguuuuccagaaccaugaccaggugauagcucuggaugguuuccaaugaaacacacaguaaguacaggaaagaagggagaugaauaucuuugguaggaaaaaaaaaaucacaaaucagauauaccuaaugacuguaacuuuuauuauucucugaacaccaaggaacguaaaggccauaaauuauguuacauguugguuaauucuccuucagaacacccaggccauuggaacauuaaauguggaaaguauguggcgggggagagagggugaagaagcuauaaugaaagguucacugcacucggguggcagauuaaacacagagccagaugaggagucaagcgucacuaaaaaugcaaaacaaauccagcuaaauuauuucaccugcaaggaaaaguuuuucucacaacacaacacuguucuaugccaacaaauguaaacaagagcuaagacgacuaucugaaaagcucaggcaguuggugaggaaggcuccuugggucacagaacccuccaaaacuucucacuguagcagcugagagcuggcaucugaaaucaaacuggguagaguucaagaaucaccucuaacagagauuagcucugagaccuagcaaguucuuuaauaucacagaaaaaaaaaagacaaaacaacaccuacauuacaaaguuguugaaaggauucacugagauaauccucauagaccacuuagaacacugccuggcacguaauaaguucuccauaaacgugagccaugaguuuuaugaugcuauaggucuaugauuauauaagcaugagucuccacauauggcacaacaaacugcucuacucaacucuacagcccuggaugaugucuccacauuuuacauauuccaugauaguuuccaauaauuuauauacauguaaaguauauuugagauggucgguaagauaacaucauucucauucauuccccuccccaauauaguuccuaaggaggaaagauaugaauagugcuaugguuuggauuuguguccacgccuaaaucucaugucaaauuguaaucuucaguguuggaggaggggccuggugggaugugacugaaucauggaggcagacuuccuccuugcuguucucgcaauaaugagugagaucugguuguuuaaaagugugcagcacuucccccuuuagucucuuucuccugcucccaccauguaagaggugccuccuuccucuucaccuucuaccugaggccucuccagccaugcuuccucuacagccuguggaaugugagucaauuaaaccucuuuucuuuauaaauuucucaguuucagguaguucuuuauagcaaugcaagaacggacuaaugcagaugggucuacagaaagagcauaacccaacaaccuuacaugguagguaccauuauugucccuauuuuacaaauaaacaauguccagagaagaggauggacuugcucaaggucauacagcucauaaaugaugcagccaggauuugaggucaaguagucccagucuagaaucuaccuucuuaaucaccacaagacucuacuccuccaaacaaguguccuuccucuguguccaguaaagaggaacucugggaacugcuggucacauaauuguuuauuccuccagguuccccaaugucuggcccuagaaaaugaggauguuucacucccaacuaagcauuucccuaagcuacuauuuguuaugcuguuagcuaagauagaaagucaauuuuaaaaucguccauuugaacaguuauaguaacuuucguaaaugguaaaugaaacaauuugaaaacacuguccaacauuuuacacaguaucccaucgaccacagcuaacuaaaguaauucacaugugaauuuuauucucaaaaaaaguguaugcuuugcuuuugacagauaaugaaagccauuuaauucaauguggcuuuuuuucuuugcuuuuuccuuuuuuuuuuuuuuuuuuuuuuugccagaaagcagugagauaaauugaauacccauaaacugaagaaaaucuguuaauuuggggugucugguuacaccuauucuugugcuuuuuuaaaagagagucugccaaaguuuauucucuucuuaaauuaccucaucugagcaguauuuucauuuguaaauaauggccacauauucucuuuaaaguaggaggaaauggagaccuuaaguguuucaaggaaacuucaggucccucaaaccuccuucaaagaaaacaacugaugauugucuuugaggcaaggagacacuagucaucaggccaucaagggcagggaacaaccugaacacuuugcagcucugcacuacagguccucaacgucguucuugcauuagcccauucuugcauugcuauaaaguucauucaaugccaucugguuauaacaccgacagaaaauaaauugauucccaguggggccccugucuauguagggucugaacauucuccccaugcuugcaugaguuuucucugggcagucaaguuuucucccacaucccaaagaugagcaugguaggugaaccggcaugucuacaugguccccaucuuagugaguaugaguguguguguguagguguguaggugaguggguccugcaaugggaugauguccuguccagggugaguucccaccuugcacccugagcugcugggacaugcugcagccauccgagacccucaacuggaauauaaauaauuaucuuaccuguuuuuauuacucuuucuuaaauguguauauaguucgcauagauuucaauguaaaauauucaaaguguuuuggucuauuuagaaguuugaugguauaguugugaccagaaauaugccauaggaacuuaacucuuauuuauaucaauuagucuauggugaaauugguuauauguugcuuugcuuuaugucccaguuuccaggaaccuaucaaugacauuaaguaaggacuuacuguacuuuacuauagcugaacaggcugccacccaaaaccauaaugagcuacuaugacgacagucaaucaggagacauaucuguguuucagagaagaaagccagcagcuuucugggaaaaagcacagagggaaacuccccuaagcuggagcuauuuccuagcaguaacuugcugcugcaguuuagcccugucaucuguguguacuccucauuaaguaccacauuaugggccaucauaucuucuccagcugcaaguaaaggcaauguccuggaauugcccuauggcccaaaugugugacuaaugacugagacuuuggcuucuugcuugauguuuggccuucaguauuacaugaaccugcucugaaagacacaacacugucacagauguaugcggacagauuaagcuccagauggaaggcugucaaugucaaucagucacuguucuuacagccuggcuggcuuuucaucuaagcaaccacagagcaugauccugcagcacucaguuccuuagcucaauuaagucuuaggauuggaggucaaguuacccugguuuccuaagcauucucuaccaaaugauuguuuuugccucacuccuacugauucauuuauaguagcuucuuuugaugcauucauccuugagcaugucuucccauuuccaagugacuuguuucacuauucugcagaauguuccagcccuuugaugaacuauauauaauugucgaaucagcugucccacaaagagauaaaaucugaauuaaauacaggacuuguugucaggagagaacagauaaggugaagaauuagaagacuagcugggaagaagugagaugauugaaguuuaugaaacauuuuccccccuccuuugagucucccaaucugcuaguuucagucgguugguuuuguguuccuguugugauauauguuuaguucaaggcuguggacuuugugccuugguuacagguaagugccucuguguuucucaucuuuaucuauccagucacuugucuccucucaaaguuucacuuuuuaaauauauauauguuauuuaauaucaaaagaauaucuucaccuuucauaaauugcuaacccuagacucuggaugccuaggguaaauuuuuaauucuauuuuauuuauuuuaauuaaauuuaaauuaaaauuuguuuuaauuaaauuuaaauuaaauaucuaauucuacuuuuauuuauuuauuuaauucuauuuuuaagucuauggacuugcuugaacacacagcucagcaaugaugcaggcaggauucaaguccaggcaaaucauggcucuagagcuuguguucuuaacuuccacaugacauugucccucgggaggaauauuguaacucccuacguuuccauuccaaacucucaaauauaaaaugauaauuacaagguacacguuauugcaaaacauguauaaaagcauauaaaucaaagauuacauuuugccuccucuucuuuuucccaucccucuacccucauauccacacaauuucauucccugagggagccuauauuaauaauuuggcauguacauuuuugcauacagacauauauuuuucuaaguuucuauaauacauacuguucugucacauguuugacaucuuuucaugucaauucauagagaugcuuguuaauggcugcagaguaauuucaauguauagacauauaauacuauauauaauacuauauugaaccucuuuagcuacuuggucaaauauaucuacagaauacguuacuagacauuucaaggaauuucuaugucaaaauauuucaaauaguuaauaguuccaaacuucccaauccaaguauaauauuuuuauuuauauccacaacaggguaucccccugauuuugcccauagugcuuauuauccuaaccaacugauugauauuuuuaguuuaauuauuuaaaaaaugagguuauaaugaggucccuaagagucccuuaaccuaauuuacuaggaucuacuuuaucuggagaguaaaauaaagcaacuacccaaucucaaaauauccuuuugccccucccaaaugacucuucuggaaucauuuauaugcugaccuccauauaauuuauuggauuuauacgaucuuauaucucuagauugaguuacaaauggaugaaucucuugaaaccuagaccaaaaaauaagaauagaauaaaaaaagaguuuuugguauggaaacugugacucuccaacgucaguagagacauugagaaugguuucccauguccccaggcauaaacuaaaauauccacugcuuuuggacaguauaaaugcagaauaugcccccagaugaauagaaaugagcaaaucuugagugcagaacugaauuucuuggagcuguauugguuaccuggagccaugaauuaaguggaucugauucuaucucuuaaaggaacagaaaaaaaauuauuccaggugauuacugcuccucaagcauguggucacucaaaggaccuucuucuagcuccacgggauacauaguugcuauucaucagcucugcucacugaagaugcugugcuacgcauuccaaauggcgccuuggaggacuaacugauaucauuaacacagacucguagagaugucaucauuuucuucuucaucaucuucgucaagauuaguuuuaaguguugggaguccgagguggguggaucacgaggucaggagaucgagaccauccuggcuaauauggugaaaccuggucucuacuaaaaauacaaaaaauuagccggguguggugggugccuguagucccagcuacucgggaggcugaggcaggagaaugguguaaacccgggaggcagagcuugcaaugagcugagaccgcgccacugcacuccagccugagcgacagagcgagacucugucucaaaaaaaaaaaagauuaguuuuaagugaaccauguacuaguucucaaaucaaccacaucggguagguuccauuauuauuuaauucugcagaugugaauacaaggccacaaguucguaagugauacugccggggcucaaaccacuuauguauuaugucaaaagccaugcucuuaaccauugcacuauacucccuucuacaggcauaaaauuuuaaaaauauauaccagaagagcaaaacaaucccaaguaugggaaggaugaaagagaaggguggcaguuggcacaguggagcauaaugggccagucugacuguaagacuccuguuucauaaugucugcaugucacuaaaaaggaucuagaccaagguucacaaacacaaaugaauaugggggccaggacguuaacauacaugaguaaagaggaccaagugcaugacagaaagaguggugaagaacgugguaaacugaaacacaugccucaagggaagaaggcaauacucucauguguguaugugguucaaauguugccaaaucuaugaauuuuuuuaacagaagaaaaaaaauccaauuuuaaugcaaaauguuucuauuuccaaauuaugauuucaaugucauguuuaaaaacacuuugacgaugacuuaguucccucugaccuccacacauaagcauuaacauggacagaaguauagcagcagugugaggugcuuuuccagcagccaucaguccuucauccuugcuaacauaccuugaucuuucucagguaccugcaggugguaguguguccagggaagauaggccuuacucucagcauaagaggcugaaacguacuggucucagccagugaagguaacugaauacuucauugacauugacuggucugggaugggaugcaugugugacucaguucuagccaaagagaaaucgaaagauaucugcuaagagacuuuaaggaaagauuuucuuuccugaaauggaaagagagagagaggcccaccacgagauggcccuuuuugcucccuucccuccuauccuguguugaaugcuaauccaggacacugugguguugaaagcucuggcagccauuuuguggcaugagguaacaagucuaaggauuaaggccaauacaccgccaaugguggaaugaaagcaugaaaggagcuuggauccuuguuuagcagccaaaucaacacugagacuacuuaauuugagguuucuuauauaggaaacaguaaaucuccuugugauuuaugguacuauuaguuggguguucuguuacuucauacugaauacauucuaaugaaggaucucacuuucaaccuuacuucagaguucuagcuuuuuguuuacagcauccuucaugcaggaaaacuucaaguuuacacagagugugcaacuagaugugagauaaggcucugccacuugagaacgcccacacgcugcuucaaaaauuuaaauuaugcuguuagcuuuucaagauggaugaaauccuucauaggaucauauagcaaggacuaaauugcucucacaguugccaggcaacuguguauaugcugccuagagacaaaaauucaugacccuugacuccccaaaggagagucuuuacccacaacugauaugcaugugcccaagucuaacacuuccauccagcaaaggucaugguguacaucugggcuauccaacaucccaagcucauuauacugccaacuuauaucauucuugaucacaccauaaauuaugauuucugcaugcaaauccaaaugacagagcagagaguguccuggggcauaauucccuguccuuuggccugucuuauuauauagacugauuggguaccauccaggcaaacaaaaaaaagacacaugaagauuccuauuagccugaagaaucacugucagguaaacagaguuuuguaaacagcuuccaauauucaaggaaaguuugaguuuucacagugaguaaugugaucaacuuuaauaaugucucaaggggcuucuaucucacgagucauuuucaacacacacacacacacacacacacacauacacacacaggcuaagaugugcucaucauucuauuagaaaggaaaucucaaaaugcaaauauagaugguguguucacauuuacauuucauaaugaucuaaguguuuuguuuuugcaugugaauuucauaauacuuuaaaucauagaaucauggaauauaaaaaucaaaagugacccugagaucaagaagguccaauccaagagaaauuaaauggcacagcugcuuaggggugaacacugaauccaaguugcuggacucucagucuacugcgcuuccccaaaacuaacaugcuugucccucaggcagucaacccuuaaucauugugaugauaaacaucagggacaacuuaauuucaacuugacaauaaaucaaacucuccauguagccauuaguugcuguacuagucagaaaaagguuaaguugaaugugaaccacucuuucacuaccucccaccucaaaaaaaaaaaaaaaugaacggaagcuugaauauacaagcuuuuauucucucauuuaacaaguuuggagaucaguagucuagugcugacauggcaguucuacagacccauuacagaccuagaugccuucaacuuacuguaucuccauuccuagagggugacugucuuagucugcuuugugccgcuauaacaggaccugagacuagguaauuuauaaacaacagagauuuauuagcuuacaauucuggagucugggaagcccaagaucaagggcccacaucuugugaaagacuucuugcuguguuacacauguaauaaggcaccacaugaugagaaacagcacgcaaaggagcaagaagugacuaaacucacuuggauaacaaacccacucuugcaauagugaacccauuaacauaauaaugacauuaauuuauucacggggguagaucccccaugcccuaaucaccucuuaaacaacccacuucucaacacuguugcauugaggaauuaaguuuccaaaacauaaacucugggggacacauucaaaacacagcauucaucuucuuaacauagccaaaaaggccgggcaugguggcucacaccuauaaccucagcacuuugggaggccaagguggguggaucaucugaggucaggaguuugaaaccagucugaccaacauagugaaaccccaucucuacuaaaaauacaaaaaauuagccuugcguagugacauacaccuguagucccagcuacucaggaagcugaggcaggagaauugcuugaaccuaggaggcaaagguugcagugagcagagauugugccauuugacuccagccugggcaagaagagcaaagcucugucucaaaaaaacaaaaacaaacaaacaagaaaacagcaaaaaguauuaaugagccguuaugucugcaccccaguuggcagcaaggaggaagcuguaaugcaucuucucuuuaagaauucuccuaguuaguguaccccugaaagcaaagccuaagacaaggaccaagggcauagguuuggguagauuauuuggauggugaucucagaaaauuugaaagaaagagaugagacaguaaacacuggaaggaaaaaggaaacagcauguguuaucaacaccuggggugcuaugugaggagcuguguggaauguacccacaacuguccaucugauagaaggcuguggcaacccaccaauugguuaagcauugccuguagugcuguuacuuccccggcuaugcuugugcgugggcugggaagccuucuuuugguuuugaguaaggccuaaaccagaauaguagauguacagcacagcagaacuugaggacccuggcagcacaugacagcaucugccacagcugcaaugaaauuagguggggauagggaauguggcacugugcaccugcuacaagaaaauguccagaaaguugcucauaaaguuucuuauuaucucuaugcaucaggaguccccaagacaauccuuagacucaaugauucacuaaaagacucccagaacccagaaaaacuauguacucauggugaugguuuguuacagagaaaggacacagauuaaaaucagcaaaguaaaaagguauauaggaaagaauccaggagaaaacaggcacaaguuuacaguguccucuaccaguaaaaucacacagcugguucuuaauugucccagcaacuauguaugacaacauguauaaaguauugccaacccaagaagcucaccugagccuugguguccaugauuuuuauugggggucagccacauagacauggacuucccacacgaaugaccuuaauuacccagucuccaguccccccagaggucaaauugauacaacauagcccagggcuucaggugaacagaaacagcauucaccaacaaucacauugucaguauaaacuaucuggcaagacccacaguuucagguauucaaaggcacuuuucucaguuagggugcuucaaaagcuccaagguuaucucuuuggagauggucaagggccagucuuuuauuugguaucugcagaauuugaacaccccaagccuugaguuaacccuuuacugaacaaccuguuuggucagaacuuagucaaauggccauaaccaccugcaacaaaaguaagaaaugcagucuuuguucugggcagcuauauuccuacucaauauuugggaauucuauuauuguauaauggugguucucaaacuucagcacaucagaaucaccuggagaauucauuaaaauagacugcacaacccccuccucagaguuucugauuaaguaaguguagggugaggccugagaauuugcauuucaguaauuuaccagguguauuacuauccgaauaaagccagaacaaauuuacacaaacuuugggcuuaaaacaacacaaauucauuaucuuacuauucugugggucagaagucugacacaacucgcaccaagcucaaaucaagguguaagcagacuccuuucugcagucucuaaggaagaauguuuccuugcucauuccgguuguuggcagaaugcaguucugaaguccuguuuccuuauugccugucagcugaagaucauucugaauuucuaaaggccuuccacauuuguuaggagguugaccccuccuuccaucaucaagucagcaaugagggguuggguucuuuucaugcuuugaaucucaccugccuccucuaucgccauaucuuucugauugcagccugaaaagguucucugauuuuuagagcucauuugacuagacugggcccacccagguauucaggagaauccccccaucucauggucuguaaucuuagucacauaugcaaagucuguuuugccagguaagauaguauauucacagguucuggagauuaggguguagauaucuuuggggggagggcgcaugauucuaccuaccacaccagucaguucacucugauucugugguuagggaacacacuuugagaaccaccaauauagaaaauaagagaaccagaagacucuuccacaauguagccuuauuuuacauuguuggaaagucaaugaaagcuuuuaacaaacugguugacugcagcuuuaccucuucagugggccccuuuccuacucaaaaaguaaugagaaaaaggcagcaagggggaccagagaauagagaaacaaaaacugaaaucacucccugacuagauuaaucagcucuugcauacucuggccauuuaucagauauauucagugaaauucuugguugagagaaagagggagaaaacacaagccaauccugaaucaaaauuaauagagaauucuacuagaauucaacagguuuuucuuuuuuauuuuuuaauggcaagaucccugaaggccuuuaaaauacgaaugucugcuuuaaaucuccaagaaggagggcagaguucuugaaaaugauagccaugguuuuuuucguggcacauauaauggaauugggcugccuggaaaaaugcuugaguaaagguugcuccacaaggggaaaggugguaacucaaugcaccuucacuuucuagguuggugcuucucaauuuggcugcauauugaaaucaucuuaggagcuuuaaaaagcgcugaugucuaggucacacaccccagugauucugaagcaauugcucuggggcaugucuugggcauugugcuuuucccccaacaucucgcagaugauucuaacguguagccaugauuaaggacuguuaugguaggugauaacccuguuuuccugagucuauuagcauauguaguuacuaaccagagucaguaaacuagguauuguucucuguauuuuaauuccugcccaaccaaauuaaggaaguaauuucaaaaauuaaaagagaagagauaaucuagaguggcaggcaguacuaaccaacuccacauucaagaauagcauccuuucuuaaccagcauugcgugauuuuaaacucuucguauccccagaauuuagcacagugccccacacauaguauauguucaggaagaacugugguaaaugauaaagaauuaugaacaaaguccucuucaaaaugaagauugcaggagaaucaagcuucagucagaucuaagugcacacuacucuagugagauaagccaaucagauaagcaggauggggaaccaccauuuugguuuuguuguuguugucauuguuguuuuugagacagagucucaccuaggcuggaaugcaguggugcgaucucggcucacugcaaucuccgccugcagguucagcugauucuccugcuucagccuucugaguagcacgccuggcuggcuaauuuguguauauuuuuaguagagacgggguuucaccauguuggccaggcuggucucaaacuccugaccucaaaugauccacucaacucggcuucccaaagugcugagauuacaggcaugagccgucguuccugaccaggaaccaccauuuugauuggcaugguaccagguacacagaauuuagccaauaaacuauuugaugugugaaagaaugaauaaauuuuggcauuaaaaggcaggcuucgguaugucagagcaagagguaauuggaugaggaccagaggauggagcccagagcaggaaaugaagcucagagaagagguagauguucaacguacugugucuccuccuccaguuuugaguaggucacugaaaacacuuggcauggcagugaaaaucacucaaaagacccccguggaaauggacagacuuguguggaaauuugcagaucuuggcugcuucuaauucauuugucuuucuaaccuauuagaauccaauucagucucuuuggcucuacccaggauaaugcaaaacugaauuguacacauaagcuuccugccuucugcuccuucucuucauaaccaauauguugcuaaacaacaauuucuaauugccccuucccaggacaccuuuugagagcaucucucuuuguacccccugaaauacauaauacuaauuuucuuugacaugcuauauauuuugaggauccaugcaucccuaacaagugcccagucuuacgauggugcagccccucauccaguguucuaucauuuaauucaugaugcuguuuaucuuggcugcaagagagugaauuauuggcauauucagacagucucauaccaccucucguccucuccauuaucauaaaaguuaaaauuauuuauuuaugaaccaaauaacuugucugaauauuuuaacaaugcacgagcacuuauggagguuuuuauuucaauuuggguagagauacaaagucaaauaugauuucaguacaaguugugaugguuuuucucaauaucuuauaugggguuccauuuuugccuuguacaauuaauacaagaagcauaaugaacucagcaauccccuugagaaauaacaaauagguauaagcaauaauuuaucuguggaaugcagggccuugauacauaacuuccauaucuacuccaaaagaaaaagaaaagaaaaaaaauuccuagcuaagagccaugaagaaagaguccaaacacucucacacauuguuguuggaaagguagacuauacaacauacuuggauugcaaucuggcaauaugcuuugaauguucacaauuuuaaaacauauauuuccugacccauuauuucaaagacuguauccugauccugaugaaauaauaaaagaugugccuaaagauauaucauguguggaugcucauuuacaguguuacuucccauaaagagaaauagggagaaacaaauaagaaaccuuucuaauauauuuuguuaucuauaaaauggauugcuaugcagucauuaaaaauaauguuccuaaaaauuaguuuauaggaaaauguauaaaaauguacaugacauaaaguuaaguggaacagcaagauauaaaacagucuaugcagccuauuuccaauauguuuauaauaaguauuuccauauauauuucuacguuggcauauuauucuacacagaaaaugaucaguacauauuuuugaguguauaagcaggguguguguguuuacaaagacaaagaugaaauaccccaaaauauuaauagugguuauggcuagauagugaaguuaugggggauauuuauucuuugccuuauguuauccuacauuuucuaaauagucucaaugcaaauguuguuuuuauaacuuauuacugauuugugagcuaaacagacccauugacauuuucccuggaauauucuagugacacaaucacucuccuguuagauagucccaccccucaugcccccucauuuggucucuuccaagauccaggacuuuagagccagaaacauuuggauucaaaucccagcucuuuacuuucuagcucuaugaccauggguaaggucauucucucuggguguucuggaccuuugggauagaguuguugggagaguuaaaugaggaguguugcauuccuauccgauaguuauuucucccuccccuuccuuucuaauaggaucugacuuugugauuuuauucagguauugacugcccacaaccuauacccagggacaagaggcuggggccuacucagaccuaaggcuugaagcuuaacuagacuaggacaagcaugguaacuucauuccccuugcaagggaucacuucaggguaugguuugaaauucuggccaaucaccaagugggacaauuguuggaggccagggucguucugaaaaaguuuucuucacauuuaagaaaacaaaggacacccagaaggaugaguauucauugccguuucuggccuucagacacugaggauuucuggaugcacuauagccaaacuuggaccauuagaggacaagccugcaaagaaaaguaacaccugaaagaggggagaaauaaaagacagaaaaaaaccuugauacuugauaauguuguugcugaauucuggcauggcccuauuuuuuuuauuuauauuuaaaauuuuuguuuaaaucaguugaacuaggauuucuauuacuuuuaucugaaaggaucguaagugauacaaaaagcaaaagugccaagcucaugacagagagcagaguucaacaaauaaaaaauaaaaaaaagucuuuucuuucucucaccuuccaaauacauauuuaguauacacaguauauacuuguuuauggcuuguaaauguaguuaauagagaaaguaacaagaaagaaagggguaaaugcaccuuuuccuccucuuaaaacaugcacaacaggacccaauuucucuaauuuuuuuauaaaggcccccaaaaacuauggacaaagacaaaguuuuccaaggaaagacaugugcuguaauggauuauaucuugcuaaaaauucgaggccuucuaaaaaaaacaaaaucuugaacaacaaagaccucuuccaaucccuccucccuguaggucuugaacaacuagccagaggcccugcuuuuguaagagguucccuagauagaucaggauggauggaguguaugcuguuagaucaaaagaaaucauuugcuacuuguaugcauggacuaccuuaacugugagucuuaaucaaguaauggagacugacaggcuucuuggccuauaggggcccuauaguaauaaagugugcacuuuucuaaaaaugguauucauaagagucaagugacuggacaauuacuuuguuugauuccacaucccaggcugaacaaccuccucuucccauauucuucugcgucugauccugauggagaagaauaagccagccugagcuaugcuuagauauuuuaaauuuuagugaaaaauaaaauauauguuuuaaagccuggaauauuauuugugauuugggucuaaggucuaaaaaauauggacaagugggaauucaaaaaucacccuaccagcacugcaaagaauucgugaguauucaagcuuuaggaguuggguuugugcauuuuccuuuuauaacuauugcuagccaucccagaauguugcacucaguaagaagggcuaacaguguccugcuggcccuauuccuaugugucaucuugcggcauuuccaguuaauggcaugacuguaaugacuagcaauuuaaauaauagaggcugaagcagaggcagcuauaaggacacaaugcagaaauugccacaguuuaucaacaucacuggcacccagcucuucauuaccuccuugaauagggucaaaguaguuaaaaugaugcuguaaauacaugacuaaaacaaagcagcgguuuauucuugauuuggcauuggguauuuauaacaaacaaguugcauuucccaggcauggguuauuagacacgagaauguaauugauauuaaccaacuuucaggcuccaguaacuuuuuccacugcaugucaguuuaauuuuuuuuaaagcauaagcagcacaugccaaauggaaaacaagaggaagaacacaaaaaaccccuuaagccuucaguacuaagugaaaaacaacuaacccauuuaucuuauagaauccuucagaguuuugcuauaaacucacucggaagagaauaucacagucuucucuuuuugagaggguauucgagugauuuuuagaaaugagacaucucuaacuguaaucuuguuuuuuguucagaacuaaaagaguaugcaagaauaucuaaaaauacaaauugugcaccuacugcauuacggcagagguugaacacuggugacccaugagccaaaucugacccauugcucuguuucauuuggaccauacaguaaugguugacuuuguguuuuaacauuuuaaaauuauuuucaacauuuguaaaucgagagauuucacagaaaaugcuggaagcucugacccuaccggcaccacacuccuacaagauaacaaauggcuggggcugaguugaggcugcucuuauccuuugccucaauuguaucacuccuacagucuccuugucucugaggccuaaugucaauuaccucucuucuucuuaauaguauuguuauuuuuccuaaguaaugaucaaagacaaauauucauuuuggugagccuugaucauaaauggggaaaauaaagauggguuaagaggacugaguguuuuagaaaaugaaaaggcuguaauuccuuauagaaguaaauaauuucuuacuuaacccccuuuaccccauaacagaauccucccagcuggcauccaagagcauugagugugugaaccuuugugaaaagcaucaaguuaaacguucuguguaaaggauaccagacacauggaaaagccaagcuagguucagucucagacaaaagcugucaagcugagaaagggaaaagaaagcacugcacuuguaagaaaaacaacaaauggcaagcacggaauugacggcuagaaagaacaaagcagguuucaauguucuaccaaaaaaugucuuagccccuggcuaaacuccuuuugggaaaaauaggcacaacaggaagaugccuucacuucccaaagucauccagacauucucagugggagcuucugcaucaaccuugugucgcaucuggagcugcagacccucacugcccauugguuuaacaaucucucuccuccugcaagaagagggugguggcaggggggaguacuauaagggauguuuguuuuauuaaaaagaauaaacauacaugcacauacacaccuacccagaaaauacuauuucauggcaucuacacuuauagggaauucacucagaaacagcuuuuuaguaacacaaagaauuaaaaucauuagcacccaacaagucagaaaugauggaagauuaggaagaccauugcauagaaacaaaauuaaaaaaagauaaaacccuuuauagaaccagaaaaggugaggagaacacaaacaauccuuuucacugagauugagaacccagaaaaaccuuuugauauaacuagggaaaguuaaguagagucaggaaaggaauaaguguguauuaauuucccacuguguagaaagcacuccauauacauuuuaauacauuuugauaauaaauaauaaauaauacuuuauauuuuuguucauuuauccauuaaauaaguauucguucacugccuucuaugugucagacaucucuagggauauaaacauuuaaagacaugguuuuccuauuaccaaguuuugagucuaacaaggaacuagacaaacacucuaaugaaaauaauaaugauuauaaauacaaacagcaauaauacaauagcuuaauaacagcuguccuuuacugagugcuuccaaugugguaagaauuguguugagcacuuuacauuauuauucguuuaaucccucauaagugcccuaugaccaaguuacuaauaucuucauuuuacagagaagggaaguaagcuauagacuaaaugauuaccuaagguuauaaagguagcagaugaaagaucugagauuuaaacacuaccuguucucugcacaccaggccaacagauaaucugcgauaucaaccccuaccagcuacgauggaggcaugccaaaaacaagcgaugcagaggggagacccuuaaacccuuuugaauuugcaaagcacuuccccauagagaaaauaagccuccagaauucaucagccccaagaggugguacugguagaaaauauaauagucuuucauaauagcuuaggucagggugugaaagacagagcuauaagggcugguaaaagaacgaaagcuuuccaauccagagacaaaaggaaaagugagauccauccaugacaugucucuugaggacucuuuuaggaccaagauggugaaugcugaacggaccaugcaugccucagucugucaaauuguauguuucuaaggacaaauaggcuacaaaacuuucacccuauuuuuauaugggaagucuguugaaaagaauacaauacauaaaagaugaauuacuuauugagucuuuaauaugucucuagcacagaaauaaacaucuuguguauauuguuucuaauuuccacaauaccaugagcuagaaauauacagaauagaagaacagugggaucagagagguuaagugauuuauccaagaccacacagguguuaagagguagaggaaugguuugaacuugcaacaaugugacuccaaaaucaauacauuuuccuuacacugaaauacaaaguaucaggccaaaucucucugcaaauauucauccuguuucuuuugguucuucauucauuuaauuaaaaacaaguuuauuaugcacauacaaggaacauaguauucauccuugugcaucugacaaguaagucaaggagacagguguguaaauaccuaaccaaacuuacaggcaggaugaaugaggcuaaauguguuuauuauuuaaauaaacuccaugaagucagauacuucaguuuguugaucauugccacauaccugaaacacaaucuugaaccaacaaacauuuguuugauggaaggauaaaugaagaaaaucccacuuaaggaaguacaaacuuaagguagaauuaauucugccuaagauaaaucaacgaaagcccccaagugcagugucauugaauuggacuuggaagaauguaugaaguauauacuagugagaaaugaagugacaggagcuauggcucaggguaaacacaggaauggaagcauagaagcccacaaaauauuuggguaauagaguucaagcauacuuagagcacaggaaaggcgagaaauuagagugagaacuaaagucaaaaagguaauuuggcaccacuuugcacaaagccuucaagucaauuauuaaaaaaaacaaacaaacaaacaaacaaaaaaaaacagccaugccaguagaaugcaguaaucugacagcuuuuagcaaagugggaauguaucaccccuacuuccuccccacugaucuuagaagaauccuaaguguuuacaccuaguuuguaagaucccaagaaacucuccaguggucuaauucccaccacucagcuaagaacucucagcucaaaagauacuggcaucuggaaagccuuuuucaaagucccuaagucugaguuccuuacaucccacacuucacccaucucauaguguguuuuucuuaucucucuccaccaucacuggcuuccaugugagcaggcacuaucuuuguugauuccuagcauguugcaaacagcccggcacauagcaacuacucaauaaauauccuggaaauaauuauuacauuagugaauugaaugauugaugcacugacugacuguugaagaaauagagucaaggagagccauaggaggcugccacaauagcccacggaaaacaccucuuuauaaagguccagauguauuucuuuaaguaggcacuuugcuaacuggggagagcggugguuaguuaaagcagacagcaaagcagaaaaaggcagggccagcgggcaguugcuggggagaccacaauuccaugggacuauagccauuagcaugcaacacuggguaaucugauuuucaugacagacagauuuauuaugacuucuaaauauauaaaucccagguuaugcuuuccagcuaaccuaacaacuugauauaugugucugacaucccgucuuaaaaucagauuccagcuucuaauuaauuuuuauucacccaucgcucuaacaagagaggcaggaagucucagggggauaaacaauagacaggguauuagucguuccuacucuguggcacauuuuccacugagucucuggaguuuucuuuuucuuugcuaccaaaaaaggggggccuuacccauucucucuguggcuucuaggaagaacgaguggaaaacauuacacaggcacccgauagucauuauuucuauuaagcaaccaaugcuucauccaucacuuccaccuccccauucccugcuuucaucuacccaugcagaaauuggaaugacaucauggucuagucaguuuaaagacugaucauugcuuauguauuacuauacaucuugcuuucuccaauaauauuaucagcaaauaguucuugaagcugaauugcaagugccacaaugaccugacuuuaaaccaauaauagugaucauaaaggcuaaaaguaccaccuaccgcuuuuuauauaaucugaacaauauuaauaauucacucacauucagauacuuuauuaacaaugaaaagugauacagcuguacccaggaaaaguuuuguaauccacugauuucuuuaaugagcauucuaugaaucuguguuuuuuaaauauaauuuucauauaugaauacaauuuaaagaacauuuucuucuauguccuuuuuccaaaacaugaaagucaauauggguaccacagaccagguuagaaaaaaaaagauggucacauucaacuuuuuaaguuuuuuaauauuuaguucucacuaugugcuagagauuguucucaaaauguuaaaugcauuaaauccuccucaaaacucuaucagguaucauaauuuauccuugugacauguuuaaaaaguuguuugcagucacaaaagcuagcaaguuguacaacugagauuucaauugaggcugauggcugaggcuuuaccaccuuggucuuaauauacugccuggagauuuaauuacuaaauaacuaauaguauaaguagccaguuguguuugccaaacccauaaagccaaacuacacaaucaucuucacuuugaggacacuauaguguuucuggcuuuuugcaagcagauuuaaaaaauuuggauaccagucuguuuaccugccauaauauggaauauaaacuaggaggagaaacacauucagcaaagaacuuuguuugauggacuucacgaaucaaaaaaaaugucauuuuucuguucauaauaaauaaauaguaaaaauaggauaauaccaaaaaauaugcaaaaucuucuccucccuauuuauuacaaguauauacuuucuaaaucucuagugucuauguaauuuauuugaugguaugaaagauguauuucacauguacaugcacaggcacacaugcgugugcacacacacacauacacaugcaaccuauguauaccagaauuacucugugcucaauuuaucuucaguuaagcacugaaaacaaaauagaaccaaaaaaauggauucauaaagugacaaaaagaaguucauucacuugcccuucagguacauaccauacucauaugaacaaacuuauauauucucccuacaaaaucacacuuaaauaugugauuuaaaguauuuuuugcuaaguauuuuuauuucuuuccccaaaauuauuugugaaaauggaacauguccuauauaucaauaaaugucauuuaaaauaaauaaauuuuuaaauuaaaauuaucaucaaacucuuaaaguauuucauuuuuuaaaaauaaauuuacacuggaauagaagucaaacaaacauuuaaaagcacacagaaagcauucauauuacaacuaaucuaaauggcugauuugguaaguuuuagagccuuuuaauaaaaccauauuuuuacucaaguacuauuuaguuagagcuuuaucaaaauacuuaauuacaaaauaagaucuaagauguucagguaaaacuaugcacaauauaaucaaauccuuagcaugaagccauucaaguugucauuuagagaucuguuuucugagccuacuccaguuuuaaaauaguuuccucaguaacaucaaaucugcccuuccuccccuuugcccucagaauuauuagagcauaauguaauucuuuuaccagccuuaggaaaacacuauuggaaugcaugagccaaaaugcagagaugaaacggaacugaaaaaaaaaguuuuuuaaaaauggaaaaucaauuacuauuuuuaauaaguagaaauagcuuuugugcuaagaaaagaaaaauugcccagagacaaaauagauguucgauauuauagugcacuaaugaguacauuuacauguaauuuucugaaauuuauguccaagacuaacugcaaauagaauuuaguaucaauaggaguuuacaaaacccauucauuuuuccucuaaucauauugaauauuuaaggugcuugauuagacucaauuauuuuucuuucggugccaaaaaagagcccugacagcuuugaaagagauggauuaguggggcauuucccaccaauggggaaacauuccuggcucccacagcaggaaaaaaaaaaacaaugagaaaguucaugccaauucacaugcaugccacugaaugaaaucugcagagaacucagagaaggucagcuugucaaaggaucacggcaaaaagcggaagaggcagauacccaaacuuaguaggacuuuguggccucccagcucacaagccugcuucuucauuucaaggcggccuggagagaagcaucugacaaagaucuaucucccacugcccagaaaagauuaaaagaauaugggcccuagcaaaucuccuaguacuuggaauugagaaauagaaagggaaauguagcuaauuugcaguagcccugcuuccuuguucagauuucccgaagcauaauaaaauagagaggcugugucuccaggguuccacuuccagcugugccccacaacuuggaaaaaacaagaagggacauguuaccuacucacaccaaccugccucuccugcugccccuccugcugccauucuuucaauucauucuaagggagguugucagcccucucugaaaugcuuuaaaaagaagcuauauuccuaacuggucaaggagauuuaggugaauuccuggcugaaagcagaaugaggaaaaaacuguucccucaaagugcccaaucuuugaugcauuauguucuacugucugcuaaaaccaucaucguagccuuuuaauuaaauuuucaaauucugguuugaugguccauguuaaacucaauuuggucaauucagggcaccauccacccagauauuccucccucugagacuucugguagaauccuuccuugccucuuccuaauuuccagucucugccucugucaucaugugacguucuccccucaucugucuguaucacugugucuuuucuccucuucuaugaggacaccauucacauugcauuaagguuccaucuuaacuccaguaugaccucaucuuaacuaauuacaucuguaaugacaguauuuccaaauaaggucacauucugaggcaaugagaguucaaacuucaaauaucuuuuugggggcacacaaguaaaccuauucugugcagggcacacaauucgaccuacuaacacucccauauuaaaucaaucaccaagucgugagcagacaccuaauaccucucaaaucugucaacuucuuucuauacccaccacuacccugaaucccauacaauugucucaccuggguaauuguaacagcuuccuuuaggaagcuccccucauuuuugcauugcuccaauagauucuccaaaaaaaaaaagugcuuauugaaauguaacugauauagagaaaagugcauaaaucagaaugaauuuuuacagggcacacauacccacuuaaacacuacccaaaucaagaaauauaauauuaucaucauccuagaagcacauuucauaucccuucccaauuaauuuccuccugcuccagcccaaaggaaaccauuauccugaccucuaacaacauugauuaguuuuacaugguuugggauuuuauaugaaugguaacauucagcacaugcuuuuguaucugucuucugcuguuagaaugauccuugcuguugcaacuagaaguaauugauucauuuucuuuacuuuauaaauauuucauuaugugaauauacccuuuuacuuauucauucuaauguugaugaccauucagauugaguuccauuuggaaaagcuauuaaaaauaauggagcuacgaacauucucacauuuuuagcguauaucuaguagaagugaaaggucacagggccuacaauuguuuuucacuaaauauugccaguuuucuaaaguaauuauauuaauuuucaaucccacaccacuguaugauaguuccaguugcuucauacccuugccaacacuuaguauuaucaaucuucuuucauuuuagucauucagaugaguguccaaugguagcucauugucucuaauaacuaauuaugauaagagcuuuguaauaugcuguguagccaugugacuauccucuuuuguaaagggcuuguucaaauucauugcccuuuuuuccaaugggcuauuuuucucccauccaaguacuaaucaggcccaucccuacuuagcucccaagaucagacaagauuggaugcauucagggugguauggccguagacuaccucuuuuucuuacugauguguagaugauauuuauaugaucugaauacuaguccuuugccagagauauuguaauuaucaucucccauucuguggcuugccuuuucucucagcuagugaugucuuuaguucauaaacuuuccauuuugauguacucuaauauauuuaucuuuucauuuuuugcuauuguuuuaaaaauaguuuuauugagauauaacucacauaccauccaauucaccaaucaaguguaugugacucaaaguuuuuuaguauauccacagaguuguguaacaaucacuacaauccaauuuuagaacauucuaaucaccccagaaagaaacguuggcccggcgcguuggcucacgccuauaaucccagcacuuugggaggccgaggcgggcggaucacgaggucaggagaucgagaccauccuggcuaccacggugaaaccccgucucuacuaaaaauacaaaaaauuagccgggcgaaguggcgggcgccuguagucccagcuacucgggaggcugaggcaggagaauggcgugaaccugggaggaggagcuugcagugagccgagaucgcgccacugcacuccagccugggcgacagcgagacuccgucucaaaaacaaaaagaaaaagaaaccuuauaccuacuagcugccacucccuauuccucccaacaccuucacccucacuaaacucuaaccaaccacucauccacucucugucuuuauugauuugccuuuucuggguauuucuuaucaauggaauuauaugauauguguuuuuuuuauuuuguuuuugugacuggcuucuuucacuuugcaugauguuuucaagguucauccauguugcagcauauaugaguacuucucuacuuguuugucuaauaauauuccauuguacggauauaccacauuuauuuauccauucaucaguugauggucauuuggguuguuuccacuuuggggcuauuagaugaaaugaugcuuggauaguguuuuuucauguccuguuuaagaaauauuuggcuaucccaaaaucaugaagacauucuaugauguuauauucuagaugcuuuauugauuuagcucucacacucagaucagcaauccaacuggaauuuauuucuguuuaugaugugagguucauuuuucccugcccugauacccaaaugauucagcacuauuuaaugaaaagaucgcccuuucuucauugcuccacagugucaucuuucucaaaauucaagugucccuacaugaguggcucuauuucuguacacuccauucuguuccauuaaucuauugcuauuugcuuauccuugugcaauaccacauuauaguaauuauuguagauuuauaaugaauuuaugaagagcugauagauaguauauguccuccaacuuuguucugauuccccuucagaauuaucuugccuauucuuugccuuuugcauaaugguguuuugauuagaauugcaugaaauuuagagaucaauuuggagagaauagaccucuugacccuauugagucaccaauucauggauauauuguguccuuucauauauuaggucaucuuuaauuucuuucaguaauauucuguaccuuucucuguagaggucuaauacaucuuuuguuagauauauuccuauguuuuuaauauuucaagcuauuuuaagugguaacuuuuuaaauacauuuauugagguaaaauuuacauagcaugaaauucaucuauuuagauguacaguuugaugaguuuugaauacauuuauauaguuauacaaccaucaccucuacauaguuuuagaacacuucuaucaauccaaacuguuaccucaugcccuuugcaguuaauccccacuccccacaccaggcagcaacugauuugcuuuccaucucuguaguuuugcccuuucuaaaaauugaaucauacacuauagauucuuuugugucuggauucuuucacuucacauaauacuuuugaagcauauccagguuauuucagguaugggcuguucauuccuuuacaauguugaguaguauucccuuguauaaauauacuaauuauugcuuacccauuuaccaauugauagauaccuagauugcuucuauaauagcuugggaccauuacaaacaacauugcuauaaauguagacauacauuucauuucuccacaaguuuucauuucaagaccuugaaguggaauugcuaagucuuaugguaaguacauguuuaaccuuuucaaaaagugccaaauuguuuuccaaaguagcuguaccauucacauuccuaauagcuuuauuuaaagguuacaguuucuccauaucuucaccagcacuucuuauugccuuuuuuacuuuagccauccuaguggguauaaauugguauuucaaugugguauauaauaauauuucauacuauuccucuccuuuaaauuugcauuuuccuggugaugauaagcauuuuucaugugauuauuugccauuaauguauaugcuuugguuuguuuucuuauuaccgacauaagaauucuuuauauauucuugauauuaaaugcuuuaucagauaugauuugcaaauaucucaucccauucugugguuugucuuuuuauuuucuuaauaguguccuuaaauaacucacguuuuaaaauguuaugaaguucaauuuaucaguguuuuuuucuuuuaggaaaucuugauuuugguguuauaucuaagaaauauuugacuaauauaaagucauaaaaccuuuccuguauguuuucaucuagaaguuuuauaguuuuaaagcuuauauuuuggucuguaauccauuccaaguuaacuuuguauacaguacaggcuaauuuuuggauaaagacaugcaauuguuccaccucaccuucuuuggaaaaacaauuuguucauaguuuauaacccuuuuuauauguugcuggauucauuuuaaaugguaucuuuuuaaaauuucauuuuguaauucuuuguucugguacguagaaauacaauugauguuuuauacugacuuuguaucuagcauccuugcuaaauucauuuguuaaauuuacauaauuauauguucugcaaauaaaagaauuuuauuguuuccuuucaaaugcucauaucuuuuuuuucugucucucuacauucaccaggacuuccaguacaaugcugaacagcaguggugagaacagucacccuuuucucagaccuaaucuuagggcaaggcucucaauguuucacuuaaguaugauauuugcuguaguuuuuaaaaaauauauagagagucuuuauuaaggauguuuacuuauaguccuaguuuguuaaaaguucuuaucaggauuagauguugaauuuuaucauauggcuuuucuccuuuucuguuauuacaucauuugauuuuugaacauuaccuuaccacucauaucuauaauaaauacaacuuugucaugacauauauuguuuuucuauauuguucagucugcuauugcuuuguuuaggauuuuugcauucuugagaccuccaaaaucucuuccccaucucuuuagcugcugcuuucuauuggacuuuuaagcuuuucaggucuuugucauuuacaaaucaacaaaugcuucaaaaagaaaaagaaugagaauguugaagucacuucaaugcaccuccucccuccaggguucugaccccucaaguccuggaugccuugguagcccuucaauaccuucaaacaaauaucuucucuuuauuuuggcuggcuuuucuaguuauucucuugguggauuauuagcuacccuaucauuaccagaagcagaaauucauccuauaacuaaauaaagucaucauauaaacuaaaucauauuauucuuccuccuugaauuugcuaaugugcugauaaaaacuccauauucuguacuauguccuauaagauucuagugauacagacauagccuuucccuccaucaucuccuaccacucacucccuuguucacuccucucccaccauauguaucuacuuucuguucuucuaaucccauuggguuaauucccaaaucagugcuuuugcauuuguucuucccucucccuggaacacccugucccugaucuucacaugccugccucacuuuugucaauccaucucaguuucaaugucaccucuucaaagaggccuucucaagacaauuuaucuaaucuugugucucuccugccugauuccccacaaacaauauucuauacaugaaagaaaugauaaugaaauuaagccaacagaaauagaguuugaacuuuccaaaagccacaauguuaucucuaucccacuuccacauccaacauaaagagaacaacaaacuaagaauauguaacaccuuuggggaccacuuuuguauauuauuauacagaucuuaagaguauauaaucuuucucuggagugugacaaaccuaaaucaccgcuacaucacuuuccagauguauaacuuccagcaagguucucagccucaacuuccuaaacuauaaaauggggauaaugguagaauccauucgauaauauuguuguaauuauaaaauaaauguuauuuuguaugcaaagugcuuaauacagugcugagucauaaaaaguguuccauaaacaagagcuauugugaugacugacaaugaugcucaugaugauaaugaugacaaaaacaauaaggcucuggagcaucugguaaaaugcuaaguaauucaaucaaacacacacagauguacacacacacauacgcacaaaauuacauguuguaauucauuuccaccaaguagauacagccuuuaucacuugcauugguagauuugguagagacuucauuucuuugauuucuguacuagguaaguuugguggcaagaaauauaggccagcccuagcaagucuauucaaaaauaagaaaaaugaaaagaauacuacaguaucucacaaaauugaaaggagaaugaaaacccaagcuuugugaagaaggaaaucaagguagcuucagagaacugagaggccggaucuuagagaccucccucuagagcacugcuauuugaaugacuaaaauaccauuaauaacuacuuuuugcuuucaauucaaaauucaaaauucuuagaagagagaaucugauuggcauaaucagauaccuagcccuagaucacucaucucugcccucaaguuaaaaagucaaacauuauggucucagcugcugggagcccaccucuguggaucaggggacacugcccagaaaagaguuuuguuuuagaacuggaaggucaucccaagaaauauuacuauaauagaagggacucugucuaagaugggcucucucuaaaagaagucauuuuguucuacuauuugcccauccagaauagcagugaccaaguuaugcaccauuagcugcuugggagggagcuaauuacaaauuaaauauaauugaaucagugagucugcuuucaaguccucuaaauagaauaacaacaugcuaccuuguacagccaauuuagcaaaucgaagcugaaucccuugcuuucuaugaagauaaagagccuuugugaaauuuuuaaaguauagauguaaacuucaaaaaauuuugcaaggcaagucaucaaaaucugggagaaaauauauuggaaacugugcuccaacaggagccaaugaaggaaccuuaugagggaguauaaaauauuaauauucaccaaugccaagaaaauuuucauauuaugcagguauccaaaaugggacuacuaucuuugauuucacaauuccuuucuacuucucuaacacgaauuuuuagugacccaaaaugcugggaagaacuacaaaauacagugaaugcauucuacuugaacauuaucuuaugcuguuguaccuaccaaaaagacaccaugaaaacugcaaguauggcugcgcuggaaaaaaccgaaauaaguagucaucugugaaguacugcaagugugggaaaugguugagagucauggacauuggggaauaucaacaaaagaggaagaaaaagaagauuaggauggagguagaaaugauucccauggaauuacugacaucaguauauauucccuuagccuauuauuacaucagugucuccuacugggaauauuuacugaaccagugguacucagacuuuuuuugagcagggaaaaaaauuuauucaacauuuggaaaacuggcauagggcauccaaaguggggugagaaggcucuugugucagacuaccagguccauucccagcucaauauauacauacugugguaagauauccguaacguaaaauuuacuauuuuaaccauuuuuaaguguacaguuuuguggcauuaaguacauucacaauguuguggaacaacuaccuguaucuaggucuaaaacauuucaucaccuccaagggaaauccuauacccauuaagcauacauuccccgauuccuucuuccuccagugccuggcagcuacucaucugcuuucaaucucuauggauuugcccauucaggcauuucauauaaauggaaucuucuaauaggugaccuuuuuuguaauggcuuauuguacuuagcauguuuuuaaugcucauccauguuguagcauguauacuucaguaaaaaaaaauugaauacaauuguaaauauuuguuugaaacacauaaaagaaauaguuaaagggauugagccuauuuacagaagacuugaacucuggggcaaggagagaugaaaagggggacuaggauagcaguugucauuucaaagacucauuguguguaaagagacuaaguuuuauucuauucagccccaaauuauccccccauaaccaaagaguagaaacuauaagaagagagauuucaauuugacauaagaaaaaucuuucaacaguguuauccaaagacagaauagacuguuuuuauaaauaaugaguuccacuuaucuguagguauucaaguauaaauggaauauucccuucgcagaaaucuuuagagaagcaagcaucagauaagauugaucugaaucagugguuccuaaaagccaaucaacaagcgcaugccaauacaugaugaaguuuucauucacucguggugaaaugccaaaaucaaagagguuuuuauaaagcuaaauauauauuuaauuauuuuaauuccaagauuaugccuuucauccuuuuaguaucaaaauagccccccaaaauagugaaugauaguuuucuucauucaugcccuuuuuuggggcaaaacuucaaggugacaaaguaaagucagcccuuuguuuuaggggggaaauuguaccagucucaaagugugagaaucauuugaauaggugauucuuaagacauuuucaaaauuccaagaacccauguuuaugaccaaggauuguuaugaaaguugcuuuuguuguucauuuuauccauauuucaacuguguaugcaaggaguggagcaccucccaagaggauuuuccccaaggcuucugccuuuguagggauggucugaaaugauauagaauuugaacggauuucuagucucacagggauuuauauuacaugaaaaaagagagagcuuugcuuuagagauguuuauccaaauucaccacggagucaaugggccaaauuccaaaugccaugggccucccagugggugucaauuuuacugggcggcuguguuugggagaaaaaguacauaugcauguguggcugugaauguguguguguagagauaaagagagaaggauaugaacaaauagauagaggcaucaacaaucacaagagggaaagggaugauauauguuuagaauuauaucuaaggacugucuaaagauaaacaaaaauaacguuuuuccccuuuuuugucacccuuguuaaaaucaauaggaaaaauuugaagguaccaaguuauuuuauugucaggcaccaaaagaguaaaaauugaugacaucacuccauacaaaacccccagagcuuucugauucugcuguuuaugcuuucuccugcaacaucuccauuuggauccugcuggaaacacuuuucuuucugucacucacaaucugucaagacagcauuaucuucugugguuuaaaaacagaaacuccauuuaacuucgugguugauaaagacaucucguucacaucccuuaacuaacaauaauuauucuaauuuaccacauaaagacaagaaaaaauaugcacuuaacauuuugcagcugguuuuguaucaaggaacacauggaagagaaauggucccacucuugcgauaaaaaaauaagguauuaaguaaaaaauagaccuaacaugaauguaugcuuuugguacauccucccuacaugccaaucagugaagcaauuaggaguuugggcucucaaaacauacuuggauuccaauccuggauuugccucuuauuaaucuaagaaggcaagacacguaaccuuccuaagucuucuucaucuguaaaaugggagcauauaucaauaucuaccucauaagauuaaauuagauaaucaaucuaugucagcugcuguuacuauuguuguccuccuccuacucguccucaucaucaccacuauuaacaucaaaucaacguauuaguuaagguucuuuggggucaagcaacgcagaucauccugccuaacguuagcaaaauagaaaagagaucuacugcaaguauacagaauagugccuaaaaaucaaaguaaaacuaaaugaagcuuagaaccaacaggaggcugggggcagugguucacaccuguaaucuuagcacuuugggaggccgaggcagagggaucacuugagcccaggaguuugagacgagccuggacaccauggcaaaacccagucucuacaaaaauuuagcugggcguaguggcacccaccuguagucccaguuacuagggagguugagaugggagaauuguuugagucugggagguugaggcuacagugacccaugaucaugccacugugcuccagccugggcaacagagagaccuugucuaaaaaaaaaaaaaaaaaaaaaaaaaaagaagcaacaggagucaggcucccaggaauucauggucaguuaguucuucaggcuacuaucagcaggaagaaucagcaacaaccauuuuccauccuugggucaauguacucaagauucagaaucucugaaaaaaaaagaguggugggguggggguaggggggugggguuugggacuugggcacugccuuggucacaugaccacugcuuggccuggggaaggcaagguguuugacagcuccaauaauacuguguuugguggagaaggcuauuccccaagggaaaaaucuacuuuauaacucaaagaagaggaguacagauacugagcagguacauauaccaagaacuauuuuucuuacaccauuacaucccaacgacccacuacgucaagcucaauuaagccugcacccucuucuccaucauccuuccuauuugguaauuacucuuuuaauacauguuuuuaauuuugaaguuguuguuaaaacucaauuugagaaaagcaaaaaggccccagagcucuaaaguauauaugucccuuaaaaauauauauauauauauacugcuugcugacaauaaauuauuuuguuaaaaaacuuccguauuagaauuuccagaaaauuuauugucuuuauguucaaguuauuuaguaguaaucugugcuauuaagaagcacauaaagcacccauugaaaaaguuaucugaagaugauuuagagaaauaguuuguucucuuagaaagaaaucucuuuuauguuuuaaguucaauaagaugauauuuaugcucauaaauuagggucaaaggcaacauuuuguuuugguaauuuuuuuguggaugaugauguuuuagugagaaaggauugacaauaaaagcaagaauguaagaauaauaaaaauaaauaauaacgaaauacaugaccuacaauuucauuaaaauuuucuuccagcuuacuagcugaacaaaucccaaacaaugaaaauauacagagucugauuaauuugaagcccuaaacaacucuguagcucagugaaaacauuucucauaaagcccagggcccugagggcacacagagcuaagacaaaucccagugugguccacccuuagcagcugugugacucuaagcaacuuacuaaucugccaaaauacccaggucucgccucaucuguaaaugaaguaaacaacguggugggauguuuugaggacuugauauaaugcauggaagggucuugacacuuuuucuggcaaacaaugagcacacaacgauaaacguuuauaauucuauguauggagagagagagagagagacugagaaagcauacaaaagagcaagaaagcaguaguucucaacagggagugauuuuugcucaccagaggacauuuggcaaggucuggagacaucugugauugucaaaaccuggaggguagagggugcuucuggcauccaguggguagaggccaggcaugcugcuuacagggaagcucuuacaauacagaugacaagcccccacaacagaauuauccaagccaaaaugccaauaaugccaagguugagaaacagaaagagauugagaaagagaaagcaaugugauguaaugcagaaccuguaacagauuuggaaggaaagguacauucaaagccgggauaggaaaguagaucagagcagauuugaaauuagauugacaggcaucugccacauguaagcuauugaggaagugcucugagccugaggauucucauuugaacaacgggcauaauauguaacaucaccuaccucaaaaaguuguuagcaggcaugauauucaccccugaccaaaucauuacagaugcccacugcguauaaccaguaggacuucaccaguguguauacccacugucaacccuaagaguuagguacacguaauaaauaaaugguuacuagucuuguuauauauuagaccaacagccagguuugaaguuugacucugcuacacuggaaauacuugaaaggguuuguuaauaucagcaagaauuagugcccucauaaggaaguaaacagcaacuagacuccaaguucaaaugaguuuucccuguagguuagguguccucaacuugggauccuuaaaaccucugaaauuaaaaagaaaaaauuacacauaugcacauauauacauguaugaaugcaaccaaguguguguguguguguguguguauuuuucucugaagagggguccaaaaauggugacgcaucacuggguuagagguauacaguuuucaauauaaaguaauaaccaggaugcaguagaguuucugaagauaucauuguaaugugaaggagacaguauuuggaaauaguuaugaacucagaucugggaguuugaauucugccucugccacuuacugucugugcaaccuugcauaacugacagaacaauaacuucuuugcaucucacaugcaaagguggaaugcucauaauauccaccuaagaagaaucuuagagcaauaaaauuagacaauucccauaugguauucagcacaguacucaacacauaguauagaagucccugguuauccgcaggacagaugcuucaagauccccaguggaugccugaaaccaaacaguacuauguuucuccuacacaugcauaccuaugaaaaaguuuaauuuauaaauuaggcagaguaagauauugacaaugauagcuaaugauaaaauagagcaauuauaacacuaugccagcauuacuacucuugugcuggggccauuauuaaguaaaacaaggguuccuugaacacaagcaccaugauaccaugacaguugaucugauaacugagauaaugauuaagugaugaauggacagggagcaucuacagugcauaugcuggacaaagggaugauucacuuccucacaauggagcgagacagcaugagauuccaucaugcuacuuaggacggugugcaauuuaaaauuuauacauuguuuauuucuggaauuuuauaguuaauauuuuuggaccacaguugaccaugguuaacugaaaccacagaaagcaaaaccgugaauaaggggagaccacuguaugugaggacuaagaauuagauacugcaauggaaguauuugcaaagacuauuauauucagaugguggugaagguuugagccuucucuaacuacguauggcacacacuaucagaaaaauggcagggauucaucaauuaaucuauccauuuacuacuaguucagccagaggauccacuaauucugagacaugccuuguauaauaauaucuauacaauguugaaaaguggacagaaguagcugugaaucuggucacaaaaccucuuuuuauacaagaaagccucauucaaacuuucuccucugacacauuucccagggcccccucugggauuuccacaaacaugauguugugcuugacugugcauuacuauggaacaauucuaagccugucucaccuacauauaagauacagacuccgcaagggccuuuucaaucuccuucauuccucucagaaccugugcaaacaggauuuuaugcacagguaacccaaauaaagcaggguugccuugagacuugcaucugcccaauaacauauccacgaagaaugacucuguaggcauuugccagugcauugcacagcagcacagccuaaaauucuuccucacccauccauugccccaaccuuaaagcaucuguuuuaaaaaaaaaaauucaucuuucccuaucucucauucuaaccuauccccacccaggaugcccucagugccauucugcuuuuucgcugccaccacauuuacugugcucaugacaccuguccccucucuucaggguaucacuccugcaaggcagagagccuggccugaauaccuuucuucuggaagcagcccucuagaauucuggguaacagauuugcuaucuuguucuauagagaaguucauuacaagaaaugccuccauuccuggcucaacgcucacuuaaccuucuucuagaggccacaggcagaugaucuuccaaguuucucuuacccuagaauaguagugaagaaaaaaggaccucaucugcacucuaccugacuugcagggcaaagucaguauuaaucagaggugcccuuuuugcuacugacagacaaaguagaugcacucauaaccaagagcuuuucaccaaacccucagggcuuuaaaucuuucucaaacaaacugcaauuugcaaagaaacacccuaaaugaugcugugcaaggaaguuacagcaggcacagaaggauggaguaacauuucaccaucugcuugugauaauaauaaugccucuaccuugcaaagugucuaauugauugugugacacaggcacaaaguuccugccacaauuucaccaacaaaaguuauuccuaaauuguacccucacagagggagagugcuaaggucagugguccuaaggaccaauuuugagcauaugaacuuucugguggcagaaugauaagaguccugggacacaguuaggcaagauugaaccaacucacccuauaauaguuguuucaagcaauguccagccggggacacagagaacagagagguaggggauggaucuagggcaguguuuuccacuuguggaauggaaaaugccuuaagguaauauggaugaacaacugucuggguuuccuguggaggaagccugggcugcuuuacucucuaggguguugagccagaaggcuuuauucugguacagccaccucauugauagugagguagcaaugccugacaaaaguagauguucaugcuuugugcuagaagagcauagacuuagccagaugccaucuuuuucuaaauuggcagcacucaggccucaacugaagggguugggaaaagugagcuggaaaaaagaggccgggagcggcagcucacaccuguaaucccagcacuuugggaggccaaggcaggugcaacaccugaggucaggaguucaagaccagccuggccaacauggugaaaccccgucucuacuacaaaaauuacagccagcuacgccgaaggcugaggcaggagaaucgaucaaaccugggagggggaggcugcugugaacugagauugcaccaaugcacuucagccuaggcaacagagugagacucaaucucaaaaaaaaaaaaaaaaaaaaagacgggggcgauuccaagauggccgaauaggaacagcuccagucuguaccucccagcgugagcgaugcagaagauggaugauuucugcauuuccaacugagguaucggguucaucucacuggggcaugucagacagugggugcaggacagugggugcaguccacugagcgagagccgaagcagggcaaggcaucgccucacccgggaagcgcaaacauguaccacauguucuuuauccagucuaucauugauggacauuuagauugauuccaugucuuugcuauuguaaauacugcugcaaugaauauacacaugcaugugucuuuauaauagaaugauuuauauuccuuuggguauauaaauacccaguaaugggauugcuggguugaaugguaguucugcuuuuaggucuuuaaggaaucgucacacugucuuccacaaugguugaacuaauuuacacucccaccaacagugcauaagcauuccuuuuuuuccacacccugaccagcaucugcuacuuuuugacuuuuuaauaauagccauuuugacuggugugagacuguaucucauugugguuuugauuugcauuucucuaaugaucagugauguugagcuuuuuuuucagauuuuuguuggccacauguaugucuucuuuugaaaaguguuuguucauguccuuugcccacuuuuuaaugggguuguuuuucucuuguaaauuuguuuaaguuccuuauauaugcuggauauuagaucuuuguuagaugcauaguuugcaaaaauuuucucccauucuguagguugucuauucacucuguugguaguuuccuuuacugugcagaagcuccuuaguuuaauuagaucucauuugucaauuuuugcuuuuguugcaauuacuuuuagcauguuugucauuaaaucuuugccuguuccuauguccuuaaugguauugccuaguugauuuccaggguuuuuauaguuugggguuuuacauuuaagucuuuaagcuaucucgaguuaauuuuuguauaugauauaaggaagggguucaguuuuaaucuucugcauauggcuagcagcuuaacccaguaccauuuauugaauagggaauccuuuccccauugcuuguuuuugucagguuuaucgaagaucagaugguuguagguguacagccuuauuucuggguucucuaaucuguuccauugggcuauguguuugucuuuguaccagagccaugcuguuuuggucacuguagccucguaguacaguuugaaauuggguagcaugaugccuccaguuuuguucuuuuagcuugggauugccuuggcucuugggcucuuuucugcuuccauaugaauuuuaaaauaguuuguuucuaguuccgugaagaaucucaaugguagauuaauaggaauaacacugaauuucuauaaacuguuaagggccauauggccauuugcaugauauuuauucuuccuauccaugagcauggaauguuuuuccauuugucugugucaucucugauuucuuugagcagaauuuuguaguuccccuuguggagaucuuucaccucccuaguuugcuggauuccuagguauuuuauucuucuguggcaauuaugaaugugacuauguuacugauuuggcucucggcuugacuauuguugguauauaggaauguuugugauuuuugcacauggauuuugcauccugagacuuugcugaaguuguuuauaagcuuaagaagcuuuuaggcugagacgaugggguuuucuagauauaagauuaugucaccugcauuugaaugcacuuuauuucuuuaucuugccugauugcccuggccaggacuucuaacacuauguugaauggauguggugagagagggcaucguugucuuaugcugauuuucagugggaaugcuuccagcuuugcccauuuaguaugauguuggcugucuguuugccauagguggcucuuauuauuuugagguauguuccuccaauaaggaguuuagugagaguuuuuuaacauaaauggguauuaaauuuuaucaaaagccuuuucuacaucuauugagauaaucaugcaguuuuugucuuuaguuauguuuaugugaugaauaacauuuauggauuugcauauguugaacuaacuuugcaucccagggauaaagguuacuuaaucacagggaguaagcuuuuugauguguugcuggauucgguuugcuagcauuaggucaaagauuuuugcaucaauauucaucaaggauauuggccugcaguuuuuuuuuguuguaucucugucagguuuugauaucaggaugcugcuggccucauagaaugaguuagggaggagucccuccucaauuuuuuggaauagcuucagcaggaaugcuaccagcucuucucuguacaucugguaaaauuuagcugugaauccaucugguccugggcuuuuuuugguugguaggcuauuuauuauugucuaaauuucagagcucccuauuggucuguucuagguuucaguuucuuccugauucagucuugggugggugaacgugucuaggaauuuauucauuucuucuagauuuucuagcuuaucugcauagagguguuuauaauauacucugauaguuauuuguauuucgguggggucagugauaauauccuccuugugauuucugauugugcuuauuugaaucuucucucuuuucuucuuuauuagucuagcuaguggucuauuuuauuauuaauaauucuuucaaaaaacagcucuggauuccuugaucuuuuuuuauccaaguaauugaacaauucuacaaguauuaaauuuuacaccaggaauguaugaagguucccgaauccuugcugaugcuuguuauuguugucugguuuagugggugugaaguggugucauauugugguuuugauuucuauuucccuaaugacagauaacgcugagcaucuuuucuuuuuuuuauuauauuuuaaguucuaggguacaugugcacaaugugcagguuugauacauagguauacaugugccauguugguuugcugcacccaucaacucaucauguacauuagguauuucuccuaaugcuaucccucucccagccccacaccccccgacaggacccagugugugauguucccugcccuguguccaaaugaucucauuguucaauucccaccuaugagugagaacaugcgguguccgguuuucuguccuuguaauaguuugcugagaaugacgguuuccagcuucauccaugucccuacaaaggacaugaaauuauccuuuuuuauggcugcauaguauuccaugguguauaugugccacauuuuccuuauccagucuaucauugaugggcauuuggguugguucgaagucuuugcuauugugaauagugcugcaauacacauacaugugcauaugucuuuauaguagcaugauuuauaauccuuuggguauauacccaguaaugggauugcugggucaaaugguaauucuaguucuagauaauugaggaauugccacacugucuuccacauugguugaacuaauuuacacucccaccaauaguguaaaagcauuucuauuucuccacauccuuuccagcaucuguuguuccugacuuuuuaauaauugccauucuaacuggcauaagaucguaucucaucgugguuuugauuugcauuuuucuaacgaccagugaugaugagcauuuuuucaugugucugcugacugcauagaugucuucuuuugagaagugucuguucauauccuuugcccacuuuuugauggguuuguuuggcuuuuccuguaaauuuguuugaguucuuuguagauucuggauauuagcccuuugucagaugaauagauugcaaaaaauuucccccauucuacagguugcugguuuacucugaagguaguuucuuuugcugugcagaagcacuuuaguuuaauuagaucgcauuugucaguuuuggcuuuuguugccauugcuuuugguguuuuagucaugaaacucuuugcccaugccuaugaccugaauacuaucgccuagguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccccauuucuugauuuugucaggugugucaaagaucagaugguuguagaugugugguguuauuucuggggcucuguucuauuccguuggucuaucucucuguuuuggugccaguaccgugauguuuugguuacugcagucuuguaguauaguuugaagucagguagcaggaugccuccagcuuuguucuuuugcuuaggauugucuuggcaaugcaggcucuuuuuugguuccauaugaacuuuaguuuuuuccaauucuaugaagaaagucacugguagcuugauggggauggcauugaaucuauaaauuacuuugggcaggaugggcauuuuaaugguauugauucuuccuauccaugagcauggaauauucuuccauuuguuuguguccucuuuuauuuuguugagcagugguugguaguucuccuugaagagguaauucacaucccuuguaaguuggauuccuagguauuuuauucucuucauagcaauugugaaugggaguucacuuaugauuuagcucucuguuugucugauaaugguguguaggaaugcuugugauuuuugcgcauugauuuucuauccugagacuuugcugaaguugcuuaucagcuuaaggagauuuugagcugagacaaugggguuuucuaaacauacaaucaugucaucugcaaacagggacaacuggacuuccucauuuccuaaucaaauacccuuuauuucuuuaucuugccuuauugcccuggccagaacuuccaacacuauauugaauaggaguggugagagagggcauccuugucuugugccaguuuucaaagggaaugcuuccaguuuuuauccauucaguaugauauuggcugcggguuugucauaaauaguucuuauuauuuugagauacguuccauuaauaccuaguuuauucagaguuuuuagcaugaagggcuguugaauuuugucaaagaccuuuucugcaucuacugagauaaucaugugguuuuugucuuugguucuguuuaugugauggauuacguuuauugauuugcguauguugaaccagccuuacauccuagggugaagccgacuugaucaugguggauaggcuuuuugauguguugauggauuugguuugccaguauuuuauugaggauuucugcaucgauguucauuagggauauuggucuaaaauucucuuuuuuuguugugucucuuccaggcuuugguaucaggaugauguuggccucauaaaaugaguuagggaggauucccucuuuuucuauugaauggaauaguugcagaaggaaugguaccagcuccucuuuguaucucugguagaauuuggcugugaaucuuucuaguccuggacuuuuuugguugguaggcuauucauuauugccuuaauuucagagccuguuauugguguauuuggagauucaacuuuuuccugguuuagucuugggaggguguauguguccaggaauuuauccauuucuucuagauuuucuaguuuauuugcauagagguguuuauaguacucucugaugguaguuuguauuucugugggaucaguggugauauccccuuuaucauuuuuuauugcaucuauuugauucuccucucuuuucuucuuuauuagucuugcuaguggucuaucaauuuuguugaucuuuucaaaaaaccagcuccuggauucauugauuuuuugaagggcuuuuugugucucuaucucuuucaguucugcucugaucuucguuauuucuugccuucugccagcuuuugaauguguuugcucuugcuucucuaguucuuuuaauugugauguuagagugucaauuuuauaucuuuccugcuuuguguugugggcauuuagugcuauaaauuucacucuacacacugcuuuaaaugugucccagagauucugcuacauugugucuuuguucucauugguuucaaagaacaucuuuauuucugccuucauuucauuauuuacccaguagucauucaggagcugguuguucaguuuccaugugguugugcggcuuucagugaguuucuuaauccugaguucuaauuugauugcacuguggucugagagacaguuugcugugauuccuuuucuuuuaccuuugcugaggagugcuuuacuuccaacuuuguggucaauuuuagaauacaugcaauguggugcugagaagaauguauauucuguugauuuggaguggagaguucuguagaugucuauuaggucugcuuguugcagagcugaguucagguccuggauauccuuguuaaccuuccaucucauugaucugucuaauauugacagugggguguuaaagucucccagucuuauugugugggagucuaugucucuuuguaggucucugaggacuugcuuuaugaaucugggugcuccuguauugggugcauauauauuuaggagaguuagcucuucuuguugaauugauuccuuugccauuauguaauggcuuucuuugucucuuuugaucuuuguugguuuaaagucuguuuuaucagagacuaggauuucaaccccugcuuuuuuuucuuuuuuuuuuuucuuuccauuuguuugguagaucuuccuccaucccuuuauuuuaagccuaugugugucuuugcacaugagaugggucuccugaauacagcacacugaugagucuuggcucuuuauccaauuuucccgucugugucuuuuaauuggggcauuuaguccauuuacauuuaagguuaguauugauaauuguggauuugauccugucaucaugauguuagcugguuauuuugcagacuuguuuaugugguuguuuuauagugucacuggucuguauacuucaccauguuuuuguaguggcugguagccauccauucuucccguauuuagugcuuccuucaggagaucuuguaaggcaggucugcugguagugaauucucucagcauuugcuugucugaaaaggaucuuauuucuccuucguuuaugaagcuuaguuuggcuggauaugaaauucuggauuagaauuucuuuucuuuaaaacuguugaacauuggcccccagucucuucuggcuuguaggguuucugcuaagaggucugcuguuacucugaugaacuucccuuuguaggugagcugaccuuucucucuagcugccuuuaacauuuuuucugucauuucaaccauggagaaucugacgauuauguguuuuggggaugaucuucuugugaaguaucuuacugggguucucuguauuuccuaaauuucaauguuggccugucuagcuaaguuggggacauucucaugaaugauauccugaaauauguuuuccaaauugguuccauucuccccaucucuuucagagauaccaaagaaucacagauuuggucucuucacauaaucccauauuucucagagguuuuguucauucuuucucauucuuuuuucucuauuaucugacugucuuguuucagaaagccagucuucaaacucugaaauuguuuccucugcuuggucuauucuacuauuaauacuugugauugcauuaugaaauuacuauaguguauuuuucagcucuaugaggucaauuacauucuuuucuauauugacuauuuuuucugucaccuacugaauuguuuuaucaugauuuuuagcuuccuuguauugaguuucaauguacuccuguagcucaaugauuuucauuccuauccguauuuugaacucuguuucuguuauuucagccaucucaaccugguucagaacccuuacuggagaagugaugugauugucuggagaaaagaaggcacucugguuuuuugaguuuucaggauucuugugcugauucucucucaucuuugugggcuuaucuaccuuuaaucuuugagguugcugaccuuuggaugcuuuuuuuuucuuuuaaccucuuugaugaccuugaggguuucauugugguacaagauggauuugccccacuggcuucguuucuggaaaauuuuagggggccaacacucagcuuccaacucauggacugugugcuguaacucugggguacuuguauuguuuuaauuuuaaaacaggaaauggcauugcuuuauuuucacuaagucuauuauuacuuucuauuuauggucaguaaugcugcucuuacauucauggugagagucugcaaauucuguuugauaugugaauauaaguaaauaaaagugagugacuuuuuuaaauuaaaauaauaauaauaaaaaaaaaguggucugcauauuuggcccaaagcaaaaaagucugggaucaacucucccugaaccccagcucuucccaucccaaccaccuauuuuuccucaaaagccuggauuugggugugaagguuuuuagauucuccuuucuucuuuacccuuauacucacuugggauccuucacaaccagccuaucaacauaauuugggaaaaguuauuugugcagaaaaggucugguucuuuccuacuggagaauugcagaauaaacaaaacaaaugaaucaauucaaagacgcuuucagccuccagcaacuguugcauuuuuacaaugguaaaaggcagccaaaccucucauuugcccagaaguucuuucuuuuuccaaugguuuuaaauggcucuaaagagaaugauccaacuuagcagauaaaaggccaagccuccuguauagagaggucuuaauguuuucuuuucagcuuuggaacccccugauuauuagcauuguauccuuggacaagucacugagagccugaauuucuacacuugacaaacaaggaccuacuucacaagggagauaaugagcaucaggcacuuaguugagggucaggcacauauaagggcuuuaaagagcuauuacaauuauuauuauuuuguuuguuuguuuuaauauauguauacauugugaaaugauugccacaaucaaauuaauuaucauguccauuacugcccaguuaugauuuguguguguggugagaacacuuaagaucuauucucuuagcaauuucaaguguacaaugcauuauuauuauuaacuguaguuaccaugcuauaaaauagaucuccagaacuuccuccgcucuaauuaaaacuguauguuuuaccagcaucucccuauucccccaccuccucccagcccuuggcaacaaccaucauucuacucucugcuucuaugagcuuggcuuuuuuaauuaauuaauuuuuuaauagacaaauaaaaauuguauauauuuaucagguacaacauauuuuaaaauauguaugcauuguuaaauggcuacauugagugaauuaacauaugcauucaucacaucuuuuuguuuguuuguuuguuuguuuuuugagauggagucucgcucugucgcccaggcuggagugaaguggcgcaugucagcucacugcaaccuccaccuccuggguccaagugauucuucugccucagccuucugaauagcugggacuaccggcaugagccaccacgccuggcuaauuuuuguauuuuuaguagagauaggguuucaucauaucggacaggcuggucucaaacuccugaccuugugaucugcccaccucggccucccaaagugcugggauuacaggcaugaaccaccaugccuggcccaucacaucauuuuuuauagugagaacacuuaaaauuuauucuguagugcuuuucaagaaaauaauacaugguuauuaaccauagucauuauguuguacaauagaucucuuuaauucauuccucccauaacugaaauuuuguauccuuugaccaacaauucuccaacugcccacccuccgcgccaacuccugguaaccaccauuuuauucucugccucuaugaguuugacuguuuaaaauuucgcauguaagugagaucaugcaguauuugucuuucugugccuggcuuauuucacuuaguauaauguccuccaguuucaccaguuugucuccaauaacaggauucccuucuuuuauuaaggcugaauaauuuuccaggguguauguauaucacauuuucuuuauccaucauauauugauggacacuuagguugauucugaaucuuagcuauuaugaauaaugcuacaauaaacaugggagugcagauauccuuagaagacuuauuuuauuuccuuuggauaacuacacacuagugggauucuggaaucauauggugguucuaauuuuuugaggaaguucauacuguuuucuauaauggcuguacuaauguacauucucaccaacaguguacauggguugcuuuuucucuacagcucagcaacacuuauuaucuuuugucuuucugauaauagccugauaaagaaaaacuucagccaaauuaaauuuaaaggaguuuaauugagcaaugaacaguuugugaaucgggcagccuucugagccagagcaggcucagagacuccagugcagcugcgugguagaagaagauuuauggacagaaaaaggaaagugauguacagaaaauggaaguaaaauacagaaacagcuggauugguugcagcugggcgcuugccuuauuugaacagaguucaaacaguuggcuacauuugauuggccaaaagucagugauuggcacaaggguaggcuaugguuuguuuauaccuccgcuuguuauaguucacgauguacggaaaaaccuuuaggcugaacuuaaaauauguaaggaggcagcuuaggcuaaacuugaucuaacaaaccauucuaacaagugugaggugacauuuuauugugacuugaauuuauaguccccugauaauuagggauauuaagcauuuuuuucauauacuuggccauucauaucucuucuuuugagaaaucucuuauuauuaucaucuucauuaucacucuaauuauuaauaauguucacuaacccauacagcuacagugauuuuuguuacaacaggagcuuucugcuuucaaaaaaaagugcugcuaccuuaaguaaucauuuauccuaacucuaggcugcaacuuacuauuauuauuauucauucaacauucacucaacacuuacuuccuagagccacuguuugggcacuggggaaauagcacugaacaacacagagcaaagucuuugcccuguggcucacauucuggugaagcagagaaacaguacacauaauaaaugaauguuaauuacaguauguuuggcagugaugaaugcuagagaaaaaauagccuaugaccuggcaaaggcauuacccauuaagguaaaggaccuaucuccuagagcacuugaguuuuguaucacauaauucaucaaggccuuuagauauuacagucugaucuuugggccaguggucucccugugucacaaggcaagcgggccucaagaaaguaaaaaaggaaaauauuuccucuauuugcuauugccaaaacuuccuccaagagggaaaggauaggacaaaaaguauuuuguguggguguggcagccauagcuaggcuaucaaauacuaugcacauaugauaugccacucucagucccuauaauggcagauaugauuaagguuuccucuuuccugcugagcccagaaccagcuucacaaacuuuuucagcacaguucucugggcaagcaacuuuagugauuaaaguuagccuaaaagacuaaaucuaugugccaucauagagugcaaaguuagguuuaaauguaaauauaucuagcaaagguaucauacugacuuaaaaucacacuaaguccuaaaugacuggucuucuuccaagugaacauuuuauuggagguagggaauggcuaagaagaaaugcuguuaaguguauagaggggaggggcagaaggcauguaugaagaaaaggacagguuuuauaaucccacccacauuuguaucugaacauguguguauggcaaacacaccugauagcaauaacuuaagcauacccuaagaauaacccuguauggcagaugcacuugaaugugguuaggugucccaagcuaagaauccaagaauggccaacccagagaguuguuccuaaucuauaaggaacaucugagccccuggccuguccaauggaacauggcuguauagggaaucaaggcccuuuguuugggguuaagugaagguugccagguagagacugucacagggagagugcuaaguaaauaugccauauaaacugcauguuuuuugcaaguugccugguucuccuguccagcccacugccacuggacucucuccccuguauguaagcccccaguaaaagcccaugucacguuuccugucucugggucucuucuucagccucuugaaccuggugccauccccacugaaguugauagguguucagcacaacagugucauuaggaauuucuacaaugucauaagcaaugucauaaggcauuucuacacacucucacuugaaggaaccaccuccauuaguguaccuuagucuuucacacaaacacauaccugagcccacaaauaaagugcucaaaaauaguggcucucuucuucuaguuguucaggccaaacaccuuggaguccaccaccaaauccuuuuaggacaaccuucaaaagauuaacagccacuucuugccauccaaccauaccauccaugauaauccaaccauuucuugccagcucuacccugaccuccaaaaucaagccaccaccaagucuuggcaagaagggcuacaauaauuccccaacagucucagcuucugccugugauccuggacugucuaucucuacuuaggagccugcuaaaaccuaagucagguaacaucccuccucuggccaaaaaccucuaguaccuuccuaucucacccagaguaaagucccacaaggucccucacgcucuuguucccaacugucucucaggccgcuuuucucuugcccugcuuuguacucuuccuuccagcccacaggccuccaugcuuuccucaaacaggccugcuauguuuccaucccaagaccuuuucccuugcugcugccuuugccugggagacuuuuacuccaaggugccauauggcuucuuccuuacuccagucacaucuucaauguggccaugagaggcccugcuagaucacuugaucuaaggcagcacacaagccagcccccaccuccacccucucccucuaauucuccuuaccuuguuugauaauuccucauggcauuuaucacuuucuaacccaauauccuuccuuccuuuccucccuccauuccuuuuuuccuucuuuucgucacuaucugucuuccaauagaaaauaagcuccauuugcauaggggcauggucuguucuacucauucuucugccuagaauaggaucuggcccagagcaggcugaccaacucuuuacuaaaaacucauccgucacugagaacuagcaccacaccacagaaggaagaaggcucugcaucuacaaaauacagcugcuuuguuugagugcuuugagcucugucuccuguaacugggugacaaaggucuaaacacauaaugauagugcuggugugauagaaagugaaaguucuuuacucuugaaaaaaagcuagauuuuaucaagugcuggauuugcucaguggcauuuagguuuuaccgcuauaaaacaauauuccuauuucuuaaguucuugcuaggaaaacaaguaacuuugauuuuucagucugaaacucuccagcgccccuuaacuauggcccccgaaacaaacauuuuauacugaauuuuugauaacacacaauuuauuaaaaugcagcuauuacauuagugcagaauaagcuauauacauucuaagauuuagcaugcugucaaaagguuuccucauuggaacugauagcuaccccuaaagcagagauggucuugagcauaucauuuacccacuuuaagccucggugccuuuaaucuguaaaaugaauggcuacaccaggcucucucuagcauuuauuccaaaugauacauucaggcaggcaggcaugggauccaguggaaaagacuugggauuuggagcuugagaucuggcucugucacuuacaagccacacugaaucucauuuuuuuucaucuauaaaacauuaaucacuggaaauaacuaccuugucuauaccaccuuuugguaucuuaggacauacauuuggaggaucaccaagacagggcugugaggacaucuauuugguuucccaggaugagcagaguaccugacacaucacaggcacucacgugcauuugcugcguggaggaaagaauauauggacaaauaaaaaaacacuuccacaccuccccagcuguuguaaggacuuacuaaagcaaugcauguugaaagagcuuuuuaaauucuaaaguaauacaaaugauaauaauuacugugauagaucuauuucacauuugcccaguucagccuugguugucauacuaauuuaauaccaacaugacuggaacuggaaagaaacuaauauugauugaggucuuacuauauccuaagcagauacauauguacguaugugcacguauauaauuugagucuucuaccuuuuuaaccaggugggugucuuaauguaguuauaaguucuagccagcagaagucagaaacugagucaaaacugaacucacaaaucagucaacaguuacuuagcacucaguacuugccagccucuaugcguggugcuuugcaggcaugggcacauucaguuuuucaacagccuuugagguaaccacagauaccccuuuuuauagaucaggaaacacagacucagagcaguuaaguaacuugcuucaaguuaacagcuaggagguggcggggccaaaauuucacugucugacuucaaaguccaugcccuuaagcaguauauauuaugcaguacauucauguaagcuuaucacugaagguaugcggaauaauucgggugcuuuuauuuuuguucaauaaaaagcugcuuuagcacucuaucaccacugccuuaauuuuuuuuuuuuuuucuaaaaugaaaaucugugccugggaauauggguauaacuaaaaaugggacaggagaccacccccagaaagacaggcggccccaguuucaaguucuuauuucucacauuggcccuucuggugugucccagcuguauugucauaaccuauagggaaguuccgcagucaggaaggccaaugacaauauauuuccccugacaacacccuggucccuuucugaguuauucaaugacaauugaaaugucuuuucaauauuuucuuuuccuuuucagggcaaacauguccacuugagucauuaugaucaucagcuguucugauuugcaagcaguuccuaauugaguaggacuagugaaugcugugagauaugaaauaucuugcugcuaaauugcacacaggcugaaggcaauaagaauuuguuuagcuaugcauagcgcuuuauauucagggaccagugguuauggagacacuaaaaccagucaucauuaggacaauccuaucuuggcuaccagagaaugaagauccccacacagagcuaccugaacagacuaacggucaagaggcugaugaggcauuaaugagaccaugaaucaaaauuuaccaaacaaacagugccuccaaggcuucuaguuguuucuguuugacuuuaucuuggaacuaacuauggaacaagauggcuguguuuagaugucuucauucauggccuaucuuugaacacuguguguguuuauuuguuuguuuguuuguuugagacagagucuuucucucuuaucugggcuggagugcagugguaugaucauggcuuacugcugccuugacuucccaagcucaagagauccucccaucucagcaccccaaguaacugggacuacaggcgugcaccaccaagacugacuaauguuuuuauuuuuaauuuuuguagagauggggucucacuguguugcccaggcugcucucaaacuccugggcucaagugaucuugccaccugggcaucccaaagugcuggaauuauagguaugagccaccaugucuggcaucuuugaacaauucuuccaagcaacuauuuugacuucauuucuuucuaggaaaaauaaauaaacaagaucauagaguuauauuauacaauauaaaauccaaauacugacaaaagucaaccauauuagucacuuuccacuaaauaaaguugugucuaugguucuuucucugggaaaauuuaccauguaguaacuaucauuuacuuaguaugugcuaagcaccaugcugagagcuuuguuccuaacucuuaguuagguuaccuuagaaagccccccacaccuggguuauuuccuaguucuauguucuagguaccucucugucauuaagcuuaccacaaacucauuuguuuauuugacaucucucuugaauugaacuguaagagucacuagagccaggaccaugucuaucuuugcccccauuguaaccccagccucuaacauaacacaugauauacagcggaugcucgauaaacauuugaggaauaaaugaaggaagcaagucgaagaaacaucccuggguugcuaucgcuguaagcaguagaaguugcauuugaauucagacuccaaagccuguguuccucaccugcagcacacggucucugucugagcugaauagucuguugcaucaaaacacaucaaacaggaaauaaacaagagcaacuauuauuaccacggucccauacagccacuagagagcaaaagggguuucucuaugacuauugagguauauuaaggacucauuacagaauaaacacuacugggcacaaaagcauaugagaaaaguuuuaggaguacaaugaaaucaugcccaaucuuuccucagggucccuuuccauucucuauuuauauuguuuccaguuuauuauuauuauaacugaacauuuaggacccaagggauguuggccaguggagcuacagaauucucaguccucugaggaaccuagcaacuaguguuuucuuaccuggcucuuaggagcaaaaggagaaaacaaaugugcaucccugagcuguugucuagcauauaaaaaagaugcuauuauuaauaacauuuugucuuauuaacauuuguccuacugugauuuauuggcagccagaagcccaagcuuuaggauuagucagaccugaauugagccacuuaguucuuguagggccuccaccaaguuauguaaccucaaccucuuucuucaugcauaaaauaggauuaguaauacuaucuacuucacauaagugcuuggcauagaaucuggcacagaggggaaaaaaaaacaaucauuggugcuuauuuucaucagcuuccuccuaauuauuauuuagucagcugugaguaaaaagaaccuagcguuggccauggaaccuggaaauaugaccuuugacccuguccuguuaaugcaauuguagugagugaauuuuuuuuuacguguucccauccccgagcagucccucccucucucaaggacccgguggacuuccuggucuuggcaaaguaugcaacacacauuuaccuuuauccugccagggaagugaagguuugagaccauuaagcugggggcuucccaccuacaguagcuccccaaugcuuccaguacaaaguuuaaacuccuuagcuugccacucaauacccaacaucauuugauccaagcaacuuugagcuugacaucagggccaaaagaugcuuuuuccacuuaagaacagaaauucaguccaguagacuaguggaggauaugcuaauauuuuacuucccuuuccauccggaacagauaauaugguaaaucaucuguucauuuagucagaaauaacuguuguucuagguguuggggcuauaacugugaaaaagaagacuugauuuuauggaauccacagccuagugaaagaaagagacaauaauuaaauggugccauuguguauaaucaguggauaauuauaauuggaaauaagugaaaagcaagauaaccauccuuggacuggaagagaaaaugccaaaagcccagaggagggcuaagaguucaccaugugaaggagguaucacugugucuagagagagccuggcauagaauggaucugaaagccugauaagaggcaggagcgccaagaguaaaggccaagcacaaggaggcuggagcaauagguagagcccaacuguccagugggaggaaggggaggaaaugaugggagauaggcaaggaggggugacagcaggaaggaaggaaaaugaacaaaugccagauauauucagcagauaaaauagaaauaagcugcugauaaaauggaugacagggaagggaaguccugaggguguggcagguagccagaaugacucugagauuuguggaguguggaaauaaaaggauggaagugccauuuauuaauuuuauucuuaaagauaccuugagacaguugagaggauaugaugagacaacugcauguauacaguugugcauaagguucagagaaacacuccggcuggccauugcagcuuguaggaaaguauagggccugggaagaagaguauugaaaaaagaaaaaggugacacgcuguucauaugagagaugcaagaaugaagcaauaguggcauuccacaagccaggacugagaccgucucccaaacagccagaugacucugaaccucaaaccaacuugcagucaccuuagaauuuuauuagcugcaccagauggcuuacauaauaucauuaacuccuccacccucacuaccuaaaaaugcuagaagauaaaagggacggcugaggaaaauccuggaauuuucuuacagaaacaacauuuacaacagguaacuagcccaucaguuucucuaguauuucucagacauuuccaguuaagucucuagaaugacaaaagcaaaugauccucgggucuugguggugccaucuuaaguuucccucuguaaauguaaaugauuuuuaaagccucgucuaguacuuuaaaaauucaugcaaauuuugcauguuacugcauaauaucauuaugcugcuuuuaauacguacacacacuuuuaauucucccaaauacugaagcaaaaaugaugugccacaaaugugccuccauuauuagccugugacuuugggaaugcccuuguccacagcuuugcaugcaggguugaacucauuaacuaaguugagaaccaugaaauuaaucagaaauggacuagggaaguuuuuccuuagagcagaagacuagagucaugaccucuaaaaaucacucuucguuccuacaaauucuaaaauaagugguaauaauaacauuaauauuaaaaucacacuaaguggauuuuaaauucauucucucacacuagagguaguuacuaugguacauaguaugagagagguaucaauuuaaagauaaagaugaggauacaaacacagaaaguuaaaguaucuuucaaagcaccauaauuugaagccagacaguucuaguccaagccaaacuacuauuguccucucugcuacauauuagcagcaaacucaucuuacuacucuugcugauggcuuauauuuggugauaaucaagaacaauacugaaaagcaugcuucaaaaauagaaaaaaagcuucaucuuccccaaacauaauuuuauuuaacugaaaaauaucagugugcaaauugaacauuuuugguacauaaagucaaguguuacuaauuaaguaaaugagugaugaaucauaauaucaacccagucauuaaacaaaauuauaaugaaauuacauuuaccaacuaguuuacaguacaaaaaauauaaugagccaacuuuaaagaaagcuuccaauaauuuuauuaaggccuuccaauaauuuuauuuaguuaaggauucuguuguauuaucuuaaaagauuaauacaaauagaaaauggaagaguaaacugugcaaugacuucugucccucucaaccuuucucuagagucacaucuuuuaagcaacaugagacaugauuuaauucacccaagagaggucaccuugcuugccgggcaggugccuucuguuuaaauucaguuuacucaaucaaauguaccacggaauagaaaauggggcauauuccuguccugaaauucuuccuauguuaacuaaaaucaccuuacuuuuguagcaaaugagccaugagauacggugccagaaauugauuuggaagaguaaguacacagucugaaaacagugucuguauguuuuguaauaaaaaggcucuggauggcccuagaugccaaagagaggcuauaaaaggacaaaggaaugcaaacaggggcagaacuauacaaaaagauuaaaugcaucaccacuaaaagcgauacuuacucuucuauaaacauauacauuuacugauugcuaauuuuuaucugacgagugguuuugagguggccucagugcaaugucaucuccccugagcuugugucuuggaccuagcuagaguagaucauuacuccccaauacagcucccauuauuuucuuccuagcacuuuaaaaaggcucuaauuauuuucucuuuaguuuuccacuugcuaauugccuauguucccuuugucauuaccagugccuagcucagugucuggcccauagugagaagauacuauaauauauuuaccgaacgaaugaacaaagcugcgaguggcaaacaggauggggcacucuuuugaguucauuuauacaaaucagauucuauuucauuuuauuaaauacuuuuauuuacucauugucuucugaaauuacucuggguucucauuaauaaggagaaacugauucuaucuucaggaaggaggggaaaaaacacuuucagucacuuguuccaaaggucuuucaaaauaauguuguaguauaauuugguuugaaagcaagguccaacauuuuauuaccuccaaauuuauucagaaaagcugaaggcccgugauaaggcucauuaagucgcugaaaggccuaucuucacgugccuuucacacaaaaggucucaacuuaaugccagguaauuacuguucauuuuccccugguuaucucuauuuccugaagauucccagaguaguuggccucaguggacacuacccgcagucugagaugugagcagagcaagaaggacccauguucacuggaggaucuuuuuggagcuguaacgaaagacaauccuaacacuggggucuagaauuuaaacuuagaucaucuacaaguuacccucuauccagaauuaaagccaagagggaaaaguuucuggcauacaaacugguuuguauuuccauuucaaagacaucauuuuucauagcaccuggaccucauuccacaccuguaggguuacagaugugggcccuggcuccagauuaccugggcucaacccucaacuucaucacuuuccacuuuguaacuuugagcauguaacuuagauugucagugugucaguucccuuauuugugaaauagggcucauuguaccuacuggaguguuguuguaagaauugaauguaaaguagaaggaacuuuaucucacacaugguaaguucuccauaaaguuauuuauuuauuaauauuaauuagcauuaucaugaucgucucugauaucccauuugcaagcaggacuuaucccuguuauuuauaacuuugauccuagucccacuggacccaucauggcauugagggagaucaaauuucacuauuugugaaacaagccaacagaaggugaaugaugaucagggaagacauuuuacugggcaccaucauuucaguuuugcacggaagagugguauagccccuuagaggucacugaagucaccauccccaagcauacaccuguuuuuauauuuaaucaauugauggcugcaauuuacuaaucugcacugcagugauccuacaauagccuucccucacagugggcucuccucacuucagccaggucauucauaagagcuuagcuucauagauacugugauaguaauuuuuuuuuuuucgagauggagucuagcucugucgcccaggcuggagugcacuggugugaucucagcucacugcaaccuccaccucccagggucaagcgauucccugcuucagccuccugagcagcugggauuacagccaccaugcccagcuaauuuuuuuuguauuuuuaguagagacgggguuucaacauguuggccaggcuugucuugaacuccuaaccucaagugaucugcccacauuagucucccaaagugcugggauuacaggcacaagccaccgugcccagccuguuauaguuaauuuuacugucaacuugacugagcuaagagauucccagguagcugguaaaacauugcuucugggugugucugugaaacacccugugaggguguuuuuggaagagauuaguauuugaaccucaguagauugaguaaagauaacuguccucacaaaugcauguggccaucauccaauccacugagggcgcaaauaaaacaaaaggcagaggaagggugaauuugcucucucuuauggagcagggacaucagccuucucccgcccuugggcugggacuuacaccuucaguucucugguuuucaggcuuucagacuuuaacuagaacucacaucaucaggucuccugguuuucagcccuucagacucaggcugagacuauaccgccagcuuuucugaaucuccagcuugcagacggcagaucaugggacuucuccaccuccauaaucaaaugaguuaauuccucauaauaaaucucuuuuuauugauucuuuuucucuggauaaccuugauuaacacaaccucugaguuacaagagauaauuaaauauagcagcugagagcaugagcucaaaacuugaaugaccuggguucaauucuucacugucacuagugaaccagggcauguuacuuuauacacuaaggcuaaguucaccaucuagauauaggguuaauagagugguaacaaauccaaaggacuaaggacuaugauaaggauuauauaagaucacuaugggugacucuguaaaacucuuagcauguugucacuuauauaacaaacauucaauaaacauuagcuacuauauuuagacaugucuugggcauguauguuccagaaaucuuuuuauauuagauggucacuacagaaaggcaaucuauaugccaagcuuuucaaugaagcaaacauuauauuugaauacugagucuuaaccucaaaagguuacagaacaauuuucauucaagaacaaaucagaaaucacagguuggaguguacaucaucccuuggcagucucagcaagcuaacccuaccuaaagugucagaagacuuuucucguuuacagaaaugccuuuagaaauccccaaccaaccacugguagguccccaagcuucagucuucaaagguggcacuuuugcaggcuaaaaaauccaaaaaccagaaugucucuucuccuccaaaggaucacaacuccuccccagcaagggaacaaaacuggaccaagaaugaguuugacgaauugacagaaguaggcuucagaagguggguaaugacaaacuccucugagcuaaaggagcauguucuaauccaaugcaaggaagcuaagaaacuugaaaaaagguuagaggaauugcuaacuagaauaaccaguuuagagaaaaacauaaaugaccugauggagcugaaaaacacagcaugagaacuucguaaagcauacacaaguaucauagucaaaucaaucaagcagaagaaaggguaucagagauugaagaucaacuuaaugaaauaaagugugaagacaagauuagagaaaaaagaaugaaaagggaggaacaaagccuccaaggaauauggaacuaugugaaaagaccaaaccuacaacugauugguguaccugaaagugacaggagaauggaaccaaguugaaaaacacucuucaggauauuauccaggagaacuuccucaaccuagcaaggcaggucaacauucaaauucaggaaauacagagaacgccacaaauauauuccucgagaagagcaaacccaagacacauaaucgucagauucaccaaaguugaaaugaaagaaaaauguuaagggcagucagagagaaaggucggguuauccacaaagggaagcccaucagaccaacagcagaucuuucugcagaaacccuacaagccagaagagaaugggggccaacauuuaacauucuuaaagaauuuucuacccagaauuucauauccagccaaacuauguuucauaagcacaggagaaauaaaauccuuuauggacaagcaaaugcugagaaauguugucaccaccaggccuaccuuacaagagcuccugaaggaagcacuaaauauggaaaggaaaaacuguuaccaggagcuacugcaaaaacauaccaaauuguaaagaccauugacacuaugaagaauccgcaucaacuaacgggcaaaauaaccagcuugcaucauaaagacaggaucaaauucacacacaacaauauuaaacuuaacuguaaacaggcuaaaugccacaauuaaaagacacagacuggcaaauuggaaaaacaguuaagacucagaggugugagacccaucucacaugcaaagagacacauaggcucaaaauaaacguauggaggaauauuuaccaagcaaauggaaagcaaaaaaaagcagggguugcaauccuagucucugauaaaacagacuuuaaaccaacaaagauuaaaaaagacaaagaagggcauuacauaaugguaaagggaucgaugcaacaagaaaagcuaacuaugacacugaccaagacaauccuaagccaaaagaacaaagcuggaggcaucacgcuaccugacuucaaacuauacuacaaggcuacaguaaccaaaacagcaugguacugguaccaaaacagagauauagaccaauggaacagaacagagcccucagaaauaauaccacacaucuacaaccaucagaucuuugacaacccugacaaaaacaagcaauggggaaaggauucucuauuuaauaaaugguguuggaaaaacuggcuagccauaugcagcaaacugaaacuggaccccuuccuuacaccuuauacaaaaauuaacucaagauggauuacagacuuaaauguuagaccuaaaaccauagaaacccuagaagaaaaccuaggcaauaccauucaggacauaaacaugggcaaagacuucaugacuaaaacacuaaaagcaauggcaacaaaagccaaaauugacaauugggauccaauuaaacuaaagagcuucugcacagcaaaagaaacuacgaucagagugaacaggcaaccuacagaaugggagaaaguuuuugcaaucuauccaucugacaaugggcuaauauccagaaucuacaaagaacuuaaacaaauuuacaagaagaaaacaaccccaucaaaaagugggcgaaggauaugaacagucacuucucaaaagaagacauuuauguggacaacaaacauaugaaaaaaaaccucaucaucacucgucauuagaaaaaugcaaaccaaaaccacaaugagauaccaucucacaccaguuagaauggcuaucauuaaaaagucaggaaacaacaaaugcuggagaggauguggagaaauaggaaugcuuuuacacuguucgugggaguguaaauuaguucaaccauuguggaagacaguguggcgauuccucaaggaucuagaaccagaaauaccaucugacccagcaaucccauuacuggguauauacccaaaggauuauaaaucauucuacuauaaagacauaugcacauguauguucaauugcagcuguucacaauagcaagacuuggaaccaacccaaacgcccauuaaugauagacuggauaaagaaaauguggcacauauacaccauggaauacgaugcagccauaaaaaaggaugaguuuauguccuuugcagggacauggaugaagcuaaaaaccaucauucucagcaaacuaacacaggaacagaaaaccaaacacugcaaauuuucacucauaagugggaauugaacaaugagaacacauggacacagggaggggaacaucacacacuggggccuuucaguggcuggggcgcuaggguaaggauagcauuaggagaaauaccuaauguagaugacagguugaugggugcagcaaaccaccauggcacauguauaccuauguaacaaaccugcacauucugcacauguaucccagagcuuaaaguauaauaaaaaaaaaggagaagaacaaaaaaagguggcauuuuuucaaaaauuguauuaagugauaagauguuaacauaaaaauuauuaagaugaccaaaauacauuagaagaagcagaaaucaaagguaggcaugcaguagggucucuuuaaccuacuucuucuuguucuaucccccacauuaugcuugcucuguuaauggcaacauuuacucccuuaguguaguaauaaauguucagcaacugggugguggggguguucuaauuguaguguuugccaauuuucaugguguaaauacauacucucaccauggcuggcuucaagauaccaacaugauaucacugaaaagggaguugggaagagaagcuuauaaucagcucuuacaaauacguacaacauggauacucuugagcccaggaaaagaaaagguaugugaauaacauaguaucaaaagcaucuagucucuucuugagccaucagcccauucuugucagguucacuauugggagcauggagaaauauaugaacugaaagcaaaaguuaugaaggcaggggauagaaaauaguaucauuaccacugaagagaaagaauuguauuuuuuccuguacgauaggcaacauggcacacagacauaacaagucuggguugaggacggcuauuagagcaaaacguguuuuagaaucagaauuuuauauuuuaaaaccaauuggcaugauucuugcauauguaucaugaguguaugauugccuaugcaugaguucaguauuaagaaauagccaaaacucucugugguguaggacuuccaucacaccaaccaggcagagaggcuuucuuugaaugcccgaacucugcucauucuccaucauccuccauuaacggagggcaguuaaugcacauaucugccuguguggugguaaaugcuuaacaacggcugguggugggauggggguguucuaauuguaguguuugucaguuuucaugguguaaauauuaauacauauucucaugguggcugguuucaggcuaccaacaugauaucacugauuagggaguugggaagagaagcuuauaaucagcucuuaaaaauaaguacaagcuagcuccaaaaaugucuauacuauguuuccaagagaugaaaaccucauggacaaauacucuuucgcgauauauaugguugcuguaaaguaauuuuuauaugguucauugugagaguuuaaguauuacuucuuuuaaguacuagaaauggaaauauaaucucuaaucccuuuucuaacugaaugaaauguuaacuucgaucauccaucugugcaguuacucuucuaguaaaugugauuuuuuaaacuuucucuccucuuuucagggcuacaucugcuaguguuuuccauuugccagcucccaacauguccccaauuacuucuuuuuuauuuuauagccuccaugcugauguuucaucaguuacaacugcuggguuccacugagcauuaacagucugcagugccucuaggagguuacauaauucacuaaguauaccaaaucauuuuuucuccaaagaauauuauuuaauguaaauacagugugagguuaauguaguacaaaagaaagguuuuucccuuagaaucaucaaaaaacugaaaaaaaugauucacggaagaaugguuuacacgcaggaacaagaaaucacuuguauuuaaggauuauuucaacuggcacuuuuuuacuaaacacaaagcaaaaaauuaauacauuugaguacaugaacaaguuuguguuuuaccuauugaaucaaaauauuuuuaccacaagagaaggaagcuaaaacuaccuuauguuaggcauaugcauacuugaaaacuuaugauagaauagauauuugaaaucauuuuagucaauagcaaagcaaaaggaaggaucaagaaaaaguucuuuguuuuguuuuuaacucaauuuuucuuauaaauaccuaauuguucuccauaaaaaguucauaaauaaccugauggaugaucugaaaauuuccaggcagguagcaggaacucucuagaaguaaaugucccagaaacuuugcaaaucaaaucacucaauucuuaauagauggcuuaaaacuggguauuacauugcaaaguuuuaugaaaaucaucuggcaaacaacugucuuuucuucaagauguaaacaaugaaacaauuagguuuaaacugucuaaaacuaugugcucaaguguccccuuuuacaucagagucuaagugggacaaugauggagcaguuagaauuuucucagguagucagauggggaaacaggaaaaggaugggaggaggaguaaucauucaaggaaauuuuuuuaaaugacaguaucaauauugaauauuucuggaguaucaaucauuauaguaugcccuugacauauagaaucuucuccaguccauauacacugugaaguagguauuaccuauccaauuuuauagauagguaacaggauggugaguugcugcucaggguauuaaguaagugaccaagauccagugcuuagcuaagucuugucuucaacaguguggagcuggggcuggguugggaccucugugguccaaagccccagccacuugacuucauacugcagcuucugguugguaucuauggcaucuaugagucugacagcuauauuuucacucauuuucagucaaauauuuaucaggcaucuacuugagccagacaccauccuaggcagcagggcccaauaggaaacaagacagaaaacaaaaguaaaaaaaaaacuugucuucaugccuuuggggucuucuuuguaguugagagagaaagacaauuguauuaguccauuuucauacugcuauaaauaaaugccugacacuggguaauuuauaaagaaaagagguuuaauugacucacaguuccacaugguuggggaggccucaggaaaauuacagucauggcggaaggggaagaggcacaucuuacaugguggcaggcuagagagagcagguaagggcagggaaaacugccuuauaaaaccaucagaucuugugagaacucacucccuaucaggaaaauggcaugggggaaccacucccaugauccaauccccucccaacugguaucucccucaacacauggggauuauaaggauuacaauucaagaucagauuuaggugggaacacagagccgaaccauaucaacaauaaaacaaaauaaacuaguaaaguauuuagcauguuagcuggugauaggugcuguagagaaaacaaagcccggaaggagcguggggagaguaccagggugggugguggaggagguuccaacuugaauggugugggccucauggaaaucuuguaaaaaccccaagaagaugagagagcaagcccuacuguacaaguuccuggaaguaaagcacauagggcugagggaaaugaagggcagagcaacccuaaaaggcuagaagaaaaguagagagccuggaguggaaugaccaagaaaaaagcaggaggaagggaggucagagaaccacaagcgcgguggcagaugaugcagggccuuguaagccaccaucauaguugccaucucuucuccaaggcaagugagcagguugugaaccaaggagggaucucuccccaacuuacgcuguaacagaaucauuugacuucgguacugagaaucaaccaaaagaugugaagaaagaccccuuaugagccugccacaauaauccaagugacaggugacaguagcuugggcccaagccauagugguggaggugaugaggcaugguuggaugcuggauguaagacuagacacugccauggcuaugcaguuuguucugccacucaguuguuuggcaugacacaaacucacaggaggaauuuuauauaaaagaucgauacaggugagauaagaucuccaauucuuaaacagcagagaaaaucaaauguuaauuggcaaauaaaaugccaagaagaugugcuugaaauaauuaaaauaggcaaaggauugaucaccuaaaaauagaagcagaaaacaaacccccccugacaguuuucaucucucacaguuaaauauuaagcuuuccucuuaagaguaacuuggccaggugugauggcucacaccuguaaucccagcacuuugggaggccgagguggguagaucaccugaggucaggaguucgagaccagccugaccaauauggugaaaccccaucucuacuaaagauacaaaaaauauuuuuuuuuguauuacaggguguggccuguaaucccagauacucaggaggcugagacaggagaaucacuugaaaccaggaggcggagacugcagugagucgagaucaugccacugcacuccagucugggcaacagagcaagacucugucugaaaaaaaaagaagaagaagaacuuuguauuuccuacuuugcucuacacaucuacacauagaagguauuuuaaauauuuaugguuuguugauuuuaaaagaggcuuuguuaaaacgaaaguauuaaacggguaaaaaauagaaccaagucugugugacaauacacuagauuucaaauucucuuuugcaaguauuuauugaacacuuucuacagacaagguacaaugccagauauuagggaucugaagagaaaaaucaguaaacaaaguuauuuagugcaaggacaacauaaacaauaaugaaaaaagaaagagauaaacuccagcugaaaacauaaagaccacauaggaccuguuuguuaaauauaagauucacagaauacagugcaaggccagggaauaaaugaaaaaccuacaacuuugaugacuuauuguaggaccaggcauauuacuuaacauccccgauccucuauuucuucaauuacaaaugaaauauaaaaguaucucuuaaaacaugucagcagggucaaauuauauaacuuagaagauaauagggauucaauauagcuuagcauucuucccuaauuuuuuuuaaucuaaccugcaauuacaauauaggcgacaacauuuucagagcugaaaugcgcuuccgucagcuacacagucuucaugaugaugucccauccacagggguuauaugugggcccguccuaguuugguguucucuuugugugccaaagaaaugauuaucccccaaaagcagcagccaucauuugagaccucucuaguucguugauuucaaacucuguuacuacugggauuuaaacuaaagcuuuaagauugaaaagaauaauaaauacagcaggcucucaaaagggaaacacuuaucuugugaaaaaacaagguuguuuuuuuuuuucuuaauucucaauguucauucuggaagauucaagguuaucuacuaccuguuuuucuuccucuccaaugcucaacucgaaaguuguucaaaagguucacuggcauacauaagccuggacccuauacaugcuuccuacgugaaauauguucuuacuuaggaaaaaugccaagcuccaguaacugugaccuacauaaauucuaaggugcaacguaaggagggcaagcaaggcauuacugaauuguauaugucacgccauacaagcugaugugcagcucccucaaagucucaaaggccucaauaauuguaaauaaacaauguccuugaguccaaaaagacuaugacaucccacaaucaaaguauuaacuuggaaagcauugccuacuuuguauuuucuagaaauguuucauguguucaucaacagcaugccagucccaauguaagacacaaacacagagacauucaguccauaugacauaagguugaaaucauccuaauugucgacaugagaaaaugagaaagcaauuuguggcaucuaaauacaugcauaauuuuuaucccgucugguuuuugcucugguucugugcaaccugaaauaaggagagugugcaacugcuuggugacagauugcacagggauggaggacuguaaauggaugaauaguuggaacaugguugaacucaggaaugaaugaaccagacucuccugaugaaauggcuccacucuggagauggagcccaggagagaugcugaauucacuuuuucacaccccagggaucaauuugguuaauaaccucucugcugccuuaaaaucacuugggaacaccugaacaaaauacaaauucaaagcaagaucuucgaagcuuagagaaacugaauugaaucaggaggugaaaaucuugaacauugacuauuucagcuacuauacaccuauguccauccaauuucaucaagaugcugaaaaaguacuuaggguaauaaguaugaaaaauguuacacuucuuggaaaaccagugcuuaaauguucaguaaaugauaccuuguuucugaauuucccuagcagcacugaauucuuaaucauucacuuauccauuuaaucauucaaaagaaauuuauaucuucacuuuuucuccugauugcaugguaauaccugcuuacuguaaaauauucaaaugagauaguaucacaucaaggagaaaguauaagucucuagaaauuccagaaaauguguauuuguuaaccacuacauucuaggcugugugcuagaggugccacagaguuggcaaaguaaaucugaaaacauuccuguccucaaaaagaccagagucuaguaagagagaugauaacaauaaaaguacuaaaauauaguacaagaaguaaugcaagucauaaaaaaggucugaauaaaugcuauaggagguccaagaaaaagaaacgucugcuaccuaagaauguccagggaaaacuuccuuugcaaaaagaaccuguuucugccauuuccuugaccauacaacuccacguguuguguuacuuaugaguccucugcucagugccgaaaagauuucccuauacuaagaucucagugcuucguuuaacuuguacaaaauucccaaauccacauucuuacaauuuccccaaagauucagcaauucugaauuccgguacaccuccuaacaggguaaacauaaagaaaucauuugaucauuaguuacuuaccauuaucauuguucacagaaauuggggaaauggaaaacuauaagacuggaaaaagauaaauguucccccaggcccucucaaaaaaauaaaaauuuuggacaaaauaaagaagcucuagguuaggaagaaggauaagaggcacacgaacacaggagcaugccacacacauuuaacacucaauacacaagagcuaaagagaaggcuguguagggucaaagugaguuugaaauacauaaaagcugaggcuauauaaaaaucugcauuuacgauaacucuucuaggcagggagguuguugaguacagacgaaaagaaccaggagaccaguggugacagaggauucugucuuugagaagcugggagaacuggaauaagacacuuaacccuuuggguuucaugauucucauuauuaaaauaaaauaaugauccuaggccuguaugaaauucaaaugagauaauauauuugaaagcauuuuacaaaacaguucauaauguauuuuauaaaacacauaggguuaaaguaguuggccaaaguucuaaugaaagauuaguugacucaggacauaaaucugaauuuuccaaaugaccaaucccaaauuguuaccucuacuaucccuuagaaguaaaaaaggauuuaaacaacucaacagguaaaaauaauacuuccuccacaauaaauaccauaucauauuccccuuuguuccuccagcaucuacacagugcuuugcacagagugaguacucaguacucuagaagcaaaacucaucuuucuccuacucuaccuuccuaucucuuagcaacuacuaauuuucugcugcauuuuuaguggacaucagcaucaguaaguugccaucccaaggaacaaagucaaauuggcaaaaagguggaugggcuagcauccaucuuugguuguuaucaaaauauucuccuuccucagcacacucaagugaaggccauaaguggacugucugggccgaaagucuccccauacuuccaccacucuuguaucauuaaacauucuucgcagccuuggucaggagaggacugcguggaugggcacuggacaugcaaaguggcccagguacauagcagucuugucaagcuuggagaguaguggcccacucuuggccccaggccacugccauuugccugucauuuguaagagcacagaccagaacaugagcccagucugcugugcaccucacagcaacauccugacaauucugaaacucaaaaaagguuucguuguuuauuggguauaagccaggcaggacugaaaaggaauucuuuaaagguuaguggugcaauacuggauaagagcuuuacacaucccagucuuccuuccuuggugucagaacgggauuaacaggaagacuggccaacagaugcccaggguaccaaucuaagaggguacuaaaauagccccagaaaacuaacacaaugaagaaaacagcauuuaucagaacuuucuucaagaagggaacuggguuucauuguaagaaauacuucgauaaaacaauugagguagaauagggaugauaugcuuugaaaaaacuaaaaacaaggccaauauaaugcuuucauguagggugguuccaacaaucaaagggcuuucauuuugcuaagcugaguauggaggccaggacacuguaaucuguugucaucuuccuccacaagcagcacuacucaaaucuguuacuucacuugauugcugaaggaauacugaauuagucugcaugggccacccacaugucuuaguugagcccuacaugagaucaccaguucucagaaaaggucuggcuguucuguuucaguuccccaguuuccauuucuugucucccuuaccuuauucauccauagacaauucaauuacaaauauuuacugaacaccugcuguauuucaagcccugggaaggaagagaugagcacaacauaaucuuggugccagauaaacacauguccuagacagacaacuaaguuaauauaaggcaaauggaugggagcucuaugagagaaacauacaaaugcaaacauggggaugccgauaaggagugagggaaugccuuauggaaaaugugacauuuacauagggccucuuaggauuaggaggagcugacaagugcaaaagaaggauagagaaacccaaggguguugaaugaagggcacagugacuugagcaaacuguaaagaguccacagugaccacagcacaggcaacaugguuaagagugcagaagaugaggcuacugauaaaugucagagccaaaauuugaaaagucuuugaagccauuccagaacguuaagaucuuacucuggaagcacaagggagcuaucgaugguuuuaagccagaaguaaaagaaaaaaaaaugugguagauuuguguucagugaaagaacucuggcagaaauugaaaacuaauggauagaaaugggguguagggaguagaagcagaaauugcaguggcccaggaugagaacagaauauagaaaacaggcauuucacaggcaaaaaucaaugguaguuggcgacuauagugcauagugaugaagaggaaagaguuccugucuccuaauucauucauauucauccuuuacaucucagaucaaaugccacuuucuaaaggaagacgucucaaaccccaagaauaaauuagguccuucuggacaugcucacaaagcacauuggacuuuuccuccacagcauugaccucaguuuauaaugcuauauuucuguaauaaauaaaauuaaucucuguaucugcuaccagauugugaaccucuugaggguacaaccaugucuguuuugugguuccuguauuccuaguaucuagcuuuuaguaggaacucaaaaacuauauuuuggaagcaauaagggaaggcacuuaaggaucacauaaagacuucuauacugcaaugccagguagcuggugaucccauuaacuaagacagaacauagaaaaagaggaaaaggggaaaauagggagaagaaaaugaauuccagaauaaacaagguaaauuggaaaaaucuucaagaauuccagauggagauuucaaauagcuugaaacucagcagucaauccagagauuauagauuuaggaaucaucuauguaguggaagagaggagagucacugcuuuacucggguuaaguauaugacuccagaagaaaagaggcucaaagauggagcccugaagaaagccagagguagaauccaagcaaacuaaauaauacagcaaaaauacugggaaagaaagucugagagccaggagaacaaccaugagaggguuguauuuuaagaggucaaggagccaggcacaguggcucaugccuguaauaaugccagcacuuugggaggccgagauagguggauuaacugaggucaggaguucaagaccagccuagcuaacacggugaaaccccaucucuacuaaaaguacaaaaauuuagccaggcgugguggcaggcaccuguaaucccagcuacucaggaggcugaggcaggagaauugcuuugaacucgggaggcggagguugcagugagcugagaucgcgccacugcacuccagccugggcgacagagugagacucugucucacacacacacauacacacacacacacacacacacacacacacaaagaggucaagggagguagagcucaagaaagagaaagugcuuaguggggcccaauauuaccaaggguaggggguuggcucauaagccucagaaaguggugggcacugggauucaggcagugucuauuucuaaagcaagagaucccaaacucccaaagaaaagcugaaaacagugaugaaaacagcaggugugcacagaaggaaacuaaaaaacaugcaagaaaauaauuauucauucaauaaguauuuguugagcuucuacuaugguccaagcauucuauauuggaaguauagcaguaaacaggauauaauggucugugggcccacaggauuuaagagcagauaggaucaagaucaaagaaaaagagucugacuucaaaaagcuaugagacaucucuucaaaggaaggagaaaugaucuggggcuaaagauuauaugggcagaguccuagaaguaucaagaagacagaaaauuuuaggguugucaugaguuggguugcccugaaggcaaaaccugagacaaggacuuaggugcaggaguuuaugugagagaugacuccaggaagcagagaugaggaaauaggguguaaaaagggaagagcaaaagccaacuaaggguacauuaucaaguuuaccacuugccaaaccagcaagaggcugguuuggccagaaccuccagagaaguacacagcuugccuccagaacuguucaccugaaucgcaaaggccggagcacuuauucacauguucaaaugcccaguggcugagaguagccucugagggcauuuauucccacagacguccaggcuccucuucagcccaggccaugcagacucccagcauaagagaugcccuuggggaagaaagcagaaaagcagaaaaguaggggcuagaggugggaagcugacuuggacaaaacuggucaccacaguuguugcugaaaucagagauaauuucacagagggacugugaaaauggccacaggggcaucugccacaaagguaguguuggugagaacuagguggaaauggcuaaucauucagcccaggcuaguuaaggagaaaaaaaaagaaugcuaagagaaaguggcuugggaaguuuucuaaggucuaagcuuucuuucaaugauuuuuggccucugcauaaaaauaugaacuuagggacuuacuaauagcucaaaguuaagaucauagagaaggcguuguacuccucuaggucaagggcauauuaaccacugauauuuauugagcacuuacuaugugccaggcacuuuauagucaucaucaaauaaaucaucccugcaacuguauauacucauuaguauuguuguucccauuuuauaaaggaaggaacugaggcuuagagaguuuuuaaagcuuuuaagaucuaugagguaacaaccuauuucauuuuaaguguaugucaauaacccacacuugcauccuuguguucgaacacacacacacacacauacacacacacacacauacacacaguaaaaucagauaugaggaauuucugguuuuacuagagaauuuaguuuauuuaucuucccugucuauuucuucauuacauggauaaugaagcacuucuagacucuuuaaugaauacauuuauuuaaauuuuaaaaaauuuauaccaauugaucaauguguuuucaucaaauacguggacuagaaauacagaaaauaaagauguuuagauauagaaaacugagcaaaaaccagcuacaaaauaccaccaaaagcacagagcuaguugaagucaaaaaaagcaucauaaagggaaaaacuaaaagcaucuaaauacagaacaaaaggcaaaucugauugaaaacuugucugcaucuuuaauuuggaggcucaugaucaugcuggagguaggaggcaaaauuuaauuuaaggagaauuuuggccaaccaucgcuauuuucuuuaacacaagaacaaggagggagagggaaugagguagacaacauccacggaggaccaggugaaggaaaagcagagagugaucauaucccauauccccagacacuuggauuagccucagggaggcugguuaggcaaugccaccaccaccaccgucaccacgcccccaccccccucacccgacccacccgccacucccagaauaaagcugguuuguaauuaguuuaggcuguagaggcuuguaucauuaaaauaaugaccacugggcauuugccacaaccaagauaauguuucauaaucaaauuaacuuggcucaaaaacuugauuuggaaccuguuuaugguuagucaucaaacagcuuucggggugcuugaagcauaagauaugcaaaaaacuagguaaguagugcaugaacacagaaucagaggaaaauguggcuauguuuuagucacagaguacuuacaauggggguuggagguaggaggacagugacuauacaagaaaaggauuugaaauugacccucaaagaacugaauaucuuuuuaaauaaaaugacaauauuaaaaccacaugcuuaaaauacguacggcuaagugcuucagcagagacugggauaccagauccugaguuccucaaaggcaggaguguccaagucauucacuuuugcuucaccggagccuaacacauugccuggagcaguguugguacucaggaaaaccuucugucgaaugaaggacuaucaugcuguuauaauaauuaggagaggacaacauagaaacauggaaaaccuuuuuaaucuacuggaaagugaaaaugauaugucaauggauugcaaccaugugcaaaaacagguguguuugaggacaacuagaagauaagguggcaaaaaugaaaacacuggugucagguguuaggauucugcauguauuguuguuguuucuaaaacugcauuuaauguugucagaauauaaucuuuguaauuucagaaucuagagaugcuuccauguuggagggagggaaggaacuggauacucaaugaacugauagcuuacaggcaaagguucaaacuccauugcuuagcacugcagacucuuuguggcacaguccccaagaacuccaguuuuauaucauaucccugcuccuuccuucuuccccaucacacugaauaguuugccuuuucuaaaacguaucauagguuucacucuuuuuuuuuuuuuuuuuuuuuuugguacacacucuucucacuauuuguaaugcccuuguuuccgucccuucuucauauggcuaaauccuacccauucuucaaaacacaacucaaauauuuccccucugagaagcugaccugauuccccacacccuaucccagucucaauuuuuggccacgucucuaaguuucuauagcaacuuaugcgcuuaccucuuucagagcccugucucacuaugcugcaaucacugguguacuugccuuucuccucuacuagccuggaugcuaccuacagauaauguaaagauaccuggggcuacaaaggccaguggaugacccacugucuuuuuuaccaaacugugacaguguggucacuuagucaagacucuuuugguugcaaguaacagacauccauugaaacugcuuugagcacaaaagggaaauuuauuuauaaggacauagagauacuucucagagcccaagguuagaaagugcagacacugaggucuggauccuggagcuagaaagccuacagaaucaaggcagcuacucucuuagucaaucagucuuacucucuccccauacccaccucucucccugcagccucacacagucuuuuaaucugcauaucuccagaggccuguuguauuccucucucuuucuuucucccucucucuugcuccgaaagacaguuauacaguggcuacaaguaugagcucauacuaccuguguucaugccuggcucugccauuaaccaacuauaugaccuuggauaaauuacuuaaccgcucugugacucaguuuccucuucuacaaaaugggaauaagaagaggucccaccucauaggaguauuacaaggauuauugaauuaaucuaagacauggcuucccacugcucccaaguuuacacaucuaccuagucuaucuacaaauaugucuuaguccaagaccacacuucugagaaagacaaccuggcugguccagcuugagucagcuguggaucuuugaucuacugagccacagccugggagccaaguuaaaaaccugaucaccagggcccauccuugaagauaaagugacaguucuuagagaaaggggccaugggcugagcagacaccagaaacaaaaaccugcuacagccacuaacuaaccaugcagccaugcuugugggccugccuaggauuacagcugggccuuuucaccucauggcccugagcaaggcucguauuuaaaacacacagcugccugucagacugcaaugacaccuaagggagcuccacacacuggcacuuaauaaaggcuuaauggugaugaugguggcgcugacaaaaaugacgguggcacaacaggccaugcuauugcuucccagcaguucucugcugggccccguggcuugaaguugaaaucagcacauccuucuaacucggcuaauguggcuuggcucuggggccaacccucaucagaucccauccaacugcuaguuagguagauuuauaccccacuaaauccauugucacacaagggcuuccuccucacugccagaguguaaagaacauagacacagcauccaauaaccaaaggaggaaaggccuccaaagaaaauuaaccauuugacuucaaaauguuaugcugcugcucuagaauuuccaaccaaaugaaaucagcugaagguccugcaucuuuaaauaauaaaaaaauaaagaagaaccacagcugugggcccuuacuagcccauaaauaaagccccguaugcaacucuauaucaaacuuuuuuuuuuuuuuuuugagacagagucucacucugucaccaaggcuggagugcaguggugcgaucucggcucacugcaaccuccgccuccuggguucacgccauucuccugccucagccuccugaguagcugggacuauaggcaugugccaccaugccuggcuaauuuuuuguauuuuuaguagagacgggauuucacuguguuagccaggauggucuccaucuccugaccucgugaucugcccgccucggccuccuaaagaucaaacuuauuuuuuauugcaguauaaucucuuuaacaaaaaacaagaauuguagaccaguacaucuuugcuaugaacugaaugucuguguccccucaaaauucauaugcagaaauccuaacccccaaugugauggaauuaggaagugggaccuuguuuuuagagaugggacaucaauuccaggaccaguaucaagaucucacaucauucucuuucacaaaaauagucugccuuugaauuuuuagcucucggugauaaguaaacuacacuuauuguaguuuuuugcuugccucaaauccuuuguagaaguaggcuggaaaauaaauaaauaaauagaauuuccucuaugaauuugaauagcagaguaugcauguaauagacgcuucaauaaauuuugcuguagcaugaagaccaaucucauuuucaaauggugaaucuuggcucauguauaugugguacuauaaucuuacaaguaggguuugcgguacacaucacuuuaaggaaugcugguacuuuaagugaauuugaauagcaagagcggucuaaaaucagucaccaucacugagcacagucauuugaaagccugaaauucacuuuuagaaaauucaucagaaaaaaagauucaaaaacuggcaacguucacucacagaucaaagacaaccuaaguauuuaacucaucaucaucuaugaggauaacgacuuuuaacagcuguccaugcaagagaaagcaaaaaaaaaaaaaaaauaagaaacaaugagaggcauuaaagcauaaaggucaagagcacuuugggggcagccagcccuaggucaagaaguccugacugugucauuuaccagcucuguagcuuugggcaaguugccuaaacacucugaacuuauucagucuuccauaaaacauuuaaauaauagugauaccuaucuuauuggauuucuauacuuaauaaacaaugaauaugaugaugacgaugaugucugcuuuuacuaugaggaaaaugcauucaguaacaaauauaaggaaaaaaauauagaauaaguaaggagacucuuuagcuauccuuauccacuaagaauaccuaagaguuuguaguaacuggcaaggguguauauauaaccagcacugaacauaucauccuuuuugcuauuagagaguaugcaaaagaggaaauauaaagaacggcuuugcuuugaucauaaucaaagggcguggguaaucuccuugagggcaggaacuaucuggguccuauuaaccuagcacagacaguaucaaguagcaagcauacagucaaagcaccaaaugaaugcaagaaugccuggauacacccugaauaugacuacaaucaaagcccgaagcucuugguagguuucacuggccucuuuccuuauaucuagaagaacguccuaccuuccuggucauagccaccacugaaauaaugaaaacaaaauaacaaaauaauauuuuaaacauacauagcauaccaguucauuaaaaauagacuagggaguauuuuacauugagacacuagggagcaucauuacuuugaaaugucacuuucugcuuuaauuaguaugcucuaaugauaaguauaugccauucuuaucuaaugaaagucuugaauacauacggaaucugguucacaguccucgcugggagguacacggauguacaaagaagaaacagaaugcauguguugaugucaacuaguuugcuuaccuuuauuaacauaauugccaaaguuucaaguuuuacaauuugaggauacauauguucaacacacccagaacacuuggcacagucaucugaucaccuuucacauuucucaagacagccuaagcuguuuuagggagaugugaaguuuccggugauuucuuucaagccgacucucggggguaucacucagaacaggaccaccugcuugguggcaucuuuuuaauaaagacagcaauaggucugcuugcucacagggaaauuuauaaggcugucuuugcuuccuuccaccuauuguggugcuuuauccaaguagaauguacucagucuucggagcuucaaagacacugauaauggacuucuuuucaaagagaagucuuagucauccgcuccuuucauucaacagucagaauaagaaaggcccagagggauacagacaaauaccucugagcugccuguuguggcaauaucagauaaagaaauucuguagcccagagagauauuugauccguucauuugaaagucaauacuaaacauccuucccagccacuccacccaagcaaugagaaugugucucagaaacaggacacagaaacuaucucuuacgauguagcuuccacuucuuuuuucuagccugaguggguuggguugaggaaggagagaaagaaagaaaucaagaaccaauguucucugcuuuguguuucccugauucagugaaaaacggaggucauuuauagcuucuucaauuggcugacccagaggaggcuccagcuuucucaggauuguaauggcaaugacauuucucaaaaucaguuaccaaguucguaccaguucccagcaauagaauacuugguuacucagggcuucuuucuuugggaaaucugcaucaccgggaugacugcaguucacccaggcccuacaauggguucucauuuacuacucaaguuucaugcagaucaucucauucacacaagccuacaggaccaaucugccucccagagccauggcucugcaccuucacaauugcaaagcaauuucucagggggagucaaagcuucacuugcuuuuuacagaaauggcucauggagauauuaucuuaaaaugcuuucucuuaaaaaaaauuuuuuuuuuaucugagaauugcaugcugugcugaaauaggauggugguggguucugauuauaucuuuuuuccaauuuugguuucacucuuaaguauagaaaauaucagguugcucucuccucugauucccuuuucucccagggacuaaaacuuuagucugcugagucaaaaguaagcuuugguauuaaauuccaucuuuuaucuuuuuucucccaauaucuaagaacaaugugauuaugcaucauuuuguacuacagaagugcugcugagaacugcaugcaaaauaaaucaagucaaugauguauuugaaugugacucuaaucacugaggugggaaaaagauaccaggguucuacuuuagacugcuaaccugcugugaucaccuuaccuccucuuuuaaaugagugggcuggaagugcuccagcucaugucuaaaauuuagugugcuucgcuaccucauggcauaacaauaggauggaaaaccaugcaaccauuaaaagugaucauuacaaaaaugacauagaaaaagaaaaaauaauuguuauaauauuuaauaaaaaauuauuccacaaauuaucuguacauuaacauuuuucauuaggaccucuuaagccaugccauuaucaaaaggggcaauucaaacauaucaagaguaucuguuaauauuuaaaauuaggcuguuagccuguaaugaacauauuuuaggggaaaagcuagaagucugacacauagaaagaaagaaagggaaaauauuaaccuacaaaauccuuuaaaaagguagacuuaaagcuuuuuuucacuaucuuagugaagaucguuaauauguaccuuacaguguauuuuaaaauuguguuucuuuaccagggaauuuuuuuuuaucuuuaguaaauuucagauuuguuucuuaccugcauggaauguuacccuucccuuaccacaauaugacaaaauuaauaauagccuuacaaauugugaagauacaaguuugagggaaaagauaccaacugcuuuuuaaauuacaauaauacaugauaucaccauuucauuuuauuuaaaagaaauguuuuacaacagaaaucauccaaccaauuaacagggaaaaauaagauggugacauaauccuuaggaaggauuacugggaaagaaaaaaacagucaugaguacaacuugguauaaguuucuaauguuuauguauaguguauguuuauauguauguauaauacauuauaauauacauagcauauaauauuuagagugcaugcauauuauguguuuuguguuacgugauuguuuuugagagauaguugcuuacacuauuggaaaaccacuggucauuuggcauuucuaaacaguuauggugcugcagaggaaagcuuuugaccagccuuugacuagccuuggucuugucguuauuuagcauucagaugugucaagaaaauuaauaccuaaaaaaaauuuucuggcugggcacaguggcucacgccuguaaucccaacgcucugggaggccgaggcggguggaucaccugaggucaggaguucaagaccagccucaccaauaaggugaaaccccaucucuacuaaaaauacaaaaauuagccgggcaugguggcaggcgccuguagucccaacuacucgggagacugagacaggagaauugcuugaacccaggaggcagagguugcagugugcugagauugugccacuacacuccagauugggugacagagcaagacucugucuaaaacaaacaaacaaacaaacaaaacugcagaucuguuuuuggaguuuuaaagugaaaaauugcauucuuuugucucuaguaguguaauauugacaguccaggcaauuauugucaugcuaacauaauaaaugaauuaccuuuacuauucuauugccaaugugcuuuuuuauagcuuuauuuagauacauuuacaaaccauaaaauucacccauuuaaacuguacgauucauucauuuuuaguauauucagaguugugcaaccaagaacacaaucaauuuuauaacauuuccucaucccaaaaagaaagcccaugugcauuagcagucacuccaauuuccccgcuaccccugcagcccuauuaauccacuaaucuacuaugcauauggauuugucucuguuggaaaugucacauaaauggaaucauacaguauguguccuuuugcgacuagcuucuuucacuuaacauaauguuuucaagguucauucacauuguagcauguuucagcacuucauuacuaauuauggccaaguaacauuccauuauaggaauaugccauuuuuguuuauccauucauuguagauagauauuugaacuguuuccacuuuuuggcaauuaugaauaaugcuacuaugaacauucauguacaaguuuuuguguggauauguuuuuaauucucuuggguacauaccuaggaagguauagaauugcuggguuauaugguaacucuauauuuaacauuuugaagaacugucaaacuuuuuccccaagugguugcaccauccuacaaucccaccaaaacauaugaggguuuuaauuucuccuuauccucaccaacgcuuguuauugucuuuucuauuuuagccauucuagugugcaugaagugguaucucacugugguuuugguuugaucuaauuugacuucccuaguaaugagugauacuaagcaucucuucgugugcuauuaaccauuuguauaucuucuuugggaaaaugccuauucagauacuuugcacauuuuuaaauuguguuauuuguuguuuuacaguugaguugcagaaguucuuaauauagucuagauacuaguccaucaacagaugcaaaauuuucucccaucuuuggguauaucuuuuuacuuuugugauggugucauuugacacacaaaaguuuuaaguuuuaacaaagucuaaauuaucuauuuuuuaaauuuugucaccugugcuuuugguauuguaucuaagaaaccuaacucaagaugacaaagauuaauucauaugguuuugccaagggauuuuauacuguuaccuuuuaaauuuaggucuaugauccauauugagcuaauuguuguguauggugugagguacaaguccuaauucauucuuugcauguagacauccccaguuguccuaacaacauuuauugaaaagacuaauauuucuccuauugaauugucuugguucuuuaguuaaaaaucaauugaccauaaaugcgaggguuuaugucuauucuauugaucuaccuuuuuuguuaguaccacacagccuuaauugcuauagcuuuguaguaaguuuugaaacuaguaagugugagucuucaaacuucuuucuucuuuuucaagauuguuuuggcuauucuggauauuugcaguuccacaugcaauuuaggaucagcuugucacuuucuggggaaaaaaauaaaaaaacagcugggauuuuuaaagggauuccauuaaauacauagaucauuuuggccaguauugcaaucuuaaaaauguuaaguuuucugauccaauaacauggcauaucuuuccauuuauuuauucuuuaauaucuuucaacuacuuucuaguuuucacaucuuauacuucuguuaaguuuauucuuagauauuuuauuuuuuggcugcuauuauaaauaagauuauuuucuuaaucucuuuuccagacuguucauugcuaguauauagaaauaagauuuauuuuuguauauugaucuuguaucuugccacauugcugaacucguuuaguaguuccaauaguuuuuuagugaauuugccagugcacuuuuaacuuaaacuuuuaaauuauuuuguccccaucauacuuauaaacaucaguguaugcuacuacuguaccacaauuauccacaauauugagcaauuaaauccugucugcccuaagcucucauucagucccuucaauuaacccuucaggcugaugaucacucuccacaggaaaggagaaagcacgacauaaaacaaauuacuucuuucuuaauccuuucuauuucuagugguuaguaaaaccauacagaguaguaaaaugaaacauaugcugagcuacugaaacucuucugccuagcauuaccuugcuaaaaugaaaucaagcaaaauggaaccaaaaguggauuuugacauuucauauuuugcugaauacuguuagggcucuggcaaucacugucucuuacauacaaauuaacagccuaccaucugucaaguguugggauaaucacaggguuuagugcacaauaugguuauuagaauaugaccugacaaaaaggaaaagaacacaaccuaauuuggacuauaaaaucuaugaucucacuugcaaacgacaguuugacaagcuauuauucugcauuuuggcuucuacaguaaaagcaguuuuaugcauacguaauucuguuauacaggcaacagcccauagaagauugcuuuaaacuacagaaucugcuuggucauacaauauuuuuuaacuaauucuuagacaaauauuugcaccaugaauaaguaggaauguaaugaucugagccuucacauuuccaagugaagcaccaaucauuaggcaaaaaaugucuuugugauauugcugccagcaguuccauagaauuccucaggguauaugcaaagaaacuacuguaggaacuuauuaaaacuauucacauggacauacaucaaagucaaaaaguugacaguuuugaaaaguguaauauaugaaacacuuugguguggaauuuacuucauccccaacagugacaucugcuaaugagcaucauuaauauugcccacuuuuauuuauccaaaugccucaugggugauaucuuuauguacauuccucuguagcaccuuuuguuuccacccaguggaaauaaaucccauacugacagcugccucuaauaaagaugcuuccaacaaaacucuucugguuacagagagaacacagaguaccaaguucuuuuuguuguuguuuucuaccucucaaaacagugcagaaaugaguauuguuccugaagguuauuuaaggguacacccagugugucuaaaauacaugccuaagacagaaauguauuaauuaagucucaaggcaaaacguucuguugaggcgacaaaacaaaacagauuuuuaauauuagcaguuauauuaccuagggagcuuaggcgagauaauaacuauauaauacauuaggcaacucacacugcaaauuauguugcuuuguuuuagacuacacguuuuuccauuauuuucauacuuguuuccuuugacgguagaaaaaaaugauguauuuuucugucauguuggcucacuauaaggugagucagagugccaagguucuucugcaaggaaucuugggauccaauuuuaauaugcugcaauaugaauuuuaagaacagugugugaugaauugucaggcugcaugauauccccaaauuucccaguauugagaccuucauggcuauuccccgaagauaacaaaaaaaauucgaucaagauuuauagaagacuuauaaauguaugaaaauauaaaaaaauaauaguuacauccauggguuuaaaaugauuccccuacaguggcaacccuguaugaaaauacaauaugagaucagggagcagaaaaauaaaugaaguaaagauuuagggagaaucauggcaacuuauucauuuacaggaaagccaguuccuuuuucacccuuggaaaaaacuacaaacaaauuccaaguucuuucuagcuacaauugacauuaucauuuggccaguauauucaugauaaauguucuaaugugaaggcgauccaucauaaauguaauuucaaaaaugaacuucuuauuuuaacuucagaaagaauuauucuaggauucaaaaguccaguuaaauacauauagaaagaaggauagaagggagaaaaguuuaaaaaaaaaaacaaaaaacuaugcccagacaaaagacuggaagaaaguuauuuaugugaugagacuaucgaugauuuauuuucuuuuaauuuuuauuaauguucgaaacaaacacacaucaucuuuuaaugaaaaagaaauucuauaugaauuauuuucucucuaugguauauuuagagggauaacuuauauauaguaaaauacacaaaucuuaaguauauggcuccauggcauuucauauguauaaacccaagaaucuuccaccuaaaacaaaguaugcaguuauuuccagaaaauuaccuccugauccuuucuagcaauagucuccuagcucccuauuuuucuggcuucuaguaucauugauuccuuuugucagcuauugaauuuuacacaaauggaagcauacaguaugcauucuuuuguuuguggcuucuuuuggcaacauaaugcuuucaagaugcauccauauuguauauauuuguuguuuguuccuuuuuguuggugaguaccaccucauuguaugacuaugucacaauuuguuuacaaugaugucuaaggauagacauuuggauuuucucaagugcuuggcuauuauaaauaaaacuuccaugaacauucuuguauaugucuuuuucaugagcauaugcaauaauuucucuugaauuaauacaagggaaaauauacgacauacaguuuuuaacuuuaaggcaaggucuaauauuuccuuuuaugguuauuuuauuuuaacaguauauuuaaaaauucauaacuuauugguuucaaucuaaggaaaauguaaugaacaaaauucagagcauaaauuuguaaaaucucauacuccuagaugaagaguucaaaagaagagaaagaaguuauaugccccaguggggacugcuucuucuggaucuucaugccacaauggaaagauucucaaaggcauaaaguuuuccauagaaacacucucaaucuguuaguuuuaacaauuaaaacuuacguuuaacugaaaguauaguagagaaagaaaacuaauugaugaaacuaaaaguaaaccucucaaauaauuaagaggcaaauauuucagggcugaaaggucaucaccagucacagaaaacauucagagaagugagaaaccauugaaauuggaccaguggauggcagaguaauagaugguauuuccaugacaucuaccccaugccaggggaaaagaagagaaggguuuacuuuggguacaaugacaaggacaaccuucugauauguugcuaaggaucaugccuagggugacuauaaauaauuuauuauccaaaaugagacacuucugagacugaagcaggguaauaaaauuaaauaaaaguaauaaauaaaaauuaauaaguuuaauaaauaaaaauuguuuuauuuauauuauuaaaaauaauuuaauuuuuuaaauauccaccuguugacugaaaaauugguuuuauuuuacugguugacaguugaaauacaguccuauucuaaaaugauuucccaaaguaaaauuauuuuuauuuuuaaaaaaugcuuaacugggccaggugccaugacucacaccuguaaucccaucauuuugggaggcacagaugggaggauggcuugagcccaggaguuugagaccagccucagcaacauagugagauccagucucuacaaaaaauacaaaaauauuagccauaugugguggugcgcaccuguagccucagcuacucgggaggcugaugggggaggauugcuugagcccaggaguuagaggcugcaaugggccaugauugugccacugcacugcagccugagacccuaucucaaaaaaauguauauauaaaaaaaugcuaaacuggacaagaugcagagaaaacugguaaaaacuagggcuauccugagcaaacucagaugcauggguacacuagucaagugucaccuccaacccucuccaguuaauuuaccaagguaccuauaaauggagccuaaggcacugccccuguccuuuucuucauucaacaaguaauuguugaaaaucuuccauauguuuggcacugucccaggcagagagauauaaugauaaaugaguccaacuuuccuuggacucauggaaccuucaaacugucagagaagacagccaaagaacaaguuacuaaaagugugcuaaaugugaaggaagauacagagcccacugagaggcuuuuacaugguagugaucaaugggguuuguauuguccccuagagagauuuuuuuuuggaaaugugaggagcgguggggagcucucuauguuccuucuuuuuuaagagauggagucucccuauauugcccaggcuggucuggucuccaccuccucuugagcucaagugauccucccaccucagccucccaaagugcuaggauuacaggugugagccaccaugcccagccauuuaacucauauuuucugaggggcaacaaggccaccaaauguucuuauguaggacaggcccacaugaugaaaaaugauccuguaucccucauaacuuucaaauguuccaccagacauucacuuagguaaagaaaaaaaauauuauugucuauuuuacauaauagcuuaaaguaucuuuugcacauuuuaauuuucacugaauuuuucagaaaugcaacuagcauuuaaacugaaggaauaauguauuuuguuuuguucaacacuuuaccaguuguucacuauuucagaaaaucccaccaccgacagcaauggggcuuuugguacccagucuaccaauauaacacaacuguauuaguuugcauucuuaucugucaaaugcaaauacguaagagagaaauaggccuagcaccaaauauuauuaaauuggccaugggacaugaaagucaaggauaccaccaaauugcauucauggaaagcauuuuuuuuauauuucauuuuacugccacaguacauaccuuuaaaaaaaaucuguagcacaaugaugagaaaucuacacugugaaaauuacugauuaaaauuauuuacuuacuuuggauuugcuucuuguuucucagucuuacagugaaacugucccuagaggucucccacacaacuucuuuauggcuucuuauauuacugcuucuuuuuccaauccauucccuauucccuguggccuaccgaagugcuuuuuaagaacuagagaccaaauguaugcaucaacauaagacaugauuucaagaugagagguauucuuccugugauucuucaacaccacucagucccuuuucauaauauagggaaugacucugcagcuacccuuuuaaguaagucccacucauuuccaggaauggcauacuugccuauguucucuaccucaaaacugcauuauuuaucuuagcauguuagcucuacuucaacuaagguuauuucccucuuuuucucaucauguauauuacuauuaauauguauccaaagguuagcuuuuauucuaguaucccucaaaccucucaucuuucauuucuuguacucauuucacagaauggcuugugauauucuuuucuuuucuuuuuuuuuuuuuuuugagauggagucucacucugccacccaggcuggagugcagugacgugaucuuggcucauugcaaccucucccuccuggguucaagugauucuccugcuuuagccauagcugggauuacaggcacaugcggccaagcuuggcugauuuuuguauuuucaguagagacggguuuucaccauguuggccaggcuggucucgagcuccugagcucaacugugaggagaaaauaaaacccgcccaccuaggccucccaaaguacugggauuauaggcauaaaccaccacucucggccugauauucuuuucuuaaauccaauuucacucauaucaaguagauauaagcauuugauuaauucauuaugucuucaaguagaguugugcccaagccuuuacauuggaauacuuagcuuauuguaagccacuucccuuuucuuucuucuuuauauuguaguuaaccaucauaccauuuuuuuaaguauauggguggguagguaauuucuauaaaguucaaaagagggcaguuaaucugauaggauuaaacaguugacuggaaucuaauuuggggcagagacucuuuaggcugaaacuuaacgaauggguaagaguuagcuaagugaagggaaaguagaucagggagauagaaaaagaggccaaacccuugaaggcagaagaauccucagagauaacagagcagagagcuucagcuagagaacugguugccaaaaagugguaagugaaccccuggaagcacacagcugaacuuuugcugauaaaaaggcuaacuuuuuaauuuuaauagauucaaguguuuugaaauacauauuagaagaacaguaguuuccauuuaagguggcaaaacaauuuccuuguacaauuaacuuaaauauuagcaaaaauaagcuuuuuuuaauaguaaguguugguacaaauaggacaugaauaugguaaauacauggcuucugaaugacugaaguuggggugcucugaccuauuagcauggagguuggagaaagagguagagcuagagaugagaugagaaagcaagggcuuggucaggcaaaguccuacaaaccacuguaauuauucaggucuuugucuuaaaagcaaugaaaagccacgaaaggacuucaaacagaggaaugagaagaucauagcuguguuuuauaagaucaguauggcaucuaaugagaaauggauuggagguaggaaagauggcuguggguagacgaguuagccaacuuuuccaaauguuuaauucaaagacaaugguggggcugggugcgguggcucacaccuguaaucccagcacuuugggaggcugagaugggaggaucacaagaucaggagaucgagaccauccuggcuaacacggugaaaucccaucucuacuaaaaauacaaaaaaucagccgggcguggugacacgcaccuguagucucaacuacucaggaggcugaggcaggugaauugcuugaaccugggaggcggaggcugcagugagccaagaucacgcuacuguacuccagccugggugccagagcaagacuccaucucaaaaaaaaaaaaaaaaaaagacaauagugguccaaguucaagugauagcagcagagaugaagaaaggaagaggaaauugagagauaacaucuccugaaauccaaguugccauaaauugaaaaauaguuggcuuaaugauagcuuggcugauaacaugaagaaauagaugcuaagugagcauaucaauuguaagauauugcuucagaaacauuaaaauauggaaaauccaugcuucuuuaaauagaggaaauacaauuuuuaaaggguagaaaagaguguguagacacuaaacaaaugacugaugauagugaacccccaguuggaaaaagucaaaauugccagauuucuuuggccucaaacugcuaaacaucuaaugucuugggcuuuauucacuuuuugucuuugagugacaugacagaucauuuuggugauauagauggagcucaaauugacaagguuacuggagaaaguaaaaucaaaaauccuuucucagguaaagauauaccugaguaaggaaugcugaccuucuaauaucagaggccuaaaacuuguaaguggaaguuugcuuacagaagacaauguucacagcauucugaaagucauggccagguuguugcuguuauuaugaaaauggugauuuauagccaauguccauagccuaggccucgagguauguuuacaauuuacaguaagaggggcccagccuuaaauuauuguuagcaagucuugauauuauuuuguaaaaaaugaaauauguaaacacauacauaucaccuuuuaauuuuauuucuuaggggacaagggaaaaaacacaguuugcaacuauguauaucuccucacaucaaaguuuaacuccucaagaugaauacauucugugccucugcucccaacuugaagaaauuucaacugcucuauucuuuccacaacugcccauugucuuaaaaaaccccaaaucgcuggcauuuuaaaaauuaaauacaguauauuuucuagaaagaaaaaauaauuaccaggcucgcacguggcagauuccucuagccaugcaagccuggauauucaugaaagccauuucucacuuggcucagggaaaccucccagaaugauaggaccauuuacacuaaaugaaccgaacauauuacuggaguaacaauugacauuaaguauauuacagcugccaggggcaguaucaggaagaaucccuggaugacagaaaacaugauaauguagaaggaagaaccugcagaaucagaaaggggggaaaaaccccucauaaaacaauuuuaaaaauauauaaagaggaaaucauauuuaaaggaaaaacagagaaauuuuguuauuuuuuuuccuucugccugcaguagccuucugguauuagaccugcaaugcauuugcuacccccuaaaauauucucaacacuaacaagaucagaggaaaugauuuauuccacccccucuccugcuacuucugaacggcagcgcguguccuuggggacaugggauuucugcauugcuuucggccaucugauauugcagcucugcagccuucccuggaaugagccagaaaaaucaaaauaauuacauuaaugcugggaaucaaaguuuauugacucucccuugagguggaaaaccaaaaugcugguuacaaaaguugccagcuuauuuaaugauaccacugccuccucccuguucuugucaaaacagcuuuugaaagcauuuucaaauaaagcccucagaugcgcuccaauucaauagcuuaucuauucccuuuuaaauaaaagcuaguucacaucaucucacccccucaaagggaggacccgacaggcccucuuccccugccaaggcacugccaaaggcaauacucccaggcaauaucccugccaucauuuccgcucucuucaggaagguucugccucauugaauauucuuccaagccaguaagagaaucucaugccuccccaaggcagcaaucuacauuuauuauaacauucauggcugcuaaugaaacuuggagcagcugguuucuuucacuuuccaacaauucuuuggauauucaaaguccccucauaagagaggggaacuuaugagcacacccauuucauggaugagcccgcagacacagagauucaauguggugcugaccuuuguaacuuucacaggacuuugcuacagcccuaaaaaaacagaugcuaaauaauaauugauugaauuaaacugaaggagguagauuaauuuuuuuaauuaaacugaaucaaauagaacagaaauaaacaaacucuagcccucuccaugccuagucaacaccuacuauucuuucuuguuucuuuuuuuuccuuuuuauuauaaaaguuuucaaauaaaaugagagaccaguauaaugaagcuccaaguaccuauccacccagguugaacaaugaucaagauuuucccacauuugcuucauucaucuucuccuuuuuuucuucuucguugaaauauuuuaaagcaagacuaagacagcaugcuacuucauuccuacuuuugucagugauuaugcugugcagaaaagaguuaccauagaaggccugagguugcuauuuuuagaauuuaaaaaaguuugcagguagguagguaauaucuacagacuucacuuuaugaugauaaaagagacauaagagaaauagaccugcuugcaaaguugacucuuggcuggcaucugggaacauggauuugggaagguugccaucauucccagaacugauaagaguggcucacugugcccgaacuguuuguucaaauaaugaaaugcuaaaugccugcuuuccuucugggagucuaaaauguugguaugugcuagccagagaguaucuacgugaccagcccccaauaacagccuugggugcugaugcccuaacaagcuucucuguuggacaacauuucacauguguugucacaacucauugcugaaggaauuaggcauguccuaugugacuccacucaaagaggucucucagaaccuugcaucaaguuuccucugaaguucaccccauacgcuuuuucccuuugcugauuuugcuuuuuauccugcuguaauaaaucauggcugcaaguacaacuauauguugaguccugugaguauuccuagcaaaucauugaaccugguaauggucuuggaaccccuaacucauauaccuaccauuuuuuaagucuacuuaaaccucacuuuuucacagaaacauuggugaccuuggggagaugccaaacuaagggaggccccgguuauccauucucacagcacccugaacuuccucuucauaacauuuaucgaaacggucccuaaauaauguugaaaucauuuguuuguggucuaucucuccaccaagaacccaaagucccugagacaggaauuuugucuguuugguuugccauguauaccuagcaugguacacaugguauacauuuaaaauuuuaaauagauucaagaaaauaccauaccccuccuccaaguuuaagagguaaaguuuauauaauuucccuugcauuacacucauucauucaccaaauaccacucacuuaugguauaaucuauacugugucccaguucaguuuaauauccacuucauuaacaucuuucuguaauuagcaacaucaugccaaugcuucaccuuuuaggugagacaaagcaugacucugcaagggggcuuuccucuugacacuggugacuaauucaucuauuugcaucacauuauaggacccucuuuccaccuuacaauccucuagagauucuccugcaaauacagacucuugagaugauucuuacaugccuacuaaaguuuggaaaaccacuguuuugggucacucaaaaaaugaaaaggcagcuauaauuaaagaaaaccucauggauaugauucuucaccugaauuuuuaaaaagauaaauaaaccacagacuaaacauaaauuuugcuaagcauauucaacuacugaaaauaccauacgacaacagagagaauaaacauauauuccuuuaaagaaaagaagugaguuguccauauguuguaagggauacaucuauauauauauacagauugucuugcacauuuaaugugugcgcagaaaugggucaaguagauuauuuuuuucaugguggaugaaaguaagaugugaugagacacacuugaauggggauuggcaagauuuuuaaagauuauaagcuuugcguuuucauauaaucuaccauccugcaaauucacuucugaguauauauuaauacccaagagaaacuugagcacauaugucaaacuccaucagugaaaggccaccaggaacacccugguagucaaaguuaagugguucaccuuacuguagcaaaggagaaaguaccccagaggaaccuugggagcaucuuaguaaaggggaauuaucaguggcuuccucuaggguuuggggaauugaaacaaacugaaguuugcccagaagcagcagucacucugagaaagacagugauagucagaagaaagggguguuuagucauuuguagggucacagaauggcuuuguuuaugccuuguucugaguauuguuuauguucuaguugccaguagagccauguuuuacuuucucacauauguaccaggaaauguguauaagaacauucauagcagcaccauucauagaagaaaauuuaaaaauuuaacuaaauggcuauugauaggaguacauauaaaacuuaaaaaggacagggaaugaugaacaugagguuaguaguugguuaccucuuacgaagagguagagaugggauaaaagggggcacaaauuuguaaguuauugguaauauuuacuuguuggguuuaugccuguuauauuaugaaauaaauauuauaaaauaaaacagaauuuaccauggaugacagugagucaugaaccaaacuuauaauuaaucuaccucugugaccugagguccacauuauuuuaaaacaaacaaaaaauaacaauaaucauucauauuuacguuuccuucucagccauacauuuucuuuucuacuuagcauuuuccacugugacacaguaggugccaguuguguuuauacagaagcuacaauaaacaagacuuuuuauuaaaugcaaaugucaccacgcaguagaaucaacuauugacuuugugcaaccucucaucaacagaaccaucaauacgucuagcaaggcacaggauuuauugucuaugcacaccuuucagagggcuuccugaaacacaacuagcuuccauaauugguaaccaaauaaaaccgcaggccaccagaagcagaauauaacucucucuaggaagcuguaaauuaaagggagauuugucuaacuaaauguacagugcugcacucacaugggcauuucaucucuugcucuuuaauggaggcaguccuuguaccccuacuucacauuacgaauaugguuucaucucugacagaaaggccagagcaccuggcagaguccucacaugcucccuccuuuuaccuuuuccauugcauuaauuaauuagaacugucuuuauauucagugacauuugauuuugaggacauuuuuacaaaauaacaacaccagguccaaguucacuacagcaauaggaucuacaagaacccaaagaaugaaugcuuuuuagcaaaugagaacacaaagucacaugaucuuuauuuuuaaaaagcucauaaacuaugucaggcaggggaaucacauugccagacaccauaaaacaacauauaauuaaacucuagcaguccauuagaagaccuagugacaagcccuucuccacugcugcaacaaaggugggaugauuuacauguagacugggaaaagucccaugauauuagaccaaaauccagcacugcugcuaauuuuuuuagacugaaaugugauugcccaauauuaaauuguuaccauuaguggggaaaaaauagcuuauucuaacaaauacuuaauuucucucuagcuuuggugcaguccugacuuguaguuuauucuaauaaauaauuuaaaaauaauuuuggucaccucccauaugauccaaaguaaugcuauuugagaucaauaggacuaacauuuucuaucugguauccauggaguuuuuuauccaaugagagagaacauucaggaacuuagccugucucauggcugaaaauagguagaauauguuaggugugcguuugauacaaucuguaaauaaaaggcaaauuauaaaaguuccccucccugcagagacgaagucccacaauagggugcacaagcugcauuucaacccccacccacaccucagauaugcaucuucauucagugcacagaagacucaacuguaggggcggccuggauacacaugccauguuucuuccuugcccacuuggugucuucacauccccuuccccuuaaaauaaucccauuaguugaaaaguuccuggauacaaggagcagccaucaaaguccauggauggauuucaaggggaugaauucauuuaacauuauuaaauguuuacuuugcuaauucucaauacuuguacacaauauaagacaugauuucuucugucuauaauaugaagucugugauuagaguaauauuucaauuuuugguuuguuuguuuugacuuggaauuagcaguaggauaccaacuuaagucaaauuuacuaguucucauuuucccuaauucagcauuuguuuucaucuauagaauuccuuuucuuaagucaggcucuuuggggucaucagcccccugaaaucaugugcaaaaugggaugccuaugugcacaugccucuuucugugaggaucgguaccugagaacuuugaugccaaguuaaaaagacugugccuugaguuuuugacacuagggaaugaaggaaaguaugagauaaagaauauacaacaucugccacaacuacugcauauuuucuuucuauaucacauucaacaguuuauuacaaucaccaggcuuuucauucccauaaagcaauguucagacuucaaaugugcuaauaauuuagcuggagaauuugagaaaacuacacauuccucuccaacacccccacccccaccuccuuagccccaagaaucagauuucaucacucuggaagagaacucagauaucugcacuuuuuacaagugccucaugugauucugaggcaauggugagagacccaagcuuugaaaaacgugccaugaucuaccaucaaguaggaaucauguacauaaguucuuccauuagaggaaaaaauaaauguauuuguuucuuuguaaagauaggacguuggaaauuuucacuuagauuacucuguaagcgacaaggaaauuagaaagcucguuuuuuacaauaaucacuguuacuugacaguuccugcagcauguuaagauggcuguuauugaugacacuuauuaccuuuucccaugcaauaaaacacaggaacauacaguggaagagauaaguauauuuuaaaacaacagaaggaagaaaaauaaugguagucauguccucucauuauuuguguagacugacuaccauggggaacagugaaaugccuuuuuuaaaguuacacuguggcuuuaaauuggguuaacucagugaggauagccaugaaacaaguggcuauagagauguaaagaaugggcuauuucucuacauuucucuuuugccuuuuauuuucccuauggucuuuaaugcauuucucuuuggaauggaugaaguuauaaaguugccuuacauaaaagcuuugcuugaaagauugguaaucacgcacuuugcuacugaauuguccagucuauucaaucuaaaaaaggcucuucucuuuuguucagcucagauuaucuccuuugcagaguguaauagaaauaucuggguauaaaauugagaaauuguucauaaauauuauggaaggcuuuuugagcuguuuacuauuagaggccugauuuagcaaacaguaagccugcuuuugcuggguugggauuuuuuauuuuuuaacuuuuuccuuuuaacugaaucauccacaguuaaaaaaaaaaaaaaaagauacagauuucacagcacuuucacccaugauuagagcagaagaaaacaaauugcuuuuuuuuuuuuuagauggagguuugcuuugucgcccaggcuggagugcaguggcgcaaucucggcucacugcaaccuccaccuccagauccaagugauucucuugccucagccucccagguagcugggacuacaggugcaugccaccacgcccggcucauuuuuuguauuuuuaguagagacggggguuucaccauguuagccaggauggucucgaucuccugauuucgugauccgcccaccuuggccucccaaagugcugggauuacaggcaugagccacugcacccagccacaaauugcuauuuuuaagagacaguuuuaauaucuuguacuacauuuggagaagaaaaaaacaucagcacugcuaucgccuauaggcaacuuucuuaucuugccauuucuuuauuuaaagucuuugcacugaaccagccaaugaaaugcauuauucuacuggccagcguucucuagcagaaacaagagacagcaugcauuacugagaagucagacacauuugcacuaaaucaaaaaauaaaaauaaaaagacucucuagcuagagguuaauaacacaacucaaucaaaaccagugacauuuuuuaucaaacagucgugaaauugccauuuggaacucuaacuugcuacaaauagaauuaaaagugccauucuaauucugucuccuuguacaauacgacccugauauggaaaacaaggugucuacacugaacacauccaguuuacaagagaaaaaacgggaugauuuuuugauucucucaaauauuagguaaguguuuaacacaugacuccugagugggagugccaguuaaagaguuguaguaccugucaacgcugguuuaacauuucaacaaagcaaaucaucaauuaaaacucaucagcaacagucauccuguuaauugaccaaaugauuauccuucuuuuaguuaagacucuaccugacacacuugaagaaauuuuuuucucuguuguaaacccucuggagucuguggcacaccucaccuuggcaaaccacuuugguuuucagauucacuggaaagccccucuuuguucuaagaggggcuccugaaugaaagccaaguucuagucugacuuucugauugcuucuucucagguuuuuuucuugcuuccuaccaggagaaggaaaaagguagucauaggccaucuguuaaacuuguguuuaaagggaaguaccaagguauggccagcuggauauuuuacucaacaugguggaucauacucaagguaguguauaaaugguuuagcagugaauuccaccccauacuucuugggguaacaucuaugcuaucaagcccuuaaaaccaaauccaacuagcucuaaaccauaaacauauauuaugauucaagcauuugcaggaaaaaaauugugcuucaguauaaaacuuugcuucaucuagaauauaaaggaucccauuucccaauuaccauauuaucagauucugauucuaugaggacuaauuuucaacucuguaaauuauagauaaaugauaacaaugcaaaauaauucuugccuauaggcaagcaaauuguguucuguucucuggagguucaauuaaucccccuaccccacccucagaaaccaguuuugcccuccauuuguaacauucuuuucaguauuccugauauauaaaugugucugggcuuuuuggauucucuuuagacuaguuauaauauuuggcugguucucucauuauaaguugaccuaaucuuuaacauguuuucauuuuauaucaguaugagagucaugauuucaccuuuauuugagaauuauucuuuaauacauguauagaucuuggacuaaggcuaucaauuucgagacuucacuuguaggacugugcuguacuccugucucucacacucucugcacaugccauuucccagccuggaauguucuucccuccuccccacuccagcuucuggaccuaguuaauuccuaaucuucacucagauuugggcacaauuauagccuccauaaacaagcauugccuaacuaccccuccucucugccaagaaguuuagaucucccuguuauaguucuugcacuuaacaccauugacauuuaucugucuggauuuucugacuaaugucucuuuuccucacuagaauaaugcucgcugaugguagggaccauauccgguuuuacauaccauugcacccaguuaggugucuggcacacagaaggcugaaacaauauuuguugugaugggguucuugacacacuaccccaaaauauggcaugucggcauuugacaaaacaguggaagcaggaaagucucucugaccuucucccacacuuuuccccugaagcaggccauaaaagaaaucucuagccuuccucuaaagugggucauaggccuuauucaagaggcacccuuccuaugccuggaggaaaggaaugucauuaucucugaaggcacagagauaaagagaaaaaucugaauaaagaaggcuugcuaaguuccccccaguuuauuaucuuuagaucacacccccuauguccaaucauacuucuacacaacugucugcucuucaucaaauuuagcauaaaaauauacaaguuucccuguuucuuugagucuuccuuucuccaugucacauaaaacuuauacuaaauaaauuuaugucccuuucucuuauuaaucuuucuuuuguuauaggggccucagccauuaaccuggcaauggaaaagaaaaauauuuucuucucccuugcaguugcguacaucagcaacacaguagauccauggaucagugaacaaauugggcuaugaauauuccuauuauaaaucagaaaaacagaucuagaccaaagcugaccaaaggagaaggaaaaggagagacugcauuuugauguaaguguuacugauuugaaaaaccauggagaucgaucaccuacuacaagguccaaugguauuccagauucuagaaaagaccuagauaaaaauauaaagucucugaaaguccucucaucuucuccaaagaguccuaaaauccaaaagaaccuaggauuucuggguauuuugaaccugaacaaaggcaaagcacaaaaagcaugguauagaagaaggcuucucaaagugugguucccagaccagcaguaccucuuggaaacucucaggccucaucucagaccuacugaugaaaucagaaacucuggaagagggaccagccaucuagguaucaacaaucgcuucaggugaaacugaugcuuguuagagacucauuggcauagaacaaagaugggccucaacaaagauggaaucaccagacuccacuguaaauagcugugaaacacugagcaaguuauuuaaguucucuaagccugaguuuacuuaugaggaaaaauggggauaauaacaacaaaaacuaucccacagaaaugugguaagaauuuuuuuuuuuuguuucaacuuuuauuuuagauucaggggguauauaggcaaguuuguuaccugaguauauuguaugaugcugagguuuggaguacaaaugauccugucauccagguacugagaauaguacucaacaguuagcuuuucaacccuugcuucccucccucacucacuccuccaguaguccccaguaucaauuguugccaucuuuaugucuaugaguacccaacauuuagcucccacuuacaaguaagaacauuugguuuucuguuccugcauuaaugcacuuaggauaauggccuccaguugcauccauguugccacaaaggacaugcuuuuguucuuuuuuuaugacuguauuguauuccaugguauauauguaccacauuuucuauauccaauccaccauucauaggcaccuagguugauuccaugucuuugcuauugugaauagugcugcaugaacauauacaugcaugugucuuuuugauaaaaugauuuguuuucuuuugcauauauccucaguaaugugauugcuagguugaauaguaguccuguuuuaaguucuuugagaaaucuccaaacugcuuuccacaguggcugaccuaauuuacauucucgacaacaguuuauaagcauccuuuuuccccacagccucaccaacauguguuguuuuuagacuuuuuaauaauagccauucugacagugugagaugguaucucacugugguuuugauuugcauuucucugaugauuagugaugaugagcauuuucucauauguuuguuggccacuuguaugucuucuuuugggaagugucuguucauaucuuuugcccaucuuuuaauagaguuacuuguuuuuugccuguucaaaaaauuuugaguaaugucuauaaauugccuagaaaauugacugacaggcugggcacaguggcucauaccuguaaucccagcacuuugggaggcugagguggacagaucacccaaggucagcaguucaagaccagccuggccaacauggugaaucucugucucuacuaaaaauacaaaaauuagccaggugugguggcgcaugccuguaauaccagcuacucgggagacugaggcaggagaauaucuugaacccaggagucagagguugcagugagcugagaucgagccauugcacuccagccugggugacaagagugagacucugaaaaaaaaagagaaagaaagaagaagagagagaaaauugguugacaaagaauggauacuaaugaaauaauagcugcuauugaauuuaucauucaugucaguagcagcagcagcagcaccaucaucaccauuaccaucaccuugucuagauucuuaaggccuggaacccaggguuggaagaaacuguuguccuuuugccucauacaucagcaaagcgugcauagggcucuuaggaauugggcaggaggaauccaaauuugugcaccauuacugucuucuagcugaugccaccguuuuuugucagucauuuauacuaaaauauacuaacuuagauagguacagaauuuaagagguuacacaagcacuuagcacacaugcuaucugaucuucacaaacaaccugagaguaguuauuuaauucagagaaguuaguggacuugcccaaagucacauugccaguccucacagucaucugaagagccagacuugaauccagguauuuugauuccaaaccuagugcuuucuucucuacuccucgucuauacuucuguuuucauuauaccaccuugccaaggaaacaaacacucaccagacacacuguagaguaaaauagaccugacauccuuuagaguucuucuuggauccuggaaugugguucuuauugucucuacuuacaaaccucacauuuacagaagcaggcuguauuuuuuuaacaccuuccuuauuagcaauaauuggucccuucugcuguauguuuguuugauuuuuaauacacacaguucaagauuaacucaaaucuguucaacaccaaucuuucuaaaaaccaacuuuccaaauauccacuuguaacacagaaaacugcagaucgucuuuccugcuuccaaaauacagucacuuucauaaauguuguccauucauucuagcacugaguguucauaaagcaccuacucauugcuaggcacuaugugaggcaaugggcacacagguguggugucuuaaguaagacagguguggugcuuuccauccuggaagugugagggagucuggcaauaaaaaaaucaacaaauaaaagaaaauagccacagguuagaguaagugccauugcaaagccucaacagguaaaaugaugaaguagucacucacauuuucuucaggggcuggagaagcccagggaaugacuccagacagggugguccaagguccacuucucacucuucagauaaaaacacaaacaagcauaucuugacacagaaaaucuaaugugaaaauccgguaaguggaaauaugaguugacagaaugggugauuuagaaacggauuaucuacuuuaacaugagaauucgauacaggauuuuucuugagcacuuuccuaauacaaauacauuuuauauuuauaucccuauuaaauauauacuauauuuaauauaaauauaaaaguuggaugccauuuauaaaaauucaauuaauaacaaaaugaaacagcuacugccaaaaacuugcauauacagacguuaaaagaaauacggggcugggugcuguggcucaugccuguaaucccaacacuuagggaggcugaggcgggcagaucaauugaggucaggaguucgagaccagccuggccaacauggcaaaacuccaucucuacuaaaaauacaaaaauuagucgggcaugugccuguagucccagauacuuggaaggcugaggcaggagaaucacuugaaccugggaggcagagguugcagugagcugagacugcaccacugcacuccagccugggcagcagagugaaacugugucucaaaaaaaaaaaaaaaaaagaaagaaaagaaaagagaaaagagaauaaaagaaaaggaaaagaaaggacaggacaggaaaggaaaggaaaagaaaagaaaaaagaaaagaagguaccaagagguggaaaggaacagggagaaagaaaacaguuauucaauguuuuuggaggcccaagcacaggguuuuggcauaauuuauuuaguccauaaaacaacucuguauuuagggaucauccacauuuuacaacaaaggaaacccaauuucagugaggugagauuauuuguccaagaucucucagcugguaagugacaaaaccacaacauaaaaaucugaucuauauccaguaacuauaucccauccauucuauaaagcaagaauuggcacaccacagcccacagggccagacuuggacagcagccucuugauaccaccacaaauuaagaaugauuuuuacauuuuaaaagcacugaaaaaauucaaaagaauuauguuucaugacacaugaaaguuuuauaaaacucagauuuccauaccaauaaauaaaaugccauugguacacagccacauuuaccuacugucuagagcugcuuucaaauugcaagaugguguugagcaguugugaaagaaucaguagggucccaaggccuaaaauacuuacugucuggcccuuuacaaaagaaguuugcuaaccccugagguagagaaaaggauccauagaaauaaaaguaacaaacacucucagaaaugugacuucaaaaaugagugacaaaaguaugcaaaaaauggcuauaaaaugcaccugaaagaauuuaaccuaauggcaguugccugaggcacaacuuucucaauuucaccugaagguuucauuuuucuggcccugugucccagugaggaagacccaagucaaccuugugacagggauuuaucacgucuuaacuugagcaaugcuguguucccaccagcacucucagaauggaggccacacaaugucuccacuccugcauucacuggcucaacuugguuucugaagaaugcgaauuuaguucaaggcacgguuucaagcuguuuuuguugauuucccacuauauugucuucucuaaauauuuucugguucaagugcauacgcucaauuaugaaaaugaauucuuacaaacaaccugaucugggcggauaguuaacucacaccaugaagcucaaauuugccaguacagggaaagguauuucuuuuucuuuucagucuucaggcuacaagguugaaagccagaagcuauguguuauaaaaugucccuaguuuuucccauguuuuguagcacacauauugaucucuaugucuuugccauuuacuuguguguggucauccccaauuaguggguuauuuuguacuuuucaaaguuaaauucuaagucaauacuuagggcguacaccuaagucaaagauggccuccaccuugaaggaaaaaaauuauuacauuucaacgaaaaccuacacaucaucuauaaacacacucuuuccagcugucugacucuagccuuguacaaugucuuugagcuauuuugcaccacuucguaaguuguagauaacugauagauauauauaaauucugucuuacaggcugugauuuuaauugacuuccuacuguggagaaaacaguuuuaucucaauuugcaacucaucuuaacucucuuuuaguccauauaaauuugugccauuuugacuuuuccuuugagccaguuauaacaucugccugguucucucaaaucauauaaguaaaauaaaaucuuuagcauguguucauuuuuauaccuauaugagucauaacuuuaccuuuuacugaaaauuauauuuuaaugacccaaaagauuaguaagaauucagauuuauuucaaaaucuaucuuuaaaaacuuuaaauuuugagugauuucaccuuuaauaugaauuuaguuggaaguaauauuaaguuaguuuaaaucauauagaaaaaugaaaugugaugagaagugaacuucuuuguucccuuuuauugcuuuuaaaaugauacaagacaaaaauugugcagaggggcaagaaacaaauguuaaacaaaaauuauucugacauguguuaaaaugguaaggaagacuuuauuaaggacuauugcaauagcaguauugcaacaggggagagagaucagguucaacuccaaauacaacaaagauagauagucagggauuuauagccaguguuagagcagauaagggguucaguggguagaaaacuacuaagaggaguaagggaauucuugcuaaauuaauuccuaacaggauucuugcuaaaggcaggccaaugacuuagacaucaaggguggggugagaaacuugauuagacaucacggugaccagcuaucacuuaaaaagauuauugcuaaagccaggcuagaaagaucaaauacaggaaugaggucuggggccaaggucgcuaguugagaaaagggcucagaggaguauaauuaaaguuugggcaaggagaaaaucuucaucauagguaauagcaaauuuauaaaaggacaauucaauucaauaaaucuuguccucaaggaauuuacaauccacugaaaagagauaauuaagucaccacaaccuggucaaauuaccuugguuuuacuuugcaauuaaauuuuauucccauaugaaucuauauguaaauaaucucuuuaaagaaaacaaauaaaaugagaaguuaaaguuauuucuaucucuguaaucuuuauuuuaaccuuuauuuuaacuucagggguacauaugcaggcuuguuacagagguaaacaugugucaugaggguuuguuguacagauuauuucauuacccacauguuaaaccuaguacccauuaguuauuuuuccugauccucucccuccucucucccacccuccaauaggcccuaguguguguuguuccccucuauguguccauguguucucaucauuuugcucccacuuauaaaugagaauaugcagcauuugguuuucuguucauguguuaguuugcuaaggauaauggccuccaucuccauccguguuccugcaaaggacaugaucuuguucuuuuuuuggcugcauaguauuuaaugguguauauguaccaccuuuucuuuacccagucuaucauugauaggcauuuagguugauuccauaucuuugcuauugugaauaguguugcaaugaacauaugcaugcauguguguuuauaacacaaugauuuauacuccuucagguauauagccaagauuuuuccauaaucccacugguauuagauacccaaaaaaaucccauugguauuauauacccaaaaaauaccaaugggauuaucagauuacuggaccaaaugauauuucugucuuuaggucuuugaggaaucacuacacuaucuuccauaaugguugaacuaauuuacacucccaccaaagguguauaaacauucuuuuuucuccacaaccucacuagcgucuguuacuuuuuuagcuuguuaauaguagccauucugacuggugugagaugguaucucauugcgguguugauuugcauuucucuaaugaucagugauguugagcuuuuuugcacacgauuuuuggccgcauguaugucuucuuuugaaaagugucuaucaaguccuuugcccacuuuuuuaugggguucauuuuuuccuuguaaauuuguuaaguuccuuauagaugcuggauauuagacuucugucaaaugcauaguucgcaaaaauguucuuccauucuauagguugucuguuuagucugcugauaguuccuuuuguuaugcagaagcucuuucauuaucucuauaaucuuaauuuauagacuaaaauauuaauuugaaaauauaccaacuaaaguguaucacacaccuaaaucaaggauuuuauaaaauacacuaaaacagaaacuaaacauagacuauuuauucaacuuucauauaagcaaaagacaccacuauuggccaccaaccucacuacucccagccugugaaacaggaugauuauggguauuugugaaaucuaaacaucaccacucacuacauuaaaaugaaauggcaacaaauuuccacaagucuuuuuacucaaagugugguggcccaacccagcaaucugggcaucaccuggcacuuguuauaaaugcagacccucaggccccaccugcugaaucuacauuguaccaagauccccagaaaauucuuauguacaugaaaguuugaaaaccauggauccagaagugugugaaaacauaacuacugccagaauuuuuagcauauucccuuauucaucucuuuuuuaugaaacuaaacguagugguuuugcugauagagauggacgggggaaaagaaauuuuguugugaccaaaguugcugcauuuuuugccuagggguggaccuaaaguuucaugucaaucauuuuguuuugugagcaaaaucaaagucauggggaaaaaggagagggugcagaaagaagaaaauugugaauacauagaauuuuaucacuggaagacagaaaacaaucucaauuauauauauaguauauguacucaauacaguaaugguuaaauaaaccaugacacaacuaugcaagagcauauauaaagacauuaaaaauaacaaggucauuuuucauguaccaagaugcagugaucucuaauguaaacuuagcuuaaaauaugcaaggggaaaaaugcaagggcagcacagcauauauaaugacuuauuauucauguaaggaaaaggacauaagugugcauaugcauagaacaucucuggaaugacacacaagaaagacacacaaugguuacugcccagaggggagcugaggcacgagggacagaaauggaaggagacugacaucccacugugcaucuuuuaacaucuuuugaauuaugugauaguauuauccaauuaaaacaauauuuuaaucuaagcauugaagaauuccuaaaaaguagauaaaauacaguuacuaagauaauaaaggaaucccuucuucauuuucccucauagaugguuaugugacuauguccaaacacuuucugugaguuacagaucugagaaguugugucuaaaauucacugacacuggagcuuaaauccacgugccuagaaugcuccucacugcccccacacaaccccugagagcccccacugaugccaguucucucugcaacacaaacuaagccucuuccugucucagcugugaacacauuugcagaaggcuauugugguuuuccuuagucaggggucagaauggccagcaggggcaggcagguauccuaaacgaguaaagcaggccuagccaaaacaaagugagccuuuaccccuccaccugcaaugaaacagggcagcaacuauucugcuccaaggaaauacuaccauggaggagacagggccagauguugccaugucuucccagggaugucagaagcugcuaaauuuauuuuaaauaccuugauuuaaaaauguuaauauuuuaauuuuuuaaaaacaguuuacagaccaaauaaaauacaugugcagcuagauguaaccuagaaguucauaauccauccugucaucuuucguguguggaaccaugaacauuucucuuuuuguuauuuucucauuggagcugcugaaaagaaaaaaaaaaucucuuuuuaaaaaacucaaacagcuauauuuuggagauucgacaauuuacuaaucuaucacuccaaaaugugcuguauaauuuauuugacagucacugugcuugccuaagaacuaaaaauaaccucauuguauguguguguguuguuucuaaagaccugugguauuuauuauuguuagaaugcuuucgaugucuuuggugguaugaacugugagguaucucugaaggauagcauuucacuguauuucacagaauauacauauacaguccaucaaaacucuggggguuauuugcaaaacauaguucucauuuuccaacaagcuuucagcggaagaaaguuucauagaaaaaaauacaaauuuccuaccacucuacuuugugagaaccuaaagagacuguuagguuauaaaaaagaaaauugagggauaaauuuaacacuuaaaagugacucuucuagcaggagguuugggcacccagccagauuaaggagaaguagcuuuauacacacaucuuaacagcagucugaauaucaaaucuucacuacucuuugcuuaaagcccaguaccuacugagucaucccagccagcaugucccuucuaacuugucauccuguuuguuaucacucuaugcccucugcaguacucuggacuuugaaugugagauuacuuuauuuaagugaacugcaauugaaaaaagaacucuuuugauugaaucuugaccugcaguaauugggaacuuauguaaggaccccaugauacucauauuaaggggagugugggaggaucccacuacuaaagccuggcugcagaagagggauaauggaaacugcagguguuagaaagguaccaacauacaucuucccccuauaguacauggacucaguuuuuacauauggcuaugcuuucuauucugcuuaaguaacauaaaaacugauuaggaaacucaagaucuugcacuacauauaaaaucugcauccauugcuuauggucuaaaguaaaugcaacaacugacaauucuuacagagucucaaaaccaagaaccaccaugauaaaacaauuauacugcaaugcugaggaaagagacauuuaauuacagauauaauuuaugugaguaagcauaaucauuuuaaauuucuaaauaaauaggcaugucauuaaauauaaagcaucaggaaaggauuucaaaaucuguaugguucaucugcguuggcaaauuugaucuauucagaguuuacucugggcgggggggaccucaugauuccaucuuuauggcccaacuguugauuaacuuccaaaugaaaaugcuugauucagcauguauuuucuguaagaaagguauuuuucacaugcuauagccaggccaaucugugucuucaauuguuguuaagacacuaguauaucuuuaaaucuuuuccacuuauuaauuucagcagauuauuuguacacauuucucaggcuauucugauauuucaaaugccuugaaaauguuguagcuacauaaauuaaaugggcaauuaagaugucaccaugcaauucuauacaauacauacuugcaaugggauacuugugaggguaccauuauccaaacuguccuauucaucagccuuucuagaacuuuagagaugggagucagucagcuggguuccagucauggugaauggcaugcaaugaucucgaggaaaccacaaagcacaucuuccuauguuugcauuuccucaucuauuaaaugaagagaagaccuggauccuaacaggacgucugcgaaacccucacgaaagguuaagaaaagaauaaagaacaugacaaagguaagguuuacaugcucuuauuguggcagaagggaaaaaaaagcagaaaugcauauaaauaccucacaguuugucacacaaagcacacauuuaaaaaacaauaacaaaaaacaacaaaaauaagcaaccaaaaauaauuaacaguaguucaaguaauuuaaaccuguauucucuccugaagaaauaccagauagguaaaauauacucccgagccaccacaaacucuccuaaaaucccuuuguccauuucugccacuuucaacauccaucuuccacccagaugccagcuugaccaccucccccaucaaagucaccagacugagcucuaggaaagucuucauuaaauagugaacacaugacauauacuaucaacucagcuugaccuuacaacauaggugcuaugguuugaaugauggugucccuuccaaacuuaaauuuaauuaauuaauaauuaauuaaauuguugaaacuuaagccccagugcaacaguauugggagauguggcccuuggguagcgauuaagucaugagggcgaggcucucaugacugggauuagcacccuuauaaaagggcuugaggucaaaaggaguacucucuugcccaugugucccuccugccaugugaggacaugguguacuucccuccagaggaugcagcaacaaagcaccaucuuggaauuagagagcagcccucaacagacaccaguccuacuggugcauugaucuuggacuucucagccuccagaacugugacaaauuucugugguuuacaaaugaccaagucugugauauuuugcuacagcagcacaaacagcuuaagacaauggauaacuaaucuaaguuccaaaacuagugggcuuuugacaugccuuggaaguagacagauaaagcaguagccaagaucuuuucucaucuuugcauaagcaaaucguaauugacaaacaucaguaucucagagcauucaacaaaguggcaauaaguaaauagauaacugaugaacauacagaaucgaaaggcugacguggguuucagguuucucuggguuguggggcaucccauggccaaguacugaaacucuuccuugaauaacuaucuccagaguuugagccauugaggcucuuggugacaaagacaacugauaugcuuggauccaucaaauaacauaucagcaauucaugccccacugauaguagaaaagugcugcaaucauuuuauucugaagagagcauaaagauuuacaccacaugucaaggcuagauguuguucugccaccaggaaacuugcugugugagacacacaaaaaauuaaacaccucaagaaauacagcuuucuggaaaacaucaauaccucuucuuuuuauuguuacauuuuucuaaugaaucuuucacugcaacaacuuaugcagagaaguuauguauccuggaauuauucuacuuuuugauaaccauuuuuaaagcuuuauacuuuauaaagcuuuuuuuauucucccaauucacuuaagaauuugcaauauccaccucgagguuaaccugaaacucaauuucacagcuaauuccaacuaaacgucuucuccagcuuuccagaugccaucuaaccaguuauauucucacugauucagcagcauauucaaagagacagagaagaacugacaugaugcugaugaagcuuaaacuucagggucccuguugcaugggcccucagagugccaagaguccuugggaguccguguucuagcugagaggaaacaugaagaggcauuucucuguaagcauuuguggcaaagagaucuugaaagaaagggaaccggccgggcgugguggcucacgccuguaaccccagaacuuugggaggccgaggcgggcagaucacgagguaaggagaucgagaccauccuggcuaacacggugaaaccccgucucuacuaaaaauacaaaauaaauuagccaggcauggcggcgggcgccuguagucccagcuacuugggaggcugaggcaggagaauggugugaaccugggaggcggagcuugcagugagccgagauugcaccccugcacuucagccugggcgacagaguaagacuccaucucaaaaaaaaaaaaaagaaaaagaaagagaaccaaaucauuucacugaaucauuuugaaauaaauacucaccuuugcaucuaauuuuguauucauaaucuuuuccucuuuuucuuaaagaggaccucccaaauuguaugagcuuccaacuccacuaaaccugagucugccugauacaagggaaggcauguaaaaauacuucuuaguuuauacucuccacugcgcaaguuuucaaucuauaaaaaaacuccugaucuuuaaaaauaaaaaauaaagguuggggagaggguaguaaaaaguuacuuuaaauguauauuuuuaagaaugcugauuucauuauguauuuuccaauaccaaaauauaaaauaaaauagaaccugcagaacuuuuggcucucugacauuucuccccagugacuuaaaacuuucagaugaaugggacaucuggguucugagaagaaugguguauuauuacugcucuccacaauagcaggccuaaauggauuuuucauguuuagacuaguaaacauaaaaagcaaaccuaucucacaugacugauacguuugccuuuaacaaaacaaccccggccaaaaauuauuagaaaacagaucagcagccccacuggacucugaagcaauguaauuagguaguccaacacuacauuuugucaaaaaauucugacaaccuaauaaccagauugucaucagauagacauuaaaaaaugauaccagguuugcuccagcauuaaaauaccaccacuuucuggguuuuuuuuccuucuguaaaaauaaaaauuaaaaaucuaucagugaugcaucccauuggucuggaugguguuuaaaugagucugugccacuugaaggauggcaaaggaaguuuuguuuugauuuaaaguuuaagaaagaauucuucuuaggaccaccugcuuaacguuaaucacgaaaucccuauguguuaagagggguaauuauaaaauggaaugauaauaacaauaguaaccggcaguuauugaguguuuagauugugccaggcacuggguuucauucuguugaaugaaaccauuacuggacucccaacaaccuugaugagaggugcuacucucacccucauuuucagagguggaagggaggcuuaucaaggcuaaagaauccacuugcacacccaacagaggccaccucaugcucuuaaccucugcaauguguugcugagaaggugguuaguuuggauuugacagggugagguggugggcauuggggauaagagguguuauuuucaagaaaaccauuacguauguggccuuccagaauauaguaaucuaguauguagucuggccuguaagccaaauuuuauguauagugugacacugaagaaaaaaacguuguaauuauagguuaauucacacaguuaaugcaauuaaauagaaaaagguagaaaccuuaagauauagccuuagguucaaauauacucuagccuccauuuaauuagucaauuauaaaaaauuguccacuaaccuguacaagaauaaaccucagggaguacauuucuaagaugaccuuuggaacccuaguaucugaaaaucuuaccauuuuaucuauuaggauauaaaugaguuaucugguauaaaucacugucaaauuugcacaaacaaaugguguggcugacagucaguaauaauucaaugacaccaauuuuuuccccaacaugaaaacaccccagauuacucagucagccaugccauggcuagauuugcaaggcacuauaaaguuuccaaaguauuuguccaccacgugauuuuguuugacauccacaagccuacauuauuucuuuuucuuuuucuuuuuuuuuuuuuuuuuuuugagacagagucucacucuguugcccaggauggaaugcagcagugcgaucuuggcucacugcagccucugccuccuuguucaagcaauucuccugucucagccucccaaguagcugggacuacacacaugugccaccaugccuggcuaauuuuuguauuuuuaguagagacgggguuucaccauguuggccagaauggucuugauccccuaaccucguuaucugcccaccucggccucccgaagugcugggauuacaggcaugagccaccaugcccagccaagccuacauuauuucuuaaacacaaaaagaucauuccgaauuucacaaacaauguugagcaaaauaugccacacacaaagaagcccauaccguaugauucuauuuauuauauaaaauuaguccaggcacagugacccacaucuguaaucccaacacuuugguggcuaaggugagaggauugcucgagggcagggguucaagaccagccugggcaacaauaaugagacucugucucuuauaaaaaacuaaauuaaccaggugugguggugcauaccuguggcccuagcuacuugggaggcuaagacgggaggaucaccugagcccaggaagucaaggcugcugugagcuauaauugugccacugcacuccagucugggugacagagcaagacccuaucucaaaaaaaaaaaaaaaaaaaaaaaaaaccacccaaaaacacacacaaauucaaaaacaugguaaaaccaaucgcagaugagucaagauagugacagccucaguggaagcaagcaugguagugaguggaagauggcaucagagugucauguucuaccucuuauucuagaugcugguuccuuaggcaugaugacuuugggaaaauucaucaagauguacaacuuggauuuacaaguauacaaauccuauagcauguuaugcuucuacagaaaauugacauaaaacaaccauucucucccuuucaguuugcuaacuagaccaagaagaaaagauacacugagaaagagggugggcacucugaaaacacugagaaguuugacuuuacaaacuauugagcuacugacagucuuguuaaaaccucuuagcgugccuuucccucacggcaucaauuuauauagcaauucacuacauuaauucuuguaaugaaagugugaggagaucuguagucaaucauaauugugcccugcaaauuccagaaaauguuugcugggauguaagccucugauggcuggcucagcaagugauuuagagcaauguggugaacuuucauaauaacagcucauuaacaauugcguuuaaaauguaaacaauugauauguuuuuagaaacaccaguacugauuagguuuauuucacuuuacaggaagucagaagauaauaugcuaagcagauuuuccuuucuucccucucaacgauaaauucaauaauaguuagguuagaccuaguuuuguuuucaguuuccaugaaugagaaaugugaagaccauggggguuccaacucagucucucuucuccaguuuuguguuuaggaagcacagacuugaaauguauuuugcaugucuuccaagacuaaauaccgagguuauguuugugcagcugucugaauaaaacugaugcuaccucaaaaaauaaguugauucagucacaaaaaaguaccaagcaaaguauuaauugauuuaauugcccugcuuuuauuuaaagcuagacaagaacuaugggggagggaccuuaucaaugauguuaacagauauauauguauaugcccagcaccuagccaaauuauagaaagagcaugggaacugcuuaaugauuugcuuuaccagucaaucuuuauguggaguggggcauaguuaaugauaguaaucauuuuaggccugaguuccuuuaaauuaucaauuuaauauuuuuauuaaauauaugcauuucaaguacauuuaucuccguugcuuuuucgacuaaaaaauaaagacaaggaauucaaauguuuggauuauuuucccucacucauaccaaauacaaggaaaguaaacauaaugaaguuaaaguaauauucuuagcuugacaaaucacauauuggggacaugagaagccuaaauuaucugaagucaauuaauuguucuuugucaacggaaagaagaauuuagcucccaaacuggauaaaaucccagccaaguaaugaccaauaauggcaauaauaguaacauuauauuuuuccugucucuugauuaucaacaaucaagaggcuauagcaaauaaauauacaaauauauacugugaaaacaucaauauuuguaucuacaagaaggaugaaaaauuaacuuuguguaguaauaucccuccacuguauuuaggaaaagacaauacaacagaccucuaagaauggguguuccuucugguacuugaaggaagcacacaaacaaauauauuauggaacugguggggaaaaaaacagucauccagaaucacagggcugaagagagcccaggaugucaccuggccugucauguccagaauacuaacaaguuucauuuaauuccagcaucacaggcugcucugauauucccuggguucccucuccuggcucugccuaaagacagacccaaagaccaaaaaaaucuaccauguaguccaagucgucuaaugcuagcaagccccugaaucuugccacauagggcccacuuauaauugcaguaacaugucucuuuccuagccuaauuacuauucuuggagaaaaaucucucuuuguuuugacaauuuuuccuaucccuuagaaaaaaugguucaggaauagauucuaguauuauuuuucauacaugaaauaaauauucuauuuauucuauuacauuucuguucuauaaguguaugguuagaugacuguuacuauucuuucuggcuacuggacauaccaagucugguuuaaauacucuaaccagaauuaguccaugccaacauaagcauuuaaugagaaaggauccuggggcuacaugcuccauagucaugugaaaucggauacucugaaggggaaauaacuuucucugaaguguaaccauuaacugaaagagaaagcuuggugugguaugagucauggguaacaugggugaaucacaguccugaugggcagguggccaucucugaagaggauuucagaaaugcucuccccaccuugaucaauuaaauucucuuauuaggauagaaaacauuguauuccacgguuaaaguaugaaaugccuacauaaccagauaaaaugacacaacuguuccaaaaguucaguuauuuacauacuccuuucaugauuuguauaauaucuaugagccaguguucuauauuaauacaacauuucucuuuaaaucaacucaauucugccagucuaaauuaccuuuuugaagaagacaauuuuauauccccacuguaaauauccaaugucacugguauacauauuguauauagccaauaucacuugccauaaauagaaggaaacugaaaagauuucaugugacuaaccaaaaauguauucauucaucucaucucauguaccacauggaauacuguaacaaacugguuuaaauucauacuagagaguaaaugaaugauagaauucucaacaccccuccauccuguccuauuaaugagauuaaagguugagggaccaccaaaagagguaggcagggcccugagaaccugaaggagcauguauucaggauaggggguauggggggugggguuggaugucacaagcuaugagaaguaaggguacaaaagagcagacaguagcccacuucaugauuauuuauaucuggggcugucccugaaugugucauagaggaaguccucuguacuguuugauuugaaggcccuucuacuucuaugcaccaucucuuuuagacauccacaucugagcucacaaauuauccaucacaaagaaaucacaugcuguuaauaggucucuucauuguggcugacagugcaaaacaaaugccagucccugugcugagauacagauuucuggaauacuaacugggauucccaauguggggagacacaguaguagaggucacuccaaggacuccuggaacaugcuccugaauucuguugcuucuugccauacuugccacagagugccguuauguucuagcucucucuggguauccuucucuccaaucagauucucaauucucucaucaucuuucuauugcucuuaauaccuagcucucagcaaaacaagugcccaauuuauagaaaaagcgaguaagugacucugaaugaaucaaccacaagugaaugaaugaaugaaaacagaucagcuuugcagaaagaagcaccugcuuaccuaagguauauccccaaauuaucccaaccucaucuaaaguuaucagggaacacagcacaaauucauuagcauccugcugccuuuucagagaaaugacagguucuucuccccuugccugaucaaaagauuugcugcacucucucucuuaaaaugccuccuuguuacaaacugugcaaucuuggucaacuuaccuaaccucucugaacaucuguucccuuacuuguuaaauauugaagaacaauaucugccccaugaauugugauaaagauuaaaugagagauuucaagaaaagugacuguaguauaucaaaagccaaaaagccagcuacauuuuuggaccagaucacaaugccaugauaaauaucaauggaauaaugguccacaaugucacaccacaugcuuucauucugcuguccucaugacuucccuguuugccagcaucaggguuuuucacguuuacaaagaaaauggagcagguuagcaggucucgguggcauuaaugggcaaagcaucaugggcaacuguuguucauaaaugcuccuucucaaauguauccuggguuggugaugaccacaauucauuuccauuuugaagcgcccuccauuuuuuacuucuuucucagucugaaucuccuauacuuguaauacugacggagcuucgcuaguuucuaaaucagaaagaugagcacgugcagccacaggaagagaaaucugggaccugaugccuauaauauuuuucagacagagaauauucccccagugucucuacccaggagauaguaaacuacucugacauuucagcuguugccccuccaagcagauucacacaccucuucggcuaacauccccuuugggcaggcaucuacucauguuuacaguuauucauuaugacuggcuauacacagacagugccucuggugucaaacugaauggccccuuagacccccauuccaagacagccagaggauacagacauauauuaaauaagacacaggcaggaaaacugcacugacuuccuugagauggggaggcugaagccaaccaaagcugaccugcuagagaguccuccagagcuccagugugggaugacucacagcaaggagcacgggaucaaaauuuuugaggugcuucagggucagaaaguuuuccagaacagcuucugcggaugucugugaacaaauaugccagcaaggaaaaagaccaacuauuuugcaggggaaucaucuugaaccagaagggccagcaugcauucuaagugccagggcaaguucccaacccucugagcuagcucacaucuauugugauuccacacaucucuccauggaauaaucuguccaagaacacacaagcagagaagugcccuucuccaucuacaagcaucuaaauguagagucaugagagaaggugagaggcagugacuucaagagguggccucuagaccucagaauccacucuaaugaacacgcuguguuuaaacaagggaucucacauuuucucaaaaggcaguuagacacauucacauacuuaggagugaaucuaagaacucuagaaagaacggcacauuucccuacugacacaguuguauugaaaaaucaaucuguggcucuaagggaaaugagaaaacacaacuggugauuucuagcacggcauccaaucuucacuuuugugaucccucaauucucaguucaaguauaaauagacuuuuucccccccacgaaguaggaaaaggauuaaguaggcaggacauuuucuaaguucuguguagcauauguucauaagcuuuccuuuuguagcauuuauggauucauucuggaguaggguuaagccggagcaaagcaauuuggcaugcuugcaauuugcuuuaucaggagaagcaagcacagacugcagaggccaccucgaccugagcagcaaagaagcuucccagaacccugagggagacacugauuauuuuccuuacagggaugcucaagcugagccaaccuccuugcaaaauagucaaugagcuucauucagauuauccucaggaaagcaguggccaagcagacacaagugaucaucaucauacgaacuuaauuucugaccaaauuccacaaucacacugcucuuccugaagucagucaggcaguaucuauacugcuacacaaaccucagggucagcauuccaauccaucccagccuaaggaucccauucagcagcagaggugcuuuucaaaucuguacauccacuucgguacuuucuauccacaugagagaacacacugcagcaggagaugaggaugcaguaggauaauucuuaauguucacaauauaauguugaauggaaaaagcaguaugugccauuuucuuaaaauacaugcccacauaaagaacuaacugggaaaaaaacacccagaaaugucacuuggagucaucucugggcuguaggauuauacacaauuucuauuuucuucucuuagcugaacugguuuccaaauauucuaaaaugcaaaugcauuacuuuuauaauaguaauaaaguaauucuaaagugauuuaaauauauagacugugauucucaaaaugcaggaguuaaagaaaaaaauaaagacauagacugaaccuuacaaaaaagauuuuuauccacaaaacaaagaagcauuuucauuaaaacaauauaauuaaccugcaccauuaggaaagaacuacaucauauuucacauucaauuuuguuauuaucaccaucacuacuucuuaagcaucugcuguacacaaugcccuguagcggguauaaguacucaaaaauaaaccaggugguaacuaaguuauuuacaucacugggacucuuccaguguuauuaaaguugaagaacuugaaaagcagcauuuauuaauaacaggggcauuaauccagcugccugcccuguacuccacuuacccagagagucucucccaguccugccaagcaagauuaaguagaauuaagacggcagcuaaccagguagaccuugugcccugggccacaggugacucuggcaagggugggcgccugaccuacaucaaaccauucagauucuuucccccaggaaggaggaauacaguuagucucuaucauccccuugaaugaggcacagggaguugcacggguagccauagcuggcuggauaugcaaagaagccagucugcagacagaagaggugagaggcuaugaggauccugagacagucuccugcucuuuaggaugggaugcugagagauauguuuguccauuuacccaucccacucugguuaguuuuugagggucaaccacuuccuggccuaaggcuucaggaagcucaccaucuaaccuuuugucaaaugaguaagcuauccuguggccuuguagaagccucaccuuucaucguuuuugucacuguuucuuuuguauugguucuugaaaacaaauuaucucuaagacauaguugcaagauucagaacucugaacucucuucacccacuccuuacaagcugaaucccuccuccuguccuucuuuucagaucuuaacuuaaacgucauuaacucugaccgcuccaaaugaggaggccugcuauguuuugccucuugauguuuccuaaauaagauuuacauaacuuuuaauuguauaugcuuuguugguuuacuaguucugaucugucuccuucccuagggcauaaaauaaucugcccgacccauguuccuuguaccucacacagcacauuccuagcauauuacagaagaucaauaguauugaaugcaucagucagucauguaggugagugcauauucauucacucaauauacaaauaaugauugagcacuugaaaucugcaaggcuuaguccuuucuugauaaggaacuaaggaacuaaugauucaaaaaggagauuagguacauaugcaaagacaagaacauagacacagcagacacugcugagggccugucacacagaaauuucccucuuugacaaagaaggccauuacaccaugguaaagggaugaauucaacaagaagagcuaacuauccuaaauauauaugcacccaauacaggagcacccagauucauaaagcaagcccuuagagaccuauaaagagauuuagacucccacacaauaauaaugggagacuuuaaaaacccacugucaacaucacacagaucaacgagacagaaaguuaacaaggauauccaggaauugaacucagcucugcagcaagcggaccuaauagacaucuacagaacucuccaucccaaaucaacagaauauacauucuuuucagaaccacaccacaccuauuccaaaauugaccacauaguuggaaguaaagcucuccucagcaaauguaaaagaacagaaauuagaagaaacugucucucagaccacagugcaaucaaacuagaacugaggauuaagaaacucacucaaaaccgcucaauuacauggaaacugaacaaccugcuccugagugacuacugaguacaucacgaaaugaagguagaaauaaagauguucuuugaaaccaaugagaacaaagacacaacauaccagaaucucugggacacauucaaagcaguguggagagggaaauuuacagcacuaaaugcccauaagacaaagcagaaaagaucuaaaauugacacccuaacaucacaaauuaaagaacuagagaagcaagagcaaacacauucaaaagcuagcagaaggcaagcaauaacuaagaccagagcagaacugaaggaaauagagacacaaaaaacccuucgaaaaauuaaugaauccaggagcugguuuuuugaaaagaucaacaaaauugauagaccgcuagcaagacuaauaaagaagaaaagagagaagaaucaaauagaugcaguaaaaaaugauaaaggggauaucaccaccgaucccacggaaauacaaacuaccaucagagaauacuauaaacaccucuaugcaaauaaacuagaaaaucuagaagaauuugauaaauucccggacacauacaaccucccaagacuaaaccagaaagaaguugaaucucugaauagaccaaaaacaggcucugaaauugaggcaauaaguaauagcuuaccaaccaaaaaaaguccaggaccagagggauucacagcugaauucuaccagagguacaaggaggagcuaguaccaguccuucugaaacuauuccaaucaauagaaaaagagggaauccucccuaacucauuuuaugaggccagcaucauccugauaccaaagcugggcagagacacaacaaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggauacaaggcugguucaauacacucaaaucaauaaauguaauccagcauauaaacagaaccaaagacaaaaaccacaugauuaucucaauagaugcagaaaaggccuuugacaaaauucaacaacccuucaugcuaaaaacucucaaaaaaugagguauugaugggacauaucucaaaauaauaagagcuaucuaugacaaacccacagucaauaucauacugaaugggcaaaaacuggaagcauucccuuugaaaacuggcacaagacagggaugcccucucuuaccacuccuauucaacacaguguuggaauuucuggccagggcgaucaggcaggagaaggaaauaaaggguauugaauuaggaaaagaggaagucaaacugucccuguuugccgaugacaugaauguauaucuagaaaaucccaacgucucagcccaaaaucuccuuaagcugauagguaacuucggcuaagucucaggauacaaaaucaacgugcaaaaaucacaagcauucuuauacaccaauaacagacaaacagagagccaaaucaugagugaacucccauucacaauugcuucaaagagaauaaaauaccuaggaauccaacuuacaagagaugggaaggaccucuugaaggagaacuacaaaccacugcucagugaaauaaaagaggauacaaacaaauggaagaacauuccaugcccauggguaggaagaaucaauauggugaaaauggccauacugcccaagguaauuuguagauucaaugccauccccaucaagcuaccaaugacuuucuucacagaauuggaauaaacuacuuuaaaguucauauggaaccaaaaacgaccccgcaucaccaagucaauccuaagccaaaagaacaaagcuggaggcaucacgcuaccugacuucaaacuauacuacaaggcuacaguaaccaaaacagcaugguacugguaccaaaacagagacauagaucaauggaacagaacagagcccucagaaauaaugccacauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaguuaauucaagauggauuaaagacuuaaauguuagaccuaaaaccauaaaaacccuagaagaaaaccuaggcaauaccauucaggacauaggcaugggcaaggacuucaugucuaaaacaccaaaagcaauggcaacaaaagacaaaauugacaaaugggaucuaauuaaacuaaagcacuucugcacagcaaaagaaacuaccaucagagugaacaggcaaccuacagaaugggagaaaauuuuugcaaucuacucaucugacaaagggcuaauaugccaaaucuacaaugaacucaaacaaauuuacaagaaaaaaacaaccccaucaacaagugggugaaggauaugaacagacacuucucaaaagaagacauuuaugcagccaaaagacacaugaaaaaaugcucaucaucacuggccaucagagacaugcaaaucaaaaccacaaugagauaccaucucacaccagguagcauggcgaucauuaaaaagucaggaaacaacaggugcuagagaggauguggagaaauaggaacacuguuacacuguuggugggacuguaaacuaguucaaccauuguggaagucaguguggugauuccucagggaucuagaacuagaauuaccauuugacccagccaucucauuacuggguauauacuaaaaggauuauaaaucaugcugcuauaaagacacaugcauacguauguuuauuguggcacuauucacaauagcaaagacuuggaaccgacccaaaugcccaacaaugauugacuggauuaagaaaauguggcauauauacaccauggaauacuaugcagccauaaaaaaugaugaguucauguccuuuguagggacauggaugaagcuggaaaccaucauucucagcaaacuaucacaaggacaaaacaccaaacaccgcauguucucauucauagcugggaauugaacaaugagaacacauggacacaggaaggggaacaucacccacuggggcuuguugugggguggggggagggaagagggauagcauuaggagauacaccuaaugcuaaaugacgaguuaaugggggcagcacaccaacauggcacauguauacauauguaacaaaccugcacauugcguacauguacccuaaaacuuaaaguauaauaaaaaaaaaauaaaauaaaaaaagaaauuuuccuguuucaccucacagguaaagcccugugcugguuaauuuucugugucaacucaacugggccauggggugcccaaacuaaauauuauuucuggaugugucugugaggguguuucugggugagauuagcauuuaaacagaaggccaucacccaguuuguugaacagaagaaaaggaggagaauggagaaauuugcccuguuucugcuucacugugugagcugggauacaugaucucaucuuugccggcccucagacugggauuaugccauuggcucccuugguucucaggccuuaggacuuggacugaauuacaccaccggcuuuccugggucuccagcuugcagacagcacaucauggaacuucucagcuuccagaaucacauaagccaauaccucacaauaaguaaauaaaccaauaaauaaccuuuugguucuguuucucugaagaauccugacuaguauaagccccaguuuuauuaggguggccucccuccauaaagcuauguacucaagggaaggugagauuaucccagaaaagagauaaaacccgauuaguuuaaaacagggaaaggguuaacagcugcucugauaucccuuuagcuccaagggcagcugggcagacccagagcagccagagaccccacacccaugcccuacacacacacaucagccacuccagcugugagcagccucuucugauugcuuaacaugccggccaaauuguauuuucuaugugcaccauaacaagaacaaaguugggaagcaccaaucuaagccaccagggaugagccccauuccgcgugccagugucugauuuaggaaggagcaugggacugcaaucaacuaaaugagacuuaaggggaagucagcucagggguuacaggaacaguuccuugcuuuuaaaaagggacauauaagaacagauauuuuauuuugccaguggauguugccaugucugccuguagcucccaaaaaggaaccagccaucuuagaacuaugaaggcagccagucuaagaacuaagucaacacacugaagauggcacaggaaaaagagcaagaaauagacacuuugguaacaauguugagccacugaauuaacaaaacuugaaacugcaccccucccaggaggucuuauucccugagauaauucauuucucuuauucugauggguuuuuauuugguggauuuucaaauguaacuugguagagcaauucacaaaauaauugacagugcuuagcaaucugucaauagcugagugcucaaaauccucucccugcuacacagugacaaccaucaaaggcacccugguggguccccaguugcuuggcaaaaguggauugcaguuagauuccagacauuuggagccaggauucuauaaugccuucccaucaaucaugacaucccuggggcagcagguagacuugcagagggcagggagcuuuuuucuuuuaauuccccuauuguuugaaccauuucaaguugacuuuuugauuauuugcagccaaaggcaucuucggugauaaauccaucuucacauaauuagcagcaaauuuauguggccuccuuugagcaaagacucaggagaaaaugaugcagagauucauaauuccacccacauuccccaaaaucuuuagaugaugggucuucagugaauucucucuacaaaaaaaaagacaacugagaugccagaaaaaggauuaaucaugugaucaucugacacuuaucaugggagucauaaaguaccacacaaauggugaggcaucaccuugucucaguguugaauuaggggcagcauaauuuuaaaauaucaauuuguacucuuuguuaucccuccuguguauacuguucccuuucgcaucucaaaaacuucaagacuuugccuucuucccuuugucucccagacauauucaaacgcaaaagaugcuaaaagacaaccaccaauccccuaaauccagucuccauuaaagacuuuucuuuuucaaaaaagccuaaauucauugaagggaauguguuacaucccagcagaaagguccaaaauaaagacaauuuggguuguuuuguuuugcuuaaaaguguuguucuuugaucuguuuaggugggcacuuggaguacaguaaggauugggcuuuccugguauuggagagaagcuggagcaguuccuuaaaguaguggacgcuggcacccugcuuccuggcagaacucuagagaggugacaggacuuuugaucgggauagugaugggauacugggaaaaugacuaccaaggccuugaagccacagcgaaaaucccagccuucuuugcacagauacaacaggacuacccaacaaugcauggacaagaagccucucauggugaccagaguggacuaaaguucagggggccuuuuuaaaaauguuuuaugcuauaacagaccugcagcauuuuugcaucaaugaccuuaagugagcagacacuccaaacaccacuuagaacuucccaacauuuagagaaaaaaaaaguaaccaguuaugcauguaugcaugcuugcaauucaugcagcauucaaaacaauuuuucagaaugaaaucuuuaaaucagagugcacacucaguuuguauuuuuaguugauuugacacaucaugagcaaccacaggauuccacaauaccaggccaaguucccacuguagggauggaaaggugugauaccuuuccucaccucucacaagagucacagccaacauuccuauaacaaaagacaggucagcaagagaaaagcauaacaaauguauuuaaucaaaguuuuaugugacauagcagccuuccgaaaugaagacccaaagacuaaaggaaaauaguuuuuaugcuuagguucagugaagaaugcacagcuguguagaaaugugguagaacaaaagggguguguucuacuggaaauagaaaauagauuggcggugguggggguggugguggggaucagcaaggccugacuauucagauucuuauuggccucucuguguaacguucuuucuucccaguauggagcagggccucuauggaaugaggaucuucaaaggagaaggaagagagugacuuuucuagguuuaauggcuugcuguggggaagagacauucuaguuucuaugacccaccuuagggaagaggaauucugguuuauacgacuugcuuaaggggaggaagagaaguaggagacaguauuaugggagacugccacaaagaccuugguucugagggcuuuccaauguauuuccuucaguucaaaguacucaggaugcuaagguaccauacuuugggggauuggguucuaagacccgacaccacuaguuauuuaauauuuuccuuccugcaaauccugcuaccuuaaaaaaaaggaaaacuaacuguacaacagguaguucuguagcuaaugagcauuauuaaauauuuucaaaacauuccaauaaaaggcaauaccaaacggcuuuuauccuaauacuuucuaaauaacgccacauucauuuaugaggaauugcauuucccucaauguucugggcauuaaugaagauugaauauaaauaaaagaauugccuuauauguauagcacuuuaaagaguugagauucccaaauaauacaaaagcauuuucaagucacacaugguauguaaagugaaaauguucuugaaggaaauauccucuaauaauacuuaccuacuucagagggugaugggaagcucuauuaacaccaaaagaacacuuuuagaucuucaaauaaaagcacuauacaaaugcaaaguauuauuauuauaguucugaaauaauuucacaccuagggaugagaaaaccccaggccaaauuuuauugcuucucucauacgugauaaacaagaaaugccauaagcaaggggcgaggggggugguuaguggggggugugauagugggggaaguggaaaucaaacagaacaaagacuucaaaguuucucuuucacuaggacuuuguauuugcccagaugucauuuagggaacucucagggaagaaagaaaaaaaaaagucccuuaaaggucagaguuaaguacagggacaaaguucucauugcuuuuguaccagauaaagcaacaaccggcugagcugaaaaaaaauaagcuugucuacuucuaugggacauaauuucucccaaagcacuucucaaaaaaaaagaaaaaaaaauggccagaugaauuauuacugaaucacccacuagugugaugaucucaccuaugaagucaaaagguagcugcuuuaacagacaccaggauuucuagucaauuacugagagcacugagcaagacauguuauugcugaugguagugguggugaugaugaugaagaugauaaugauguugaugaucaugauugugaugaugguaauuacgguaaugauaggauauggaacagaaguucucaaaccugcugaucaauggaaucaccccuagagcuuuuuacaauacagauuuuugguucuccaccucagccccacugauuuugaaucucugaagauagaacucagaaauuuuuuuuaaguagccaucaggauaacugaagugacaguauuuguaaguaauauaaugauuaagaaugcaggcucugugaacagacuggcuggugucuucucccaguucuaacacuuacuagcuaugugaccuuggaaaaaauacuuagccuuaagucucaauuucuacaacuauaaaauggaaauacuaauaugacccaccuaugaaauugacaugcuauuacuaccuaccuuauaagguagaugccuaaaguaggcaaauuuuuuuaaaagcacauauuaauuccaagaaagacaaaaaauuuuauauuaaagaaaacauaacaaauaccauucggcuuagcaacagaaaaaaauuacguaaucaugauaauguaaauauuaccuguugauuuaaauaaaaauuguaauauaacuaugucaggaggcuguggggaccagaagugguaagaguggaaaggaucagagagcuauugcuaaaauugauaaauuaggaaaaaauaauauaaguacauuauuuagaaagagagaggugaacaccagaaauaucagaauagaaaguugcuaauucugggaagcaauccagagagagguagaaagaaggcauagauguugcaguuuuuaaauauuugcuauuuaaugcuguuuuauuuaaacaauguagauacacugcuuugauaaaaauaaaaauaaaauguaaaagguaauuuguaaugcauauaaguacaauaugguauuucuuuauacacugaggcuacuauaaagcuuuucaauuuaccaaaacuugcuuuuaaaaaaaaaagauauaauaucuccaacuaugcaaucaaaauguccauuucuuaaaaguguacaauaaagacuuacuuuuuaccuggcacacucuaaauccuaaaaagauauuugcugaauugggcugaggaugguggaaaaauauauaaagaacaaaguuccuuuguacaaucaaggucacagcaggaaggagaugacaucuucaccuggggugaaggcaggguuaagggaagaccacuaagggauggucuagugugcuggacuuagcaaaaauuccauuaacacuccagacucaaaggggaaaagggaagaggcaguuaccagacaguagaaaaagcuguagccgcugaagagaggcccccaaccggaacuguggccuuccuuagagggauacagccauugccaacccacaaugcugcagggaagaaaguagggaagaauauuucaaccucguguucccaggucuucauccaguuccuuccccuggcuaauacaacagaaagccagcaaacaagggagcccagagaaugccugcgauagagguuaggcccauggugcagagccauuuagaagagagaggagcuggaagcacaaaugugaauacccagcacaagcacuauacaaggugguuguugcuguugucguuguuguuguuguuuaaucugucucuuuuuccuacucagccuccuaaaacaagccccucaaauuuucaucuguuuaagaaauauucauggcaugauaguaauaaacugauguuaugcauuuguuaaaauuuacuaagcacuuucauauauauugucuucaugugauccucaaaacagcccugugcaauaaauagggcaaaaguuauccucauuuuacaggugaggaaccucagaucuuaaagaaaguuaggaaucuugcacagagucacaaagcuagcaaauggcagagccaaaacuagaaggaauguuuccuaauaccccagcuaaggcucuuccuuccauauaauacugucaugcuauuuauucacaguaggagugcaaaauugauauaccuguuaaaaaaaaauuaacaaguuuuguucuaggcacugcacagagcacagaaguagucaacaaauaagacacaaggggaaauagagaaaacuugcccauuccauucucauucuacauuccacaagcaaugccagaacuggaaguaauugaguuuucaaucacauuuuacacaucauugaaaagaaggugcucaguaggguaagaacaguguucaaaugagaaauaaaaauucagggaaaaguagacaaaugucuaaagaauauaccuguuguguuugggguugcuggggguaaaccgaagaaaaucucagucccuuaacaauccccaugacacaaagagaccagggccccagaaauugggagggaugacuucuccgcuucucuucucauuuccagcucuacgcccacauacauacaccuucuuugagagcuaagagaagcagccaagagugacuuuucuguaccaaacacaggaguacugggaaguucagcaaaauaacccauuuuugagagucuaauaaagaacucuguacuuuuuguaaucuacugcaaaacacugagcuacuuacacaugaugaaagaaaguaaugaguggcauuuuaauuguaaaccuccaaacauaccauauuuauuccagaucuagcucacuaaugaauagacuauacuaucaaugaggguucuguaguugcaagcagaagaaacaaauuggcuaauuuaagaauuauuggaaggauacuggagucucagccaauccauggcagaauggaaaauaagguuuggaggccaugacuacuagccaagacagacauggaggcaacaguggucucauaguacauguuggcagaucagaaugcccaccuaggacaagggagaauccuuuagcuaaagaaucaaauuccaaagaaggagcauuuacuuagccaagcuuguggucauacacccauccauaggcagggugcaggccccugaguagggccccugguuacaguuccacuagccuaauuaccucaaaaagaaauaaagaugcuguuaggaaggaaaaacauacacgacagaaaaaaaaaauugguggggggguucccucuauacuaccaaggcuuucuuuaaaaauucuugaagaagcuaacuagcaguagacucuuaauuucucaagacuauuaacuaguaauugaugacaaccaaggaagguaguuuuccuaauaccuacaaaacuucagccuaauaacuuuucacuuccagaggccucacuuccuguauuaccugaaaguuaccuuuucauuugauuccuaaggaccaagcagaauuuucccuucuuugguagcaacaugcuuauuuuagaaauauuauccugaagcuucuaaaaagaauagacuuauaaaaauguauaaugaauaaauucauaaagaugcuguugcugcugcugccgccgccgaugaugaugaugaugaugaugaugaugaugaugaugaugauauuaauaagagcaguggcagcucacaucuacugagcacuuaucaugggccaggacuucuaaguccuugacacagaauacuucauuuaauucuccacaccuacaugaagccaaaaacaguauuauccccacuucacagaucaggaaacugagacucuaagagggugaauaaguuguccgcaguccaacagcuaguaaaagccaaaucaugacuaaacccaugucugauuccagaguaccaauucaacaaaagauuuucauugagaauaaagaaaauggacugugccuguguggaaacauuccccaagaggaaaggaagcaccauaucugugccaaaagauuacaaaguuguuaagauggcuacaucaccaccaaauccaauuauucaugagcauuuauuucuaaaagcuaucaaguauuucuuuauuccaagauguggcucaaugguccagagacauguaguuguauggccaaaaauaagaauuaucuacugcuuaagauaguaauuucuucacugauguucaacaauuauggcaaaauuccaagccaaccaguuuucaugcaccagaguuuaguugccccaaagcaaauccuaagaaaagaggauuuuuuuauaacucauauuuuuauuaucuaaaagggguuuucuccaauaucccuguaaaauucuucuuugcccuccaaauaaacaugaaaaauucagccccagaaauagauuugucaagaaguuaggaagaacuuaaaguacaugguaaaucaaaauggcuuuucaacuuuaacuaaaguggucauaguaauaauugcugcaauaaaaaugacagaaaaaaacccuaaaaguaucaaaaauguaauuuaugaugaaaacaaauguaaaauuauagcauauuucacccuggccaccaaagacucuugaugaaaccgcagcccuauaauugcccagaaugaauucuuuaaauuaaaauacuucaugcagaacagaaauuaaacaaugaaucaaagaacaaagcuguacagagguaugcucauaaauauaccuagcaaagaggaaacaauuacauuuuuccauguaaaaaccaacuugauuguaauguuucacaagagaccgaguagguacuuuucccauugcuucaagcuuggaaguucauuuccuguaauucauuuagggcucagagugacuggguggaaugaaauuagauacaccaaauucaguggcucuuuucuuucuacaaaacuggcucuuccaugcaacugcacaacugacuuucacaauaaauuucauucaacccaauugaaaugccacucugcauuuuauuuuaaaugcuuuauuuggccagcuaguuuuauuuaacuauuggccagaagugguacaagugcauucuuuuuccaucuagcauuaaucuuaguaaacuuagcuccauuggaaugucuuagcugcugagaagaaagcaaaagucagcaagcauacaauugcauuugucuacucucaacacaucauuuuauuuccuccugcucucugcuaacuauugcucagcacuuuugccuaagagggaggacaagcaggugguuaaggaaguuguccugucagcuauaucuuuaguccaaguguuuaaaucucugaauaaaagaaaaaucaauguuguaaaggcaauguuugucaaggccauguaauaaauacacuuaccuuuacagacuguucucaguggauuucucuucuuuccugagcuucaaagcuacaaagacauaaaaaugaaagacagaguugucugugaguacaacaacaaacauuuucuccccaugucucuaaauagaauuuccauaugccaugguauauggugcuagccaaauaaaccauugauaaaacuugugccucauaccucccgcacaagaggccaaaaaaagacagucagaaacugaaaauggugcacacaucuacccagaauugaagcacacaaaccuuggccaaaucuacagucaaaucuuuuggaguguguacuccucaacagaaugggaacggcuuauagcgagaugaaaaucaaauuaaacaugagugugacauacucagucugacuaagcauuuuauuuucuuauuucuuuuugucaucuuucuugcaugcucuauuuccauuucucugaaaaaguuucacuuagggaugccuauuccauuuauaugacaugcaugguccuucuaauauaaaccucaccacuugcuccguaaguauaugugugcaugauuacagggacaaucacccuuccuguauguagacugcagccuucucucggaagaaacucacaaaacagaggaagccacaacuugacauuucaaaucaaaucuuguuaacuucagcucucugugaucaaaacauaaauacuaugcacugaccacacacaaaucaaugugacaaaagaucugcaaaagcaacaguaauaacuuacaguaucgugaagcugguucuuuaaucauccaaucuuacucauaaggugccucuacagucaccaguaaugggaauaugauucuuucucucauuuuuggcuagguccuaacaucuccgaaaggugcaguaguuggggauagacagcuacaccacagcuuuuccaugguucuuuuuuuuuccuucaauaucugaagggauuguuuuagcuuuuacugggcuguuucccuccacaucccucuauuccaucaaagaaugcauuaccacugaugcaugaccaccaaagaacaggucagacuuacgggcuaagauguaaauuucagacuauuaaugcaggagguaggucccuucuaugggacagcaucagaaauuucuccuucccccugagcuacaccguuuaccaaugaguuuagaacaagcagaguuuggagaauauuagauaaaauaguguaauauugcauuugugaaaucuaagagaugaauaaucugauaacauggagauugagcugaaucccuuuccacuucaaacacagaaaugcuaaacaaaauacaauaaugacuuaaaauacauauauguguguguauguguguauauauauguguguguauguauauacauaugugcauauauauacacacacauguacaaauauacauacacauguguauauauauaccuacauauauauacacgcacauagauacacacacacacacacacacacacgcacauacacacacauauauagccaagcccaaaagaaagagaaaaagccgucugggaagugagaagcgccucugcucagccgccaaccaucugggaagugaggagccccucugcccggcuggccaacugacugggagugaggagcgccucugcccggccgcccaacuaucugggaagugaggggccccucugccuggccgcugcccuguccgggaagugaggagcgccucugcucggcagccgcccugucugggaagugaggagugccucugcccggcugcccaaccaucugggaagugaggagcgccucugcccggacgcugugcaaccuuccaagugugaagugacagccuugugugugaucuuuucuguucuuccccaaguuugcauuuuugacauuaaaguuuacuuuuucguuaaaaaaaaaaaaagagagagagaaagccaauauaaaaauauauggauguagaguuucuagaaugaaagacaugaguccucuggaaaaaguauaacaauaucucaaaaagauaaauaaaagcaaaugcauacuuucauauaucagaaugaaaccacagaacgcagagauaaaaauaaaaucuuaaagucaaccagagagggaaaaaaaagagacuucuagcaaaagaacaugucauuagcaaaaaugaaaguaaagcaacagugcggacacugugucucacgccuguaaucccagcacuuugggacaccaaggcaggcagauaaccugaagucaggaguuugagaccagccuggccaacguggugaaaccuugucucuacuaaaaauacaggccgggcgcgguggcucacuccuguaaucccagcacuuugggaggccgaggcaggcagaucacgaggucaggagaucgagaccauccuggcuaauauggugaaaccccaucucuacuaaaaauacaaaaaauuagaugggugugguaccaggcgccuguagucccagcuacuugggaggcugaggcaggagaauggugugaaccugggaggcggggcuugcagugagcagagaucgcaccacugcacuccagccugggcaacagagcgagacuccgucucaaaaaaaaaaaaaaaaaaaauuagcugggcgugguggugggcaccuguaaucccagcuacucaggaggcugaggcaggagaauagcuugaacccaggaggcagagguugcagugagcugaaauugcaccauugcacuccagccugggcaacaagagagaaacuuuuucucaaaaaaaaaaaaagaaaaauuauaugcccaugcuaaaccuaacauucaagaaugauagagaacaauagauaaaucagaacauuuuucaaaaaaaaaauuguuuagugcucacaguaguuuacuuuugccaaaagaaauacuaaaauaagauaugcuugaauaagcgggaauuuaucccagaaggaagcagugagaaacaagaagcaauaguaaacagagaaauuaguaagcaugaugguaaaucugguaacuuuaauaauaaguaauggguauugauuaauaauuauuaagcucuacuuguaaaaaaacaaaacaaaacaauuuuuagcauuugccaauaaagugaaacugagugguuuaucacaaucauauggaauaaagaaggggguaauaaauuguuuacaaggaggagagaaauacuacuuaaggcauuaaagauaugcacuaaaacuacugauuaacuuguuaaggauaaccagcauuucuuucucugucuauauaagcaaagaggcccuuacacauguacucacagagauuuguacaauguuuacauucuacaaauguauugccaggauggcaaaaaauacagaaaacaacccaaacaucuaucagcaauacgauaaacacuuuuuuuacauauucuuagaauggaguauuauauaacuuuggaaaaucagugaaaguuacccacaucaacauagauaccucucaaaauauaauguaaaacaaaagaagcaagucacagaaagcuauacauauuauucuauuuguauaacauucaaaaaggcaaaaauaaauacuguguuguuuuugaauauaaaguauaagugguacaaaacaaaauaaagaaagggaagaaauuuacacagaauucaggcuaucuuuaucuugagagugggagaggagauggaauacgugagaggaaugggggggcuucuggaauaugguaaugaucuguuucuuggccuagaaagagguaucuggacaaucaguuuauuauuuucuuuaaacuguauauguacacuugcacaaauuauuuugcauguaggcucuauuuccgaauuuuaaaacauacaagaguaaccaccaaaagaacagaaauuuccaaaucaauagaggaaacaacauagaguaaacgcaaucgauucucuauacaacauugaaauggaagggagaaagaagcaaaggaaaacacgcugaauagaauauaaaaaagaaaauauuuuaacuaaguccagcugugucaggaaucaggguaaguacaucuguuaaaauuuuaucaaaacgaauguuuuaaaaucuugcuauguguuguuuauaagaaacaaauuuaaacauaaguuuugaaaagaaaaguguggauaaguacacaccacggaaauaggaaccaaaaaaaagcugacggaauaaguuauuguuaggcaugacgaaaguuagcaauaauagaagagaaaguauuuauauucuuuuuuuaaaauuuuauuauuauuauacuuuaaguuuuaggguacaugugcacaacgugcaaguuuguuacauauguauacaugugccauguuggugugcugcacccauuaacucaucaucuagcauuagguauaucuccuaaugccaucccacccaccccccgccccacaacaauccccagugugugauguucuccuuccuguguccauguguucucauuguucaauucccaccuaugagugagaacaugcgcuguuugguguuuuguccuugugauaguuugcagagaaugaugguuuccagcuucauccaugucccuacaaaggacaugaacucaucauuuuuuauggcugcauaguauuccaugguguauaugugccacauuuucuuaauccagucuaucauuguuggacauuugggucgguuccaagucuuugcuauugugaauagugccacaauaaacauacgugugcaugugucuuuauagcagcaugauuuauaauccuuuuaguauauacccaguaaugagauggcugagucaaaugguauaucuaguucuagaucccugaggaaucgccacacugacuuccacaaugguugaacuaguuuacagucccaccaacaggguaaaaguguuccuauuucuccacauccucuccagcaccuguuguuuccugacauuuuaaugauugccauucuaacuggugugagaugguaucucauugugguuuugauuugcaugucucugauggccagugauggugagcauuuuuucaugugucuuuuggcugcguaaaugucuucuuuugagaagugucuguucuuauccuuuucccacuuuuugaugggguuguuuuugucuuguaaauuuauuugaguucauuguagauucgggauauuagcccuuugucagaugaguagauugcaaaaauuuucucccauucuguagguugccuguucacucugaugguaguuucuuuugcugugcagaagugcuuuaguuuaauuagaucccauuugucaauuuugucuuuuaaugccauugcuuuugguguuuuagacaugaaguccuugcccaugccuauguccugaaugguauugccuagguuuucuucuaggguuuuuaugguuuuaggucuaacauuuaagucuuuaauccaucuugaauuaacuuuuguauaagguguaaggaagggauccaguuucagcuuucuacauauggcugccaguuuucccagcaccauuuauuaaauagggaauccuuuccccauugcuuguuuuucucagguuugucaaagaucagauaguuguagauauguggcauuauuucugagggcucuguucuguuccauugaucuauaucucuguuuugguaccaguaccaugcuguuuugguuacuguagccuuguaguauaguuugaagucagguagugugaugccuccagcucuguucuuuuggcuuaggauugacuuggugaugcaggcucuuuuuugguuccauaugaacuuuaaaguaguuuuuuccaauucugugaagaaagucauugguagcuucauggggauggcauugaaucuauaaauuaccuugggcauuauggccauuuugacaauauugauucuuccuacccaugggcauggaauguucuuccauuuguuuguauccucuuuuauuucauugagcagugguuuguaguucuccuugaagagguccuuccccucccuuguaagauggauuccuagguauuuuauucucuuugaagcaguugugaaugggaguucacucaugauuucacucucuguuugucuguuauugguguaaaggaaugcuugugauuuuugcacauugauuuuguauccugagacuuuccugaaguugcuuaucagcuuaaggagauuuugggcugagacgaugggguuuucuagauauacaaucaugucaucugcaaacagggacaauuugacuuccucuuuuccuaauucaauacccuuuauuuucuucuccugccugauugcccuggacagaacuuccaacacuauauugaauaggaguggugagagagggcaucccugucuugugccaguuuucaaagggaaugccucuaguuuuuguccauucaguaugauauuggcuguggguuugucauagauagcucuuauuauuuugagauaugacccaucaauaccuaauuuauugagaguuuuuagcaugaagaguuguugaauuuugucaaaggccuuuucugcaucuauugagauaaucaugugguuuuugucuuugguucuguuuauaugcuggauuacguuaauugauuugcauauguucaaccagccuugcaucccagggaugaaacccacuugaucaugguggauaagcuuuuugaugugcugcuggauucgguuugccaguauuuuauugaggguuucugcauugauguucaucagggauauugaucuaaaauucucuuuuuuuguugugucucugcccagcuuugguaucaggaugaugcuggccucauaaaaugaguuagggaggauuuccucuuuuucuauugacuggaauaguuucagaagaacugguaccagcuccuccuuguaccucugguagaauucagcugugaauccaucugguccuggacuuuuuuugguugguaagcuauuacuuauugccucaauuucagagccuguuauuggucuauucagagauucaacuucuuucugguuuagucuugggaggguguaugugucugggaauuuaucaaauucuucuagauuuucuaguuuauuugcauagagguguuccuaguauucucugaugguaguuuguauuucugugggaucgguguugauauccccuuuaucauuuuuauugugucuauuugauucuucucucuuuucuucuucauuagucuugcuagaggucuaucaauuuuguugaucuuuucaaaaaaccagcuccuggauucauuaauuuuuugaaggguuuuuugugucucuauuuccuucaguucugcucugauuuucauuauuucuugccuucugcuaguguugaguguugcucuugcuucucuaguucuuuuaauugugauguuaggguggcacuuuuagaucuuuccugcuuucuuuugugggcauuuagugcuauaaauuucccucuauacacugcuuugaauggguccaagagauucugguauguugugucuuuguucucguugguuucaaagaacaucuuuauuucugccuucauuucguuauguaccccauagucacucaggagcagguuguucaguuuccauguaauugagugguuuugagugaguuucuuaauccugaguucuaguuugauugcacuguggucugagagacaguuucuucuaauuucuguucuuuuacauuugcugaggagugcuuuacuuccaacuauguggucaauuucagaauaggugugguguggugcugaaaaaaauguauauucuguugauaugggguggagaguucucuagaugucuauuagguccgcuuggugcagagcugaguucaauuccuggauauccuuguuaacuuucugucuuguugaucugcuaauguugacagugggguauuaaagucucccauuauuauugugugggagucuaagucucuuuguaggucacucaggacuugcuuuaugaaucugggugcuccuguauugggugcauauauauuuaggauaguuagcucuucucauugaauugaucccuuuaccauuaugcaauggccuucuuugucucuuuugaucuuuguugguuuaaagacuguuuuaucagugacuaggauugcaaacccugccuuuuuuuuuguuuuccauuugcuugguagaucuuccuccaucccuuuauuuugagccuaugugugucucuguacaugacauggguuuccugaauacagcacacugaugggucuugacucuuuauccaauuugccaaucugugucuuuuaauuggagcauuuaguccauuuacauuuaagguuaauauucuuaugugugaaucugauccugucauuaugauguuagcugguuauuucgcucauuaguugaugugguuucuuccuagccuugauggucuuuaaaauuuggcauguuuuugcaguggcugguacugguuguuccuuuccauguuuagugcuuccuucaggggcucuuuuagggcuggccugguggugagaaaaucucucagcauuugcuugucuguaaaggauuuuauuucuccuucacuuaugaagcuuaguuuggcuggauaugaaaugcuggguugaaaauucuuuccuuuaagaauguugaauauuggcccccacucucuucuggcuuguagaguuucugccgagagauccgcuguuagucugaugggcuucccuuuguggguaacccgaccuuucucucuggcugcccuuaaaauuuuuuacuucauuucaacuuuggugaaucugacaaugaagugucuuggaguugcucuucuugaggaguaucuuucuggcauucucuguauuuccuaaaucugaauguuggccugccuugcuagauuggggaaguucuccugaaugauauccugcagaguguuuuccaacuugguuccauucuccccgucacuuucagguacaccaaucagacauagauuuggucuuuucacauagucccauauuucuuggaggcuuuguuuguuucuuuuuauuauuuuuuuucuaaacuucucuucucgcuucauuucauucgucuuccaucauugauacccuuucuuccaguugaucgcaucggcuacugaggcuugugcguucgucacgugguucucgugccuugguuuucagcuccaucaaguccuuuaaggacuucugugcauugguuauucuaguuagccauucaucuaauuuuuuuucaagguuuuuaacuucuuugccauugguucgaacuuccuccuuuagcucggaguaguuugaucaucugaagccuucuacucuugacucaucaaagucauucuccauccagcuuuguuccauugcuggugaggagcugcguuccuuuggaggaggagaggcacucugauuuuuagaguuuccaguuuuucugcucuguuuuuuccccaucuuugugguuuuaucuaccuuuggucuuugaugauggugacguacagauggguuuuugguguggauguccuuucuguuuguuaguuuuccuucuaacagucaggaugcucagcugcaggucuguuggaguuuccuggggguccacuccagacucugugugccuggguaucagcagccguggcugcagaacagcggauauugaugaaccgcaaaugcuacugcuugaucguucaaguuuugucucagaggaguacccggccgugugagguguuagaacgccccuagugcgggguaccucccaguuaggcuacucgggggucagggacccacuugaggaggcagucugcccauucucagaucucaagcugcgugcugggagaaccacuacucucuucaaagcugucagacagggacauuuaagucugcagagguuacugcugccuuuuguuugucugugcccggcccccagagguggagccuacagaggcagacaggccuccuugagcuguggugggauccacccagagcgagcuuccuggucucuuuguuuaccuacucaagccuuggcaauggcaggcgccccucccccagccucgcugccgccuugcaguuugaucucagacugcugugcuagcaaugagugaggcuccgugggcguagggcccuccgagccaugugcgguauauaaucuccuggugugccguuuguuaauccugcuggaaaagugcaguauuacggugggagugaccugauuuuccaggugccaucugucaccccucucuuuuacuaggaaagggaauucacugaccccuugcgcuucccggauaaggcaaugccucgcccugcuucggcucacacacagugcgcugcacccacuguccugcacccacuguauugcacuccccagugagaugaaccugguaccucaguuggaaaugcagaaaucacccaucuucugugucgcucacacugggagcuguagacuggaacuguuccuauucggucaucuuggcuccaucccccguuuuuuauugacauauaacaaauuauccaaaaacuagauauuuaaaaauaaaagugguggcuggcagccaagauggccgaauagaaacagcuccggucuacagcucccagcaugagcaaugcagaagaagggugauuucugcauuuccaucugagguaccagguucaucucacuagggagugccagacagugggcgcaggacagugguugcagagcaccgugcacaagccgaagcagggugaggcauugccucacucgggaagugcaaggggucagagaucucccuuuccuagucaaagaaaggggugacagacggcaccuggaaaauagggucacucccacccuaauacugcacuuuuccgaugggcuuaagaaacggcgcaccagaagauuauaucccacaccuggcucgaaggguccuaugcccacggagucucgcugauugcuagcacagcagucugagaucaaacugcaaggcagcagcgaggcugggggaggggcgcccgccauugcccaggcuugcuuagguaaacaaagcugccaggaagcaugaacuggguagagcccaccacaucucaaggaggccugccugccucugugggcuccaccucugggggcagggcacagacaaacaaaaagacagcaguaaccucugcagacuucaaugucccugucugacagcuuugaagagagcagugguucucccagcacgcagccagagaucugagaauggggagacugccuccucaaguaggucccugaccccugacccccgagcagccuaacugggaggcacccccaaguaggggcugacugacaccucacacggccggguacuccucugagacaaaacuuccagaggaacgaucagacagcagcauucgcgguucacgaaaauccgcuguucugcagccacugcugcugauacccaggcaaacagagucuggaguggaccucuagcaaacuccaacaguccugcagcugaggguccugucucguagaaggaaaacuaacaaacagaaaggacauccacaccaaaaaucuguacauaaccaucaugaaagaccaaaaguagauaaaaccacaaagaugggaaaaaacagagcagaaaaacuggaaacucuaaaaagcagagcgcuucuccuccuccaaaggaacgcaguuccucaccagcaacggaauaaagcuggauggaaaaugacuuugacaaguugagagaagaaggcuucagacgaucaaacuacuccgagcuaaaggaggaaauucaaaccaaagacaaagaaguuaaaaacuuugaaaaaaauuuagacgauuguauaacuagaauaaccaauacagagaagugcuuaaaggagcugauggagcugaaagccaaggcacgagaacuacgugaagaaugcagaagccucaggagccgaugcgaucaacuggaagaaaggguaucaaugauggaagaugaaaugaaugaaaugaagcaagaagagaaguuuagagaaaaaauaauaaaaagaaacaaacaaagccuccaagaaauaugggacuaugugaaaacaccaaaucuacgucugauugguguaccugaaagugauggggagaauggaaccaaguuggaaaacacucugcaggauauuauccaggagaacuuccccaaucuagcaaggcaggccaacauucagcuucaggaaauacagagaacgccacaaagauacuccucgagaagggcaacuccaagacacauaauugucagauucaccaaaguugaaaugaaggaaaaaauguuaagggcagccagacagaaaggucggguuacccacaaagggaagccuaucagacuaacagcggauaucucggcagaaauucuacaagccagaagagaguggaggaggcccauauucaacauucuuaaaggaaagaauuuucaacccagcauuucauauccagccaaacuaagcuucauaagugaaggagaaauaaaauccuuuacagacaagcaaaugcugagagauuuucucaccaccaggccugcccuaaaagagcuccugaaggaagcacuaaacauggaaaggaacaaccaguaccagccacugcaaaaucaugccaaauuguaaagaccaucaaggcuaggaagaaacugcaucaacuaacgagcaaaauaaccagcuaacaucauaaugacaggaucaaauucacacauaacaauauuaacuuuaaauguaaauggacuaaauguuccaauuaaaagacacagacuggcaaauuggauaaagagucaagacccaucagugugcuguauucaggaaacccaucucacaugcagagacaaacauaggcucaaaauaaagggauggaggaagaucuacccagcaaauggaaaacaaaaaaaggcagggguugcaguccuacucucugauaaaacagucuuuaaaccaacaaagaucaaaagagagaaagaaggccauuacguaaugguaaagggaucaauucaacaaguagagcuaacuauccuaaauauauaugcauccaauacaggagcacccagauucauaaagcaaguccugagugaccuacaaagagacuuagacucccacacaauaagaaugggagacuuuaacaacccacugucaacauuagacagaucaacaagacagaaaguuaacaaggauauccagguauugaacucagcucugcaccaagcagaccuaauagacaucuacagaacucugcaucccaaaacaacagaacauacauuuuuuucagcaccacaccacaccuauuccaaaauugaccacauaguuggaaguaaagcucuccugagcaaauguaaaagaacagaaauuauaacaaauugucucucagaccacagugcaaucaaacuagaacucaggauuaagaaucucacucaaaaccgcucaauuacauggaaacugaacaaccugcuccugaaugacuacuggguacauaacgaaaugaaggcagaaauaaagauguucuuugaaaccaacgagaacaaagacacaacauaccagaaucucugggacccauucaaagcaguguauagagggaaauuuauagcacuaaaugcccacaaaagaaagcaggaaagauccaaaauugacacccuaacaucacaauuacaagaacuagaaaagcaagagcaaacgcauucaaaagcuagcaaaaggcaagaaauaacuaaaaucagagcagaacugaaggaaauagagacacaaaaaacccuucaaaaaauuaaugaauccaggagcugguuuuuugaaaggaucaacaaaauugacagacagcuagcaagacuaauaaagaagaaaagagagaagaaucaaauagacgcaguaaaaaaugauaaaggggauaucaccaccaaucccauagaaauacaaacuaccaucagagaauacuacaaacaccucugcacaaauaaacuagaaaaucuagaagaaauggauaaauuccucgacacauacacccucccaagacuaaagcaggaagaaguuggaucucugaauagaccaaugacaggcucugaaauuguggcaauaaucaauagcuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccuggcagagacacaaccaaaagagagaauuuuagaccaauauccuugaugaacauugaugcaaauauccucaauaaaauacuggcaaaccgaauccagcagcacaucacaaagcuuauccaccaugaucaagugggcuucaucccugggaugcaaggcugguccaauguaugcaaaucaguaaauguaauccagcauauaaacagagccaaagacaaaaaccacaugauuaccucaauagaugcagaaaaggccuuugacaaaauucaacaacucuucaugcuaaaaacucucaaugaauuagguauugaugggacauaucucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaaucaggcaggagaaggaaauaaagggcauucaauuaggaaaagaggaaguggacaaauugucccuguuugcagaugacaugauuguauaucuagaaaaccccaucaccucagcccaaaaucuccuuaagcugauaagcagcuucagcaaagucucaggauacaaaaucaauguacaaaaaucacaagcauucuuauacaccaauaacagacaaacagaaagccucaucaugagugaacucccauucacaauugcuccuaggaauccaacuuacaagggacaugaaggaccucuucaaggagaacuacaaaccacugcucaaugaaauaaaagacgauacaaacaaauggaagaacauucuaugcucauggguaggaagaaucaauaucaugaaaauggccauacugcccaagguaauuuauagauucaaugccauccccaucaagcuaccaaugacuuucuucacagaauuggaauaaacuacuuuaaaguucauauggaaccaaaaaagagcccgcaucaccaagucaauccuaagccaaaagaauaaagcuggaggcaucacucuaccugacuucaaacuauacuacaaggcuacaguaaccaaaacagcaugguacugguagcaaaacagagauauagaucaauggaacaguacagagcccucagaaauaaugccgcauaucugcaacuaugugaucuuugacaaaccugacaaaaacaagcaauggggaaaggauucccuauuuaauaaauggugcugggaaaacuagcuagccauauguagaaagcugaaacuggaucccuuccuuacaucuuauacaaauuaauucaagaugcauuaaagacuuaaacauuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacucaagagcuucugcacagcaaaagaaacuaccaucagagugaacaggcaaccuacagaaucggagaaaauguuugcaaccuacucauuugacaaagggcuaauaucccgaaucuacaaugaacucaaauaaauuuacaagacaaaaacaaacaaccccaucaacaagugggcgaaggacaugaagagacacuucucaaaagaagacauuuaugcagccaaaaaacacaugaaaaaaugcucaccaucacuggccaugagagaaaugcaaaucaaaaccacaaugagauaccauguuacaccaguuagaauggcaaucauuaaaaagucaggaaacaacaggugcuggaaagguuguggagaaauaggaacacuuuuacacuguuggugggacuguaaacuaguucaaccauuguggaagucaguguggcgauuccucagggaucuagaacuagaaauaccauuugacccagccaugccauuacugcguauauacccaaaggacuauaaaucaugcugcuauaaagacacaugcacacguauguuuauugcagcacuauucacaauagcaaagacuuggaaccgacccaaauguccaacaaugacagacuggauuaagaaaauguggcacauauauaccauggaauacuaugcauccauaaaaaaugaugaguucauguccuuuguagggacauggaugaaauuggaaaucaucauucucaguaaacuaucgcaaggacaaaaaaccaaacaccgcauguucucacucauaggugggaauugagcaaugagaacacauggacacaggaaggggaauaucacacucuggggacuguugugggguagggggaggggggagggauagcauuaggagauaugccuaaugcuaaaugaugaguuaaugagugcagcacaccagcauggcagauguauaaauaugugacuaaccugcacguugugcacauguacccuaaaacuuaaaguauaauaauaauaaaauaaaaaaauaaaaauaaaaguaagaauuuauuaucucucacgguuucuacggaucaagaauccuggcaggguucagcaggauggcuuuucuguaugcuacaaagccugaggcuuccgcuagcagacuugaaaguuaggggcuggaaucaucugauaucucaugcccucaaauaucuaagcuaggggcugggaucaucugaagacucaugcccucacauaucugccaguuguugcucaggguuagcugagaccacagcuagagcuagcagcuggaauauguccauguggccucuccauguggcuugagucuccucacaacaugguggcugaguuccaaagacgaguucugagagaagcuguauuuuuuaugaccuaggcucagaaaucacauaacaccauuuacacugcacuccacuggucaggucagucacaaacccccacccagacuaaaagaaagagaacaacagccuugccgcccucaaugagggagugucuguuacacuguaagaagagcacaggauuggauaaaugugcugaugugaucaccuuuggaaaauacaaucugccacaacauucuuuacaagcacauaugaaacauaagcaaaaauuaaacauauaguaggccugaaaguaguuucaaugaauaucaaacaauagauaucaaagguuucuuauuauaaugcauuaaaguuggaaaagaauuacuaaauaugauuuuuaaaauauguuugaaaauuacaauuuuaugacaguuucccuuugugaauugggauuagacaaggaccuuaacuaaaucccacuggaugaagguccacaucuggagucaaaagagaucacuaauuugguuguggauacauugaauuugaagugccuuagagacaucuaaaggaaaauauccagguaagcaguuggguagaugggacuguagcuaagaggggaggucugagagugguaaguuaucuguaaguaggaaguaacugcaguugugaauauggaugugacuguccagggagucaguauaaguagaaagacaaaagggccuaggacugauccgugagcaaguucaacaucuaacaguuguguugaggaggaugaauccuacauaagagagagaacaguugccagagaaguaaaacuaaauccucaagauucacagaaaggucaagcaauauaaauacuaaaaaaagcccaauaggaaggucaucgaggaacucagcaggaacuguuuuguggacugauggaggcagaauucaguuuggaguugguuaagacagaaguggaagucauuaaacaaagacaaugaguaaagacaauccuagauaagcuuggcugugacuggggaggaaagaguggcaacuaaaggacaaagggcuggaagacgguuuguuuguauaguuuuuaaacagaaaaaaggccgaguauguaucaagguaauggagaagaucuauuuaagaugcagagugaguguagaagagaaaggguaaccaguacugaagguuccugagaagguugaaagggacaggugguaggacugguuuuaaacugagcuuuggccucaccguaaucauauagugucuuaugauaggaacccaugcuauugucuuaaugcacuacuuuaucguguguuuauguuuucucacccuaauuagaaucuaagcucuauaaaauguauggccuuuauuguucaaaccaaccccaccuuacucacacauugaaaaccccagauucuaucccagcacccaacagucauucaauaaacacucaugugucacuuaguaaugggaguauauucugagaaaugcacccauaggugauuuugucauugugcaaacaucacugcauguacuuacacaaaccuagaaaguguagcccacuauacacuuauccuauaugguauagccuauugcuccuagguuacagaccuguaaagcauguuacuguccuaaaugcuguaaguaauuauaacacgaugauaaguauuuguguaucuaaacaucuaaacauauaaaagguaugguaaaaauauaguauuauaauauuauggaaccaugguccuauuugcaguccaucauugacugaaaugacauuauguggcacacaaccauacuuguugaauaaacuaauacaagcagauucuaucaucuuuguguacaucuuuguguaaaucuaaaaauguguguguguguguguguguguguguguguguguguuuguguguguccuggcuauccaaaaugcgagcaagucagaacccaaaaguucuuguuccagaguauagauaucuagacaauagucaggaauagccacucaaauuagcccucucuuucccauguuuuccuugaccuaaaaauccaaggaucuaaacuacaggccaugaaaacauuuucaccuacaguuacaauauuauaccacuucccacuuuccucaugccuaauucguccauauuuuguucuagagcagacaaacucuguauccuucauuugaccuccugcaagacauaaauuaaauuuaaaugaauccaaauacuuugggcuucaguucuccuaaaagaaauaaacauggaaguagagcaguacaggccaguaacacacugauuuaucuugcugauuuuucagaggauagcccuccaaaaaaucuuuacaaaccucaagccucucaauccauggauccaaaccccagcucccuuaaaaauaggucugaauuuaaacaaauaucuuuccgaaauauagaaaccugcuuugauggugacucaucuuaucccaguagaaaccuuucucuggguaccauccaacugcaccauucuuaaggcaacauuaccuggaacugagggauuugccucuauuguugcauucugcagcccucaccugacuuaacugccacguuaaggaauugguuauugaccuuuaagucuuuaacaauuauuuacauaccuaggaaagagucugugcauucagguacaagaaugaagacaccgaauaaauucagcccucguuuucauuuuuaugcuacguucagugagcuguuacugcagacaaauuauugcagcauucuuucaaaugauagccaauuuucaacuaagagaagauucuuaaaccccuuucuaaaaccuuuuccugcauaucggugaaaaccaggcaguuggaaaacacagcccugguuaaaccacauaauaauaaauuaauacuuuaaacacauggaauuauuuaagaaucugcauaauaauuuaaacccucauaagacauagcagcaaaggccccaaaaaccuaacacuucucagauauauuccuagaaguuuuauuucaauuuauauguaugcauuucuuacagaauauuuucagaauuucugaaacucagauacauuuagaguccagggaggugaccagaauaauucuuacuuuuguuauuuaccuggggagcuaaucaauauuguuaaaauguaggugaaagucuuucuauuugaccauaaguucagcaauaauacggaccacaucugucuuguucuauauuaaaucuacaucuucuagaacacugucuggcacauauacuccguaaaauuucuuuaauaaaagaauauuauaaguuuucacuauuacuaggaaugaaaauugauugcaaauuauuaaggaaagguuaguuuugaguuuuguucuugguuuucauucauucucuuaauuuguaccccaugcuuucacaaaacaauaaguuaucucucuacugaagccuacccuucuauggccugagacacauacacacaacacgacaugcccuugccacaucuauucaaugcugucauauuugccaugcaucagaaaaauaaauuuaccaaguagcagaagcucuggaaaaucauuaggugacaucugaggagcagaauaccaaucagccaauaauuagcaucugaaaauucauagagucacagacaaaucaaauuccaugaaaucucagggagcuuggcucccugacccuggcuggguuggugcccaggcaauggguaagcaguaaauugugccaccccaacaggacuggaaggugccauggcuagucuaaccccagggggagacauucugacaauguggcauuugcacagggaugcccuaacauggccccaguauguuuucucagaacgggaugacauuuuaagucaaauagcucuguucccaauagcacagguccucucccaaacucuaauagccugaauuugagaaaaagagguucaucuuggggagaaacugauguuuugcagaugcaauauuaaaacaauccauuuauaaggaaggcaaaaccagauauucaguguuuaacuucauuuauuaccuuuccaucauuacauagaccucagauagccuuagacuuaaaaagucauucacauuuaagcaaaacucuguuccuggagcaucuacacuggauacuuuucaaugaaugcugaaacugguuauaaaguugugcuaccaagaggcaugaagagugacugucaguaccuuaccaaaccccugcugacuggaacaugcaagucaguccaaggaugcagggccaccacuguuacugcugccuccagccuaacuaaggucaccuuuccugcaugccugccucauucuaaaggaagaaaacagagagguuggagaauaccagcuccccauuugguuucuacaguugccaacucuacccacaugugacuuggggaaagcacccuuaagaagagugggguccaacguccaaccagacugacccagccuuggggguaaacauuccaccuccaccacguggccugugugcaccugauuugaaucugcuccuacccugagccaagggugaccauucugccagguccccacuccacugcagggucaggcagcagccucugcuccuggcuccuggcccagugcucggauggcccagcaacgucacugcggagagggagucugguugugcccuccucugaacucuccaucuggaagacucucuagucuccuucccucucauuuuuaaucugacagacacugcggacagggaaacucagagcagaccaaaguucaucuucccuuuccugcuucauggcuggcauaaucacaggggcagaacaagguuggcauggaccaggaugccaggaauuaaaugagggucccugaccacuggaacacauuaguccugccuuccaaagucuuaauuagucuuccugugccuggcacaccuaccaccagggagguggccggguaaggugccaugcucacagcaaguauucaacaaaauauugguagagaauggcggucacaaaugccugcuggcucauggcuuugcaacaacagucagcucugaggucugggcaccagcggcaagauuucugcucucuuuacuaaugcagacaguucuagcagcguuauucugagugauauucagccaccagcucaauuuggaagcaaaaugaucuuaacaaacaguggcagacuugauagacaggcugcugagccuggggaccaaaacaaaggaugaaaagaaaaagaaaggaaggguugaugacaagacgaggagugggaaaugaauacugcaaagaaaaaugaggaggauuacaguacuagauacuucaguccggcaacucugaaaugagcugugaacauaacaacagacucaaggguggaaacaauggggggaaucaaggcaacggaacagggcagcaucugucacgaauuuugaugcugggacagacuuagcgcuagcaguggaauagauuugauaguaaguaauauuugagagguuucaaaagacaaugggucuuaauucuguccuguuuugcaccucuugaacuacagugacauaccaaaauuugcuauuuuucuaagaggacauugacagauacaaugaaaauugugaauacauuuuuuccuucugcauucauuaucucuggcccuuauccacaggccuauugcagacuaaauuggauuuuggaucacugguacugaggugcugcaauuaauuaacaauagaaacauaauauuuauauccaggccuaacaacaucugacauuuaaacuauucugccagucggacaaauuccauucgacaaauuuucauuuuaaugaacaugacagaccacaguuugcaugauaggccaagcagcagaacagaguugaccucuuggcauguguuuucaaggacugaccaugcuccagaagaaacaaucugagaaacugucagaauaacagaaagaccagauccccaguuccacccagacagaccaaauacauaccacccucaugucccccagcacagauccuaguaugaaacuguccucauuucaugugcgagcucaaaguuaaauacuuacugccccuuguaauccacuggauaauuuuucuaucuuuggguugcugacauuuucuuugggguacugaagucccuuagcccuuccuaauuaaaaagugauaaacauuuuugcaaggcauccaauaaugugcaaaguacacaagaguuggaacugaugcagcuuuuucaguuggcacaaaacuggccuuccacauuuugccagaugguguaucucaguaaguccccaaucccugacucgagugaggggcauugucaauaugaugcugaagcagagacuaucuuuaaaugcuaucuuauuuugcauuauacuaacacgaugggucuaacacuuauucuugcugaaacuuucacagcuaaagaaguuuucauucuucugugacucauuauucaagccaacagaauaugauacagauaaggggaaaaauucugccccucuuaagaaccauauaaauuugcuggaaaccaaugucagagagcagaucucccagcaagacuucccauugcuccucuauggguuacugguccaaagcacacugggugaaauaguauguauuuacccaagcccaucucuacuaccccaaaaacguggaugucaaggauagagauaaagaugaaaaaugcaaagacagcaaggcagauagaagcuuaauagaucugggaaauaaguaaggucagugaaaaacaauauauuguagcugggaucccuaagggccguauaguucuaguucacauaucuacaacauuccuuauucuaguuuuuaugucaauucaaaagaacugaaauaaaauuccacuuuaaaaguaauacuucuuuggaguagggauuugguucauggguuccaaucucagcaacugaaaugacuaccuacaugguaauuuguuuucaagcuguggcucugacuagacccaaaaugguaaccaugcuuauguuacuauuuuauuuuauuuuauuuuauuuuauugacauggaaucucauucuuaucgcccaggcuggaaugcaacgauaugaucucggcucacucugccucccggguucaagcaauucuccugccucagccucccaaguagcugggaccacgggcacaugccaccacacccagcuaauuuuuuuauuuuuaauagagacgggguuucaccauguuggccaggcuggucuuguacuccugacaucagcugauccacccgccuuggccucccauagugcugggauuacaggcaugagccaccacauccagcucauguuacuuuuagauauggccaugauaccagaacauuaagcacugaaaggaugacagcauuuccaccaguguaaccuaauuuagaaucaauaaugugucacucaaaucggcagcauguacauauauacauacaguguggauggacacacacacacacauauauauauacauacauuaauuauaguaauagccacauguuugagguuuuuacaugcaucuucucuuauauaacaccaugagauaaguacuauuaugaacucuguaacacacugaggaaagggcaguuacaguucacugaccuccuuaagagguaaagucaaggucacaggcauguaagcggcagaguuuaagugcaaauccaagucugcccuuccuccagagccugugcucuacacaacacaguggcauaugacagcauccgcaagggaaacagcaugaaggaauugauuccuuuuggcaacagucaaaauaucuuuuaaauaucagguauaaaacauuuucagaccaccagaugcuuauucaauuuugaaaaaucaauuuuuauggaguugcuaugaguaguuucauguuuguuaaugccugguuauauucuugaaaaaguagcggccucauagagaaaaauauauauauuuuuuugaaaguugggaagaaaaaugagaccuuaacuggauuaaauugaaaauauuugacagaacacaaaugaauagaaucuguaacuuuaacaugccuuugcaggaggcauguucuaaaauggucauaccaaauucagaacacaauagacuuaacaugcuucuuguuguaaacaaaggcauuggguuaaaugaaaguuccaucaaagcuuaauaaccaauucaagugaacacaaaguuaagcguuauauacuuucugcgguuucaguaauagcuaaucuaauaaugguaaauggaggguuauuguugauuccuuugccuguuucauaaauuagauaaagcaacguggaaguuagaguacuuuagaguuuuauuggacuaagugauuuuaaagcuaucucaaaauauaacgaagucaugacuugaaugacugcugaguuguagcuuguuuuccaucaccauguuaguacuuuucaccaguguuaaauaaaaagcuuccuguuaacuaaaacaauucuauaaauacaaugucuaucuacagaaccaaaccauuuaagguaaagugucauugauacaguaugaucugauauucuauuucaccagggccaagcuuauaaaauauuaacuauaagagcagucaaguguuauuuauuucuucugauacaaaacucaggaacaguagaauuucucugcuuaaugauuuuccauagcacauuuccaauuuucuacuacaguuuauugaucuggaauacuaaaacaguuuucuucccugucuaaagaacacaaaaagcccugugccccuagucccaugggaugugccuccaaagauaacagucguggcaucucaucaggcgcugaggggugguaaugagaagcaaggcauuuuccuuacugaaagaaggugcuagucaaaucucaggccuuuugauaacgggaaacacuucccaagccuuugcauuuggagaugaggcuccacaccugcaguucugagagcagaugaguugcccuucacaaaggcagucuauuuuccugcauuuccccuucaugcccugauaugguuacuuucaauuacccugauaguccaggaagaaaaauaucccucucuccauauuucauucacauaauaagaaucugcaagcuguucuguaugacagaugaggacugugugcugaagcaacuuguuccgccugucagccuccgagaacccacagcaaugagauacaaucgugaugacauuacuagagaagaagugggucaaauacauggucacuuuaaaacagaaugucaaccauucuuucuacuucaguaauuugaugcagugguacucaaaacacagacagagagagagaaaaggaaagagagagagaaagagaaaaaaguucaccacuauuaguuuaguguccauacauacacaaaugcaaaugcaaauaauuguuaaaauuacuguucccauauacccuuacaugacuuuuuucauccuccagccaauuagucaagaaauguuuaguaagcaugugguaugagccagacacugaaauggguagaaugcugaaaacagacacagccccugcccucuuagaguuuacagucuaggauaaaggacaaagauuaacaagcaauugagauuaauguaaugaagccugaaaaaaaacgaaguagaagguacuaaaagagcuuacaauauaagaacuaaccaagucuuucaggucaguaaagguuucucugaggaagagacauuuaaguuaaggucagaaguauuagagcagccagauaagaggugagagagaagagugacaaguggaggacuuuucuccucagaauguuuccuuucaaagaaaccauuaagacaaaggccucaggacacaguagaagauauaauggaguaaaugacgccaucaagucuaccauugggacuuauugucuuuccuuauuucaaucccuaguuuagaaaauuaauuuuuaaaaaaaauuuuuaaacauuaguauaccucuguccuaucuugccacauaagggcaaaaguuaaucauaaucacauuuucuugcugaucuaaauauuaagguagauuuuacuuuaaaaaaucuaauuuaucuugacuguacugguuaaaauccauggguuauuuuuaaaaauauguuuugacagcagugaaacuugcagcacauacaauaccaagagcauaaauuuguucaggguauaaguacaugaaaauuaauauaagcaguugguaaaugugacuuauaaaaaaaaagacuguaccaacuacaugccacaauggguggaaauaaagaagaaaaagguucuuuuucucuaauauuuggucaugaaaauucugauuuguucuugcagaaaauuguuuuuggaucauuauucaucucucuuacagcauagaacuuuuuuccaugggaucaacaaauuggaauggagaggaaaaaccggauauauucaugaguauguuugcccuuucuacuaaagcccgagugugauguucggauuauuuucuuuccaaacucaaaauccauucccagaauccaaaaucaauaaaaaugguacuagcaaaacugaggguugaauuuggccuaaaaacucaaugacuaaguagagcuacuaauaugaggagagguuuuuaaaaaaaugucuguaguuauuaaucaccagcaaugacuuuagcagcugcucuaaaguaaacacaaucuacagcuacuuuaaagcaauacaguguaaaaaccaugagaauuaacauucuacugggugaaagguggcagaauaugccaccccaaaauauaccacauuggcauaagaauuauuuucaagcuaaaggcacuuauaaaaaaauaauuuaaaaaaaaaaacagcaggugcaagaaggguuuucugacccucuucuuuuucuucauaaaagcaagagcuaaaaucccuguauggaaaauauucuccugacaccagaaggaaaguaacauucuuaucaucaagggcgggauacugagaccaagagaacucuguacaaacaaaccuuauuaaacuagcucuuauuuuccucgucaccucuccacccaguuaaauauccuggcccaaggcccuuugccuugucacaucuucacaauuuacuacucuuuauccaauuccauauauaaguguucaauucuaacuucaucuuugggucuucauuuccuuaugagggcucccaugucacaaaaaaacuuacauuaaauaaauuuguaugcuuuucuucuauuaaucugccuuguaucaauuuaauuuuuaagcccagccaaaaacccuaagaagguaggggugaaauuuugcuuccccuacaucuguuacuuaggucuuaucuagaguucaaccugaaaggcauauuuuaggaggaauauuggccaaacuggaaaauaucuccaagaggacaacuagaauggugagagguucugaacuucacauaagaaaccuggggauguucagccuggagaaaagcaaugggagacagcaaaacuaccuucauacauucgaugggucauucaucaauaaggccauuccguuuuacugagcacuuccucuauacaagguaccaugcaaggcaaaggagauacagcacugagagagaaagccagucuuuucuuaccaugcggaagggaaaauggauuuucuccaugucacuucacaagauacuguagaguagagcagagcacagauuuuggaaucagagcacuagaguaaaaaccuguacuggguugaaugccauuccccaccccuccaauaugucugugucaaaucccuggagccugcaaauauuacuuuauuagaaaaaaaagucuuugcaaauauaauuaagaaucuugagaugagaucauacuggauugucugggugagcucuaaauauaaugaucaguguucuuacaaaagaaaggcagaugcagacagacagaaaagaagaagauauagaagagaaggccaaaugaagcaaacaguuaugugggugcaagccaaagaaugcuuggggccaccagaagcuagaagaggcaaggaaguuuucuccccuagagccuguugagggagcauggcccugccaacaccuugauuuuggacuucuggcuuccaggacugugaggaaauaaauuucuguuguuuuaagccaccaaauuuguagcaauugguuacaauagcucuagaaaacuaauauaacucccaauuacuuagcuagcuguaguaccuuacuagcuguguuacccauugcuaauaacucuagcccucugagaaccaggcccucauuaggaaacuggagacaauagaaauacucaucucacaggucagagauuaaggagguaugucaaacgugcagcacagggccuagaacaaaguaaguuuucaguacauaauaguguuauuauuaauggauucagauuuacugggaagcuuguguagaccuuagaacaauauaucaacagguguaauaacagcuaauuuaugcaguagggcucucucuacugguaaauauauguagagaccagauaaaucauuuuccagaaauacuggaaaagggauguuuauauuguuugggaggcuggaauaaacauccacuagccuuccuucuagaucaacccaguaaccauuucuccuuggugcaucaggucaagauccuuaggcagguuaacccaguaagggaagugagguauacacaggguuuggcugcuaccuuaaaaagucccuuccccucgcuguaccuuguugucuuuagcuauaaaauaagcauauucugaucaugucuuaguauuuccaacuugaaaaugccaagacacaaugagaaagacuuggaucaaugagauaguuuggguauuuguccccccaaaucucauguugaauuauaauucccagugucagagguggagccuagugagagguaauuggaugauggggguggauuuuucaugaaugguuuagcacuauccucuuggugcuguccucauaauagugagugaguucuugugagaucugguugugcaaagguguauggcaccuccccuuacuauccucuugcuccugcuuuugccauaugacaugccugcucccauuuugucuucugccaugaguaaaagcucccugaagccucccccaaaauggagcagaugccagcaccaugcuuguacagccugaagaucugugagccaauuaaaucucuauuuuuuuaauaaauuacugagucuccuguauuucuuuauagcaaugcaagaauggccuaauaucaucacacacuuaaauuuucugauucucagaaaugaagcaauuagacuagaguaaggauugcuaaggaccaguugacaaaccaggaccaaaccauaauauuguuuuuaaccaguaccuagcaaaaugagaaaaauuuaaaaaauaauaauuuuuuaaaugucuuugcuuggcagaauuaaaaguuagcaauccuaugucagcucccauccuaucucacuuccuaauucaaaaauuauguuuacagccucugaaauucuaaaguuuuggaacugguauaucacagaacaaucuauuaaauuugauuccuacacuaauauucugugauuuuuuuaaaggacauuucagaacuguggauucuaucacugacguguucaaguucaagaauaagaagucauccuuuuagaauuuaaaaauacucacugguaaaaucauauagaacuaaauguucacaacaguaaaauggaaaaaucuaaauaaaaugagucgcuaguaaauaugaugcuauaguuuuacaaaauguuaucaugaagagaaauuggguaacgcauaggcaugaaucucucuauacuaguucuuacaacugcaugugaaucuagaacuaucuaaauaaaaauuucaguuaaaaaauacucacuggguugugugcaauggcucaugccugaaaccccauuuuggaaggccaaggugggaggaucccuugaguccaggcauuugaaaccagccuggacaacauaauaagaccccauuucuacaaaaaguuuaaaaaaaauugcuaggugugguggugggcaccuaugguuccagcuacucgggaggcugaggugaaaggaccucuugaguccagaaguucaagguggagccaugaucaugccacugcauuccagccugggcaaaagagugagucucggucucuuacggaaaaaaaaaaaaaaugcucacugggcucuaaaaguucuuaauguuguuuauuaauucaaacaauggucagauucaaacucaauaaauauaaucaacugugcuuuauacauagcauauggacaguuacuaugaaccauuuguuuggcaaagauguacugaggaucuucuauauuccaggcacuaugcuagguacuagagucugguggccaacucaguucuucccuucacagagaguaacaccuagcuggagaaaaaggcaauaaauaaagagacaacuucaaauuguaacaagugcuauggaaaaaagaaaggcugaggcagaaaacacagggagggauaaggaacuacaugagccauacauauggaaaaugaaacugugaugcaggaaugugcccuuauuuuuuguaugccuauauuauugaacuggcauaaauucugaauaaugaaaauaugugcuuggguugugacuguggugggcucuuaaagguaggcucugcccuucugcaccaauaaaaggagugagaaaaaaaaaguaaaguugacauuugccuuuaacaaauaaggcaauacaagacuguccauauguaaaaguuaaacauacaaugggggccgggcaugguggcucaugccuguaaucccagcacuuugagaagccaaggcugguggaucacuugaggccaggaguucgagaccagccuggccaacauggcgaaacccugucucuacaaaaaaaaauacaaaaaucauccagacaccaugguguacaccuguaaucccagcuucuugggaggcugaggcacgagaaucgcuugaaccagggagguggagguugcagugagcugagaucuugccacugcacuucagccugagggacagagcaagaccuugucucaaaagaaaaaagaaaaaacguauuccauaaacauacaauggacacagcacucugugagaugaaauucuuuaaaagguaugugagucauaauuucccauauaugcccaccaccccuuggaggaggagggguuggcucucuaccuaaacuagaagauaaaacucucucauaaucaaagacaggggaggaccagggaggucuucaagaggagaaacauaccuuugaaauucucucccuucuuagaagauucagaauauuucaaauacugcaaaguaugcccugggagccagucaaaauauguaguaggccagaccacaggacuaggaaauuaagauacagcugccugcuccuauuaggccuaggugcagggccagaauauuaagguuaacuugggcccaguuuggcugaaaagacacaggcuucaaauaagacuggacaggagagcagguaaauaaauagaauauucacauaauggaacauuauauaacagucaaaccaaauaaagcaagguacagaacaauguguauuguacaauaucuuuauauaagaaaggaaggaaaauaacguacauacauauuugccugugugcuaauaaaaguggcuacuaccuuaagggagauggguacaaagaugaggguaugagaagaggagcaagaacaaaauuucacuuuauaccuuuuuauauuguuuuguaaaaauaaagagcuaaaagauuauaauucucauugcugguguuagucacacauuuggagagggcaauucggugguauacauccagguccuuaaaacuggcauaucccuagacccagaaauuccacuuuugaaaggaaguuaucuaagaaaauaauaagagauuuguguacacacacacacacacauucacugcagaauuauuuaucauaguuaagaaaauuuuuuuaaucuacauguaaaauaauaaagaaccagugaaggaaauuaugggccaucuaaacaauccaguaacaugcaacugucaaaaacuacacuguaaaacauauaccguagaauacucaguggcacagaaaaguauucauaguauauuuuuuaaaucauucauuaauuuuucaauaccuucuuuagagcaucuaccagguacuaggcacugagcuaaaugcugauuuaaaaggccaguuacaaaacaguauauaaauggacaauuccauuuuuugugcaucugugcauuuauaacuagacuagaaggauagacaccaauaugagaguagugauuaccugaguggcaagauuaugggugaaauauauuuucuauaaugaacauauauuauuucugcaauaugagaaaaaagcaccacuuuuuuaaucaggcuaacaacucccaggaucaagaaugugucucauucaucucucuguccucucacccccuccugacucccugaauacaaacaugaugcuugcuucagcugcagcaauucuguggccauuauggaaaggccaagaacugcaagauacacucuccuugacaucucugagcugcugaacuaaagccaaagcuaaccauuucuagacuucuuuuuauguggaagaaacaaaccucuauucuuuuuaagcagguuacuugcagcugaaagcauuugaagcugacauaguaaccuauuaaauaauacaugacacauuaaggccaguacaggcaacccagcaaauuucuuugaucaaccagcagaaacugaagacugaugugguuaauugccccacuagcuucuggcucuguauucucuucucugaagcuccugggaaguagagcccaggagaagcuguuagugaggauucgagauccauaggggagcacugcuugcugcaaagaaaaaccaggcagcuacuccuacagcuuuacaacguggcccagcauucccacuccuggaaaugucuccuaagaaaaaaucaugaaugugauuaugcacacgugcaaauacaucagaaaaaauggugaggaaaaccuauauguugaccaagugggauagauuaaaaaauaaugucauguucuaacaguggaauacucuguagacauuaaugccaugggaaaaugcauacaauauauugacgagugaaaacagaaaacaaaacuguauguaaaguauuauccaaauuuagaaaaauguguccauuuucuguuagaaaacuaacagaacaaauaugcaugcaauaaaaacaauggaaaaaaagccacacacugaaauauugauagugcuaucaugaaugggugaaaugcaauguuauuuuauuuuuugaguauuucuauauuuuuuuaaaucuuccaaauuuauuuucuugugcaguugguaagaaaauuucuucuaaauagcaccuucuuacagaauauucugggcccuccgaccaagauguucaauucauccacaccaacuuugucuaauaccugccugcagauccaauggaguuaacaagaaacaauuuauuuuuguguuuuaaaaauagacauggcaacagcuguaagcuaagcuacagaaaaugauaaagaaauuuuauuuccaaauaaauuugcauuguauaaaugcaguacauuuucuuuaauuccauaagguuuugauacugcuaauuugagaaaaauauugauguuuccuuaaauaagucuaauuuguauugaaauucauccccucacuugaaauggaaugaucuugaaaacaauaaaaaugaauguuaauuugcuaugucauugauaaaagcaauuccuuuuauauccuuguccuuauccauuagacuucauuuuacagaaaagguagcuaucaggcaggucugaccuuuuugccaccuaaggacauuagcuauuagagcucaagcucccuagccggauggccuggguccauaucuuaggcccaccacuugccaacuggguguccuugagcccuuguuuaaccucucugagcuucaguuuucucguguguaaaacaaggauaauacaaguaucgacuccauagaguugcuaagaggaugaaauacgaaaaucuacauaaagaucuuaguucagugccuggccauaguaaucuaauuuaaaaaaaaaaaguaaggucucuuuuaacuugcuuucaauuuuuaugugcagauagaucauggaccugaaauuuuagguccuaaagaggcccaagcauccugguuuaagaacccauguuggaaaaauuagcugggugcaguggcgcaugccuguagucccagcuacuugggaggcugagacaggagaaucgcuugaacccaggaggcggagguugcagugagccaagauugcgccacugcacuccagccuggaugacagagcgagacucugucucaaaaaaaaaagaacccauguuggauacagauacuugacuuuuaaaugcagacucaguaucauuuacuuagcguucccuaugauaaaugagauguuuagggaaaauguuggguuuuuuuagaccacuggaaauugacuucagcauguguauuagagaauguaacuaccccauucaccuuguccuguccaguacuuucacuaaaagcaagguauugugaccaauaauaaaaucauagcuaaaauaaucacuaacaugucauuagugcuuaauauguaccagaaagugcccuguguguuuucauguauuaucucauuuaauccucacaacuaaccaaugagguaaguucucuuacuauccccauuuuuagaugagaaaacugugguauaaagagccaggaaagugcuaagucaagauauaaauauaguauguaacaauauacuauauuuacuauauguauuauaacauauacuauaauaauauauuuuuguuauaauauauaguauauuauauuauauguuauaauaauauaauauagauauauaaauauaaauauauauuauuguuauauaauauauauuaugguaauuaguaauaauaauaauaacacagcaucauuauucaaucccugugaccugccaaaugcagcucuagaugccuucccagugacaucucuuguguugacaacaaucuuuuacuauucuuauuuaauggaugaggaaacugagaacuuaaaugaguuacuuaagaugagcuauagcucugacugguuccaaagccagccacuccagaauuacucuucuacagagggcagggaaaacagcucauuaggucccugaagugcucuacccaggucacagaauguuggagaggaauaggacuucagaaugaucagauccaagcccucacuuuacagauguggaaagggaggcccagagaaaagagacuugcauaaggcagugggagagccagaacuaaaaccugggucucccaguugacaugauguagccaucucauguugagucagcuaucucaggcacugugaaagcaggaagggaaagcugacagcuucagagugaugacagcagacuguccucccucucucugcucccugcugacccugggacugcugcauaugcuuccuggcccacucagaguagcagcaacaugacuugagaagaggcucuucaggagagaacccacaaugaagacaggaagcacccaugcccuuacaugaucuaccuagggcccauuuccaauggaaucccccugaaauagaauuaaagaucaauggagauggaggguugccucagacacaugugggucucuuuuguagacauacaacacaaccuaaaucuuugagaacaugaucugacucaacaaauuaccugcauuuuuucugauuaaauguacauccaucuuaguuuguauacuggauaaaaauaaaccaacucguacagaaaguuuuuuaaaaauagaguuuugggguguuuaauuaaaaaugcuuucaguauuauguaauccuugaaauacaacaguuguuuacucugcuuugauuucuaagcuuuccuuugaugacagauauuaauauuuaucauuuuucugauguuggacuaaugagaaucuuaaguguuuaugagaagccauuuaaauauuacaguacugcagauauguuuguuuucugauuuauauuccugucuuuaacaucaaccaggauuuauuuuuuugugcugaauccuggguuguuguucaucaacauuuucaguaaacuuuaaauagccagaacugaugauuucuacauuuauuugauggucaaagugaauaugaaacuucaccaaauaacauaguacuaugggaaagguuuaguuaugauuuauaaaguaaaaacuggaaugcauguauaacugcuagccaggaauagaguaacauuccagguuuaaugacacugaucucaggucauacguauugagugcugaguauguaucaggcacuguguagaacauaauugaaaucaaugauuucacuugauucuuacaacagcucuaagagcuagguaguauuaucaucuccauuuuacaggaaagcgaagcucagagagguugagcacuucacucaagaugacacagcaaaugagaggcaaagccagaagugaguccucagggucagauaaugggcucuuauuuauaauuccucucucaagggucccucugugacuccccaguauuugaaaaaucuuauucucuacaaaguauaaauaacccaucugcacagagcaacagucuucagacaacccagacuuucagaucuugauggcuaugaugagucacaccucauuuuguuuaucauaggccaugcauuguucuaugcauggagacagcaauaaacagcaccaacaauugucccugcccucauagugcuaucuuucuagagagggaagauagauaauauuaacacaauaaacaaagcauuaucaccauuauggggaggaaacgggaggcuaugcaaauucagagaaauaguaaaaggggaugaagucugcaguuucuguagauuucacuugcauauacuccccaugcagccaagacucagcuaaccagagaaaugacuuacaaucaguaacagaagauggcccagaaguagugugguacagugcaaaaucuaacacugaauucucaguuagggaccugacauaaaucacucacccugcauaaggaccaggugcaggggagacagccaucagcaaaauagccacuaccgcugcccuucauagagcuuacaguccaaagggaagagaagcauugauuuaaaaucaaagguuaaauaaaagcuguaaaaaguauaagaaggaagcaaaagacacaggagcuaaccuauaggagacuaagaaaggucaacauucugccaauugcacugucugugacccacaccaagucauuuuuccucuuuacagccaguuuuucaaauaugcaaauaaaggagaguagacuagaugaauccaaccagcuucuuucaagcucuuuuuaaaaaucucuugaagccaugauucuaacauauaaaaauuauguaucuccucuucuuuccaccaauuaaaagaucccaaacugucagucccuuucauuguauucaucugccucacuacugcuagggcuuuguucuugauuuucacugccauuuggcagagaagucaaaucaggagggauauggaugugauaccgcauuagggggcagaaguggguaucgcagaugcucugaucagaaccuagugaaggaaaugagaaggaauuggguuauacaaauggaaccuaggguccagagaguguauuaacagguaacaaauuagccuguggagauaguaggcauuagggaagcaucagccaggacuguaacucauguucuggccaaagggaggggaaaaaaaaagucuagaaguaguggagaagcagaugaguggaagagaggucuagacagcaaacagcauggauccaaccacaauacugagauccagggacaggagcauuacccaugggaaaaaaauccaaauuccauacuuugacuucaaggcccuguauggccugggcccuaucuauacagccaauuucaucugaugucagucucccuuucccucucuaugguucagccacaggggccuucuuuucucccuuugaugguguuaagcucuuucccaccuuaaggccuugguauaggcuauuccuucugccugggaccccauucuauuaauaccagcucuucauauggccagcucccucucauccuuuacuuaggucucugcuuaauucucagcucuuucugucuggccauuuuaucucaauagguuacucaucccucuuucuaucacaguaucuuauaaucuuccuucuuguacuugacauauuauuauuacagguguuugccuauguguuaucuguccccuucacuagacuccaugagggcagugcugauauuuuauauagaucaucccauuuaauucauaacaaucuacgaaguggguacuauuauguccauuuuacaaagagaaauaaaacugcaaagaaaaacaacuggccauauauauauauauauauauauacacaaauucuaaacaauacuacucauuacauuaaaacagaauggcaacuuaguagaagccacaaaaaucugaaaucuuuuuauuucaaguguagcccauggaccagcaacauauauaucaccuggcagcuuguuggaaaugcaaacacuucuggccucaccagggcccuugcauauaguuccagcaguccucaacccacaggaguuggacccagcuguuccaucugcaacaggaagccaaacacagcuaacaccucuaggccagggaaaccuuggccuguugccuuguggaaguucaagaggcuagaggaagccuuaguuuagaggaagcuuuaucccugcucagaggagccaagagagggccucagcuguagauuuuucugaagcuucuuggccuuguuuuuauccaccaggcuggcagaacccagcaaaugggauuucaaacuacaguggcuaccuguuuugcuguaucccuagugucacaucccucuucugaagguaucagcagcucucguuaaccagggccuuucuguguguacagcccugcaagcuuugcacagcacaacuccagcaggcaccagucacauauacucugguaugaaugguggccucugaugcuaagaauguggcagcccuggcccacuuccucugggugaaucucuccucucccagggugggcauuugcuccacaccuggccacucacaguaccccuccaacuggcuauagaaacaauuccaagugguaggcauauggcccaagcuagaacuccuucaaucugcuguaaauuuugagguauuaugggcaaauagauauauuucagcccauacaauugagucucucuaaacuugauggaaaaaaucugggaucuuuaagguaacauguuauaucugauuauuaagaugggaauuuaagguaccuugccuucuaauggaaauuuauguagccaauuacagugcccccuucuuuacauaauuuuaacccauugggauugcuuucuaaccagugguucuuggcccuggcuacaaguuagaaucacuagagcaugucucguccagaucaauuaaauugggaaagguugguggcacaggccuugguaccucaauuucagcugcgcuagacucugacuacucaucuauguaaggcgucccaaaguggcauauggugugcuacauagucuaugcuuccaggcaggccaacaaagugguagacuacauccagugaaaaucagaccugccacuuucugaugauguaguaacugacaggcagagacuaauuuuacuuacacaaguggcuguaaaacaaaauauuccccucucucuccaccccaccauuuuuuguuguucuaccucucccacacucucugcauuuguuuuaccucccucuugccucuccugcucucccuuggauuucuugccagggucauuccuagaagagauugaacuggaaucgcuagugcuccaggacugaaacaaucuuacucuaagcagguuccaacccuucccuccaccuguccucagggcuccaaacgcauagguaaacuugugcuucugggcacagcuuaaacaucuacugacaaaaccaagcagguaccguccuucaguuaauguggaguccaaaggcagcagugaguuuuguguuuugcuuuguuuuuucaaaacuaagaugugggaagaagacuucucagaaaauaaaaaucuuguucuuaccacauuccacagacuucagugauuaaaugacuguagauuguaugcuccuccagccuggucuaacuaaaauauucaugcauuaaaccuugugagggaguacugauacuucaacauuaucuaugaugguuucuaacuccaguagcugugagucugagaaacugcaaaauauacugaauuuuaauaggauucugauuguuaagaaaaagagguaaauccauaacaaagaacacuaauaaacacuuaaaaagacucagcaagagucuuuaaguuacagaauccugaaaauguguaucuuuugugaacuucucaagcaguuucucaauuuucucuucuauucccacuuauucaucauuaaaagaaaacacuggcauacaaacaaaauaccccuaaaauaagugauuuuuaacugcaguuaacacucuggcaaaaacacucuuuuucccacccuuucucuuuuucucuguauggagugaacagaccagaaaaguaaggccacuacauugugaaauaaccuccuggugggcagaaagguucaggaaaugcugaaaaaugaaauuacggugcuggguaauauauauucaaaccaagaauguuccuggaccguugauauaaggguuuaaauauaaauauaaauacucaaauauaacuguaugcauuuucuaugagucagaaaaacaacuuuccaaaggaaagggucugaaaggggaucagaauaugcuaccccaaaauaugccacuuuggcauaaggguuauuugaguugaaggcaauuaagaacagcagauucagaaaaaacaacaacaaaaaaaaaaacaccucugcccuccuccaucuagcuaaaagcagggcacagauuuuccuuuguaaaggugacauauuuucuauaaauaaagguuuuccccuuucccuaccagagagacuucuuaccugcauaaacaaaccuuacuaaacaaccuucauuuaccauacauuuuccuagucauuuuuucacaguuuaucccccuaccccagaagcccaaauccccuuguccuuuuguaaccacccaacagguucauuuugccugcugcccagaugguuuauccagagagaggaauugcaacagagaaagaauuuaauucaugcagagccggcugaacaggagaccagaguuuuauuauuacugagaucagucucccuggaacauuucagagacugggauuuuuuaaggauaauuugguggguagcgggccaggcaguggggagugcugaucggucgaauuggagaugaaaucacagggagucaaagcuguccuccugugcugagucaguuccugcauggaggcacaagaccaaaugagccaguuuaucaaccuggguggugcuaucugauccaucuagugcaagguuggaaaaauaucuccagcaccaaccuuagguuuugauguuaucccuaggagcaacuggggagguuuagaaucuuguggccucuaguugcaugacuccuaaaccauaauuucuaaacuuguggcuaauuuguuaguccuaggggguuugggaaaggguuguuaucaucuuuguuccaaaguuacacuauaaacuaagauccucccaaaguuagucuggccuacgcacaggaaugaacgaggacagcuuggagguuagaggcaaguuagaugcgguuaggucagaucucuuucaccgucauaauuuuugcaaaggagguuucacuuugucuaguuucuucuccacauaauauauaagcccccagaccuaaccaccucuuuagggucuucacuucuuuucuaugaaggccucuguaugcauauguaauaaaugauuucuccucuuaaucugucuuuugucaguuuacuuuucagugccccaggagcagaaccuaagaaaguagagaaaggauuguuuuucuuuuuuccucccucacaaucaccacauauauggauuaucaagaaaauuaaagguauguaaucaaauuagcuuaauuauucuucugcuuugacagaggauggggguaggaagaaaacuuuauaauaggcagccuuucuagaagugguucauuucaaugguucauuucaagcuacucaauuagaauguaagaauauuaccaguaaaaaugagugguauuuuaucugaacaacuguuuaaacccuuucaauaacacugccauagaucaugaaagcaugucacugaguuucuuuggaacacaguuuuaaugggauuauagccccccacuccacccccagcuaugaggaaugaggcaaacuaaguacaggacgagaaacacaaccugaaauucaauauaaggaaaacccuuagacaagcacagcaagagauacaaggaggguaggggagaaagagugucccugguaguuaaucucaaagauaacuagugcaaaauuuauaguuaguucaucaaauuccaugacagcuuugugaugacgcuuuucuuucauucccaaagccuucaaaaugcuacuuucuagauauuucauuccccacucagaccuuuuaccuauuggauuauaccugauucauuccacgaugcuguguuauuagaaucagugguuuucaauguuaaaugcacuuuagaaucagcugcgaaucauuccacaaugcuguguuauuagaaucagugguuuucaaucuuagaugcacuuuagaaucagcugggaaauguaaaaaauaaacaaacaaaagaaaucacacaaacaaaaaaaacaccugcuccccuccccacucuuucgguuaucuggaugggaccagccccaggugauucuaacuuacagccaagccugagagccacuaguuggaaagcaauccaaacaaauuaaaauuacauaaugaaggaauaaacuuacauuaggaggccagguaccucgaauucccauccuaauaaucagauauaauguguuaauuuaaggaucccagauuuuguccaucaaauuuagaaagacucaauugcaugggaugaaauauaucuauuugcccaugaugggguucaggacauacuacccugaaauauuguaagcugaaugaauuugagaagacagcagaagccagaaggucagaggucacucucugaccuuccuucugcccucucugaagcaggucauaaaaccuaggaagaauuaucuggccuucuccugaagcaggucuaagacccuccugugaaagguuucucacuucccauaccuggaaugaaagaacauccuuaucucugaaaacaaaggguuacagagaaucugaacaaacaggucuugcuauguuuccucccauuguuagcucauguuuucuuauucaaucauacuucuacacaacuauguacuucuucaucaaaucuagcauaaaaaauacacagguuuaccaguuuugggggucuucauuccauuaugaagaauccugugucacauaaaacuuacguuaaauaaaucugugugcuuuucucucguuaaucugucuuuuguuacaggggagucaaccaagaaccugagggugaggaaaagauacuucuccuccccgaccccauaauacgccaacuuuuacagaggauugaagaaauuccaaacaucauaucauagagguaagcaaaaacaguagaauuaaagguuaucuaaguccucuuaguauucaaaauaugauaaacaaggaaacagagcaggaugcaucaacuuguguuuuuuauugacaaugauaagaauaaaaucauuagcuaccauuuauggaguaccaguuacuguguuaagcauuucaauggguuaccucacugaaaacuaaaaacaucccucugcaauagaaauuaucgcccccauuucacaaaucaggaaauugaggcucagagagauuuggacacuuuccccagagucacacacauagaaaguagcagaaccaagauuaaaguccaggucuuuugcucuaucgaguccauucucuuaacuacaucaucugucaccuagaccacugaagaguauccuaaguacuugcuacucaaaggacgauccauggaccagcagcaucagucuguuagaaauacugacucucugauccuuuccaggucuuuaauuuaaucagaaucugcauuuuaagaucagcaggagacuuguaugcacauuaaaauuaaagaagcacaaacauacaugcuuaucccacaucaacuauuaccucagauaaauucauuauccauaaugcauccauacuuuuuaaaaccugauuuacuugacaaauaaaaauuguauauguuuaugguauacaacaugauguuuugaaauauguaucccauguggaauggcuacaucaagcuaauuaauaugcacuaccucaaauacguauuuauuuguggugagaaugucagagguguuugaaccagagcaacuccaucuucaauaggggcugaguaaaauaaggcugagaucuacuaggcugcauucccaggagguuaaggcauucuuagucacaagauaagauagaagguuggcacaagauauggguaauaaagaccuugcugauaaaacagguugcaguagagaaguuggcuaaaaccccccaaaaccaaaauggccacaagagugaccucuggucguccucacugcuauacucccuccagcgccaugacaguuuaaaaaugccauggcaaugucagaaaguuacccuauauggucuaaaaagaggagucacgaauaauccaugccuuguuuagcauaucaucaagaaauaaccauaaaaaugagaaaccagccacccucaggacugcuccgucuauggaguagccauccuuuuauuccuuuacuuucuuaauaaacuugcuuucacuuuacucuguggacuugcccugaauucuuucuugcauaagacccaagaacccucucuuggggucuggaucaagaccccuuucugggaacaagaacacuuaaagucuacacucuaaguaaucuucaauaauacaauacauagcuauacauccauacuuuuaugaaaacaaauccaacaauuucauuuccccauuuaaggccauuaaacaauuucccaaaugcccucggaauaaggucgaaaugcagguaaccggacucugcauaguauuacucaggcucaccauucucagcaaacuaacacaggaacagaaaagcaaacaccacacguucucacucauaagugggaguugaacaaugagaacgcauggacacagggaggggaacaucacacaccggggccuguugugggguagagggggaaggggagggagagcauuaggacaaauaccuaaugcaugcagggcuuaaaaccuagaugacagauugacaggugcagcaaaccaccacggcacauguauaccuauuaacaaaccuguacauucuguacauguaucccagaacuuaaaguaaaauuuuaaaaaaauuuaaaaaaagaaaaacauaucuauuacucaggcucaccucugcagccuuauucucuccaccuccuccagccauugauuuucauacccuaagcacacagaccuucuuucugcucaucaaaucccaacauccccucccucccucccuccuguccuccauuguacuagguucuucccugccgagaauauacccucacucaccccaucagugccucccuaccagccccauuuacugcucucaccagagcagaugcagugccuggaacagagcuaggagcaagauaaaugugcugaauaaaaauauguuuaggauacugagggccuccgcuguuuccuuuguccuucuccucugcuguugcugugauccucauuccuguugcuccuucccuguucccugcaucacuucuuuucaguaacucaccuccuuaucguaaccucauggcuauugaaguugucagcuuuagaaagaagcacugccacauccccacggucauugccccaggauuacucaccagcuggaugacaacugccucacucuaacccugagccuccugggauaggaccaauccuuucuagagauggacagaaggccccacugacagaaacaggcugcuuuuaaaucaaggauuuaauauauagguggaaccauagaucaggggccucucagcaggcaguaccgagccaaaagcuucacugucucucugcccacacaagagagugucacugugcugacaagacagguuaucaagaguugugaggaacuucauauuuuaaaugugaugaccaagugugcuacucuaagaaaacaaguggcaaacaaauccuuuuauaauauaaauaccugcuuaaaguuuuaaaucuugaggaaaugugaauuuucauauaucaggcuuacaauaacaaaaauaagagcuauuauauuuaucuauugacugcaagcuguuaagagccugacaacaugcucaaagcuuuaaacacacuuucuucuucaucaucacugugagguagaaaugcuuauuaucccuauuuuaagagagaaaaccaagggcuaaguaaccugucuaaaaggcacagcugggaauuaaaucauggguccccagacaaccccucuacugcuucucugcuaugucuuacuauauagaucacuuucucaucugagaagucacagauauggacauucccaaagagacaaccccuuggagaaugaucucaaaggcugagauuuuucucugcaauguacauguugaaagcaaaguaaccuccuacaucuuauauuucaaagcugcacuucugcauuaaaagaguaaacagauucaaugaagagaugugggaacagggugcuuaugaaugcaaugccacaaguacuuuuucagugucuacugguggucaggcacugugguggaagcugaaugaucagacuaucaguugggagagcgugggggugggggcaugggggugaugaggagaacuucucaaauagacuguuucaggaauguuuagccaauaauucauaaaacuguuacuuuauuaccuaacuauauggaaaucaucuuucagaagagaccagaguuaccugccuuauuaucugugaauacauaauugaaagggccaauaugucuuccaaaaugaaagucacaacuugauagauuucugagaguucauauuagagggucagauuuuaacaugugaaugcaaacauagugucagaauuuguucucaagugucugaaagaacaaaagagaaaagaguaaugggagccaaaaccagacuaacuuccaaaauagaaacagagcauguugaaguugcauaaacacacaaauaaagauggggacacaaaaacauuuccuaaagcauucuaucaaaggcugcaggaaaaaggccaagacaaggauaccaaauagaaaagcauaagccuaaaaagguuauccacacuacugugaggacuccagaaaccugccuucuugcagaaacgggauacuuuugacaugagggcaugagaugaagauugcagacuacuucguaacacacucuccucauuuauaaaauaagaguuagauuagauuauuuauaagguccuuccagucugaaugcauuaaguccuuaucaucuaugugguccuugcaccuuaagagagaugaccauauaaagaagcucaaaaaacauuuguugaauucaugaaguauuacaaccuuaccaauaauaaauaagauaauuuauaacaauugguccuggucuguggccuugaaagagcaaauuagaggagaaaccauuaucuaaagagcuacacaucugguguuccugcuagcugacugcugguggaaugaaaauaacccuggacuugaaaauaagaugcuugguucuagucuaaucucugacacaaaccaacugugugaccuugggcaaacugcuuuaccaccugggccaguuuccuaaucucuaaaauaaagguauucuaaaacuauauacauauauauauggaaucuuuauuauaggccaagaaguguuccaagaucuuugcauuagaauuaaaugaucucaaagguuuuugcagcucaaauguuuaguaucuaaguacagaggcagcaugguauaauuaaaagauuccaaauucuguagccagaaagguuggacuccuccucagcucuguaagguaaggucuuucucuaagcagagacuguuaagcagaagggcuuacagucucaguccuuuuauucaccaguguuuuaacuugaacaaguuacuuaacuuuccuagccuuaguuuucuaaucuguaaaguugauauaaaaaugguucucacucucauauagcuuuuaagaggauuaaauuauaacacauauauuuuauugaauauauauuauauugcuagcuguguaaucaugggcuaucuucucaaguuuuuucucauauacaaaugggaaauguaguauuaaaaagagaucaugugaacagguucuaaauggucaaguguuagugguuuuggaagcauguacguuaauacuuggaacaccguauacaacaaucccauaucuaacacuuagaacagcauaugcaaucaauaacaacacacacacacacacacacacacacacacacacacacacacacacacacacacacaaacccuagacuucuuucuuuacuaaauauuucuaguccagguugcagcagguggacacaggccggcagccaugaacgcagguccacaugggaguuguaguuccgagucaagcggcugcucuacagaacggcuagaagcgagacuucgucucccaggagacaucucgccgugcaaaauggcacgccacgagguggaguaccugcccgacgagaaacaagaggcgggacugcaacucccagaagccuccgcggccaaggccucaggccgcaggcugaagccaaggagggagaguucagguagauccggcuuaacaucaggugcgaguagggaccacccuugguagucugggcccggcccaggucagaaccuuacuaaaacaaccacugugaguauuuucuauuggucccagcacauuucugagagaccagaauaauaauagcaguaaaucugcaagugguaaacuuucacaagcauaaccucaauuuagauuucggcuucaggcaacauccuuuggccacuugaccugggagcauugagcuccuuguuucccagauaagcgcugugaguggcuguuccaagguaacacagcgagggcagaaugugagccuacagagaaaucugcagaugcaucucaaguuccacuaaccugccuccuuaccccccaccaccaccaacuuggauauaccuuuaaaauuccccccuuugacgcuaaaaauaaaaacaacaaccauaaaauaaguguaagaaaguccgaccaaguaccgaugaguucucccacaacaauaaauucgaugccucuuugccuguuuuugaaguaguaauguaaaauuaucucccaaaaugcugccuucucuauacuccgguuugcuccuguccugggcacguguucagcaaccccuuaggggaauccagagcugcguguuuaacacagaccuguugggacggauuuucgcuacuugucuaugaaacugacgaaccaucccaaaacggcgggugccgacuacacccccagagccaagagcuguggcguccccggacccgcuggcguggccccgugccucaguuuccccaauguauaaacacgguggaggaggaacggguuagggcuagggucggugcuugggaauuggggggcccgaguccccacccugagacccucguggggcggaagaguacucgggacagaagcccaccgccccgugagcggcgccggccccacugggcuccggggugaugaccugacgcgcguggaaacccagacccgcgccccagaaacaguauuccacuugggcuugccuccccgccccuaccuuccaggauguugacagcugggaaugaaaggcagagggagggagcgcggggccggagcgccgccugggagugugcccacuggguggccgccugagggacccgggaacagagggcaaaaaguccugugaccggacagagcagagcggggacugcaauuc

SEQ ID NO: 192462 - RNA, 30052 nt, Homo sapiens
gcggccgcgggcgccgccgccuccuccuccauggcuguuuacccggcugcauugugggaguuugaccuccgccgccgccaaccgccgccucagcuugcgccgccgccgccgccgccgccgccgcgcacgccaugggagccgugacugacggugaggccccgcucgccgccacacgcgcccgcugcacggcccgcugggccuccccugagaccccuggccucccggcccgcuuccgggaaccccucggccuccccggccucuucgccagagcgcuucggccuucccgaccucuccccggagccccgggccuccccggcugcuucccugaguccuuccuccucucgccagagcccgagcgccccucggagacccucggcuuuccccguccgcucucccggaggcagcgcggggcuauagggugugccgggagcguggucggugggcugggaacacacguggguggccgagacggcuagaagcggugcaagggcgggugggaccagagggaguccggguuugucuaggggcgcggugaggacccaggagccgcgaaggguggacaguggugccgggcuuagggcugggggccuggaagguuuguggaggucugggagggagugggagcuccagggacggggcgggaauuucgggacucgucuacaaggggugucaggauacagagcgugacaccaggagggguccuggggcauauugggaagcacucacagacaguggagucgauggcaaugaggccuugaacugcgaguggauugugggugagaaggaggagcagggaauuauuuauaaaaggaauagauagggaugagguauccggagggugaucaggaaguguaccugggagauuuacggggguaaggaggagccaguauagugaugagaccgucuaggguagaucaggacgauaaaagauguauguguguguguuaggaagggugguugucagcugggaugaauuuagaggggcaaaggcuggguuuguggacagucuaagggagauggucuauggacugagagcggaaauaaggugacacuuugggggaaggggcaugauuggcaacuggagggagaaccuacaagguaucugguuagggaggaaggagguccuuugauaucugggaaggggauaucuagggcucuuggguguuuuucaggagauggugaccgguaacuguaaaugccuguggagaggccacuucuuaagaguugaagaccaccagggucuccacauuaaagggccuggccaugggaagaacagugauaggcccaaauuuccagacugauaaagaguaguggaggugggaggcuacuaaagacccaggaacuucauguggaauuucagcuuugcuucauuccaguuucauuuauuuaguggauauuuauccuuccuggacuaggcuuugggauuacaacccagaacuaacaagcaagaacuuuucccucuccaaaauuuuggucugaagggaaagaaacauugacuaaugaguuuuaagagugacaaauauuaccacaaggaaguacaagguugggaacuguaggaacauguaacaaagauuauuuauccaaucaauggaaaugagaaagccuccucgaaguuaaucccauuuuugaagaauaaauagauauuggacugguguucuggguugguagccacuuguauaaagaccccaagauguuggaagaacucaaagcugacaaguauugcuagaauuuagaaaguuaugagccagagaucucuaagggcaauaggaauccauuaaaaguuuuaacacuggugugguguuaaucagauuggcauuaaaacacacacacaugccgggcacaguggcucacgccuguaaucccaacacuuugggaggccaaggcaggcggaccucuugagcucagaaguucaagaccagccuggaaaacauagugagaccccaugucuacaaauacaaaaaaauuggucuggcacaguggcacacaccuguagucccaggacuugggagucugaggagaaaggaucacuugagccugggagguugaggcugcagugagccaagaucgcgccagugcacuccagucugggugacagagugagaccgugucucauuaaaaaaaaaaaaaacacacacacacauacacacugucucuguuaugugcagaaugauuagaggaagagaaaaugaggagcuaaguuuccucgccacuuacuaacguuuacguagugcuguuagguauuauucuaauuguuauccccauuuuacagaugaaacagacacagguuagcuugccuaaggucgcacagauaguaguuauagagggucaaaggcagggagaccaccugccgaguuccugcucuucacuauuaugcguccugugucugcuacuucugcaguggcccuggugagagacaaugaggacugugaccaagagggaaugcaaagaggacaggugggagggaaauagggaaauuugugagguagaaugucaggacuucagguauugaauggauggugggagaagggauuuaggaugaucccagguuuuugacuucacugugugccuguuagugcuacuuuucuauuuauugagauugagauguccaaaggagcaacaggcuuugucagaugggagauagggacagaagaugaguucuaaaguaaugacugcagucaagugcccccccacauccuuaaaagccacaggaaucucuacccugccacuuacagacugucucagcuucagucucugaacggagauaauaauaaaauccacaucagcggauuguuuugaggauuaaacacaaaaaguuguaaagggcuuugcauugaguccaacacauaauaauuaauauucaguaaauauuaaugucagaguuguuuuacuaaucugucuuccacuuuccuuugauguggacuuugccuucucucuuaaucugcacagguugccuuuuccugccuuuucuaucaggugacacuccacuuauuccucaagacccaccucaaaaauccccucuuuucuuuccuagaaguaguugaccuucugccuacuagccauauuauuuuaugcauauugcugcugucacccuuaauacguuauuuauaugccuuaugcuagaaaacauuuaaggcaguucacuguaaugagaaaauauaaaaauuaaacggauuagaaaacaagacaaaaagaacauugagauuaggaaaaauaaagggaagucagaaguggggugauccucaaaaugcaggaggauaaagucuaguacauuaauuaaccaagcuguaagugaccuguuucuccaguaggccauucugagaggcaggaccucgucugcucugugaucuaguguucaugagagaaggcaaucuuagaugcccaggaaaagcacuuuuuuuuucugauuugaacuagaggaaaaguuuaucauugaggucuuuauaaaugaaagccagugucauauccuuaaccucuuuucagcacugaagaucauagagcuguuuuguagcacaucccuugcuagguaaaagaaggcuaaaucacaauuuagaaagacauucuaaagccaguagaggcugggugugguagcucacaccuguaaucaaucuuagcacuuugggaugcuaaggcaggaggaucacgugagcccaggaguuugcgaccauccuaagcaacacagcaagacaugaucuauacuacagaauuuuucaaauuagccaggcgugugugguggugugcaccuguagucucagcuacucaucucuacuaaaaauuuucuuaaauuagccagguggaguggaacacaccuguagguagucccagcuacucaggaggcugaggcaggaggaucacuugagcccaggaguuugagguugcaacgagccaugauugcaccacugcacuccagccugucaacagugcuagacccugucuaaaaauaaauaaauaaaaucaauggacaaugugguuuagguggguaguggguagcucugcugaucuggcuugauucaaaucaggguuuuuugauugaauaucuagaccauagaggaaagacaaacuacaacuucuucagacaauccucuauaaacaugguuuuugucagcugagcuuuugaaaaaaucaagcugaaaugagugguaugugugauccgucaacaaguauuuauugcauaccuucuaggcacaaugcgagguccuggcuacuuugcagugaacuagacagaggagggcccuggccccugcuuuggggaaagaagccauagugugcaaucaaauaaguaaauaagauaauuucugaaaaggaauguaauuaaguucugagaaugaacuugauggaaugaggacagagaguaaugggggagggcagugauaccugacagguucaaccacaugaagagcccaggaaaguauuccagauagagacaacaacuagugcaaaggcccgaggugaaaacaagcucugcacccuuuagaggaaauaaggaaagccacugggcuggaucuagggacaggacugcauccaggugggccaagaggaguacgaugcaaaaggagguaaaagggagcucaggaggagccuugcaggcuuuggaaaggagacugaauuguccuuugugggcauuuagaaaugauaggaggauuguaagcaggagaguuagugauccaauucaucuuuuagaucauucugaguugcauaaaaaauggauucuaggaaggcaagaauggaaacagggaguccaaugcaaaauauuccagaugagagaaaugugggcuuggauuagagcgauguuaguguggaagauagaaguggaugcucuugauaucucauucauccuccuggaaagcucuuggaggaguaccaguaccuguccauggagcuuacauaagagccaaugucuuuuacaaauuugaugugccuguaucacugucccuucauguaauccauuccucugggucugcguauccaguuggacugggagcucuugaagaagcagcccuuuauuuccugcacucaguuugaggaacugcccugcuuuagaguagcuauagcuacuagacuggauauuuucaccacuacugucauguuauaagugaaaaaguagaggucuuuggaaguuagugacuugcagucacacagguaguuugugacaaagccauuuucucuccuucccuuguugccaacucuagcagucuggcuagcugaaaaacaguguggauguugucacuguuaauuuaaacuauguuaacuguauuuuguauguguuaauuuaaaggaugcuaaauauuguuaguacccugauagaaaucauuucagaagcacuuuuugcacuacagagaacauuaggugauauauugauaugccagagcaacagaugagagauggagaaagggguugggguggaauguggcucuacauucuauuuaauaaagcuugcugguuuugacgguagcuuuuuuuuuuaacuuagaaaaauguaaugcaugaauauguacuuguugcaaugugaaauaaugguuuuuaauaugccuacgaauaauaugacagaauaauggagcugcauuaugacuuucuaauaauguaauuguauauauuuuucugugaaugcagaggugaguaguaacucaucugugaaaggaagauaauaguacacacuuuguagaguuguuucaaggaugaaacaugauaauauauguaaagcacuuugaaguugagugaccauuuaauuuauuguguaaaccaggacacuuuucagagugaaaagaaacaaauggguuguguggucaccaacuagggugguauaaaugcugugcaaguguuugcugcugcuguuauuccuauuucaauugcugauccaauguuaauuagacauuugugggcacaggguucuuuuguuuuuggguuuuuuuuucauuagugccauugcauuugcccacuuucuuccaucuucuguggccccaacacagggauaacugcugcaguucaacuaugaaaugauguuucuuuagccaagauaauugguuuuucaaagcaagauggacauuucaccuugacuuuauuagcacuauacuacucuaaacauuuaaauagagagaaaagacaaaggaccucaacaugauguuuugcauuuauuuuccuuuuaaaauuuuaaauuuaauuuuggugcacguaauuuaccuuggcaucagcaauuuauguagaccagucagaaguaucuuaggagagguuaauaucuacauggaggaaucaaaccaucuuauuguuccuuccacccaccuuuuaugugucuccuuaauauuguugaccuuaaaaauuguuuuaauggcuuugagcuuuuugaaaggagggaccagguguuauuuuaccauaaggaauguaacacaaugggcuaauaugugugauucaucuuaauaacaugagcugugguggucuaacgauaaaucuuacaggaaucugcaugaacauuuuuuuuacauggccuuagucucucuucuuguucauuuaaaguaggucaaaucaagccaguuuucuuuguuguuguuaacauaucauagcuuuauucaguaacggaguagaauuuuuaauacagagaaaaugaaguaccugagaaugauaaauaaguuuaccacccaguuaaccacuguuacuacuucauaaaaaaaguacuacaugucaguaaauucaagaagaaaugcacaauaugaaaaaugaaaaccuuccccucuuuaccuuccguaauaauuccucucccagaaugauuuuuaaugccucuaaaagguaaaaguaucuucucuggagccugacuccugaguuugaguuccauuucuauuccuuacuuccugugacauuuaauuuuuggcaagaugcuuuuucauugguaaaauagggauaagaauaucuauaaugaggccgggcaagguggcucacgccuguaaucccagcacuuggggaggccgaggcggguaggucacgaggucaggcguucaagaccauccuggcuaacacggugaaaccccgucucuacuaaaaauacaaaagaauuagcugggcgugguagcgggcgccuguagucccagcuacuugggaggcugaggcaguagaguggcaugaaccugggaggcggagcuugcagugagccgagauagcgccacgcacuccagccugggcaacagugcaagacucugucuaaaaaaaaaaaaaaucuauaaugcuguuguguagauuaaguguguuuauaugugaaaagcaucuaaagcaguccuuagcauauuuaaguguuacguaucugcuggcuaguauaccaguggguauauaugcuugaaaauuuuauacagucauuuacacacuggucuguauucaacuucuguguacccauaaaauuuuuuuuaagugauauaguaggugcguauauuuaugggguacaugagauauuuugauacaugcauacaaugcaaaauaaucacagcaggguagauaggauauccauugucuucaagcauuuaucauuuguuauaaacauucuaguuaugcucuuuuaguugguauaaaaugugcaauaaauuauuguugacuauaaucauccuauugugcuaucaaauacuagauccuauucacucuauguuuuuguacuaauuaagcauccccgccccuccccugccaccacacaccccacagcucuucccagccucucguaaccaucucuauuuucuaccuccaugaguucaguuguuucaauuuuuagcuuaucauggagcucuuuugaauauaaaucuaccuuauucuuuuauaucaguguguauagucuauuaauuuuuuagacagauccucuauuggcauuuaguuuguuuucaguuuuuuacucuuccaaacaguguuacaauggagauauuugcauagauauauucgcguacuugugggaauaauuucuaaaagauaagucaaaagguauaugugucuuuaauuuugguauaucuugcuguaaugccuuaguagcuagcuguuuuccccacuauaauccugucugaaauuguuaucccuuccuguggcuuucaguuugguaccuaccaaauuuuuugccaaacugcauuuagaaaggaaaugcuaauccucacugguagaucacaggauuacuaguucacaaaggcaggugagauugcagccuucccucaaagggaaccacauuugaccugcaauuuagccuuagcaaggaguuacauaacaaugaugcuauugccucugguugucaagccuugaccugucucugaaguuguuuuguaaucaagguuuuaauggcaaauauagggaaagaacaauuaugaauuuugaaaacguuagucuggguuuaugagaaacucccuuuuaugcuaaaaugagagcacagcuaaaauggcugugucaucugaccagaggccuagaaaucuagaguugcucuaguaacuguaaaggagucauuucuuccugccucuauguuuaugaaacauagaguuuuaagaucuaaggacuuuuugaggcuuauuuggugucuugaauaauuuuauauuucuucuggcuauauguuggcauauauguaucccauuuugcaaguaaauauuuacauuucagcauaaaugugucauuacugauuuuaaacugauuuugaaagauauuuuguaugugcaauuaugguauaacgaaauccaguaggaagucauaaguucuagaauugugauaauagucuacuguuaaaccaauccuguuuuuuuauguuuucagugguuaacauuuaggcauauuggauaugaggcauuuugaugagcaaauauguaucucaugccccugccucauagacaguauacucuagacaauguguggucauauuacucacuaauuaauacgugaaguuaauugcugccuccuuuucuuucuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucagcguuuuagccgggauggucucgaucuccugaccucgugauccgcccgccucggccucacaaagugcugggauuacaggcgugagccaccgcgcccggcccuccuuuucuugacucagauucacacuccacagucuuuccaggagcuagauggaugguauuauccagccauuguccuacaagccuaaagccagguggaaaaccaccauccucacagcaggugucaaguauuuugguuuagaaacucuuuccagaugauguucauccucauaguaaagaaaguaauuaugacaaggagugauguugauaacauaaaaaaaauaacaaaaaaucugcuaagccaucuuuacuguuuuuacaggauagaccaaagcccagcagaauuacuaauauaagcauucaaacugcuuacagaggguuucaagcaugauaauuugugaagucaacauguauaguaaacaaaacauauuuuaaguguguucauuauggagcuaauugauaagaugucauuaaaaauaauaaugcucauggcauuuguguuaggaacuaucagcagcaguccaucuuuaaauuuaaaaagaacagaggcuauucucaaacugagagcuuaccuuuuuguuuuauucuguuucuguuggagcugugcucuguacuuuauacauguuauuucaauaauucuuguccacagaguuuucuaggcagcaacucucugugcacaauuucagcuagaaacgccaugaccuucccaguaaauuugagacagaagcaaauuuguaaggaauccuaacugggcaaaacuugauaugcauaaaugccuaauauguaucuacauagauauaucuauagauaaaucuucaacauuuacucugacuuuuauaggaugauacaaguuguggauuaaauuuuuuuuuuuuuuuuuugagacggagucucgcuuugucacccagccuggagugcaguggcgcgaccuuggcucacugcaagcuccaccucccggguucacgccauucuccugccucagcuucccgaauagcugggacuacaggcgcccgccacuaugcccggcuaauuuuuuguauuuucaguacagacaggguuucaccgcguuagccaggauggucucgaucuccugaccucgugauccucccgccuuggccucccaaagugcugggauuacaggcgugagccauagugcccggccgugaauuaaauuuaacauaaacauaaggauaacauauuuuuuguuuucguacuauagacagacauugugcuccuuuguauacuuuuauuucccuuaaguuucccaauauuucuauaaaguagauaguuuuauucccauuuuacagaugaaaucagauguuggucuuacgugaauauacacacaugcacacacaguaaacauuggguccaguuuuuguuuuguuucguuuuucuggucuaggcaguuggcugugaggugugcuuagacuaaagagggagagggcugagugggaggagggccugugaaugccuggacagggaauucccugugcugccagaacuaguggugccacacuccuacuugugccaccccaauguuggcauuggccccuguuuuuuccuaaccaagucaucugcucaguccuaaccugccuucuaggaccugugauucuuuuuuuuuuuuuuuuuuucuuuuuugagacagagucucauucugccacccgggcuagagugcaguggcgagaucuaggcucacugcaaacuccaccuccuggauucaagcaauucuccugucucagccucccgaguagcugcgauuacaggugcgugccaccacgcccagcuaauuuuuguauuuuuaggagagacagggcuucaacauuuuggccagccuggucucaaacuccugaccucaagugaucugcccaccuugggcucucaaaaugcugggauuauaggcaugagccaucgugcccagccaggaccugugauucuaaucucuccuuuuuaguucaggccauguuagcuccuaacuguguaugcuuugguagccuccuaacuagccucccugccucugggcuuuucccaguuacaauccaguuuguacauccuccuaaaaauucuggcccaugaaucuuuagcaacucccaguuuccuaccagcaagauguacaaguauaguauuuacuggugugacucccaaaaucugacucccaacugcuuguauaucuuuggguccugcuauuugucuucacucauccagccucccuaguguucuacacacucaugccccagcuucagccuuucauuccccacccagccucugcuagagcacagcuuucucccugccuggggugagaagaaggaaaggacuucagcuuucuuuuuuaacaacagcuaacaaguuuugaguacauaugguucaaaaaucaaauacuauaaaaagauaaucuccaaucuuccagucuguuccccauccaccccacuuauacugccuucucucuugguguaaccccuuuuauuaguuuuuuguauauccuuccaggguaucuauacugcucagcacugcacuaguagggacuccuugugccccuuugacgggucucugucugggcuucuaggcuguccacagcauccuuugaaaucuaggcggaucucuuggaaggucagagaacaacuugcauucugcaugccugcagaauuagcgucauguagaugcuaccaaguuuuauggcuguaucuucccaaguaguaagucaagcugcacuugggccuucuugaaccacaacugggguggccgaggagcacugugccagaaugcagggagcagagacccaagguagcucugggcagcaaaccuauggagggcacccuaggucaguccuccaaaaccauucuacccgccuauaguucugggccugggucuguggugggagggacagacuugaagguuauuuuuuaguuuaaagaucucaauuggcuuuauucucgauucuagaauugggccagacaucauuccauaaaauagaauaaguguuccaauaagccgaggagcagaggcuggcuuuauauacagagaagggcuaaagaacguagaagcacagaacagacagcauauuagucauuucaaagcuacucuucuuguaaguuggggacagagaggccaacgauagaaaaauaacuaauuaguuaacaugagguuauuucagccuaccuuuuuuguagagaagcaaggacuaaaguagaaggaacuucauuauuauacccacggaagauuuaaacuggccucuuugggaaauuagcuguuauucucuucugaucucuuacaagguuggguaacgacuuagucuagguuuggugacauggaacuuuagcaugggugacuccauuuugauuuuuagucugguccauugggacauaguacaagaacuuaguccaaaacaauggccuccuguaauuuuuauuugacaguuuucccuuuuggucagguuguuauguaggugagaguguaaccaaaacuuaggucaucaguacuaucaguugccaucauucugaguuucuagucucagcauguguuuauagcuuauuguguccuccccauuauuauaaguuuguuugaguuuuuguuguuccagcuaaagacauaccauuugaugcuugacagauggcucucuggaaacauuuaaaacuuuuugagaagauacaguacaccagggagacuacuguugugauuagcagguggaaaacaugaagaguuuggagcuuucuccuuagccaggauucccaugagccaaaccaacuaaaaucaaauaacuagaugaggagucuacauguuuuaacaaaguaaucugcucuacaauacccaauguauuuaugugcaacaagaaauaucaguugcacagauggaucccuguuuaauuaauugauaucuagccucccaugacuaucuuaaauuaaagcagaggucaggugcaguggcucacgccuguaaucccaacacuuugggagucugagggaggugaauugcugaggucacgaguuuuugagaccagccuaaccaacauggugaaacuccaucucuauuaaaauacaaaauuuagcugggcguggugguaggcaccuguaaucccagcuacuagagaggcugaggcaggagaauugcuugaacccaggaggcagagguugcagugagccgagauugugccacuguacuccaggcugggcgacagagcgagacucgucucaaaaaaaaaaaaaaaaaaaaggaaagaaagaaagauaaauugcacagauugcuccuuguuuaguugguaaucuaguaucccaugacuaucuuaaauuaaagcagaggccaggcauggugacucacgcuuguaaucccagcacuuugggaggccaagguggguggaucauuugaggucaggaguuugagaccagccuggccaaaauggugaaacccugacucuccuaaaaauagaaaaauuagcuggguguggugguacgugccuauaaucccagcuacuugugaggcugagacaggguuauugcuugaacccgggaggcagagguugcagugagccgagaucacaccaccgcacucuagccugggcaaugggagugaaacuccaucucuaaguaaauaaauaaauaaaagccggcagucccaaauuacuucuaggaauuacugauugugaaacuguauagcauuaucuagucaagggaaagaaguaggcauaaauaaggaauaauuaagaggaguaagagucuucuuaugauggggagucuuauuccaauggucuugggaaaaguuguccccagcaugaagucaacaacuucucauccugauuugcaguuugauugucucuggugugacaucaggcauucuggugaauucucuauguggcacauguaucagguaugagauaucucccuugaaauuuacaucgaguuguccagcuuuugcuuauagggcuugagaaacagccguuuuuguuauuugagagucuuagccagauauuagagaaaacuagaagaauucagaauccagucuagucuacuagugaaaaaaggagaaaaagaaaaaagaaaagcaaaaacaaugagccaggcuacaaucuaauaacaaggccacuauaacuuuuuuuaacguaauuuuuuucucuacauucacccucauuucuacaaaagauaaucacagaccaauuugccugauuauuuauaaaagugcagcaagaauaacuacauagccgucuuuuaaauuugcuuugcugcaaacuuugacaaggaaucucagauuagaauuuuagaaaccucucaauguuaggaagccaaaugaaggcacacaucagacuuugccugcuguaucuaguaccuugagguucaugggccugccaggaagugacaaccuuuacucauucacuauaaagcugagaauccuugaagcuaggcauucuuguuuuuuugagauggugucuuacucugucacccaggcuagagggcagugacgcagucuuggcccgcugcaaccuccgccuccuggguucaagcaauuguccugccucagccuccugaguaguugguauuacaggcucaugccaccacacucggccaauuuauuguauuuuuaguagagacaggguuucaccauguuggccaggcuggucuugaacuccugaccucagaugauccacccgccuuggccuccaaagugcugggauuacaggcgugagccaccaugcccaggugaagcuaggcauucuaagaacauuuucaaauaugguauuccugucagagccuugauaauauaaccacuguuuccaauuguauccuguuaaagagaacagauucuuuguugaacuuaugcagacaaccaaauugccguaaaaauaacaguacuaacaaauaguuuccaaauucuggagauaucaucagguagaaagaaaaagcaaauguuucuguuuuuauucauaaaaguaugcuuuaccaaauugcuguaagcuauagauagcuuuuaaaaaaagaaguuuccuuaaaucuguaaaacaaaauauuaaaaaaaacagcaauguuucaaauaaagaagccaugaaaacccauaguuuuuauuuaucaguucaaucagucucauguaauuaauucgugcucuguuugaucuugguuagcaguuuuacaaacccaucaaauuugucaaccaaaaaguaucugagacaagucuuaaucaauuuaggaguuuauuuugccaagguuaaagacaugccacagcaucaggagguccugagaugugccgaaggugguugaauuacagcugauuuuaugcauuuuagggggacagaaguuacaggcagacaucaaugaauacacguaagauguauauugguucaguacagaaaagcaggacagcuugaagguggggggugggaaggacuuccagcucauagguggagucgauuuucugauugguaauugguuaaguuauugucugaagaccuggaaucaauagaaaggaauuucuggguugaaauaagggguuguggaggccaagguucugacacagaugaaaccuccagcuagcaggcuucacagagaauagaugguaaauauuucuuaucagacuuaaaaaggugccagacucuuaaucucuccuggaucaggaaaagaccuggaaagggaaggggauucuccacagaauguagauuuaugagacaacuuugcagggccauuuuuaaauacaucaaagaaauauauuucagaguaaaauacuucaauuuauuucaaugucugcugucaugugauguaucuuauugguacaaagagucuguuuggucagucuuaagaucucuguuuuaauguucaugcuggucaguugugccugaauucuagaaggaggguguaaugaggcauucugaccccacccccauucccaucauggccuaaacuaguuuuucagguuuacuuuggaaagcccuuggccuauugaauggguguccauucaauuggcuggagggcuuagaauuuuauuuuugguuuacaguuucuucauuaaacuuuuggaaauuuuguccaaugguauaaacuaaaaguuaugucagaguuuguuuuuuuuguuuguuuuuugagacagagucucacucuguugcccagacuggagugcaguugcacgaucuuggcucacugcaaccucugccuccuggguucaagcaauucuccuuccucagccuccugaguagcugggauuacaggcacgcaaccccacacccggcuaauuuuuguauuuuugguagaaacaggguuucgccuuguuggccagccuggucucgacuccuaaccucaagugauccgcucgccucugccucccaaagugcugggauuacaggcgugagccacugcacccggccuucuuuucauucuucugauauagcuuuuuggagacacagcacuuuaggauuauaauugcuugcagaaagcuuucauaaaaggcauuagaaccaaaacaauuaacuguggacaacaugacuuaaaauggccaugguuaaaaccugaugagaguucauuaaaauaaugaugaaauugacaaggaaauuugguuauuuuucaaccaaaauuaugacugauagcauuuauaccaauacauaccagauuuauaggaacuuuuuuuaucacagggugggugggaagccugauuuuaggggcuuuccuagaaauuuuuuuuagcaguccuuuuuccaauguccugguuauuugcacaaguggugguacuuccuauucgccuacgcaauucuucgauccauucccaacaaacuaggaggcguucuagcccuccuacuagugaauuuuuggaaacugcuguuuuagggauugcuuauuuggggaagcacccuaggacaggcccaaaugucauucuagguugcugguugucauggagcugaaauacuuggggaauggcuuuucaaacuguaauuugcagucuuuuggguuuugccugacccauaaguagaucggacgggacuuguuggguacuugauagaauucucaggagacuaucauucugccucuuucauccauguggggcucccuagaguacaccaacacauauacuaguugguacagaucaaguauacugggguuauaaauuaccaguaaggccaagcacgguggcucaugccuauaauucccgcacuuuaggaggccgagguggguggaucaccugaggucaggaguuugagaaccagccuggccaacaugguaaaaccacgucucuacuaaaacuacaaaaaaauuagccuggcgugguggugggugccuguaaucccagcuacuugggaggcugaggcaggagaauagcuugaacccaggagacgaagguuguggugagccaagauugcgcccuugcacuccagccugggcaacaagagugaaacuccgucuaaaaaaaauaaaaauuuuuaaauaauaaguuacuaguaagacccugaauucuucagaaaacuugugaaauuuuucucuagguuuaggaaaaucuugaacuguggcccugaaguccauuuuuguccagggagugcaagucgcuuggggauuaucuccugauuuuucagacgauucucuuauaaggaaacuguuuaacugcuuuuuucagggaagaaaggcaauucagacaaagcagacugaauauuuaguaguagauuguaaauauucaggcaaagaaagagagagagaggcaguaggaguuacaucaguuuuaccauccuugguaagggaauaucuuccauuuccagcuuuucauuagcucuuuacagugaaucuuuuuaaaaggugauuuuagaggacugucucuuugaggcuucugaaugccaauaagaauuuuguucucucugcauaauuugggaggcucgggguucgagugcacuucuuagaugaauagucuuuuucauguggaacauuccauguaauggcaucauaauucugaauuaucuuuuguaagauuuugccauuuguaaauauuuguagcuuccagaaccagaaaccuuauacacaaaaaaggcagacuggccagaagggaggguacucagaucuuuagaaauuaaagaaaccauuuuauguuggauauugggucuuccaaagccaaaauggcuuuggcuuugagaucgccuugaccaacuuagcuaaugacauuucaguuucuuuuuugucugacccagucagaugccugaggccucccucaucuaaacauguaagaaaaaaagaacacacauaccuaugaauuccaaaagccagaguucaugucccccuccaccucaugguaauaaccacuuacugugacugccguugguuaccuuuacuacugcagcccuuuaugguagccacagagaguguaacgcacauuucccucuggucauaugcuggucaccaaugggaugcaacccguauuucuguccagccacauucuucagggcuugacccaagccuuuuauggcaucaugcaugagauaucaccagagugggagccgaaacaauguagucauugccagugacuugucagccacuaugaacccagaagucaugugcccugccacaguacaaacuaacccuagguaccccaaagucaaauguccucucauagcacaaacuaaucuugauacccccaaagccaaagauaucagcgagcuuaaauacuuaaagagagcagagcucagaucugagggggacuuaacccucagggcuacaugaaggagauaguaccccccacccccagaaaagaagguuagcaucaccuuuuccuguguuccucaaggagucucaggucagcugucuccagguccuuuuguggucaucugucaagagacaaaauuacaacaaauguaaagaucucaauugucuuuauuuaugauucuagacuugggcaacacuugccgcuuccacauuuucagguauuauagcaacagccacacugccaguacaauuuuccgucuuacucuguuuuccaaggcuguaauagaauaccagagaauggguaauuuauaagcaauaaaaguuuauuugacuuaugguucuagagggugggaaauucaagaucaaagggccaaaucuggugagggucuucuugcugugucauaacauggcaaaagguaucacauggcaaaggagagugugagauggagaaaagaaauggagcugaacucacccuuuuaucaggagcucacuccgagauuacuaaccuauuuccacaauagcugcauaagccuguucaucagggcacaguccuaaugaccugaucacuucuucagucaccucuucaagguucccccuguuaauacuggcacgauggcaauuaaacuuccuucuuuuuuauguauuuauuuuaaaaugacagauaacauuguguauuuuugucauguacaguaugauguguuggaguauauauacauuguggaaugguuaacuagcuaauuaacaaaugcauuaccucacagaguuaucauuuuuguggugagagcauaucacauucacucuuuuuacauuuuucaagaauauacuauaucaucauuaacuauagucaccuugcuguacaauuaggucucuugaaauuuauugcucuugccuaacuguaaguauguaucuuuugacuaacauuuccccaaccuccuucucccuagccaccccagccuuugguaaccaccauuauacucucuauuucugugagaccaccuuuuuuagauuccauauguaagugugaucaugcauuauuuaucucucugugccugccuuauuucaccuagcauaauguucucuagguucauccauguaguugaaaugacaggauguccuccuuuuuaugguugaauaguauuucauuguuuauguauguauguguauguguaacacauauuuguguguguaacacauacacacauauauauauacacacacauccacaguuuuguuuuuuuuuuucugagacggagucucacucugucgcccaggcuggagugcaguggcgugaucucgguucacugcaagcuccgccucccggguucacgccauucuccugccucagccuucugaguagcugggacuacaggcaccagccaccaugccuggcuaauauuuuuguauuuuuaguggagacagaguuucacuguguuagccaggauggucucgaucuccugaccucgugaugcgcccaccuuggccucccaaagugcugggauuacaggcgugagccaccacgcccagcccacauuuuuuuuaauucauucaucuguugguaaacacccaaauugauuccauaccuuggcuauugugaauaaggcugcuauaaacguuggagugcagauaccucuuugacauacugauuuuauuuccuuuggacacauaaccaguagugggauugcuggaucauaugguaguuccauuuuuaauuuuaaaagaauuauugaggccuggcacaguggcucaugccuguaaucccagcacuuugagaggccgagguaggcggaucauuugaggucagaaguuugagaccagccuggccaagaugguuaaaccccaucucuacuggaaauacaaaauuagcugggcaugguggcacaugccuguaaucccagcugcucggaaggcugaggcaagagaaucgcuugaacccaggagauagagguugcaguaagccgagaucaugccacuguacucuagccuggaugaaagagugagacucugucuccaaacaaacaaacaaacaaacaaauauacauacgguuuuuggagggguuggggcaggcacagaggcucaugccuguaauuccagcacuugggagguugaggcauguggaucacuugaguucaguaguuugagaccagccugggcagcauggugaaacucugucucuauaaaaaaaaaaaauacaaaaauuagcuaggcaugauggccugcauguguagucacagcuacuugggaggcugagguaggaggcuggcuugaacccaguagguggagguugcagugagccgagaucaugccacugcauuccagccagaucaguggugaauucugauauuuuagugcaccugucacccggguaguguacuacacaaguguguacuuauacccaguguacccaauguaguuuuuuuuucccucaccccucucccagccuccaucuucuuaaucuccagaguccauuaugucacucuguauguuuugguguccucauagcuuagcucccacuuauaagugagaacauaugguauuugauuuuccauuccugaguuacuucacuuagaauaauggccuccagcuccauccagguugcugcagaagacacuauuucauuccuuuuuauggcugaguaguauuccaugguguauagauaccacauuuucuuuauucacucauugaucaguggacacuuagguugugaauucuccagcucauauuuucaguuuuuugaggacucuucauuuuguuuuccauaauaccuguacuaauuuacauuccaccaauaguguauaaggguucugcuuucuccacauccucaccaacacuuguuauuguuugucuuuuugauaauagccucucucaguggggugagcuaguaucucacugugguuuugauuugcauuucccugauuagugauguugagaauuuuuucauauaccuguuggccauuuguaugucuucuuuugagaagugucuauucaggucauuucaauggcuguuaaauuucaacaugaguuuuggaggggacauucaaaccacagcaucaaacuuuaaucucucuuagaucuauuaauauuuuuuccucucaaucagggcacucacuccccagguugccuuagauguuguuuuccuauuacuuuaauguauuuacauuugaaauccccaguccucaauacaguuggagauccaggcauguagcaaaaaaaaugguauuucuuggagacuugagaagaacacagauaagacuagcaaaggaacuguugaauaccaucagugccaccagauucacccacuagaugcuucuuuuuaauaaacuuaaaacauuuguaguaagaaaauucuauuaguauuuauuuccugcauuuuaaucucuucaaggacuauguuuuauuugucucagucucuucagauaauaauguuggugguuaaaaaaccgaaagcauuaguuuguauuuuuaaaauauaaaauuaaaacacuugaugaauauguagcuugagcagucugucaaagccaugacucugagaaccaaacccaauucuaaaaauguuuaucugauauuaucacaauauauuuuaaaacuggagccaucugccuuccaaaguuuaucuccgcugcaccugcgcucaaaaauacuucugccuacacacaggaacuauuguuuaaagauuuugcuguugauucagcauggaggcucuccaggaauuauucacacuuuaaaauuuauuuuaaaaaauaauuacugcguacuauaaaaaacaaaacagaaaaccccccaaauucuacaaagacaugcaggaaaauuaucuuuucccaccucuaucuguagucccucuuaccagaaauaaccgcuauuacaaguuucuuguggaucuguccaaggauagucucugaauacacacaugcaugugugauacacaugcacacacgcaaagccuccuuuuuccacacauauggcaacauauuguauaugcuuuucuacaccuguuuuguuuucauuuuacuuaauguaucuaaggagaguuuuuugguaucaguauaucugcacuauucuuuuggcucauacuauuacauuaugugaauguuucaucauuuaaccaguuucuuacugaugaauagguuugcaaucuuucuacuauaaacaguaccacuaagaacaucccuuuaugucugucuuugugcaugagugcacuucuauaggacaaacuucuagaauuggaauuauggggucagaaugguaguguguuuuuaauuuuauuuguuauuguucaguggcccuacaaagaauuaccaguuugcauuuuauuaguguauaaaagugcaguuuucuaacacccuugccaacaguuuuaucagaucuuuugccaaucugauaguugaaaaaugacguuuuacugugguuuuaacuugccuugcucuuguuacgauccagcaucauuuuguccaggaaagaacacuagcucaggacugccaggcagacagauuuggaccccacuuguuggccaucauugucaucuguauuuuuuuauuuuuuauuuuuuucuuuggagacagcaucucgcuuuguugccaauaggcgcuggaguccaguggugagaucauggcucaaugcagccuugaucuccgaggcucaagugauccuccuaccucagccucccaaguuacugggacuaacaggcacaugccaccacacccagcuaauuuuuauuuuuuguagagucagagucucacuguguuggucaggcuggucucaaacuccugggcucaagugauacucccuuagccaccccacccagccuuaaauuauauguuuaucuaacaaauccauuccuuuuucccucacccaucucauuuuuuuuuccuaguuugccacuacaucuuuuaaauauuuccugucuauuccuuuugucagugcuucucaacagccagagacauuaacauuuggaguucugucugucugggcagguuauuucacaaaagguucucuaugaauuauuggcuuauuuccuugauuguaccugaaaauuauuuccacucaacaacccaguagacugccaacucuguaacgaugucuuuucacugcuauuacuccagccccuagaauaguaccugacacacaauagucaugcaauaacuuucuuuuuucuuuaguauauaaauauuuuuuauuauauacaauaacauaaacuaugcauaacauaaaauuuaccauuuuagcuagccauuuuuaaguguacaguucaguggcauuaaaugcauuuacauuucaauaauuuucuuuugaauaaacaaaugaacagugauacugguuauuuguacuugaaaguuaccaagagccagaugguaacauugcccuucuuuccugcagacgaaguuauacggaagcgucuccucauugauggagauggugcuggagaugaucggagaauuaaucugcuagugaagaguuucauuaaauggugcaacucugggucccaggaagagggguauuucauuuucacuguuguuuccauaccaguguccuaaugugauuuuaggcccuauauuaagguccugugaguagaucaaauuuucacucaccuuaaauguacaguggagucaacucuuaauuaaccaagaguagauuuucuuggccuuuucuucucuucaaaggccucucauauguuuauuaaaacauggagaaggcagauugguaaggagaaaugaagauuaaauucagacucauuaguuugguuacuuuuaggacauaaguguuuaguaagauaaaauaucuaaauggaauuuucuccuuugcuaauaaaaggcugcugcuauguauguauauauuaaguuggugcaaaauuaaucgugauuucugccauuaacuuuaauggcagaaauggcagaaaccacgauuacuuuuguaccaaccugauacacacgcacacacguauaucuaaucuuuuuuuuugugagacagagucucauucuguuguucaggcuggagugcaauggcacaaucuuggcucacugcaaccuccgccccccagguucaagcaguacucgugccucaaccuccugaguagcugggauuauaggcaugcaacaccaugacugacuaauuuuuguauuuuaguagagaugggguuucaccauguuggccaggcuggugucaaacuucuagcauuaagugaucugcccaccuuggcuucccaaaauuccagaauuacaggcaugagcuaccacgccuaacuauauuuauuuauuuuuuaacauagcaaacuuuuucucauuugaauuugcuuuccauauaaauaauuuuauagagugaaaaaauugugggaacagaauugugaaguuaaaaaaacaucuuaaaguauuucuaaagucuuuuaaacaaaauucaaauaauuguuugaauaaaaugugcauugauaagaacaacaaucccaccuuugcauuuguaacuaaaguaguuaaauucaagaauacuacauuugauaaaaagaaaacuuaagggacagauauucuaaauuuuaaauaagcaaaugauucucucagaacuugcuauaauuuaauuagcaaauauuugucugcauuauaacaguucacuuuugucaguccacaaauaucuuuauuuugguuuucuuucuuuuucauuagauauagccaguaccaacguaugcugagcacgcugucucaaugugaauuuucaaugggcaaaacuuuacuaguauaugauaugaaucucagagaaauggaaaauuaugaaaaaauuuacaaggaaauagguaaagaaucuuaauguuucuaucuguaauuuuauuuuuuauggucuaaaggaaacaauaccugcuaacaauuuucuuuggugguaaaagaauaauaacaauuacuguauuaauggaaagaauacaguaaauguuagcuauaaaaaauguguauucuaagaugauauaguacuuuggguuacagcuauuuuuuaaaaauacuagugucuauuuuguuaccaauagagguuaauuuauaaaugcguuuuaaaauuaaaaauggauuauugauuuuguuacaacuaucuuuuaaaaaaccuucucauauagaauguagcauagcuggagcacaugaaaaaauugcugagugcaaaaagcaaauucuucaagcaaaacgaauacgaaaaaaucgccaagguaaggguuuugagggauuuaaugugcaaauacauuauuacugacuacaguuuucaugcaguuuuuaauguugugagguaaaaucugcagccugaaucaaccuggauuaaaaaaaauccaaauuuuaauuccuuaaaacuauauuauucuuuaaaauagagaaggaagucuguguugagaagaauguuuuugcuggauuacauugauuauccaaguauuucuuuucuguuuuucucuuuuuuuuucuuaucccaguauuucuuaaguauuaaauuuuuaccaucuuggacccuuuugccuaaauaauguuaugguuaaucagcagaggcaauuuacauaaauauacuagauuuaugguuuggguuuuuuguuuguuuguuuaauagagcuacuuuccaaaaaaugaaauggaaaagaauuuaaacucugaguuuucauuaaguacaaagcaagcaaacauuucuagacugccuagaauaucuaauaagaagguuaaaguugaguuuuguuauaaucucuuguuuuuaaguuagaguauacccuuauguaguuccuaaauacuauuucaagauaauuuuuaauguuagaggcacugcucuucuuauaauguaaauugaagaaaaguaaaaauaaaaaauauaauguguaaucacaacuguuacauugauaugaaaaacuagaagaaaauagaaaauguuaaugguuauuuugaaguuguggguuuuuauggcuuagguucuuuucucuguuuuuguguuguuuuguuuuguuuuacauagggcauguauuauuuuguaauucaaaaaauuuguauccaaaagaaucauacuuugaauuaauaugcucaguucuaaaacaaugaauuuucacuuuuuaaugaacuaauuaagaugaagcuuaauuuccucuuuuuacaaguuuuuuuuuucaguuuaaaauguguauggugaaguuuuggugccuuauuuacaguaacauauaccaacuuaguaucaguucuaaagucaucuaaaaauauuuugcaguguuuucguugguuaaugaggcuuuuaaguaaauccugccacucaucacuucauaagaaagcuuaacaggaguuacaugacuuaucuuggaggucucaguggagcagaaaauagaaccugaauuuuaaguuauuugcaaguuucugaaaucuuaacuuuuggaaugagugagaaguguaauuugcuguugacuaacaacucagauuaaugguaggauauauucacugauuguauuuuauuuuauuuuacuuuuuggacaacuagugaguaagauccuucucagaaucagucuauuugauaaucaauaauaacuuaaauuugcuuaugcuuaugcugaccucuuacguucuguccaggacauauaaauggaaaaaaagugggagcuaaaaccccuguuuggaacacuuuugauguuauguaucguuauaauuauaacucaguuaacuaaaacuggcaauacucaucuuucagugauuucauuucuugauguacuaggaaagugauuaggagagguuugugauauuacacauuuuguuuugauaauucacauucaaaaaauccuuaguuugauaaauauuuuuaugucuuacagaauaugaugcuuuggcaaaagugauucagcaccauccagacaggcaugagacauuaaaguaaguguagagcuuuacuuugaaaggaacuaaccuuuauacauaaaugcucgaaaacuaccguaggcauuucauuuuugcagaaauaaauauguuucaaaaggaggggucagauauucaauauuauauuuucccauacuucucuguuagauuuuauuuuccucuaaccuuaccagcuauaugucuaaaauaaaugcauauaauaugcaucaauaucacaauggauaaauagaauauggucuucauauauuaaaauauugaauuucaguuaaaaagaauaaacuaguuaugcccuuuuaaaacacagcucucaaaacauaaucagugaaaagacacauaauaaacuuuaaauuauauuuaaauuccugaaacacauacagaauaauaaccauuuauaaaaguuagaacccccuuucaaauauuauauaccaauacuguguauuauucagggauacaaguauaugcauaaaaaagaauaagaaugauauaguaguugccugagugggagguagaggagauaaaaaggcccaggauagaggacuaggcguaagauucaaaggguauuucgaguuaauuggcaauguuuuauuucuuuuaccaaaauaaaaaacccucgaaguuaaacuucacaauauguaucauuucuugggucuuguuauucuguuaucuguauuuuucuguacuuuaaaaauggauccaaaaauguaauuuuaaugaaagugaguccauauuuagaaguuaagaagaaaucauccucagcuuuaaaaguuucaccauaauggaguguuauaacuccuuauaagcccuuuuuuuauuuuaaaaauccuaucuaguaacuuaaaaguuaggcauuaauuguaaacucuucucccccauucagcaaaauguaacacuguuuuauuauuuccagggaacuagaggcucugggaaaagaauuagagcaucuuucacacauuaaagaaaguguugaagauaagguauucgcauauauauuuagccuucaugaucugucuaucugucugucuauauaucuauauauacaggucauuuguauaaauuuuuuucuuguuaacacagcuggaauugagacggaaacaguuucauguucuucuuaguaccauccaugaacuucagcaaacauuggaaaguaaguagaaauagucucaaaguaaaugcuuaugaagauuuuuuaaaugacccagggauguaccuuuugaaauauacaucuuggagagacaguauaccuucaauuucugaacaguguagcuggaugacguuagaagguacucauguucaacuuucuugaauacauguagaaaagucuuaauuuguaguaauauaggauuuaaacauauacauagugguuuaaauuaagaaaaauucaaggaugauagauuuggaaucuuucuugguucacuguaguugacuacuauaauauaacaacucaggacccaggcaggcaauaauaagaaaucaguacauacgaacauuugcauacccacugaguagugggugcuuuggggaacuggagacuugcucuuuauauucacuauaggcaaguggaaauuuuuguguuaccugaucuucugauuguuuuaaagaauagccuaagacccauuuuuucuuuucuuuuuuuuuuuuuuaagacagucuugcucugucacccaggcuggagugcaguggcacaaucuuggcucacugcaauccucaccuugcaggcucaagugauucuccugccucagccucccuaguagcuggaauuacaggugcaugccaccacacccagcuaauuuuaguauuuuuaguagagacgggguuuuaccauguaggccaggcuggucuugaauuccugaccucaggugauccaccugccuuggccucccaaagugcugggauuauaggcaugagccaccagacccugccuggauuuuuuuuuuuuuaagugaagucuaucacauaaauuuuaaaguuugauucaacuaguagccaucuuagcuuuaauuguauuggcuaauaaaggauaaacauguuuucauguguucaucgaauauaaaauauaggcaaacuugacuaagguuuuauguuuccuucucaauuacagaugaugaaaaacucucagagguagaagaagcucaggaagcaagcauggaaacagauccuaagccauagacaggcuaauugcccaccacucccaggaauauugaaauagcuacaugaccauaauguguuuaaaaugugguaugcucuugagauauuuaaaguuuuggcaguaaaauacucuguuuuuaaguaugaauguauuucauucauauuuccucucacaaaggaaaaugacuucaguauagauuuguuuuuauuaaaaugcauuuuuuauucuuaagugguaggaagcaacauccaaaaaugcuuaauaaaaugcuuuuaagcugca

SEQ ID NO: 192463 - RNA, 46074 nt, Homo sapiens
gucagguucaugguuacgaagcugcugaccccaggaucccagcccgugggagagaagggggucucugacagcccccaccccuccccacugccagauccuuauugggucugaguuucagggguggggccccagcuggagguuauaaaacagcucaaucggggaguacaaccuucgguuucucuucggggaaagcugcuuucagcgcacacgggaagauaucagaaacauccuaggaucaggacaccccagaucuucucaacuggaaccacgaaggcuguuucuuccacacaguacuuugaucuccauuuaagguaagguccccccuccagggugggaugagggaaaaagagggcaggcaggggaggcgguggacuguggguucccaaauccaagcuggcagacacggggcauuggcauguaacagguuucugcugagaccugcuguccgugugggcaccacaccacacauagaaugacccgguaccagagaaguauguuugcgaucucauucacccuuuuguaaguggaucggacgcugaagccaucauagcauguuagaugccuuggguuuauaaaggugauagcauuaggaguaauuugacagugcuuucugcuuuuucugugugcuugcuagaaaauguacacaccuacacauggcuagaguucucuguuuauuagaaagcgcugguucaguuagucaaugagcucacgcccagggcgagcugacugccagccggggagccgcuuuuggggcugggaccccagccugcuuguaguguuucucagugguuuucaaaggcuggcgggacucagaauguuccagauggcuggugaaaccucaggucccuccuagcagcuuuauucacaguagccaagagguggagacagcccucguacccaucuauagaugaauggaaaaauauaauguccauccacacaguggaauauuacgcagccaugaaaaggaacaagcagcuuuauucacaauagccaagagguggagacagcccucauacccaucuauagacgaauggauaaauauaaugugguccagccacacgguggaauauuacacagccaugaaaaggaacaagcagcuuuauucacaauagccaagagguggagacagcccucauacccaucuauagacgaauggauaaauauaaugugguccagccacacaguggaauauuacacagccaugaaaaggaacaagcagcuuuauucacaauagccaagagguggagacagcccucauacccaucuauagaugaauggagaaauauaaugugguccagccacacaguggaauauuauacagccaugaaaaggaacaagcagcuuuauucacaauagccaagagguggagacagcccucguacccaucuauagaugaauggagaaauauaaugugguccagacacacaguggaauauuauacagccaugaaaaggaacaagcagcuuuauucacaauagccaagagguggagacagcccucauacccccaucuauagaugaagggagaaauauaauguccauccacacaguggaauauuacacagccaugaaaaggaacaagcagcuuuauucacaauagccaagagguggagacagcccucauacccaucuauagaugaauggaaaaauauaauguccauccacacaguggaauauuacacagccaugaaaaggaacaagcagcuuuauucacaauagccaagagguggagacagcccucauaccccaucuauagaugaauggagaaauauaaugugguccagccacacgguggaauauuacacagccaugaaaaggaauaagcagcuuuauucacacuagccaagagguggagagaguccucauacccaucuauagaugaauggagaaauauaaugugguccagccacacgguggaauauuacacagccaugaaaaggaacgaggcucugccacagguggcaaugugggugaaugcugaggacaucaugcuuccugagagaggccagauacaaaaagauacauagugucuguaugauuccauuuauucccuauguccagauacaggcaaauccacagagacagaaaguggaugagugguugccacaggcuggggaagaggaaggacgggucuuuaaugggucuggagucuccuuuuggggucgugacaauguucuagaagauagaaguggugguuuuuuuugagacagagucucgcucugucgcccaggcuggagugcaguggcgcgaucucagcucacugcaaccuccaccucccggguucaagcaauucuccugccucagccuccugaguagcugggacuacaggcacccgcaacuacgccuggcuaauuuuuguauguuuaguagagacuuuguauguuuaguagaguaguagagauuuuguauguuuaguauguuuuguauguuggucaggcuggucucgaacuccugaccucaagcaauccaccccccucagccucccaaagugcugggauuauaggcgugagccaccgcgccuggccaaugaaaauauuaaucaauaaauguuaagagcacagauuucccaacguucugacucaggcaucuuccuggaccacagccccuacaggcaagugugacuguguguggugagcccaugagcugaacacaggcucuguccgaaaggagacucuagagauugccuguugccuuggaggugggcugcggucccucugcccaggcaggaaggggcuccgaggccucuggaaccucauuuuaccuuuucccugcugcccucagucccguccccagccucaaggggcucagcuuuuuccaggcucaccccuuccauuuauaauuuggagacaagcaagguccacugacgcuaacgccauuugguucuuuaaaagauguuaggccgggcgcgguggcucacgccugucaucccagcacuuugggaggccaaggcggguggaucaugaggucaggaguucgagaccagccugaccaacauggugaaacaccaucucuacuaaaaauagaaaaauuagcugggugugguggcggacaccgguaaucccaucuacuggggaggcugaggcaggagaaucgcuugaacgugggagguggagguugcagugaaccaagaucgcgccacugcacuccggccuggacaacaagagugagacuccaucucagaaaaaacaaaacaaaacaaaacaaaaaaccagaaaagacagcugccaccccagagcacaguguaggagagccagccuuucugggaugcggcagaaaguuccagugcaggaggcugagguccuguacccccuuguuacgguaacugcagccacuuaggaauuuccguguguugauuucaucauuguaauuauacuuccuuccacugcuuugucaucugagcuuccuggugugccgcagaggauguguuuuccugguuuguggauacagcucgagccaagaacgggcuaaacccccagggcagcaacucuuucuuuucuuuucuuuuuuuuuuuuuuuuuugagacggagucucgcucugucguccaggcuggagugcaguggcgccaucucggcucacugcaagcuccaccucccggguucaacugauuguccugccucagccucccgaguagcugggauuauaggcacacuccaccacgccuggcuaauuuuuguauuuuuaguagagacgggguuucaccauguuagccaggcuggucuugaacuccugaccucgggcaaucugcccaccucugcuucccaaagugcugggauuacuggcaugagccacugcacccagccggcagggcuucuuucaaaagggaacggcugacacacacacagaugcaugcacauacaugcacacauacacacugaugcaaacacauuuguacacauacauucacacaugcaugcacauaaauaugcacuucuaggcacaugcaugcacacauacagacucaugcauguauauuuguguaugcacauauauuuaugcacauguguguacacguggaaugcaugcacagauacauaugcauucaaacacaaagacuguguguaccugcaugcaugaaaacacacaaacacagccgggcacgguggcucacaccuguaaucucagcacuuggcgaggaaaaggcgggcggaucaccugaggcaggaguccgagaccagccuggccaacauggucaaaucucuacuaaaaaauacaaaaagugggcuggacgcgguggcugacgccugucaucccagcacuuugggaggcugagguggguggaucaccugaggucaggaguucgagaccagccuggccaacacggugaaaccccgucucugcuaaaaauacaaaaauuagccggacaugguggugggugccuauaaucccagcuacucgggaggcugaggcaggacaaucgguugaaccugggaggcggagguugcagugagcccagaucacgccauugcacuccagccugggcaacaagagcaaaacucugucacaaaaaauaaauaaauaaauaaauaauacaaaaauuagccaggcaugguggcgagugccuguaaucccagcuacucaggaggcugaggcaggagagucgcuugaaccugggaggcagagguugcaaugagccgagaucaugccacugcacuccagccuggacgacaagggcgagucuccaucaggaaaaaaaaaaaaagaaaacacacaaacacuuaugugugcacacagauacacacgggcacaaaaauguacacacgugcaagcacacacacacacagacacauguacacaguacccgugugugcacaggcaugcaugcaguccugcaaaugugcaaacagacauggcuacauagaggcaugcacacauauagacccauguacacacacacgaauauucgugcacacauguagaagcacacucugaugugcaugcaugugcaaaggcgcauuugcacacagacacauaugcacacucaccaccgcuuucccuccagaagcagcuccuucugcugugagcaccaggcucuggaaggggcaagcauccuucauuacccgcaacccaguuucacagccaguccccgcugccugacucucguuucuccugcagcaggcaccucuguccugcguuccggagcugcguucccgaugguccuccuuuggcucacgcugcuccugaucgcccugcccugucuccugcaaacgaaggaagguaagaacuggagaaaaaaugcacgugccaccuggggagcgguggggguagacagacacacaaugucagcgugccguccuucagggaaacuuuucaugcugagcucauggcagagucucaugcaguggucgggaaugacucagacacuucccuguacccgucaccaaguucccuguaaugcagcaucuugcaaaacgguaauacgaccucacaggcagggaccugaucgugacacagaugccaugugagguguuuugaugaaacucacacgcugggaucaacagcaccaauaacaauuuccaguuuccuucauuguuuaucuuacuuuuucauuuucuuauuauuuuuauuuuggagacagggucuuacugucuugcccaggcuggagugcaauagugugaucucggcucacugcaaccucugccucccggauucaagcgauucuucugccucagccucccgaggagcugagauuacagucgcgcaccaccauacccggcuaauuucuguauuuuugauagagacgggauuucacuaugucggucaggcuggucuagaacugcugaccacaagugauccgucugccuuggccucccaaagugcugggauuacaggugugagccacagcgcccggccuuuuuuuucauugguuuuuacagucuauuacugcaggguuucacuuuaccuugaauuucuuuuaacuuuaauuugcuuuucauucuuuaacuucuuuuuuuuuuuuuuuuuugacacagaguuucauucuggucgcccaggcuggaguguaauagcgugaccauggcucacugcaaccucuaccugcuggguucaauugauucuccugucucagccucccaagcaccugggauuacagguguccgccaccacgcccagcuaauuuuucuguuuuuacuagagacgggguuucaccguguuagacaggauggucucgaucuccugaccucaugauccgccugccucgggguugggauuacacacuuugggaggccaaggcagguggacgaucacaaggucaggaguucgugaccagccugacuaacacggugaaaccccgucucuacuaaaaauacaaaaaucagcugggcgugguggcgggcgccuguaaucccaguuacucgggaggcugaggcaggagagucgcuugaacccgggaggaggagguugcagugagccuagaucacgccauugcacuccagccugggcgacagagugagacuccgucucaaaaugaaugaaugaaugaaugaauuucuuauaagaauuuuuuuccccagacaguuuguuuuaagggauaaauuauccuucuaaguuagaagaaaauaaugccagaagucuagacauucuuaugcuuuggucccgcuuaucaaaccaagguugcugaccuugauaaccacucaagauccuuacaguuuauaaagucauuuccucaaguuuucuaaguggccgaucagagauaaacccuagagaaauaguugauguauguuucuagcuuugggugaccagcaaaaugugauagaauauugccuuuuacuggccgggugcaacggcucacgucuguaaucccagcacuuugggaggcugaggcggguggaucacuugaggucaggaguucaaaaccagcuuggccaucauggugaaaccccgucuguacuaaaaauacaaaaaaauuagcugggcgcggugcugugcaccuguaaucccugcuacucaggaggcugaggcaggagaaucacuugaacccgggaggcggagguugccgugagccaagaucacgccauugcacuccaaccugggugacagagcgaggcuccaucucaaaaaaaaaaaaaaaaaaagaauauugccuuuaacaucuuuguacaggucauuuaugaaauaucuugagcucugugauggcuaagagagaccuucuuuuucuuucuuucuuuuuuuuuuuuuugagacggaguuuuuuuguuuuuuugagauggagucucgcucuguuacccaggcuggagugcaguggcacgaucucagcucaccgcaaccuccgccucccgaguuccagugauucuccugccucagcuuccugauuagcugggauuacaggcgcccgccaccacgcccaacuaauuuuuguauuuuuagucgcgacgggguuucaccguguuagccaggauggucuugaucacuugaccuggugauccgcccaccuuggccucccaaagugcugggaugacgggcgugagccaccacgcccguuugcuuuaugacuucuaccagcucacagaagucuccuguguacauagaacuccacuucccagccaggcucaguaacucacgucugugaucccagcacuuugggaggcugaggcaggcagaucaugugagguugggaguucgagaccagccuggccaacauggugaaaccccaucucuaguaaaaauacaaaaauuagccgagugugguggcaggcaccuguuaucccagcugcacagcaggcugacacaggauaaucgcuugaacccgggaggcggagguuguagugagccgagaucgcgccacugaauuccagccugggcgacagagugagacuccgucucaaaacaaacaagcaaacaaaaauacccauuacaauguuguuuuaagauuguuguauaucaacugggcaugguggcucaugcuuguaaucccagcacuuugagaggccgaggcggacagaucacgaggucaggagaucgagaccauccuggccaacauggugaaaccccaucucuaguaaaaauacaaaaauuagccgggcgugguggugggcuccuguaauccuagcuacucgggaggcugaggcaggagaaucgcuugaacccgggagguagagguugcggugagcugagaucgugccacugcacuccagccugggugacaagagcaaaacuccgucucaaaaaaauaaaaaauuuaaaaaaauaaagaacucgaccucccaaagguauuggcuaacuccacgggcaaaaaaaccauacccauuacaaugcuguuuuaagauuguugaccuggugcgguggcucaugccuguaaucccagcacuuugggaggcugaggcggacgaaucaugaggucaggagaucgagaccauccuggcuaacacggugaaacgccaucucuacuaaaaauacaaaaaaaaaaaaauuagccgggcgugguggcgggcgccuguagucccagcuacucgggaggcugaggcaggagaguugcuugaaccaggaggcggagcuugcagugagcugagaucgugccacuguaguccagccagggcgacaagagugaaacuccaugucaaaaaauuuaaaaaaauuaaauaaaagaacuccaccucccaaagguauuggcuaacuccacgggcaaaaaaaaaaaaccauaccccuuacaaugccguuuuaagauucuuacguaucucuucgaacuccaaccugucaccguuuuagauccaaacccaccaaucacgaaccuaaggaugaaagcaaaggcucagcaguugaccugggaccuuaacagaaaugugaccgauaucgaguguguuaaagacgccgacuauucuaugccgguaaaucauacucucuauuguuuuuuuauuuuuauuuuauuuauuuauguauuuauguauuuauuuauuuuuugagacggagucuugcucugucgcccaggcuggacugcggugacccgaucuccgcucucugcaaccuccaccucccagguccaugccauucuccugccucaaccucccgaguagcugggacuacaggcgcccgccaccaugcccggcuaauuuuuuuguauuuuuaguagagaugggguuucacuguguuagccaggagggucucgaucuccugaccucgugaucugcccgccucggccucccaaagugcugggauuacaggcgcgagucaccgcgcauggcccagacucucuaauguugacgaacaagacguuuccgucuucugcaggaaucucagaaccaauacugcucccaucgcuggugucaugacuaccugguuucugccccgaagucaggugugggauuugaagugacuuuggagggucugguuccccguccgcgggacaucuaagauggcacacacuggacaggguggaugugaaagugaaaugaggcuaagcuaugacuggugcgaaacccaaccccacgcugggcgugguggcucacgucuguaaucccagcacuuugggaggcugaggcgggcggaucaugaggucaggaguucgagaccagucuggccaacacggugaaacgcugucucugcuaaaaauacgaaaguuagccgggcacaguggcucacaccagcacuuugagaggcugaggcggauggaucaccuggggccaggaguucgagacuagucugggcaacauggugaaaccccgccuccacuaaaaauauaaaaauuagcugggcaugguggugggcgccuguaaucccaguuacuugggaggcugaggcaggagaaucgcuugaacccgggaggcagagguugcauugagccgagacugugccacugcacuccagccugggggacgagagcaagacuucaugucaaaaaagaaaaagaaaaauuagccggaugugguggcacaugccuguaauaccagcuauucaggaggcugaggcaggagaauugcuugaaccugggaggccgagguugcacugagccgagauugugccacugcacuccagccugggugacagagugagacuccaucucaaaacaaaaacaaaaacaaaagcaaaaacaaaacaaaagugugugcucaggaaacaagguccucaucacgaaauccuuccaaaucccccaucuugucaucaccugcguucucaggguuugagaacagcgccagaccucaugggguggcccaggugacacugugagcuauuuacaagucagugucuuaugggaaaggagcacguuucccugagaaccuauuugguccccuccaagagcuauguucguucaauacaauucaaaucacggcccuucaugcgucugcucgggccaccauuauaaaauccuacccccagcuccaaauacagucccauugaacuuugugauuuuggagaguagagauaaaacagucuagaaucccagagcgauuuuaccauaccauggcaaacugacucucaacuuuagaaacacaaaugcugaaaaaaaaacuaaggaaauuuugaaaaagaaggugaaugaaggagaaccugccuuaccuauaucaaaaggcacugaaaaguucauacccaaugugcggauugcuauaagaauacacaaguaggccgggcgugguggcucacgccugucaucccagcacuuuggaggccgaggcggguggaucacgaggucaggagaucgagacccuccuggcuaacacggugaaaccccgucucuacuaaaaauauaaaaauuagccgggcgugguggcuggugccuguagucccagcuacucgggaggcugaggcaggagaauggcuugaaccugggaggcagaagcuugcagugagccgagaucgcgccacugcacuccagccugggcgacagagcgagacucugucucaaaaaaacaaaaacaaaagcaaacaaaacgaagaauauacaaguagauuaaugaaauguggccgggugcgguggugaggcaggagaauugcuugaacccgagagguggagguugcagugagcugagaucgcaccacugaagucuagccugggcaagcggagugaggcccugucuuaacaaaaaaacaaagaaacaaaaaacaaacaaacaagaaaaaaacaaagcaaaacaaacagaaaaguauuucacuaauauuuacugcuaagugggauuauuuuuauucaagcuuuuguaucuuuagaaaaaaauuguggccgggcgcgguggcucacgccugucaucccagcacuuugggaggccgaggaggguggaucacgaggucaggagaucgagacccuccuggcuaacacggugaaaccccgucucuacuaaaaauauaaaaauuagccgggcgugguggcgggcgccuguagucccagcuacuugggaggaugaggcaggagaauggcaugaacccgggagggagaggcuacagugagccgagaucgcgccccugcacuccagccugggcgacagagcgagacucccucucaaaaaaaaaaaaaacagaaaaaagucuuggccgggcacgguggcucacgccuguaaucccagcacuuugggaggcugaggcaggcggaucacaugaggucaggaguucgagaccagccugaccaacauggugaaacccugucucuacccagaaaaauacuuuaaaaauuagcugggcgugguggcgggcaccuguaaucccaggugcucgggagguugaagcaggagaauggcuugaacccgggagggagaggcugcagugagccgagaucacgccacugcacuccagcgugggcgacgagagcgaaacucugccucaaaaaaaaucugaacaucauuagcgucaaauuaagcauggucugucagcagccaucauaguccuaugucucucuuaggcagugaacaauagcuauugccaguuuggagcaauuuccuuaugugaagugaccaacuacaccguccgaguggccaacccaccauucuccacguggauccucuucccugagaacagugagaaaaauguucauuguuuguuuauucucuauucccucccuccuucccucucucccucccucucgccuucgcugugucuuuuuucuuuucuuuuucucuuucuuucuuucuuucuuucuuucuuucuuucuuucuuucuuucuuuuucuuucuuucuguuucuguuucuuucuuccuuucuuuuucuuucuuucuuuccuucuuuccucucuuucuuuucuuucucuuucccucccucccuucuuucuuuucuucacuuccuucccucccuccuucucuccuuuuccucccuccuccuucccacccuacuuccucucucuccuuccuucccuuucguuuucuuuuccucccugccucacucccuuccuuccuucucucccuccucuuuuccuuccuucuucccuccuucccuuucucucucucucucuuucucucuuucccccuccccucccuuccccuccucuccccucuccuuuccugacacggucuugcucuguugcccaggcuggagcgcaguggugcaaucacagcuuacugcaggcuucaccuccugagcucaaacaauccuucugccucagccucccacguagguggaacuacacccauguaccaccaugcccaccuaauuuuuuaaacaccuuuuuuuuuuuuuagacagagucucacucuguccaccaggcuggagugcacuggcgcgaucucggcucacugcaaccucuggcucccggguucaagcgauucuccugccucagccucccgaguagcugggauuauaggcgcccaccgccacgcccagcuaauucuuguauuuuuaguagagaugggguuucaccauguuggucaggcuggucucaaacuccugacuucgugaucugcccgccucggccucccaaagugcugggaguacaggggugagccaccgcgcccagccuuaaauacuuuuuguagagauggggugucgcuauguuaccugagcuggucucaaacuccuaggcucaagugauccucccgccucagucucccaaagugcagggauuguaagcaucagccaccacgccuggccucuucuuuguuuuuuaauuaauuagaaguccaugguuuauuuuuuuguuuuguuuuguuuguuuuucugugauggagucuuguucuugucgcccaggcuggagugcaguggugcgauuucagcuuaccgcaaacuccgccucccggguucaagcgauucuccugccucagccucacaaguagcugggauuacaggcacccgccaccaagcccggcuaaauuuuguauuuuaaguagagacggggcuucaccauguuggucucgaacuccugaccuugugauccacccgccucagccucccaaagugcugggaugacaggcgggagccacugugccgggccucaauuuaauuauuuuuaaguuuaauggauuuccagggaguuaugccgagucggaaaaaaaagaccacuccagagcgugacacacacagugauuucauuaauacaacugucuugaaauggcaaaauuuuacaaauagaaaacagucuccuggguugcagggauauaagcaggagugagagcugagagagguggguuuggcuguaaaagugcuccuuggggaggccgggcgcaguggcucacgccuguaaucccagcacuuugggaggccgaggcgggcggaucaccugaggucaggaguucgagaccagccuggccaacauggugaaaccccgucucuacuaaaaacacaaaaauuagccgggcaugguggcucacgccuguaaucccagcacuuugggaggccgaggcaggcggaucaccugaggucaggaauucgagaccagccuggcuaacauggugaaaccccaucucuacuaaaaauacaaaauuagccaggggugguggcacaugccuguagucccagcuacucaggaggcugaggcaggagaaucacuugaacccgggaggcggagauugcggugagcugagaucgugccauugcucuccagccugggcaacaagagugaaauuccaucuaaaaaaaaaaaaaaauuaaaaagaaauuagcggccgggcccaguggcucacaccuguaaucccagcacuuugggaggccgagguggguggaucgcgaggucaggagaucgagaccaucccggcuaacauggugaaaccccaucucuacuaaaaauacaaaauuagccaggggugguggcacaugccugcagucccagcuacucaggaggcugaggcaggagaaucacuugaaccugggaggcggagguuguggugagccauugagcuccagccugggcaacaagagugaaacucugucuuaaacacacacacagaugcacacacacgcacacacacacaaacaaugaaagaaaaacaucuguagucccagcaguuugggaggcugaggcggguggaucacuugaggucaggaauucgcgaccagucugggcaacauggugaaaccccaucucuacuaaaaauacaaaaauuagcugggugugguagugggugccuguugucccagauacuugggaggcugaggcaggagaauugcuugaacccgggagguggagguugcagugagccgagauggcgccauuguacuccagccuaggcgacggagcgagacucuguaaaaaugaauaaauaaaucauuaaaagaauaugcaggaucucuccauauuauuauuauuuuuuacaacggcuuguguaucuaccauggucucaaaauacaaaaggcacucuaaaaaggaauuagaguuuuauuuuuuuuuuugagacggagucucgcucuugucacacaggcuggagugcagugacguggccugggcucacugcaaccucugccuccuggguucaagaaauucuccugccucagccucccuaguagcugggauuacagcggcccgacaucacgcccggcuaauuuuuguauuuuuaguagaggcaggguuucaccauguuagccaggccggucucgaacuccggaccucaggugauccuccugccucggccucccaaagugcugggauuacaggcgugagccaccaugccuggguuuguuuuuuuauuuuuuugagacgaaggcucacucugucgcccaggcuggagugcaguggcgugaucucagcuccaugcaaccucugccuccuggguucaagaaauucuccugccucagccucccgaguagcugggauuacagcggcccgacaucacaccuggcuaauuuuuuauauuuuuaguagagacuggguuucaccauguuagccaggcuggucucgaacuccggaccucgggugauccaccugccucggccucccaaagugcugggaucacaggcgcgugccaccagacacagcuaauuuuugcauuuuuaguagagauuggguuucuccauguuggccaggcuggucucgaacuccugaccucaugugauccacccgccucggccucccaaaaugcuggggugacaggcgugagccaccgcgcccggucccgauucgaguucucuuucauguuugugaacccaggugggaagccuugggcaggugcggagaaucugaccugcuggauucaugacguggauuucuugagcugcagcugggcgguaggcccgggggcccccgcggacguccaguacgaccuguacuugaacguugccaaguaggugugcccgugggcagaggccgggcugucccuggugcgggugccaucggcguggggucgucccccaaccuuaccgcuuaccgcagcaggcgucaacaguacgagugucuucacuacaaaacggaugcucagggaacacguaucgggugucguuucgaugacaucucucgacucuccagcgguucucaaaguucccacauccuggugcggggcaggagcgcagccuucgguauccccugcacagauaaguuugucgucuuuucacagauuggugaguagcccgggacacucccucccacccucaguucugugauaccacggcuuuagcgccaggccagaucccacgggaccacguggcucccaacgcagacguuggccucucacauuuccagaggcuggacguuggaggucagcgugcuggcuggcugggcuccucgggaggucucuuccuggcuuggagagagggucaucuucucacugugucuucacgugguguagagagagagagagaugaaguucuggggucucuuguuagaagggcacuaacaccaucaugggucccaucaugggucauaggaucccucaccaugggucaugggaccccccaucauggguuccaucaugggucccaucaugggucauagaaucccccaugauggguuucaucaugagucauagaacccccuaucauggauuccaucaugggucaugggaacccccaucaugggucccaucaugguucauaggaucccccaucauggguuucaucaugagucauagaacccccuaucauggauuccaucaugggucaugggaacccccaucaugggucccaucauuggucauaggacccccuaucauggguuccaucaugggucaugggacaccccccaucauggguuccaccaugagucaugggaucccucaucguggguuccaucaugggucaugggaccccccaucauggguuccaucauggguaauaggacccccccaucauggguuccaccaugagucaugggaucccuuaucauggauuccaucaugggucaugggacccccuaucauggauuccaucaugggucaugggacccccccaucaugggucccaucaugagucaugggaucccucaucauggguuucaucaugggucauaggacccccaucauggauuccaucaugggucaugggaaccuccaucaugggucccauuaugggucauagaauuccccaucauggguuccaucaugagucaugggaccccccaucauggguuccacaugggaucccucaucauugguuccaucaugggucauaggaucccccaucauaggucccaucauggguuccacaugggaucccccaucauaggucccaucaugggucaugggaccccccccaucauggguuccaucacgggucaugggaccccccccaucauggguuccaucacgggucaugggaccccccccaaucauggguuccaucaugggucaugggaacccccaucauggguuucaucaugggucauaggauccccuaucauggguuccaucaugggucaugggaccccccccaucacggguuccaucaugggucaugggaacccccaucauggguuucaucaugggucauaggauccccuaucauggauuccaucaugagucaugggaucccucaucauggguuccaucaugggucaugggacccccccccccaucaugggucgugggacccccacccccaucaugggucaugggagcccccauugugagucauggaaucccucaucaugggucucaucaugggccaugggucccaccaugggucaugggagcccccaucaugagucauggaaucccucaucaugggucaugggucccaucaugggucaugggagcccccaucaugggucaugggucccaucaugggucacgggagcccccaucauggggguccacccucauaacuucagcccacgccagucaccucccaaagaccccaccuucuaacaccgcccaaccagggguuagagcuucaguggaggaauuugggacagaaggacacacacuuucaguccacgauacccgagcuccgaggaaccucccagguggugagaaugucaauaugcccagagcugacgugcccugaacccaagggcagggugcucggaugcuucagaagaggagggggaaacgaggaagaggaggagaaggacaaggagaagagaagggaggagaggaagaacaugagcagggggaggaggaggagaaggaaaagaaacagaggaaaaggagggggaggagguagagauggagagggaaggaagaggaggaagagaagaaaacggagaaagaggagggggaggaggaggaggaagagaaaauggagaaagaggagggggaggagguggagauggggaggggaggaagaggaggaagagaagaaaacaggagggggaggaagagaagaaaauggagggaaaggagggggaggagguggagauggggagagaaggagcaggaggaggagaagaaagaagaggaagaaaggaggaggagaggguggaggaggaagagggugaaggagagagggaggagaauggagaggaggaggaggcgggggagggaagagaaggaggugaggaggaggaaggggaggauagagaaggugggguagaaggguggugagguggggagggagaaggagggggaggaggagagaggaggacuggggggaggaagggggaggaggggagagaggaggagggaggagggagaaggagggggagaggauggaggaaggggagcagauggaggaaggcgagcaggagggggaggaaaaaggaggggcaggaggaagaaggagcgggaggagaggaggaggaggaggaggagaaugggcagggaggaggagagggaagaaaaggagggggaggaggaaggagggggaggaggguggagggggaggaggguggagggggaggaggguggagggggaggaggaaggagggagaaggaggggagaggauggaggaagaggagcaggagggggaggaaaaaggaggaggggcaggaggggaggaggagaaaggagaguggaggaggagggugacaaggagaauggggaggagagaggagugguagaaaaaggagagagaggaagaguaggagcggagggggaggaggggaggggaggggaggggagaaagaccaggaggguaggaggagggggaggaggaggagggggccagggcuggacuuccuuccaggggcccaggggagacccagccaggcagccggacacacagggcugggcugguagucgggucacaccugaggauguggaagugccugggguucccgggaaguggaggauguccugggccacugggagaggcggcacauccccuggggggcggaggugggggaggugagaagccaggcaggggccaggaaguggaagcuucaggaggaugugugcaggucaaaguguaggagucugcaucuugaaugaugcagagagggccuccaaggcuccagugugcugcaggugggcagagggggcaugggaaguagggguuggcccugggcagggguggggagugggccaggcugcccagcggggcugagccuagagauggaaggggcagggacaaagaugugcagcugccaguccuuggaaaagcugaacgccugguacuucagagaacaaaagggugguucugaaggcugcucccaggacaguggggcuccgagggugcaaccccaaggcucacuccucccagugcccccaacgcggcucaguccugugucucugccuguagaguuucuuuguucccucuuccuuccugguguuuuucucucccgcucuccaaaugcauaggagaaguaauuugaaguaucuccagaaaaaaaaagagaaaaagaaaaagaauugauuucuuguacuccuaaauccuaaaaguguuuuucucguugcuagagauauuaacuccacccaacaugacugcaaaguguaauaagacacauuccuuuaugcacuggaaaaugagaagucauuucaaucgcaaauuucgcuaugagcuucagauacaaaagguaaacuuucaccccgcccccagcccccccacccccguggacaucccuuauuuuugguaagucgcacucuggggccuugaaacgggcaacaaucuccucugauaacgucacagaaggcauggaucauuaaaaaacaaaaacaaaaacaaaaggccgggcgcuguggcucacgccugucaucccagcacuuugggaggcugaggcagguggaucacaaggucaggagaucgagaccauccuggcuaacgcggugaaaccccgucucuacuaaaaauacgaaaaaaaauuagcugggcgugguggcacggucuuguaguuccagcuacuggggaggccgaggcaggagaauugcuugaacccaggagguggggguugcagugagccgagaucgcgccauugcacuccagccugggcgacagagcgagacuccgucucaaaaaaaaaaaaaaaguuugagacuguauguggucuguuguuuuuuauuuuuauuauuucuauuguuaugugguuuuuuaauuuuuucuugaacuuucuuuuuucuuuuguagugaucuacagauucaaugcaagcuucccagauauuuuugauccacaguucguuggaucaguugaacauaaauauugauuuauuuauugagccacucuggcucuguagcccagacuggagugcaguggcuuaaaucuugacucacugcaaccucugccucccggguucaagugauucuccugccucagccucccgaguagcugggauuaugggcacccaucaccacacccagcuaaguuuuuguauuuuuaguagaaacagaguuucaucauguuggccaggcuggucucaaacuccugaccucaggugauccacccgccucggccucccaaagugcugggauuacaggugugagccuucgugcgcagccuauguguuauauuuaguuuguauuuuauuuuauuguauuuuauuauuuauuuauuuauuuuugagacggaguccugcucugucacccaagcuguuuguuuguuuguuuguuuguuuauuauuuuugagacggaguccugcucuguugcccaggcuggggugcaguggcaugaucucagcucacuguaaccuccgccucucggguucaaccaauucucagcuucagccuccugaguagcuggaauuacaggcaccugccaccaugccuggcuaauuuuuuuuuguauuuuuaguagagaugggguuucaccaucuuguccuggcuggucuugaacuccugaccucaugauccacccgccucagcuucccaaagugcugggauuacaggcgugaggcacugugccccgccauauauuuauuauuuaugcucaaauacuaauuauuucauaugcaauuuuucuguaagucuaaaucugcuaaaaaacguuaggucuauuaauuucuuuuauauuaccaaguguuuuuuagccaaucuguuuggguuuuuuuuuuuuuuaagaaaauaaauggcugggugcaguagcuuacgccuguaaucccagcacuuugggaggccgaggcaggacgaucacgaggucaggagauagagaccauccuggcuaacaugguaaaaccccgucucuacuaaaaauacaaaaaaaaauuagcugggcgugguggcgggcgccuguagucccagcuacuugggaggcugaggcaggagaauggcguaaacccagaaggcggagcuugcagcgagcugagauugugccacugcacuccauccugggcaacagagugagacuccgucucaggagaaaaaaaaaaaaagaaaauaaauacagcacagacuucuuucuuucacugauuugagggagcaggcauagcugcagccacaggcagagucguagcuagucugauguugcacccccuaccuaguucgcuggccuggcauaggcugucuguggcuaccccugagugcaucuggacacagucugggaggacggugggucuuguuuguccaccggccucacaaagcccccucccaccaaggucuugccacaguggcccauaagaaaccuuuugggccaggcgcgauggggcaugccuguaaucccagcacuuugggaggccgaggugggcagaucaugaggucaagagaucaagaccauccuggccaacauggugaaacuuuguuuccacuaaaaauacaaaaaauuagccaggcgugguggcacgcaccuguagucccagcuacucgggagacugaggcaaaagaaucacuugaauccgggaggcggagguugcagugagccgagaucacgccacugcauuccagccugggugacggagugagacuccgucucauaaauaaauaaacaaacaaaccuuuuggucaggugcuauuuacuccuaagcucauuauuuugcccccacugcugcccgaaggccuucccagagcccucacuguuuugcugguuuuccuggagggagaaauuugaguuugggaggaggaggcuuucagggacgguccagacacucaaaaguuugcuugcuuuuguguugcagagaaugcagccuguaaucacagaacaggugaguguucccuacccccagccgcuguacuugacauugcaaagggugaguuuuauuauuauuaagaauaaaaugauaaaaaauauuaauaauucuuauuaauaaaauaaugaaaauauuauuaauaauaaauguuauuauucaauguucagugacuuucauuggacagacucuugagugucacccuuacugcgaucuugcaaaauugggauauuucacauccccaaauugagggaugggaaaaggaagagucagggaugacaccucccaaggugugagagccagaugcuauggcuggccaggugcuguccaaacgagguccacccauuugccccagauuccuuacccugggccaggcagccccaguccagcaggaacaagcuaccaaaccauagcuccacccagcagagacaagcauucagacagguggcccagaccucagacagaggacccucccccagccccugccugggaucugcaggaacagacagccggaccacagcauucucuguccccucucucucuguccaucucuuuccccguaucucuuucucugucucugaaucucucugccuuucucccucccucucuuucucucucucucgucucuaucucccucccccucucuguaucucccucccuuuuucccucccucuaucuuucuggcucucucccugugucuaucucucccuguccccaucucucucugugucucuuucccucccucucucauucuccuucccucucucuaucuuucucucccugucucuaucucccgcuccgugucugucucuaucuuucucccuuucucccuccaucucucucucccugucucucucuccccguucccaucucucucucugugucucugucucucccucucucauucucccucccucuuuuauucucccucccucucuuucucucucucucucucucuccuggucucugucuccccccuccccaucucuuucucugugucugucucuguaaccuucuccauuucucccuccaucucucugucucucccugugucuaucucccacugucccugucuguuucuccgugucugucucuguaucucucucccuuucucccuccaucuuucucucucucccccggucucuaucuucccuucuccccaucucucucucucugucugucucuguaucucucucccuuucucccuccaucuuucucucucucucccggucucuaucucccccucuccccgucucuuucuccgugucugucucugugucucucucccuuucucccucccuccaucuuucucucucucucccggucucuauuuccucccuccccaucucuuucucugugucugucucuguaucucucucccuuucucccuccaucuuucucucucucuccuggucucuaucucccccucucccugucucucugugucugucucuguaucucucucccuuucucccucccucucuuuaucucucucucucucucugccucuaucucccacuguccaaaucugugucucugucucucccucuuucauucucccucucuuucucuaucucucuccuugucuauaucucccccucucccagucucucuguaucucuguaucucucucccuuucuccuucccucucuucaucuuucuuuuugaaacggaguuuuucucuuguugcccaggcuggagugcgauggcacgaucucggcucacugcaaccuccgccucccagguucaagcgaaucuacucccucagccucccaaguagcugggauuacaggcacucgccaccaugcccaacuaacuuuuuuuuuuuuuuguauuuuuaguagagacaggguuucacuagugggccaggcuggucucgaacuccugaccucaggcgauccaccugccucauccucucaaagugcuggaauuacaggugugagccaccgugcccggccccucucuuuaucuuucuagcucucucccugucucucucucccuuccccucucugucucucucucccuuccccucucugucucucucucccuuccccucucugucucucucucccuuccccucugucucucucucccuuccccucucugucucucucucccuuccccucucugucucucucucccuuccccucugucucucucucccuuccccucucugucucucucucccuuccccucucugucucucucucccuuccccucucugucucucucucccuuccccucucugucucucucucccuuccccucucugucucucucucccuuuccuucucugucucucucucccuuccccucucucucucuccauuccccugucucuaugucucucccuuucucucucccauuauuucucugugauugucucuuucuuucucugccucugucugucugucccccuguauuaguccauugucacacugcugauaaacauauacccaagacuggguaauuuauaaacaaaagaggguuccuggacucacaguuccauguggcuggggaggccucacgaucacggcagaaggugaaggaggaggaaaggcaugucuuacaugucagcgggcaagacagaaugagacagucgccgggcgcagugacucaugccuguaaucacagcaccuugggaggacgagguggguggaccacgaggucaggaguucaagaccagccuggccaacauggugaaaccuagcucuacuaaaaauaaaaaaaauuacccagacguggugguggcaggcgccuguggucccagcuacucgggaggcugaagcaggagaaucgcuugaacccgggaggcagagguugcagugaguugagaucgcgccacugcacuccagccugggugacagagugagacuccgucucgagaaaaaaaaaaaaaaaaaaaaaaugagagccgagagaaagguuucccuuauuaaaccauuagaucucgugagacuuauucacuaccccgagaacaguguggggggaaacugcccccaugauucaguuauguccuacccagucccucucacaacacgugggaguuauaagggcuacaauucaagaugagauuuggguggggacacagccaaacuacaucacccacucucucugucucucugcuucuguuuuccucucugucucuguuuuucuuucccucucucugucucuuuguaucucugucucucucucucugucuccguuucuaucucugucucucucuguccaucacccacucugucucuuugucucucuaugucucucuguuucuguuuuucuguuuuucucuuucccucucucuuuguaucuaugucuuucugucucuccguuucugucucucucucuguccaucacccacucugucugucuuugucuaugucucucuguuuuucugucucuuuuucucuuucccucucugucuccccucucugugucucuuuguaucuccgucucucccugucuguuucuaucucugucucucucuguccaucaccuacucugucucuuugucucugucuguuucuguuuuucuuucuuuuucccucugucucccuucucugugucucuuuguaucucugucucucucuguuucuaucugucucucucuguccaucacccacuaucucugucuaugucuguuuuucugucucuguuuuucucucucccucucucugucuccccucucugugucucuuuguaucucuuucucucucucugucucucccugucuguuucuaucuccguccuccuguauuaguccauuuucauggacuaaugaggauccuucccgcuucucccagcuccuggggacucuggggucccugggcuuguggccauaucacuccacucucugccuccgucuccacauggccuucuccucugcauccgugucuccuuuuuauuuauuuauuuauuuauuuugagacagagucucgcucugucacccaggcuggagugcaguggugcgaucucagcucacugcaaccuccgccucccagguucaagcgauuccccugccucagccucccgaguagcugggacuacaggugcacaccaccacgccuggcuaauuuuuguauuauuaguaaagaugggauuuuaccuuguugcucagguugaccucgaacuccugaccucaggugaucuacccaccucagccucccaaagugcugggauuacaggugucagccaccgcgcccggccacgucuccucuucuuauaaggauauuggucauugcauuuagggcccccccugauccaaaaugacaucaucucaaucuauaucuuaacgacaucugccaugaacagguauuucaucauaaggccccauuguaaggugcugggggcuaagacugcaacauaugaauuuugggggaucacaaugcagccucauucuuuuguacccaucaaauaugaauggucuuuucuucuuuuuuuuuuuuuuuugagacggagucucgcucugucacccaggcuggagugcaguggcgcaaucucggcucacugcaagcuccgccucccggguucccgccacucuccugccucagccuccugaguagcugggaccucaggcgcccgccaccgggcccggcuaauuuuuuguauuuuuaguagagacgggguuucacuguggucucgaucuccugaccuugugaucugcccgccuuggcccuccaaagugcugggauuacaggcgugagccaccgcgccuggccgagcuauuucaucauaaggccccacuguaaggagcugggggcuaagacugcaacauaugaauuuugggggaucacaaugcagacucauucuuuuguacccaucaaauaugaauggucuuuucuucuacuuuuuuguuugguuuuuaauuucagacaggcucucacucugucacccacgcuagagugcaguggcacagucacggcucacugcaaucucugccuccugggcucaagggauccuccugccucagccccccaaguagcugaaacuacaggcguuugccaccaggucagcucauuuaaaaaaaaauuuggcugggcgcgguggcucacgcugguaaucccagcccuuugggaggccgaggcggguggaucaugaggucaggaaaucaagaccauccuggcuaacauggugaaacccugucucuacuaaaaaaaaaaauacaaaaaauuagcugggcaugguagcgggugccuguagucccagcuacucgggaggcugaggcaggagaauggcaugaacccgggaagcggagcuugcagugagccgagaucacgccacugcacuccagccugggggacagagugagacuccaucucaaaaaaaaaaaaauuuuuuuuuggcuggacgugguggcucacacugguaaucccagcacuuugggaggcugaggcggguggaucaccggagguugggaguucgagaccagccugaccaacauggagaaaccccgacucuacuaaaaauacaaaauuaaccgagcgugguggugggcgccuguaaucccagcuacucgggaggcugaggcaggagaaucgcuugaaucugggaggcggagguugcggugagccgaguuggugccacugcacuccagccugggcaacaagagugaaacucugucucaaaacaaaacaaaacaaauuuucuucuagagauggggucuugguuuguugcccaggcuggucucaaacuccuaagcucgagguauccccccaccucagccucccugguagcugggaccaaagacaugugucaccacgucugguaauuuuuacaguuuuuuuuuuuugguaaagauggggucuugcuauguugcccaggcuggugucaaacuccugggcuuaaggaauucucccaccucagccuccaaaagugcuguggugagaggcauaaaccguagcacccagccccucuuuucuucuuuuauuuauuuauuuauuuauuuauuuauuuauuuagagacagagucucacucuguugcccaggcugcagugcaguggugccaucucgccucacugcaaccuccaccucucagguuuaagcuauucuccugccucagccuccugaguagcugggauuacaggugccugccaccaugccaggcuaauuuuuguauuuuuaguagagacaggguuucaccauguuggccaggcuggucucgaacuccugaccucaggugauccaccugccuuggccucccuaagugcccaggugagagucaugagccaccauaccuggccccucuucuuuauuuucuuucaaaccacaggucagagacagaaccuccuuccagcuacucaauccuggaacguacacaguacaaauaagagcccgggaaagaguguaugaauucuugagcgccuggagcaccccccagcgcuucggugagugggcugugcggggugcgcggggugagcggggugagcggggugcgcggggugagcggggugcgcggggugagcggggugcgcggggugagcggggugagcggggugagccgggugcgcggggugagccggcugcgcggggugagcggggugagcggggugagcggggugagcggggugcgcggggugagcggggugagcggggugcgcggggugagcggggugagccgggugcgcggggugagccgggugagcggggugcgcggggugagcggggugagcggggugcgcggggugagccgggugcgcggggugagcggggugagccgggugcgcggggugagcggggugagcggggugagccgggugagccgggugagccgggugcgcggggugagccgggugcgcggggugagcggggugcgcggggugagcggggugcgcggggugagccgggugcgcggggugagcggggugcgcggggugagcggggugcgcggggugagccgggugcgcggggugagcggggugagcggggugagccgggugccccgggugagcggggugcgcggggugagccgggugcgcggggugagcggggugagcggggugcgcggggugagccgggugcgcggggugagccgggugcgcggggugagccgggugagcggggugagcggggugcggggugcgcggugcgcggggugagcggggugcgcggggugagccgggugcgcggggugagcggggugagccgggugccccgggugagcggggugcgcggggugagccgggugcgcggggugagcggggugcgcggggugagcggggugcgcggggugcgcggcgugagccgggugcgcggggugcgcggggugagcggggugcgcggggugcgcggggugcgcggggugagcggggugcgcggggugcgcggcgugagccgggugcgcggggugagcggggugcgcggggugagcggggugcgcggggugagccgggugcgcggggugagccgggugagccgggugcgcggggugagcggggugcgcggggugagccgggugagccgggugcgcggggugagccgggugcgcggggugagcggggugcgcggggugagccgggugcgcggggugagcggggugcgcggggugagcggggugcgcggggugagcggggugcgcggggugagccgggugcgcggggugagcggggugagcggggugagccgggugccccgggugagcggggugcgcggggugagcccggugagccgggugcgcggggugagccgggugcgcggggugagccgggugagcggggugagcggggugcgcggugcgcggggugagcggggugcgcggggugagccgggugcgcggggugagcggggugagccgggugccccgggugagcggggugcgcggggugagccgggugcgcggggugagcggggugcgcggagugagcggggugcgcggggugcgcggcgugagccgggugcgcggggugcgcggggugagcggggugcgcggggugcgcggggugcgcggggugagcggggugcgcggggugcgcggcgugagccgggugcgcggggugagcggggugcgcggggugagcggggugcgcggggugagccgggugcgcggggugagcggggugcgcggggugagccgggugcgcggggugcgcggggugcgcggggugcgccgggugcgcggggugagccgggugcgcggggugagcggggugcgcggggugcgcggggugcgcggggugagccgggugcgcggggugagcggggugagccgggugcgcggggugagcggggugagccgggugcgcggggugagcggggugcgcggggugagccgggugcgcggggugagcggggugcgcggggugagccgggugcgcggggugagcggggugcgccgggugagcggggugagcggggugagccgggugcgcggggugcgcggggugcgccgggugcgcggggugagccgggugcgcggggugagcggggugcgcggggugcgcggggugcgcggggugagccgggugcgcggggugagcggggugagccgggugagcggggugcgcggggugagccgggugcgcggggugagcggggugcgcggggugagccgggugcgcggggugcgcggggugagccgggugcgcggggugagcggggugcgcggggugagcggggugcgcggggugagccgggugcgcggggugagccgggugcgcggggugcgcggggugcgcggcgugagccgggugcgcggggugcgccgggugcgcggggugagcggggugagccgggugcgcggggugagcggggugcgcggggugagcggggugcgccgggugagccgggugcgcggggugagccgggugcgcggggugagcggggugcgcggggugagccgggugcgcggggugagcggggugcgccgggugagcggggugcgcggggugagcggggugcgccgggugagcggggugcgcgggcugagcggggugcgccgggugagcggggugcgcggggugagcggggugcgccauccugggucacggaaacacuccucuccugcaaaggagaggagauucacucccccaguuucugugaccccaaaaaggacccugaacccgacggugaacucacagcuugcucuuacucacgagaggagacguggaggggaaacaaggucgucccacugacagacacccccugggccuuguaauaaagaccgaggcgggcggaucacaaggucaggagaucgagaccaucccggcuaacacggugaaacccggucucuacaaaaaauguaacaaauuagccaggcguggugaugggcgccuguagucccagcuacucgggaggcugaggcaggagaauggcgugaacccgggaggcggagguugcagugagccgagaucgcgccacugugcuccauccagccugggcgacaagagcgagacuccaucucaacaacaaaacaaaaggaucgccucagaguagaacuucuggccgggcacggugacucaugccugccaucccagcacuuugggaggcugagguggguagaucaccugaggucaggaguucgagaccagccugaccaacauggaaaaacccugucucuacuaaaaauagaaaaauuaggucaggugcuguggcuuaagccuguaaccucagcuaccagggaggcugaggcaggagaaucgcuugaauuguguucccucaaaauucguguguugaagcuuugaucccccaggaccucagaaugugacuguguuuggaguugggguguuuaaagaggcgauuaagguaaaaugaggucauuagggugggcccuaaucuaacaggacugggguccuuauaagaagaggagaugaggacacagacacacacagagggacgacccugugggacacagggagaagacggcgucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggacgacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggacgacccugugagggcacagggagaagacggcgucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggaugacccugugagggcacagggagaagacggcgucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggaugacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugaggacacagggagaagacggcgucuccaagcccaggagaggggccucaggaggaaccagcacugcccacaccuggaucucagaccuccagccuccagggcugugggagaaucaguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggaguaagacaucucauaagaagaggagaugaggacacagacacacacagagggacgacccugugggacacagggagaagacggggucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacagagagggacgacccugugaggacacagggagaagacggcaucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggacgacccugugaggacacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcccugcccacaccuggaucucagaacuccagccuccagggcugugggagaaucaauguguuuuguuucuaagccgcccagccucugguauucugugacagcagccugagauggacuaagacaucucauaagaagaggacaugaggacacagacacacacagagggacgacccugugggacacagggagaagacggggucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggacgacccugugggacacagggagaagacggggucuccaagcccaggagaggggccucaggaggaaccagcccugcccacaccuggaucucagaacuccagccuccagggcugugggagaaucaauguguuuuguuucuaagccgcccagccucugguauucugugacagcagccugagauggacuaagacaucucauaagaagaggagaugaggacacagacacacacagagggacgacccugugaggacacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcccugcccacaccuggaucucagaacuccagccuccagggcugugggagaaucaauguguuuuguuucuaagccgcccagccucugguauucugugacagcagccugagauggacuaagacaucucauaagaagaggacaugaggacacagacacacacagagggacgacccugugggacacagggagaagacggggucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggacgacccugugggacacagggagaagacggggucuccaagcccaggagaggggccucaggaggaaccagcccugcccacaccuggaucucagaacuccagccuccagggcugugggagaaucaauguguuuuguuucuaagccgcccagccucugguauucugugacagcagccugagauggacuaagacaucucauaagaagaggacaugaggacacagacacacacagagggacgacccugugggacacagaagacggggucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggacaugaggacacagacacacacagagggacgacccugugagggcacagggagaagacggcgucuccaagcccaggagagaggccucaggaggaaccagccuugcccacaccuggaucucagaccuccagccuccagggcugugggagaaucaauguguuuuguuucuaagccgcccagccucugguauucugugacagcagccugagauggacuaagacaccucauaagaagaggagaugaggacacagacacacacggaggaacaacccugugaggacacagggagaagacggcaucuccaagcccaggagagaggccucaggaggaaccagcccugcccacaccuggaucucagaccuccagccuccagggcugugggagaaucaauguguuuuguuucuaagccgcccagccucugguauucugugacagcagccugaaacggacuaagacaucccauaaaaaggagaugaggacacagacacacacggagggacgacccugugggacacagggagaagacggcgucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggaugacccugugagggcacagggagaagacggcgucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggacgacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugaggacacagggagaagacggcgucuccaagcccaggagaggggccucaggaggaaccagcacugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggaguaagacaucucauaagaagaggagaugaggacacagacacacacagagggacgacccugugggacacagggagaagacggggucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagccaucucauaagaagagacgaggacacagacacacacagagggacgacccugugagggcacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggacaugaggacacagacacacacagagggacgacccugugggacacagggagaagacggggucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacacagagggacgacccugugggacacagggagaagacggggucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggacaugaggacacagacacacacagagggacgacccugugggacacagaagacggggucuccaagcccaggagaggggccucaggaggaaccagcccugcccacaccuggaucucagaccuccagccuccagggcugugggagaaucaauguguuuuguuuccaagccgcccagccucugguauucugugacagcagccugagauggacuaagacaucucauaagaagaggacaugaggacacagacacacacagagggacgacccugugagggcacagggagaagacggcgucuccaagcccaggagagaggccucaggaggaaccagccuugcccacaccuggaucucagaccuccagccuccagggcugugggagaaucaauguguuuuguuucuaagccgcccagccucugguauucugugacagcagccugagauggacuaagacaccucauaagaagaggagaugaggacacagacacacacggaggaacaacccugugaggacacagggagaagacggcgucuccaagcccaggagagaggccucaggaggaaccagcccugcccacaccuggaucucagaccuccagccuccagggcugugggagaaucaauguguuuuguuucuaagccgcccagccucugguauucugugacagcagccugaaacggacuaagacaucccauaaaaaggagaugaggacacagacacacacggagggacgacccugugggacacagggagaagacggcgucuccaagcccaggagaggggccucaggaggaaccagcccugcccacaccuggaucucagaccuccagccuccagggcugugggagaaucaauguguuuuguuucuaagccgcccagccucugguauucugugacagcagccugagauggacuaagacaucucauaagaagaggagaugaggacacagacacacaccaagggacaacccugugggacacggagaagacggggucuccaagcccaggagagaggccucaggaggaaccagcccugcccaugcccaucucuugaucuuggaccugcagcuuccaggacugugggagaaucaauuccuuuuuucuuuuucuuuuuucuuuuuuuuccucuuuuucugagauggagucucacucugucgccaggcuggagugcaguggcgugaucuuggcucacugcaaccuccaccucgcagguucaggccauucuccugccucagccuucugaguagcugggaugacaggcgcccgccaccacacccggcuacuguuuguauuuuuauuagagacgggcuuucuggccauguuggccaggcuggucucauacucccgaccucaggugauccgcccgccuuggccucccaaagcgcugggauuacaggcgugagccaccgcgcccggccaaauuccuuuuuucugaagccaccaagcugugggacuuuuuuauggcagucccagcagacagauccacccucguuccaaauaagguuaucgucauagguucugggggugaggucauagauguauguuuuuuuuuuuuuuuggagagagagucucucucuauugcccaggcuggagggcaguggcgcgaucacggcucacuguagccucgaccuccugggcucaagcgauccucucgggaggcuaagagaggagaaucguuugaauccgggaggcagagguugcagugagcugagauagcaccacagcacugcagagcgagacucugucucaaaaaaaaaaaaaagaaaaaagaaaaaaaauaggccgggugcguggcugacgccuguaaucccagcacuuugggaggccgaggcggguggaucacuugaggucaggaguucaagaccagccuaacgaagauggugaaaccccaucucuaugagaaauacaaaaauuacccgggcgugguggcgggcgccuguagucccagcuacucgggaggcaggggcaggagaaucgcuugaaccugggagguggagguugugagcugagaucgugccacugcacuccagccugggcgacaaaacgagacuccaucucaaaaaaaaaaaaaaaagaaaaagaaaaagaaaaaauuaacacacacacacaaauuccaugauaaacacaaaaucaaguucaaagcacgcacgccagugcugccucugcugccccuccaugcugcccacacccaaagcaccugccggccugcugggcacaguggaagucccuggcgcuccccgugucccgagcaccaggcagacagggaucccugguggucuuuccgcucccuuaggguuccagacuggggcugggagguccggaagucgcucccgguccugguacucagguggccugcagguggcccgcagguggucacggucucugugcagguggcacuacuggggugucccccccuggacgccaccccauauggcagccaccucucugcuucccagggccccggggagagcuuacagucccugguccccccaggacggcccccggucugugacccucucacccuuuaccccuagagugcgaccaggaggagggcgcaaacacacgugccuggcggacgucgcugcugaucgcgcuggggacgcugcuggcccuggucugugucuucgugaucugcagaaggugagcccucgagggcguccgcgagcgucgcuuguuuccagugugacccugaaaguuauucacagaaccauccugagaauuaucauuauuauuuuugugauggagucucgcucugucucccaggcuggagugcaguggcacgaucugggcucacugcagccucugccuccuggguucaggcgauccuccugccucagccucccaaguagcugggauuacaggcacccagcaacacacccagcuaauuuuuguauuuuuaguagagacgggguuuugccauguuggccaggcuggucuugaauuccuggacucaggugauccaccugccucagccuccuaaagugcugggauuacaggcguaagccaccucgccuggcccauauuauuauuauuguuaugauuauuauuauuuuuugagucuugcucugucacccaggcuggagugcaguggcucgaucucggcucaccgcagccuccaccucccggguucaagugauucuccugccucagccucccgaguagcugggauuacaggugugcaacacugcacccaacuaauucuuguauuuuuaguggagacgggguuucaccauguuggccacacugguguugaacuccuggccucaagugaucccccagccucggccucccaaagugcugggauuacaggcgugagccaccgcaccuggccccuugagaauuauucacaaaagaccaggggccagguccucucugcuagcugcccccugccaggaggucuguagagccaaagcugagggcucuggugggaccaaggguguccccaggguggaggaagcagggccgguccuccccugcccugcccagcgggccugacacagucagagggcgaaaggccaggcuuucuggucgggaaggggccugggcgaacgucacagcuguccacuuggaugggccaggauccgucaugcagaccaacucgagguuuuuggucaccagcugggucaccccagguccugucuccuuuuuuuuagagaaggaguuuugcuuuuguugcccagccuggagugcaauggcgccaucucgguucacugcaaccucugccuccuggguucaagcgauucuccugccucagccucccugaguagcugggauuacaaggaugugccaccacgccuggcuaauuuuguauuuuuaguagagaugggguuucuccguguuggucaggcuggucuugaacuccugaccucaugugauccacccgccucggccucccaaagugcugggaugacaggcgugagccaccaugcccggauaauuuuguauuuucaguagagacggaguuucuccguguugaucaggcuggucuugaacuccucaccucaguugaucugcccgccugggccucccaaagugcugggaugacaggcgugugccaccaugcccagauaauuuuguauuuuuaguagagauggaguuucuccauguuggucaggcuguucucgaacuccugaccucaguugaucugcccgccugggccucccaaagugcuggcauuacaggcuugagccaccaugaccagccaggcccuguuuccuuccugcugggcaucagagcuucacaaucugucaaaugggugccauggugacuucugucucccgggggaagggggaaaaggggagggggagggggaaggggaagaggggggaggaggggggaagggaggagggggaagggaggggggaaaggagggggaagggaggagggggaagggaagagggggaggagggggaaggggaggaggaggagggggaggagaggcgagggggagggugggggagggggaagggggaggaggagaggggaggaugaguggggagggggaaggagggagagggggagggggagagggagggguaggggggaagggguggaggagggaggaaaagggggaggaagagggggacgaggcccuuccugcaagcugucucaggucguaaacucagugaccugaggcaccaggggucugucuuugcagcugcaccccuggguggcuccgguaccagcgcccuacuccuuuaauuagacaccagcgccugccuaugaugauggucgggggcgugucagggccucaggggccgggaaaauagagaccccucgaguagaugacuugagucuuuugcucuguccuggcacugucuguccuggacacgcugugucccagaugaugagcuggucgguuuuggguucagagcugggccauuucucuuuccuccgagguaucuggugaugcagagacucuuuccccgcaucccucacaugaaagaccccaucggugacagcuuccaaaacgacaagcugguauguuguuuuuucugccuugggacgggucuggaggcgugguggccacuuugggaggcccaggcgggcggaccacuugaggccaggaacuggagaccagccuggccaacauggagaaacuccgugucuacuaaaaauacaaaauuagccgggugugguggcgggcgccuguaaucccagcuacucgggaggcugagggaggaggaucacuugaacccgggagguggaggcugcagugaacuacgaucgagccacugcacuccaucugggcgacaagagugaaauggccuggacuaggaggcuggacaccugucugcuggcgcuggugggcggcugggaaaagcugcaggaugaagggaguggggggacacugggcucccagcccaccgugaucacgggccgucuccgcacccugcacaccagagcagagcagauuuuuuuuuuuuuuuuuagauggaguuuugcucuuguugcccaggcuagagugcaauggugcgaucuuggcucaccacaaccuccaccuucccaguccaagguucaagcgauuguccugccucagccucccgaguagcugggacuacaggcacgcaccgacacgcccagcuaauuuuguauuuuuaguagagacgggguuucaccauguuggccaggauggucucgaucuccugaccuugugaucccccugccucggccucccaaagugcugggauuacaggcaugagccaccaugcccagccuaguuuucaacaaguuuuuagugauaccugugucccuaagagaaaggaagggcagaggaaaaggaggcagacaucucugucagaguuuuuuguuuuguuuuguuuuguuuguuuuuguuuuugagacgcaguuuuguucguugccccggcuggagugcaauggugcaaucucggcucacugcaaccuccaccuucccgguugaagguucaagcgauucuccugccucagccucccaaguagcugggacuacaggcaugcaccaacacacccagcuaauucugcauuuuuaguagagaagggguuucaccauguuggccaggauggucuggaucuccugaccuuaugguccgcucgccucggccucccaaagugcugggauuacaggugugacccaccgcgccuggcccaaagugcugggaugacaggcgugagacaccaugccuggcccacagagcagaucugagaugggacaggcccccgcagaucaggacgugggcucuguuaucugggggguggccgacucacccugccuccucucgucucugcagguggucugggaggcgggcaaagccggccuggaggagugucuggugacugaaguacaggucgugcagaaaacuugagacugggguucagggcuugugggggucugccucaaucucccuggccgggccaggcgccugcacagacuggcugcuggaccugcgcacgcagcccaggaauggacauuccuaacggguggugggcaugggagaugccuguguaauuucguccgaagcugccaggaagaagaacagaacuuuguguguuuauuucaugauaaagugauuuuuuuuuuuuuaaccca

SEQ ID NO: 192464 - RNA, 34498 nt, Homo sapiens
cccuccucccccgcgggguugcacacugcggaggaggccgcgcgugcgcgcccgcugagcccccgcggcggggcguccccgaagcgggcgcugacaccgcagugcaccggacgccgcacgcucuuuucgcgaggugaccccaaggcgcggaccccgcgcaaaccaaacgaaccggcgccuggggaggcugguagcugcauaccuugcagauuccgaggaggaagugcaggacgagggcgugcugcaggccggaggaggcgccucggggaaggcguggggcuuucccgaagggauacgcucgaaggagcucugaggugcuucgaucccgagcgacuccccgcagacuggguagcaccgccccuguuaggaugccgucuguuuacaaaaaaaaccguuugcucuaggacgcgaccugucucauacacacacagucuuaaaaacugcuuccagaucccuucgggcuggaguuuuccaguaaacgggucacacccgcagcugagcgugcagcucacguauggucaggaugacucaggugaucauaggugacuccaacaccauauguaagacuggacauucuucauuuaaauuaaaaaaaaauuaaccugugggucgcugacuuuuccugaaucugaucaagagaauuuggcuuuauaaauauuuuucuugucacauuuuguuacauugcaacggaacaacagggugcccuucccuccuuuugucugccccaaaugaugagguagaucugaagugagugagguuauggaaacagccagcuuuuguuuuauuuuuugaguugcaaugcgccucuaagaaucuugccucgauaacaaauguauugugaacuuuucaccaaaaguaaaaauaaagucacuuucuaauuuuauuuacguauuuuuagaauuuacuuauuuuuuuuaaccuguugucucacaaaaaucuggaucuaauuguguuuugauuaccuaaucggccuacuuagccuuugaggguauuuuuaaaauuuuaugaguuuaucauagaauuaaacuucuacauguuagaauucagaggugaucagggugaaccucuucuaacccacccuuuagcaugaauucuaauagcuuuaguaaccucauaagggcuggcucaauuaggaaguuuuucucugguuugagcccucuuccaauacuucgcugaucuaaaucuugccucguggagcaaggcacauuauaaaaauuccuccggaugaauguugaccauccccuucccccuucaguucuuccauuuacaguucucaucucuuuguccuugcccagcauuguuuuuucugaucacucaucauccuuguugccguuugggauggagcacccagaagugaacaggcucuuguggaagugguuggaugauuaucaaguuccaaguugcccucuuugucuugaauccuguugcaaaugaauucccuggcaggcuuaguauuuuuggcauguugcuuugcugacucacaguaaccuugcagucaacuaggaccuuucacgugaacuauuaugaaguuagauuucauucauugugcagauaauugcaugacuugaaguguaggaauuuacaaugaccauucuuaaaauuucucucguucauuuggccuuaaguucaaagcuguuacaagcuguuacccaccauguuuacaguuucugcuaucuaucaguaagcaggaggucuaauaagaauugccuuaaacuggccgggcacaguggcucacgccuguaaucccagcacuuugggaggcugagccgggcggauccccugagguaaggaguucgagaccagccuggccaacauggugaaaccccgucucuacuaaaaggacaaaaauuagccgggcgugguggugggcuccuguaaucccagcuacuuaugaggcugagcagcagaauagcuugaaccugggaggugaagauugcagugagccgacaucgcgcuacugcacuccagccugggcgacaagagcgagacucccaucucaaaaaaaaaaaaaagccuuuuaacuuucgaauuuuuguaaacauugaccaagguggggccagauucagcgcuguguggcacaccucuacccuucccucuaguuugguuaucaguugacaaacauucaaccagugauccuguaaucuuacuguccuucgugacaucucuaugucuccucgccccaugaguaacaagugaaaacaguggaguaaaagacuuggaaaaaaauuggagagguggagcaaagaaaucuuuccuuggagcaaggaaaagcaagaauugaagaaaaguugcucuacuggucaguaggguuaagagauucaaaagguaguguggaaauaaccuacaaagaaaccacuggauccuuaacacacauuaaaaaaugaggugaauaauggguagggaggauuaguuacuuugguuugaaccauucuguuggaacucuucuaguauaaugaugacaaaaaaauaaucaucagcuucuuacucugugccaggccuuuuacauguguuccucauguuaauuccaugaaggaaggugccguugccaccaucuuaaugaugcggggcuaaguaaauugaagcuaaauaacuuacucaggcaaguaguagagccagaauuugaauccacaaaauuuacuugggaacacaaacuguuaacuacugugcuauaauguacuuuagccugcauaauauuugaagauuuauacgcaacuuggugguccugucuucuugagggugaaggagauacugcauguguauggauccccacucaauuugcagugauauauguagguuauagcuaguggaaaaggauagucaucugcagggccucccaguuucaucaguccucucuuuagucaugcuggcuuauuuccagacauuagauuacaccuugaccucccuucuccaguaauuuacauggagauaaaaauaaugucuauuuuauaaaauaagaccgauuuggcugggcaugguggcucaugccuguaauccuagcaaucugggaggcugagaugggcagaucaccugaggucaggaguucgagaccagccuggcuaacaugugaaacccugucucuacuaaaaauacaaaaauuagccgggugugguggcgggugccuguaaucccagcuacuugggagacugaggcaggagaaucgcuugaaccgaggaggcggagguggcagugagucgagaucacaccauugcacuccauccugggugacagagcgaaacuccgucugaaaaaaaaaaacaacaaaaaacacaccauuuauuuuugugucacccuauuuaaaaaaugucucuuuugaugauuuaaacagucuucaauuccccacuuagauauugcaaccuuggauguguuugccccuauugauuucugcccucuuuaguaugauccucagcagucacaaucaugugugugaaacauugcuccuaauaacauagguguuuccccaguuggccuauaaggcauuuuagggaaaggaccaugcuguucucuggagcccugacaccuaggacacaauuggaauuuuagugcuucaguuagaucuacucuaccacccuuggaguagaaauuauuuauaacacuuuuaaaaugagggaaacuaaagcuucuuggugauaaaauguuuuguucuaagucacaaggcagaaaaguacagucaugacuugaagucaaacauaaucuccaggaugguggacagaggaagugugaggguuuugaugauggacaaguguagaaaauggguaagaagaccccaauauaugcaggaauaucagugcuuccuagcaguacaaaauuggauauugacuuaaggcuugucugaaguugaccacuggguaagcccuagccugggaaccuggcccagguccagggucccuuucaacugaaaauagagaagacugcuucagcuaauuuuagcucaggguuucaaagagguacauacugccuguuucuuggagguguugggacuugcugguuuggggauuuuuacucuucuuacuuuaucaucaaaaacaguguaugaaaaaagcacuuaugaaugccauuucauuucagucuuguaauaaguggcagauauuccaauuuuauagaagaccacucagguuuagaaagauugaaagugacuugcuugcucaggucuucucaccaaauaaguuuguacucuggaauuggacaaccuugacuuuaaacuuuggccugccacuuaguggcugacuuauccucucugagcuccuuguuuaaaaaaugauuugaugaaaguuaauucacagaguucuucuugugaggaugaaauugugucauuuuauuccugacauccaguagguacuuggugacuuguaguuucacuuuccuuucuucauuagguugaggaacuacuagauguacuccuuuucuucuaagaaauuaaaauuuaacccauuuggguugcuaucagucagguucauagaugggugucuaguagcaagaauagaugccaagacaacuaaaucaauauugaaggucuugcuaggagaaugcagcuacuucuagaugggucuucuuugauuuucuggugccuggcacagaugcuuguuuucuuaagacaggaauuggaucuucgcuggauugauaauagcccaguaguuucuuuuagguuggauauugaagcuuuugcaaaggaaauuguuuuuugguuaauuaauuacgauacaguccauugccccgucagugcuugcaaccaauuuuuaagccaucugcauagcucuaauuucuuuucuuuucucuuucuuuuucuuuuuuuuuuuuuuuuuuugagauggaguuuucacucuuguugcccaggcuggagugcaauggugccaucucggcucaccgcaaccuccgccucccggguucaagugauucuccugucucagccuccugaggagcugggauuacaggcaugcgccaccacaccuggcuaauuuuguauuuuuaguagagaugggguuucuccauguuggucaggcuggucuuggacucccgaccucaggugauccgccugccucggccucccaaagugcugagguuacaggcgugagccacugugcccggccagcucuaauuucuaaaaguuuauuucuuagcuaagguagucagcagaucuugugaacauaaaugacugaaaaugggggcccuaggaaagucuuacuuccaaggaaaaacaucacuuucuuaucuuuuauuuuccugagauguuagaugugaauuuaguacuuaagacacuauuuuagagaagacaaauagcugugagaucuuccuuuggaauuucauugaggacuaagaauauuugucuuuguaaaguguccuauugugaguggagacaucugugaaaaaguagcagugugcuaauaccuggaauuuuuaauguggacuuaagaucucuaaaguuauauaaagacagcacaaugguuuuauccaguaacaugacacuggcuagguuucuagguuaaguugguuucucuuuggauucacaggguauuaaugauauucuggcgguuguaucgaugaaaucaucaaucuuuaaaacuaugggccaauuuguguuugaauucacugauuguagccauuuugaaacuucaaugugcaaauaauugcuuggagagcuuguuaaaauugcacauuccugaggauguguucucgucugggcagggccuuggaaacauguauucugaaaaagcaccagcuaguuuugaggauauguauuuuacauaauuucucugggugaugaaaauaaacucgaaguugggaaucuuucuucuuguguuuguaguuuuggaguuuuuagauuuuagaauaaaugguagaugaaaacuaccuuggucacuuugucuuccagggagcacagaugaaguaguuggcuuguggcaguguucuucaaacuuggaugugcaucagaaucaccaagagggcuuauuaaaguuucugauccaguagaucuggagcggagccugauaauuugcauuucuaacagauucugggugauacugaugccccuaguccagggcccacacuuugagaugguugguuuguaguuagggaccauguugcaggaaaaauauuaauugcaggauuaauuaaggugagaugcacauagcaagagagcauauggacaguggguuuaacugggaagagcagauuugcaccucucaccucaugaucgaguccaggcauaggcuucaugaauaaaacaguggauggaauugucuacguuagugauauuuuugucuuaaaaaucaagugcauauaguugaauuuauguauguuaaauuugugucugggcugggcacgguggcucacaccuguaaucucagcacuuugggagguggaggcgggcggaucaucugaggucggaaguucgugaccagccugggcaacauggugaaacccugucucuacuaaaaaaaaaacaaaaaccaaaaacaaaaauuaaccaggcgugguggcgggcgccuguauucccagcuauucaggaggcugaaggaggagaaucgcaugaacccgggaggcggagguugcagugagcugagguugugccacugcacuccagccuggacaacagagugagacuccaucucaaaaaaaaaaaaaaaaucgugucugaugaaaaacauuguguguuucuuggcauaguaggcaccuguuuuaucuucccuucuggguugcacucaaaccccuugagaguugugguugugcuuuccuccucagaggguuuguuucuuagccucaauauauauaauuggugcuuaaaaacacaucugauaucuacuacaugacagacuaaaagugacucuaaauuucucugccuguuuuuuuuuuucuugccuaaagacggcaaugucugucuuuuugggauuguuuuggccucagcauuuugcuuuguggauuuuuguuuaaaaaugauugauaggcccggugcgguggcucacaccuguaaucccagcacugggaggccaagguggguggaucaccugaggucaggaguucgagaccagucugaccaacauggugaaaccccaucucuacuaaaaaaaaaaauacaaaaauuggcugggggugguggcaugugacuguagucccagcuauucaggaggcugagacaggaaaauugcuuggacccaggagguggagguugcuguaagucgagauugugacacugcacuccggccugggugacagagugagacucugucucaaaaaaaaaaaaaaaaaaaaaaaaaaaaaugccaguuuucagaaggguuguggcgguuauauaaaauugggaaucacauuuugacaauagcucuguguagagggaauuagcuucagccuuacuguuauucugguauagcaugcauucuucuagcaucuuuaacaccuauaaagagcgagucagaagaacaaguagugagucuggauuucuuaagagcugcuuagagaugaauggcagaaugggguagagaagggagaguauugaacuggggauugguuaguggauagccacauaugucuucugggaacaccaaaacagaaaggugugggagcaagggcugugaaacgaucccuguuuugagauaauuuaccuuaucuaccauucuaaauguuacaucuguucuggauuaaccugugcuucuagccaaguguugggggaggcaaaugauaaauucauuguuucuaggauugugucagauaacuauaacaggaggcaaagaagagaccagaaccagauuucuucauggccaguuuguuugagcaaugaaguuacuuaggagcauuuuuuaguccuuuuaggaaaauacuggaaaaugaaaagcuuuaggugugaggaucuccaugugcucagaauauccaagccagugaaauccuucucacuuaauuuuuucuuucuuugagaugggguccugcucugucuccaggcuagagugcaguagcaugaucauggcucacuacagccuugaacuccugggcucaagugauccucucgcuuuagccuucugaauagcuggcacuacuagaggugcugggugcaaaccacaugcagcaaguuuuuaaauuuuuuuguagaaacagcauuaccuuauguugcccaggcuggucucaaauuccuaggcucaagcgacaauccucccaccucagcccccaaaguacuaugauuacaggcaugagccagugugccgggccuaucucccuuuuuaaaucagugggaguuacaugugcuuugaacuuugcggaagcaggacgaauaaugggaaauaaggaaauacuuuauuuuuugcuuuugguguaagcaaacauuucauaucaguauccuguuucuaaaguuaauggcuuuacuguugagauuugcaaaaauaaaaaauacguauuaucuuguaucuaauuaugugauuuuccuccuauuuucuaggaggugugauugccuauaucaguucuuccagcucagccucaagcccugccucuugucacagugaggguucugagaauaguuuccaguccuccuccucuucuguuccaucuucuccaaauagcucuaauucugauaccaaugguaaucccaagaauggugaucucgccaauauugaaggcaucuugaagaaugaucgaauagauuguucuaugaaaacaagcaaaucgagugcaccugggaugacaaaaagucauaguggugugacaaguaaguuacuuugguuuucuaaagauugcugccauuaauugcaaauggggcuuauuuuaucagcuuuucauuuagguggccauuauguuucuggguacaguuuucacuccuugcuggguaaucauacaucaguaguuagggaagaaaucagugaugaugauagaaguuauaaccuaggggcugucauuaauucuugccucagagcaagacaugugauuauguacucugccugacccuggucccucuaggguacccucuuuuacuacauuucacaguuacuuuucuucugaacuacuagaacuaagucuuguuucuagaacagaguacuugcucauugugggaagggguuacguuagugaaacuggauuugggaauauuugggaugaggaaauguuggauugggauaaccaaaugaguagggggauuuggaccuaucuggccucuguaggugaaguaaauugacacagcugccuguggagagauaucccuuuccaccuuuuauugauugacuucucugucugaauucuuaauuguuauccagagaauuguuuucuuaguucugguugcauaucugguauaaaguaacucuaaauuuacaaaauuucuuauuuccugcugacaggucuggaaaaaaaauaaauuuacaaaauuucaguguaauucuaaaaucaggaaaggaaaaauccgggucagcgagguauuuuugucagugccauaaguuguauuuaaaagaaaauuauggcugggugugguggcucacaccuguaaucccaauauuuuuggaggcugaguggggcggaguccaggaguucaagaccagccugggcaacauggcaaaaccccaucucuacuaaaaauacaaaaauuagcugggugugguggugcaugccuguaguagucccagcuacuugggaggcugaggcaugagaaucacaugaaccugggaaguguggagguugcaaugagcugagaucacgccacugcguuccagccugggcgacagagggagacucuaucuuuaaaacaaaacaaagcaaaacaaaaaaaaaacaccguaagaaaauuaugauugugauuacuuuugauuugaaaauauuuuucuuuuacauuaugaaaguagauguguaucuucuaaaagcucuuacacguugaaugaaauaaaauaucuaauuggaaagaaaacagacucgguguuuccuccuacuuuuuacuucguguccuuuuguguccuagaauuuaguggcaugguucuacuguguaaagucuguggggauguggcgucaggauuccacuauggaguucaugcuugcgaaggcuguaagguaaagcaugcuuuuguuucuuuaagcuacugauucugggauuuaagaaguuggguuuagauuuacccauuugugcaauugauagucugagagacagugagaagucagcugcucuuuuuaaguuuuaagcauuuuauguaguguauaagcauaacuuguuuugaauaauauucuuaauucagugaaaguauuucuuuuuucuuuaagauuuugaacaaaguaaauuugcuaucucaauuaaacauacuuauuguguuaaaccaagugcaccaaaugcucauucauuaaugugucaagcacaguucuaggugguagugaaauaacaaggaacaaaacagagaaggcacuacuucugccuugugggaacuuaguuuaaaccaaacuuugaauuaggaucucaucauauacuuugacuuaaugacacgucagguacugggagcugggaauaauugcuacauacuugaaaaaaaugugguaucuuaaaaaauaaugccaagugaguaaaauaauccugaauauaaguugagcccuugggaaagcuaguuuauuuguaaguuuaguugacuauuuucuaguuauugcuauuagaguauuggucaaauaauuccaagugagauggucucuaccucccuaccuauauacagggaaucuuucucucuuuuuaaaaaacuuggcacaaucuuuucuccugaguaucaaaaauuaacgugaugaagacacauguucuugcuguucucugacuugaggccacaagcaagaaucuaguuuggcgagauaugauggguaaacaagauaaugaauauacaugaugggagaggaaauauuuucaaguguggcucugaaugaauugcgaguuugccaguuuuuuuuuuuuuagauggaguuuugcucuuauuucccaggcugaagugcaguggugugaucuugguucacugcaaccucugccuccuggguucaagugauucuccugucucagccucccgaguagcugggauuacaggcacacgccaccacuccaggcuaauuuuuguauuuuuaguagauucgggguuucaucacauuggccaggcuggucuugaacuccuaaccucaggugaucugcccgccucggcuucgcaaagugcugggauuacaggcgugagccacgcgcccugccaaguuugcuaacuuuuaauggccggguaacuuuguaagacaagucaguauuuuuuauagauguagcauuuuuuucauuguuuaaaaaagauucuccuucucuauauaucuuuuuuuuuuuuuuuuuuuuuuuuuacaaaaaugugaaguaauaggccaggugcgguggcucacgccuguaaucccagcacuuugggaggccgaggcgggcggaucacgaggucaggagaucgagaccauccuggcuaacauagugaaacccugucucuacuaaaaauacaaaaaaaaaaaaauuagccggacguaguggugggcgccuguagucccagcuacucgggaggcugaggcaggagaauggcgugaacccgggaggcggagcuugcagugagcugagauugcaccacugcacuccaagccugggcgacagagccagauuccgucucaaaaaaaaaaaaagugaaguaauauuggggaaggcauuauucuuacuuuauagcuagaaaauaaaagcacaaacugaaugagcugauugcauauucuugauaaauacacaucugugcaguacucuuaaaaugucuaguucagcucuuguaguaucuaagucaaguguauaguaucacaauaauaaaauauaaaaauguugugucccaugacuacuuaguauagauucgggaaauguguuuaguugucauauaaaaggaaaaugcaguuuaaaauaauuucaguaauugcauucuugaguuuucuguccucccugguaccaugaaacuggagaucuuuggagaccuaucacagaacauguacuggaauuguuuguguguggaguaaaggcagcuguuuguagccaucuaguugggaacugucuuuccuuggauaguuagcuacucuguuggugugugguguaacacuuaccuguugcuggcacguagucagugauuucugucauguauaaguaggccuugccauugucagcagguaaugauccuggaaagaccaacuucuguuaauguaauccacaaucuagugaggggauuauagcuaucaaacauauuucucaguccacuuuuuaagaaguagucauuuaggcugggugcaguggcucaggccuguaauucuagcucuuugggaggcugaagcuguaggauugcuugagguggagugugagacccaccugggcaacauagggagacccuaccucuacaaaaaauaaaaaagcuggaugugguagcacaugucuguagucccagcucuugggaggcugaggcagaaggauugcuugagcccgggaguucgaaguugcggugagcuauuauuacgucauuguacuccagccugggugacagagcaagacccugucucuuuaaaaaaaaaaaaaaaaaaaaaaagccuggacaugguggcucgugccuguaauccuagcacuuugggaggccaaggugggcggaucaguugaggucaggaguucaaaaccagccuggccaacauggugaaacccugucucuacuaaaaauacaaaaaauuagccagguaugguggcacgugccuguaaucccagcuacuggggaggcugaggcaggagaaucccuugaaucugggagguggagguugcagugagcugagaucgcaccacugcacuccagcccgggcuacagagcaagagucugucucaagaaagcaagcaaacaaacaaacaaaaaaucagguccggaguggugguggcuuacacccuguaagucuaacacuucgggaggccaaggcuggcagaucacuugagcccuggaguucaagaccagccuaggcaacauggcaaaaccucauuucuacaaaaaauacaaaaauuagcugggugugguggcgcaugccuguagucccagcuguuugugaggcugugguuggaaaauugagccagggaggucagggcugcagugagcugugaucaugccacugcacucuagccugggcaacagaacgagauccuaucucaaaaaaaaaaaaaaaaaagaaucagucauucauacuucaagaguuuuggaauuuguagugaauaaaaguaugagauggaaaaugugacugcaggcagggucugguaacaggguagugugguuguugcaagggguguuuuggguaaggacaaagaaucucugaagggaagaagaauuuuguuugguuaguagguguuaggugcuuacucauaccaauaagaaucgaaauuaaauucugugugucaacauuguauuucccucuguccuaagacauaguguuucccagauagugagucauauacugggacuguaguucgucauauacacuagauagguaugggagcaguguuuauaagaaguucauuuggguguuuuuaaauggguaaguaaaucuuccuuuguucuuaggguuucuuucggagaaguauucaacaaaacauccaguacaagaagugccugaagaaugaaaacuguucuauaaugagaaugaauaggaacagaugucagcaaugucgcuucaaaaagugucugucuguuggaaugucaagagaugguauguucccaguuuaaagaguguuccuaaaguguauggagcuuggcuuuuauuccucaucaugaaccagagcuauaaaccgguuaccaaggacccucuuguauuuaaggugaagcagaaaacauauuuucaugcuuuacaggacaccaaauugauuaaagucguauuuuagcauuaucaucccagaaacaguuuuuggcuaaacuucuguuguuguugcuucuucuaaaaagagccauuuuuuuucugugcaauuugauuacuuuuuauuuuuuccuaaaaccaauggaguuuaaaaacauuuuuuauauggccgggcaugguggcucacgcccguaaucccaacacuuugggaggcugaggugugugggucacuuuaggucaggaguuccagaccagccauggugaaaccccauaucuacuaaaaaugcaaaaaaaaauuagcugagcgugguggcaugcaccuguaaucccaguuacucgggaggcuaaggcaggagaauagcgugaacccaggagguggagguugcacugaguugagaucgugccacugcacucuaaccugggugacacggugacacucugucucaauguagccucuaucucccagguucaagugauucuccugccucagcuuccugaguagcugggauuacaggugcccgccaccacaccuggcuaauuuuuguauuuuuaguagagauggggguuucaccauguugaccaggcuggucucgaacuccugaccucaagugauccaccugccucggccucccaaagcgcugggauuacaggugugagccaucaggcguggccaggaguuuuuugaguaacagauuucagcaauugauguuuuguuuuuucaauucccugaaauuuuuuuuauagugcuaaaaguacuaaugcuauaaaaauaguugauggauauugugauugcccugaaagaauaaaacugacaaucauuugugaagggaggaguagagauaaaguaucaaacaugauuaaguuguuuguuuuugguagcaauaauguuagaggcuacaauuagauuaacgaggcuuucugggcaaguauacugaauuuuuauuaucucuguguaaauacuagacugugaaagaagcuuuucuuucucucauggauaggauuauuggagacaagacaccuucuaagacuagcuucuaaaagaauagaggaugacuuaucucauuuuuacuuauuucacugguuuuaauuaaaaucuaccaaguuuauuuuucaguaagugcauuucuacugauuguggaauuuuuuuuaaggauuuuuuuuuuaaagaggcuggaaaagaagacagcagauaauuucauaguuagaucuugagagcaaaguuacaaaaaugaauugacaagggccagguguucagggaaugauuucaccuaccagauuccauuaaugguaauggauguguguagcugaaucacacaugccuugcugggaacaguccucagcuuuguuaguaaggagcuguguaguaauacuggucugcuucaaacugguuuucauuagcuaauuucauauuucuuuuuucuuuuucuuucuuuuuuuuuuuuuuuuuuuuuuuuaagauggaguauugcucugucaccuaggcuggagugcauuggcaccaucucgacgcacugcaaccucugccuccuggguucaagcgauucuccugccucagucuccagaauagcugggacuacaggcgcccgccaucacaccuggcuaguuuuuguuuuuuuaguagagacgggguuucaccauauuggcuagucugguuucgaauuccugaccucaggugguccaccugccucagccucccaaagugcugugauuagaagcaugagcuacugcacccauccgaauuuccuauuucuuuucuuagacuuugcuuauaaaauaccuaggagguagauguccuuaacuuuguuguggggggaaaauagaaaauuuucucucccucuccuacuuccuuuggugcaucaagaccagcaaguuuagaaaaauguggaccagagacauguagacucauucuuuauauguaugacuagaggccauaacuguuggauaauuuuguguuauucuuuuauacaaaacaggucuuauuuagaauauagacguuaaauaucuuuuucuucaauagcuguucgguuuggucguauuccuaagcgugaaaaacagaggaugcuaauugaaaugcaaagugcaaugaagaccaugaugaacagccaguucaguggucacuugcaaaaugacacauuaguagaacaucaugaacagacagccuugccagcccaggaacagcugcgacccaagccccaacuggagcaagaaaacaucaaaagcucuucuccuccaucuucugauuuugcaaaggaagaagugauuggcauggugaccagagcucacaaggauaccuuuauguauaaucaagagcagcaagaaaacucagcugagagcaugcagccccagagaggagaacggauucccaagaacauggagcaauauaauuuaaaucaugaucauugcggcaaugggcuuagcagccauuuucccuguagugagagccagcagcaucucaauggacaguucaaagggaggaauauaaugcauuacccaaauggucaugccauuuguauugcaaauggacauuguaugaacuucuccaaugcuuauacucaaagaguaugugauagaguuccgauagauggauuuucucagaaugagaacaagaauaguuaccugugcaacacuggaggaagaaugcaucugguauagugaaaucgauuuuuugcuuacauuguaucagggaaagcuuugaaaauuuucuuuuauucgggagauaugcuaacuuggggggauggugucaggaaaccuaagaaauuuacagacuuaauuuuguacaguauuuuaggucaaauaauuuuaauaaacaucuucugaugaaugaccuaauuucacacccagcuagguacaagcaugugauuugauugaucugagauugggauuaggauuuuauguaaaauaugauucaugcagaauugguccuuuaauucuuggaaaucccuuugaaaauuuaagcauucugguuaauuaguaccuuacuagcuuugggauuuucucaaagggccgaacuuuucgcuugccauaguuagaaauucuuugauuucuauagaaagagguuuuuuuuuuuuuuaaccauuauuaugcaagaaggucuuuggauauagaacauagauguuuuauuguuugauaaauuuaggaguauuuuaauuucauaggcuaauuucuaaggauuuucucagacuucaucuuaugagaugacuuaauguuggucauaucauugaagcuuuucuauuuuuccaucaaauacgacauucuacaucaaaguacaguguucauauucagccaaaauuucaccaaaaacagcaguaccacaccauuuccaguuuaaaccaugaaguccuuugauagugcuugguauuuucuacugacagguaauuaaagucgucuuuuucauuuucaaaauaguugacucuaccucaaucuucauuaaaauuuuuguugucacuuggaguuauuugauucuguggaccuuauguuaggcuaagucguugcuuuuuuguuuuuuuuuuugagacauucuugcucuguugcccaggcuggagugcgguggcgcgaccucagcucauugcaaccuccaccucuuggguucaagcaauucucaugccucaaccucccaaguaguugggauuacaggcaugcaucaccaugccuggcuaauuuuuguauuuucaguagagacagguuucaccacguuggccaggcuggucuugaauuccuggccucaagugauucacccaccucggccucccaaagugcugggauuacaggcaugagucaccacgccuggccaaguggcugccuuaaugaaggaaaaaucugugggcauuuugguucugauuucaugauauucucuaugguuuuguaaucaucccauuccuagauuuuguauggauuuagugaaaauuuaaaggcugauuuuacuaauagaauauacagguguguuucaucaucuuuuugguguuuuuuuuuuuuuuuuaauaacuucuuggcuuccuauuuucccucacgcagucgucauuuagaagacacaccuguaucugcaguccuuguuuccugauugaacaaguagaagucagugaucacagcauuguuuuugaaauaaaugggcagugacuuuuuuuucuuuuuuuuuuuuucgagacggagucucacucugucacccaggcuggagugcagugguaugaucucggcucacugcaaccuccgccucccgguucaagugauucuucugccucagccuccugaguagcugggacuacaggcgcaagccaccacgucuggcuaauuuuuuuaauuguugguagagacaggguuucaccauguuggccaggcuagucucgaacuccugaccuugugauucgccugccucggucucccaaagugcugagauuacaggcgugagccacugcgcccggccaggcagugagugaccuuuucaacaaaaugaggcaccuugcuguuuuuucuucuuggaaauuacaacauuguaauucuaccuauauagaaauaaaggaguuuggaaauauuaacuaaaugugaauuugggccuaggcuugugacuucuggcuguguuggacaaaucacuaaaccucucagagucucauuucuccaccuaagaaauggaaauuauaaucugccaugaauaauagauugagaaucaaacaauugaauuuguuugcaaaauuauaaaacaccauauacuagcauaagguggcagcaguguuacaaaauaaacucuuaaaccugugcaacagguguuugaaauagcuuguuauagaugauauuuuugcuuaggcuuuuuuuuaaugauaaguuaauugcuauuuauauuagguugccaagaggcuuucuacaguauggugggcagcaaauggaugaagugcuaauaucucaguagauuuuacuuguguuuuggggguuaaauucauguugggguuucugauaauugagaugcugcuuuugacauuucuuuaccaccucuuaguauuuaagaguuuuuccguuuuauguauacuagguuuguccauugaguaagucuccauauguggauccucauaaaucaggacaugaaaucugggaagaauuuucgaugagcuucacuccagcagugaaagaagugguggaauuugcaaagcguauuccuggguucagagaucucucucagcaugaccaggucaaccuuuuaaaggcugggacuuuugagguagguuuuauuuauccugaauauugaugcaggcagggcauguaguauuuuauuuucauggauguuuuaauucuuuuuuuuuuuuuuuuuuuuuugagacagaauccugcucugucacccaggcuggagugcagcagcgcgaucauagcucacugcaaccucugcuuccuggguucaagcauucuccagcuucagccuccugaguagcugggacuacaggugugagcuaccacgcccggcuaauuuuuuuuguuuuuuuuuuuuuguagaaacaggguuuugccuuguggcccaggcuggucucaaacuccugagcucaaagcgaucugcccacuuuggccuccuaaagugcugggauuacaggucugagccacugugcccggcagauguuuucauucuuuucuaagucaguauuuauaguccagagucugaaacuaucaacaaaauaaucaucaucucaggauuuugggaacagacuugggagacuugguaaauccagaauuguuuaggauuuuauauauauuuuuuacuuauuauuuaggauuugaaauauagguauucuguaucuacagcauaugaacuccugaguucuaguauugcuuuuagauguggacuuaacaaguuucugcaguguuagacaccuccugaaagccuagccuagcauuuacuguauucgauacagaauaagaagggcaaauagaaugugauuucguuuuucgagagacuguagaauauuuuggggauauaucagacauuucuuaugugccaccuuagcucuuccugguuucaccuugcuucaggauccuuggcuacuuuucugucccgcuucucuugcaacacuguauccugcuugggcuugggguagucucuacuguauaacuuaacagaugugccucuccugguccuuaguuaggugucuuucaccuucugucugccccagggcaucccuuuugcugccaaggugugagaugccuugggaccuaauuaaggacaacucugagauugggguggugagaggaaguugauguuuggugggccaaaucuuugaaccuuuuauggauggaagaagugagccagggcuauauuuucacuucucccuggauuuauuauaacggagggagugagauaacuaaguaauauaauuguuaaccgauuuaacuuggaugucaauuauaacauggugcuuagaacacuuacugugauagcuuucuuuguggauagucucuuuggguguugguuucuugaagcaguucaguuagacuucaucugcuuccuuugccuuggcugcauuugauguguugauguuucgaaguguugcugcauuggaauuuugcucuuuuuacuuaaggcauagaggccauguguuauacuuggcagccuaaagagauucuuuaaugccuuuggccagggcccaguuuuaaauuuacuggcacuauuucuugcucuaauuuuauauugcauuucagaaucuuuguuaauagaguggcagaguaucuuugccaugaguggcuagaauuucuuuugauguucuucuuggaguauuuauugcuuugguagagaaucugucuuaagaaagugguuuugggaccgggugcaguggcucaugcuuguaaucccagcacuuugggaggccgaggcaggccgaucacuugaguccaggaguucgagaccagccuaggcaacauggugaaacccugucucuacaaaaaauacaaaaauuagcuggguguggugguauguauuuguauucucagcuauucaggaggcugagguggaaaggaucacuugagccggggagguucagguugcagugagcugugauugcaucuccggccugggcaacagagcaagacccugucucaauaaauaaauaaauaaauaggccgggcgcuguggcucaugccuguaauucuagcacuuugggaagccgagauggguggaucaccuaaggucacgaguuugagaccagccuggucaacauggugaaaccccaucucuacuaaaaauaaaaucagcugggcgugguggcgugugccuguaaucccagcuaguugggaggcugaggcaggagaaucgcuugaacccaggaggcagagguugcagugagcugagaucgugccacugcacuccagccugggugacaagaagaaaacuccaucucaaaaaauaaaaucuggcaugguggcucacaccuguaaucccagcacuuugggaggcugaagcggguggaucaccugaggucaggaguuugagaccagccuugcuaacauggugaaacccugcuucuacuaaaaauagcaaaaauuaguugggcgugguggcgcacaccuguaaucccagcuacuugggaggccgaggcaggagaaaugcuugaacccgggaggcggagguugcagugagccaagaucaugccauugcacuccagcucgggccacaagaacgaaacuccaugucaaaaauagaauagaauagaauauagaauauagaauagaauagaauagagugguuuugaguaaaaguauacccuguuuuucuuuuauaacuuucuuuuauaugugggaugauucauaacugacuugauugaauacuaaguuauuuuuuuauuauugcuguuagacuucuccaaauacauuucuuuuucuuuuuccagguuuuaaugguacgguucgcaucauuauuugaugcaaaggaacguacugucaccuuuuuaaguggaaagaaauauaguguggaugauuuacacucaaugggagcaggggaucugcuaaacucuauguuugaauuuagugagaagcuaaaugcccuccaacuuagugaugaagagaugaguuuguuuacagcuguuguccugguaucugcagguaagcaagcugguucaaaauugugccacaccuagcauauagugaccaacuggggagaagauggcaguuaacaggguuccagaaaguuauauagagggaauaaggccuuaaggaagaugcuaaauuguaugacccuguuauuuuuguguaacuaauuuuuucguuauaacaauauaugucaaaguacuauaggaauaaaguaauacuuacaucuaggccuuguguuuaccacuguuagucuuuagcuuuuuguucauaauuuuucuaugagucuaaaucuuuauuucaugaauuuguuagaacauuauguaucuccagguagguaguuguaauaugaauuucaguuuccauucaaauacaauguggguuacuugaaaacauuaaaaguaucaagagguauuagugugguuuguugcagagaaaugugaauuaguuguaggcuuuaguccaguucugccauugaauuauguggguaacuuggguaaguaacuuuacucuuuugggucuuggauuccuuccucauccugucaaaggaagggguuguaccaugugagccuaguguggugucuggcauagaagagcuacucagucacuguuugaaugagugagcaagauuuuugaguuucuaauguuuauuuauaugagucauuuaugauguuucccaaugccccugccaucuugcauuaauauuacaguuauuucugacaguacccauuaaggcagagauuguuacucccaauaacaaauggaaauugagguacuuuccuggguaugucuaaguaagugccagcuauuuuuaggcaucauuuuauuguauaacauuugggaauuuuuuaguauuugguuaugacuuuguuucccauuugcuuccuacuguguaaagggcacugugcuaggcauugugagaguuauaaguuacggccucugauuauguagcuaaaccauaaauuaguagcucuugaaagagaacaaguucuuggccaggcgccaggggugcacgccuguaaucccagcacuuugggaggcugagguggguggaucaccugaggucaggaauuugagaccagccuggccaacauggugaaacccccuucucuacuaaaaauacaaaaauuagccgggcaugguggcacgugccuguagucccagcuacucaggaggcugaagcaggagaaucgcuugaaccugggaggcagagguggccgugagccgagaucacaccagcuugcauuccagcuugggugacagagcgagacuccguguuaaaaaacaaaaacaaaaacaacaaaaaaaaaacaaguuauuuguauaauuuugaggaccuguaccucaguggaauaaagacuugccauuugguaacauaauuuggcuaccuuuucugaccagcucuaccuggauaacuaaaaauguguauaugacgugggaguaguaugaaaggaauaugucaauaagggauaucuguuuuauagcuaauuuauaaugccucuugcauuuuaccuaucauuugcagaaucucuugauaaguaauuaguauugguuugaguugacaucagauuaaucgauuauuuugaaaccacagauaaucaauacuuguuaaauuauuuaucugaugaauaugccguaccuauuaggugcucagggggagacagaaagcuuuaaggcacaagcuugcuaaguguuuucauucuuuuuggagagaugaaacuacacaaagagcuuuaugcuacuaaaccguguaguucucugucugagguaagcuggaguuguagaaaggaaggugaaaucaucuuggaaggcucuguggggaaagauagaaguggagcuggaauuugaagguugaauuauuaagcuuucccagugaagaagagauggaaaggcaugagagaguacgagauagggccggggaagggucagguggccaaagccuggaguguacaucaaggaggaagggggacaaaagccuucagaguuaggggagcaccagguuauggacuaacagcuaugagaacuaagcggggagauuuuaaccaaaauauggggcagaagaaagucuguguaccuucuuaaguaggagagugaucugguugaacaaagugauguuuaacauuaauucugcauuuuuauuguggugggcagauuagauagguaagucauuagugcuagagaguuagguugagaagcuuuugaaaugacaucagguggggugaacucuucuaaaauaaauuaaggcaggugagaugaaguagaagggccaacuucccagagguaguucagaggaagaaaugauggcaaagggguagagggaaacucuguaugccaggaacgaaccuuguuauuucaggauaggaacaugauuuuuaguuugauuuaaucuguuuuugaaaaagccuuuuuucugauuauaaauuuaauauggguucuuugaaaauguagaaaauauuaaaauggaaaaaaaagguuauaauaucacuaccagaaaagaucacuauuaauauuggggagucuuuauccauuuaccuauccaucuauccauucgccuauccaucuauccauuuaccuguuuguuuauauaggauauauuuuaaaaauggaaaauuaagugugaaagacugauuguaaaagaauacagugcauucuaauuuuuguuaugucacuguaugaacauauacaaguacacauauaugaaguuucaugucaaauuuuaauccuuaccacuuaaaaauuacuagcuguuuuuuguuguuguuguuguuuguuuuuuuauuuuuauuuuuggagauggaguuucucucuugcugcccaggcuggagugcaauggcaugaucucuguucaccgcaaccucccucuccuagguucaagcaauucuccugccucagccuccugaguagcugggauuacaggcaugcacuacuacacccaacuaauuuuguauuuucaguagacaggggguuucuccauguuggucaggcuagucucgaacucccaaccucaggugauccgcccgccucggccucccaaagugcugggauuacaggcaugagccaccgugcccggccaaacagcagcauaaauuacuagcuguuuuuaaagcaguaucuaggcaggaaaaugaaauucaaacgcuacagaagaguuuaaaaugaaaagucucugcuuuuuuccucuuuccuccaccccagccuuauuccucagaaaacuggauuucuuaacacccuucuuuuuaauuuucugguuguugaccacccaacucugaauauaaugcuuauaucucuauaccuauuuuuuuuuuuuuuuuuuuugagacagagucuuacucugucacccaggcuggagugcagugaucucagcucacugcaaccucugccucccaaguagcugggauuacaggugcccaacaccauccucagcuaauuuuuguauuuuuaguagagacaggguuucgucguguuggccgggcuggucuugaacuccugaccuuaggugauccacccuccucggccucccaaaguguugggauuauaggcgugagccaccgugcccagccuauaccucuuuuuauuuagugaguauaacuuauaaauaaaaguauccuuccuuuucccucucaauuuuuuuauguuuuauuuuuuaauuuacuuuaaugguuuuguugguaauuuuaauauacucacaguuuuugaccuuauacauaaugucuuuuggauaguuuagauagaaucucuuaauuguucaaagacaguuuuuucuuuguacucugacuucgcuguaacauuccuuuuauguagucaauuaaaacauuuauaucuuguucuaucacuguuugucaugauuugaucagucaauucccaaaguugaaaaguugaaagucagcauuuaugguauuaugauuauguaaauaguacuuacaguguucacacagugagguugaaaugguaaagaauaauggaaaccucuucuccaaaccucugcaccuugaaucagggaacaaauggauaguuuauuucaguucucuauuaauuguuuagaauuaaguaacauaguuugcuuuaucuuuaaaauagcuuuuucuucuuggaaauguauaguggucuucuuuuguuguuuuuggguugucagaagaaaugguaguuaauuucuauaucucauuauauuacuuuauccucacaguagaucccugugagcugggacauguuauucacaguuauacagacaagggauuugaggaacagagggauuaaguaauuuacccaauguccauuuuuaauuacuggcuaagcaaguauuugaacucccauuagucuggcuucaaagccuuuccauuauacugcuuguuaacagaauagcucuagcugcuaagggggagaaaaaucucaaacaugauguuugccuguaagauuggaagaauccuaguaucauggaaggggaauuauaccuggaagguaaguuucuuuucagguuguuuaaaguaacagcagccacuuccaguugaagauuaaggacuugcauguaggugugaggucaaggcucauuuacauacagacuucaguugucuucauagagauuuuuguugaagguuugacuuucauccuguaggaagugaaaauaaauagaauauuuggugaggaguacaagcuugggagugcaaugaagaaccagcuaaggagagagaagauagaagugucauaaauuaaacucugcaguacuaguguagcauuuaguacaccauuuagaagaugaauuuccacuucaacauguguacucuuaacauuauagucuccagaagauuguuuaccauccagccagguuuguaccuuagguucuuuggccuugaaaucuuaaaaaccaugguuuuagaaauggaggcuuuagaaaaauuuaauacaaucuaugguuuuagauauaggcauccauuucccugaaguucugaguuguauaacgaagcauaggucaucuaaacacaaaauagccacugaaagaccaacaacuucaaacauuuuuaaauuuuuugugugacuuccuacaccuguccaaccaacuacuacuaauacuaguucccacucagguaucuucccaacuuaucaguuguuucuuucuuugcccaccuagauuauuuuguuuguggggauuacugucauucuuucucaguuuucgguauuauaaauuacuaaucauaugauugaaaccagagucaugcgucgcuuaaugacguaaauauguucugagaaaugcauuguuaggcaauuuugucauugugugaacaucauagaguguacuuacauaaaccuagaugguauauccuacuacacaccuggguuuuaugguauagccuauuguuacuaggguacaaaccuguacaccauguuacugugcugaguacugcaggcaguuuguaacacaauaaguauuuguguaucuaaacauaucuaaacaaagaaaagguacaguaacaauagauaugaaagauaaaagcugguauacuuguguagggcauuuaccaugaaugcagcuuacaggacuggaaguugcugugggugaaugagugagugcaucgugagggcaugugaaggccuaggauauuacuguauaugacuguagacuuaaucacugaacacguacgguacacuaaauuuauuaaaauuuuuuuuucuuccauaauaaauuaaccuuagcuugcucuguuuuacuuuauaaacuuaaauuuuuaaaagcuuuuugagucuuguaguaacacuuagcuuaaaacaacacauuguacagcuauacaaaaauauuuucuuuauauccuuauucuauaagcuuuuuucuauuuauaauuuauuuauuuacuucuuaaacuuuauuguuaaaaacugugacagacacauacauuagcuuaggccuacacaggcucaucaucaucaauaucacugucuuccaccuccacauuuuguucuacuggaaggucuucaggagcaguaacaugcaugagcugucaucaucuaucaccuucuauauuucuaugauaacaaugcauucuucaggaauaucuccugaaggaccugccugaggcugcuuuacaguuaccuuuuuuuuuuuuuuuuuuuuuuuuuuaaguagaagggacgggcgagguggcucaugccuguaaucccagcacuuggugaggcccaggcugguggaucauuugaguucaggaguucucaaaaaaugaaguagaaggacuauacuguaaaauaaugauaaaaaguauaguauaguaaauacuuaaaucaguaauauaguuguuuacuauuauuaaguguaauagguuugcuuaccccagcaucacuauaaacguguuaguuauguguugugcuaugauguuacgacaacaaaagcugcaacgucacugggcgauaggaauuuuucagcaacauuauaauauuaugggaccacccuuuuauauguggucugccauuaacugaaacauuguuacguggcacaugacuauuuuccucugucagaauguaagcuccuuaaaggcauucuuguuuuguucaccgcugauuuccaagcaccuuagaacaguaaccaguacauauguuuaauaaauguuuggcaaacgauuucaucaagugaaauaguguuuuuuuuaaaaaaaccauuacuugaauaucaaaggcaagagggacucuucaaaucauuacugaaggcuuuauuuuuaugaagauaauuuaugauugaccaaaguuaaaugucaagagaaagaggucucugccaguaguuuugucugaaaaauugugacccucccccuacccccacaaaccaauauccaauuuuuuuuuuuuuuuuuugagacaggcucccacucugucacccaggcuggagugcaggggcaugaucucgacucacugcaaccuccauccccuggguucaagugauucuugagccucagccuuccaaguagcugggauuacagaugccaaucaccaugcccggcuaaauuuuguauuuuuaguagagacgagguuucaccauguuggccaggcugguuucaaacuccugaucucaggugaucuaccugccuuggccucccaaagugcugagauuacaggaaugagccaccacguccugcccaacauucuuuuuauuuuuugagacagcaucucgcucugucacccagacuggagugcaguggaaugaucgugggucacugcagccuugaccuggguuuaagugauccucccaccuuagccacccaaguagcugggacuacuggcaugugucaccaugcccauucaauuaaauuuuuuuuuuuuuuuguaaagacaaagacucacuauguugcucaggcuggucucaaacuccuaagcucaagcaauccuccugccucggccuuccaaagugcuggaauuccaggugugagccaccaugccuggccuuuuuuuccaaauaagaauuaacauauaguuguaauguucaaauuuuguuaaauaugagauaaacuggccaggugcaguggcuuaugccuguaaucccagcacuuucggaggccgaggcggguggaucacaaggucaggaguucaaggccagccuggccaagauggugaaacuaaaaauacgaaaaugagccaggugugguggugggugccuguaaucccagcuacucaggaggcugaggcagauaauugcuugaacucgggaggcagagguuguagugagccgagaucgcaccacugcauuccagccugggugacagagugaaacuccaucucaaaaaaaaagauaaaacuuauuuuuaucauucuucugcauuuagaguuaaucaaauuuuucuuuuuuugcccuuuacuauuaaauuuuaguccuuguuuuaagugcuuucauggcaaaugaccuuuuucagcuaucacuuauaauggaagaccuccucaauauccuuguaaaaaaacgaaagggcaugaauggccagaaguuuugauuccuuguagaaguuagaaaucuuuuucuuguuaauuacaaccucccaugugggggaccauugaauauuuuuguauacuccugccuccuguuguaaagggaaaaaaauacucuugcugaugaaaacaucuaugggugaucuacauagguuugccugauuuuaagauacuuuauugcaggcuuaugccaaaugacugguuuauaaacauauuguaugacaaauuuaauaaacacaauaugcuaaaugaaagugaauguaggguuacauagcaauaaaguugcauaguguauuaguuaccuauuacugcauaacaaauugucccaaaauucaggggcuuacaaaugcaaacauuuauuuaaucucacaguuuuugaggguuaagauaugauaugagagauaggauaugauaugugccucugacucaggguuucuuaggagguuauaguuaagcuguggacagggcuguggucucauaugaaggcuugaguagggaaggaucugcuuucaguuguauguaguuaucggcaagauugaguuccuugcaagcuguuggacugagcaccucaguugcuugcugacuguuggcuagagcccacucuuaguuccuugccaugugggccucuccacaggguggcucacagcauggcagcagcuuuucucagaguaagugagcaagagcguaccuaagauggaggccacaguuucuuguaagcuaaucucagaacggacauccuaucaauucugccauauuuuuuuucauuagaaguuaguaagucuagguccacuuaguaggaggagguugcgcaagggugcgaauaccaggaugaagggaucauuggaggccauuuuaggggcugccuaccacacauggugacauacaaaugggaguguauuccauauguauugaaaauauguuuauauacuacauuauuuuauuuugcuaauuagaagcaguugaaaucagaugacaucuaauuuuaaaaagucagaaccucuauguucuugugaauaaaaauucuuaacaguaaagaauuuugauugaucaaauguuuuaugugauauauaugcuuuauaauauaguaacuagcuaacgauuuguuacugagauuuugagaaauuugucaacuuuugccuuuauucagauguauaaaaccuugcuuucuauucguuagugacacugauaagcaagaauuuuauuuauauuuaauguuaauaauuuauccuguuuuuccuauuucccuauuccugaucucucuuagaucgaucuggaauagaaaacgucaacucuguggaggcuuugcaggaaacucucauucgugcacuaaggaccuuaauaaugaaaaaccauccaaaugaggccucuauuuuuacaaaacugcuucuaaaguugccagaucuucgaucuuuaaacaacaugcacucugaggagcucuuggccuuuaaaguucacccuuaaggccuuuguuuauuuaaacaugaacugaugguaacuguacauuuugugcuaaaaugcauauuuauauguguauaccauauguggagauagaaaagaccuuuaagacaauaaaagauuguaggcuaucucuguaaucaugcaauagcuguucggauugagaacucuucagccaugauuagacguugacugcaucucccugauagaccaaucagcugugucgcacuuaaacuggagaaguuacacugaaguauaaucacacugaauguuagacuuuuucaucugccaaaaccaaaaaccauuuugaucucccugugguuaucaauauaacgcacaaucacaaguguaugaggacuuagaaauuaauccuuugugguaggaguucuguugaaugauggaaaucuuauuacuaccacaagacuauuugaucugguaauuggagacuucgggauuuaggagaucuccaugucuguauuuacucuaccacugcuaaagugugugguccuggguaguuuacuugcuugcggaaaaugagaauugaugguguccccaaugccccaccucacagaguuacuaaaaaaugucuguaaagcauauuuaccucuugggagauaggcacuauguaaauaagguaaaauuucuguuauuacaauuauucauaauaauauucuuuucuuauuucuaagccuuucugggaaaucauuucaguccacaccaaccauauuauucaggguuccugccauaugugugggguauccuacugauacacacguauucaaaguuuauggguacaacaaagacauaguacauguacauaauauguaugugaauauaguuaaauauauuucuucacaauauuuuaaacugugaagaacuuuaucauacaggaaacuuaaaacaagaggugucaaaagacccaaauuaggugcauuuuacuuguuuaugauggcauaaccauugcuuuaaaauguuuagacaguagaauauugaauuuaugcucuauuuuuguuuauuuaagcaacacuuaauguaaaagugcaacaggcaauugaauccaaauuucaacgacaaaaaaaaaaaacauguauuuuagaguucaucuuuggcaaaaucuuugguucaggguacuaguuguuuaaaaguugauucauauucuuaccuugugcugagaaagguugcauugcugccccuuauacacaugcugcagcuugauguuaaagaauuuuuauucuuucugaagaacuaauuaauguuuaaagcaacuguuuaauaugauggcaugugugugugugcgugcguguguauguucugaguccacuucuuuuuuccuaaauaacacuacagggauuuugucauauuagauuuaauuuauaauuugaaaaaucaucuagugugugaccuacaggcuuagaaaugguauagucaaagacauuuuauccacauuucuaauaguggacuugauuaaguagauaagaucagcaucuguuuaugguaguaggagaaauagccaaaguugaggauuuuauguauguuuuccuguuuaccuggaaaauagcaauuaauuggauuuuuugguaaagauugccuucuguauaauguuuggauuauauaaaauugcaaaaaugauaacagcccgcuuuacuguacuaagccuguuacuuucaugacgugugagcagaaugccuuauuuuguaaucuuguuuaacuuguugcuacugggacuugauuuacuguggcacuaguuaaguaaguuaaaaaaaaguuaaacccucucauuauuaaagaggaaaggcgauggugaugucuguaguacaauauaaaccauaauugugauuuaccuuaaguagguauaacucuuaugggauauacaguauaguuuuugugaaucuuuacaugauagcauuaucuuuuuauaauuuuuuuuccuaagauaaacaaaugcauaguuuucuucuaugggugauagaaacagcuuuuugaaguaaugaaaaccucaaaagaucauguugauucuuaauuuuugccuuuugcauaagccucuuuauaacauguaucuuuaaaacaauuaagucuuuaggaauguguaaccagaacuauguuaguauugcuuauaaaacuuuaguuagguucaauauauacauauauacaucucuauauagguauauagauuugcauuuugucuuguaaaauuuuauuugaauaaauucuuccuguagguaaugggaaacaaaauuaauaguucauaugucacucauagcauuucuauauuugaaaguagcccaauauaaaacuuuugauucuaaaauuaaaccagcagccuauuacaagcacauucuuugauugagucauugguuauaaacuuacuaaaugcagagaaagcagccaauuuaggaaacuucugaguuggugggacacuguugauuaauaauguacuguaugaauuaagugaugcuuuaacuuugauuuuacauuuuaaaguuaaaaugugggcauuaugucagcaaacuuaagggcauuaugucagcaagcuaaaacauuuuuuuuccugugcuuuuaauguaucucuuuacaugaucugagagaggauucaaguugauagaaauagcugaggggaaaagggggaacaucuugggaugaagcuuguccuuauggugaugguuuaauuacagauuaaaaaauuagaaggaaauuucaguggauuaaguguauagcuuucauaucuacauuucaagaaauuaccauuguaacuugauaagagaugauuuauuuuauguaaacaucuuugcaaagcaagguguagcagcucagcuagauuuauuacugugcacgaaaguaaauaccuaucucaauuauucuuuuucuuuuccaauauaaaguuugcugaauguacaagaagaguuuaucacuuaggauauagaauuuuuuuagggguugggggaggggaucuguuaggaaacuguuaccuauaaacaaagauugacuggauucgauccaaaagauaaaacuugaagcuauucuggaacuaacauggaaaaaugaaauggcuauuguuuaaaaaaaugauagaaauacauuguugaugggauaugaguuaaguuuauuuucuacaaacuguaauugaugaggacauggauaauaucuucauguuucugagaaguaaucuguauguggggggaggggauaauaaauauuucuaaccaac

SEQ ID NO: 192465 - RNA, 81198 nt, Homo sapiens
agucuauccccagugugagcuagagagcggaccaugaaggaagugggcagaccccgggaaguuagaggacgcccggggaaaagcagguccggggaggugggccgagagucccggccagcgugcggggcggaggcaggguccggugcaccugugcggccgcgggccggccacuuggggucuguggugcccgaguggcgggcggggguguucgcgcccugcuuucgcgcgcggucucgggccaagguucugggcgccgggagaggagagcuggggcggcgcggagcagcccccgugcgggcacccuguuccccucccccgcccgcaacuucaccggcgcggcgcgagccgucgggggcgcgcgcggggugggggcggcguggccgggcgguggcagcccaccgcuggggagcgaccugcggucugggccucccgggcaccccgccacggcuggcaggucacucgggcccgaggggccucguggggagcggccauguuggcuucgucacugaggacuccgggcgggucggguguugagcgaggccucggaccuucggccugucgggggcgcccugccggggugggcaugggggcaucugaggggugaaaggggcaagggaggcuggaggcuggcguccuucccacgcaccgauggcugugaucucuccgugcuggggagaggugcaggggagggacugaggaaaccggucggcaagugagaaacuuuaaaauuagguccuacauggaaaacaccgaggaauagaacugcccuggugugcgaggcaagguuggaagccaaacuuugcagaugagaacaggagauuccaggcugccucacuuccuccgugaaaaguuuuuuuccuaaacuagggaccugaaguucuugauguguaguuccucuuugcccaguagaauccagugaucgcgcuuagguuuaucugcagaccugcacgcuacaggugggaggcuuccgcgccuuaaugcuucuuguguuugucuuucccauuucucccacuccagaauucagaaggagcuggcggacaucacuuuagacccuccaccuaauugcaggugaguugcuuuucggauuuuuuccauuuuuaaaauucuucuaaccuuugucuuggguuuuucuuuuuauuauauacuuuuucuuugauucuuuggcuaaugcuuguuauggcacuaacaucacguaacagcugaaauuuauuaaccugaguauaauguuuugaugagccucugacaagcucaguacuguugagaagaaguaauggauuuauuuggaguggauuuuuacauauaugaaacaaaacuaaaguaaauuuaaaggugucuccuugccuaaucaugggucuuugauaugccauuaaagaugauguaaaaccuuucagaugcgaaggacauuuugguuuggaaaacugcuuugcuacaguaaucucuuauucaaucucugcuaagcuaagagaacauuagaguuaaacacuggaucuucaaacuuacuccauagcauauagauuuuuuauuagacuuuuggcagagcaauucaggaaacaauuucuggcuuugauaaagguuuucuuuuaaauuguagaguuaaacuuucaugggguguuuuuuucacuugcuuuauucagacuguauacauauguguguuucaguuucaaaacaaauugaaaccagcuuucuaaggguuuguugaucacagcuuuauuuagagaagccauuuugcuacuguugagucaagguggaagacuugaugacuuuacuagaucaacaaugaagugaggguaacuuacaacuauguauuagaauagaaccauuuauuuaagggagguccuguaacucccauacuuuaaaaauuaaguauaacauuuaaccuaguucucaagaucggcguuggaaagggaugugagauuucagaaauacucuaaacuuauugguaggaguagaaguuacugacaaaguauucagcggcuauacacaauuuuuaagaugagugugugggaauagguugaaaagcuaaaugaaguauuuuguuuaguaacagugaacuuuggaaacuaauuaguggauuaaauacaaaacuauugccguuuugguuacauucauucuuaauguugauuaggugugggaugcucuuccgugaaacuuuguccuguuuuguaaggaaagucauuuugaguuugaaaugcucuuaaacuauaguuuauaauuggaacacuuaaucauucuggggaauucuuuccuggcuaauaaucucucaagaugguugagaaguggaaaaaccauaagacuuaggccuaacucauuauuuugaugguggugguucacguggaagccuguagcuucccuugguuguuuguguggaauccauguacauuccccaaggugguucugugcugucuaguuauugcuccugcuugguauugugugucuccuauguguguguuauuaauaacauugauuaaaacauauaauggcuuucuugugaauaagcacagucaaaucuaaaauuguaaaccauuugaagauuuucaugggauuaagcauuuaaaaaaaaaaaacaguguaaguacacuucaguuucacaucguuuuaacugaguuuaugugugaaagauuuaugcuccugaggcauguggaacuuuuuuaucuuugggaaacccucccaauuaccccuucaaggugaaacguuugggaauuaccuguggucaggggaugcaccaaacuggguggcuguugggugauugguguuacggagucaaagcucaaaauacuaaauuuuaagaaaaaucucugauuugagagaaaauacgaggcaucuucauuuugcaagagaauguauauuacauugucuuuuaacaauaaagaugacuuuauuuucugaagauauuuuccaguggggccguuugaguaaugugaauuaaaauuuuuacuuuugguuggcuaauggugcugucuuaauguuauauaguagucccaauauucagcucucuuaaaagaguucgguuuuacguuuugugcuguuaccuuuuggaauuuaauuauuuaguauuuuaauguacuuuauuggagauaaagauggauuauuuauuuauuuauuuauuuauuuucuuuuugagacggagucuugcucuguagcccaggcuggagugcaguggcaugauuucggcucauugcaaccuccaccucccggguccugguucaagcaauucuccugccuccugaguagcugggauuauaggcacgugccaccaugcccagcuaauuuuuguauuuuggguagagaugggguuucaccauguuggccaggcaggucuugaacuccugaccuugugaucugcccgccuuggccucccaaagugcugggguuacgggcgugagccacugcaccuggccuuggggauacuuuuugaagucagcguccaaugaaaaucuaugaauuaagugauauauuaagugcguacauguuuaaaauuacccucagcaugaaagcaugagauuugaaugaguuaaauaauugguuuucaauuagucugucuuauauuuuuacccuuugccauacuuccuuucuucagucagcauucaguguguaguuuuaaacacguuauuaaaauauggcacuuggcacauaguaacuucucaguaaauacaaaaauuagccgggcauggugaugcacuccagccugggcgacagagugagacccugucucaaaaaaaaaaguugauuauugcaaaucaguagaauugcuccucuugaaggaaggugcacuguuuguguucacuaauuuuggcacuuggcaaaaauauuugaaguuacugagcaucaaaacuuaugugaaaugcaauugcucaauauguuauaauguaugaaaacauaaaauuaaauucuuaauguuguauauuauguuggguggauauuuuuuagaacacaguacagauuguguucaaugaccugguccaaagucauuuuaaguaaguauuuucaaacugcuuuauguugccauagaaaucaaauucuuaauuuuaguaucugugauuuguguguguguguauauauaugcauacacacacacacaaaauaguuucccaacucacucuucauuuugguuaggcuuuuauucccauaucauuuagcucuauucuuuuagggaaaaaaauauguuaacuuuguaaugauucccuaaagcgugccagaucuuagauuguaaaauuaugccuuuuagauagcugaugaacucugggccaccagagucaguuuugcagcuguuauuuauagcccagggcucaaacuuugcuaaauugacuaguuauaacuagccuguagacacgaauaucuguagacaguaugucuauacagacuaaauggcauauuuugccuaaguccuuuaaacuucagauuuuauuuaauggauauauuuguuucaugaguaaaugucucagugacuuaaccuagaaauucagauggggugcuauuuuaggauaaaaugucugaaaagucauuaaacacuucaagcaugggugagaauaauaaaaauacauuucuuucuuucucacuuuuuuuuugagacagggucucauuuugucacccaggcuggagugcaguggugcucacugcagccuugaccuccugggcuuaagcuguccuccugcuucaggcccccaaguagcaggaacuacaggcguucgacacuacacucgguuaauuuuuuguauuuuuuuguagagaccagguuuuaccuauuggccaggcugaucuuaaacuccuggccucaagccguccacccacuuugcccuuccagagugcugggauuacaggcgugagccauggugccuggcccugauacuaguuuuucuguaugugacagaauuuccauuuagccuucuuuugauagcuuuuuuuucccuaacacugccuauauuuuaaauaguuuuaagccauuauauuauacaagaaugcauguuuuugaaaaauucaaauacagaaguuuguggaguaaaaggcaaaagauaguccugaugaccucuucugauccugcuccuugcacacagaugcuccaaguuagcacuuuguauacuuccacguaguuucugugaauuuacauuguguuuuucuggcauuccaauaccuccucgaauuggugguaaugguaaugagaugucaguucagaagucccaggcugcucaucaugguucacaauggaaagagauccuuuucuugcaacaguggaguguuacauaccucguccagguucagcauguuuuaaaugguuguuuggguauaagaaauagguucagcagaagucauccuuuauaaaacccuguaucuuaugugcuaaaaaguauucuuccuuuuagcaucuuucauuuaucugauguuacuaaaugcguuaaggauagaagugugacuuaaacaucugaaugauguuuaguuucaccauugcaguguguauaccuuuaugcauguaaaggcaguguugaaaaauugugacaaccaggagacugggguuucagcacgaucaaaacagcacccauacuagggucaggcuguugggaauuagaucaucacuggggccuuuccuauuagagaggaaagaaacccuaucuggagaugaauugccuuucaaaugagcaggaagucuuguggcgguuguguuuaccaaaagacuauaucuggauuguaaaacuguacuauuguuauuccucagaaagcuaaacagaauuaccguaugacccaguaauuuuacugcuaucuauguacccugaauaauuaaaaacagaggcucaaacagauaaccuguaugucaguauucauagcauuauucauaguagccaaaaaguggaaaaaacccaagugucugucaacagaugaguggauaaacaaaauuugguuaaucuauaaacuggaauauucaucuauaaaaaggaaugaaguugugaugcauggauacaacaugguugaaccuuaauguuauacuaagugggcugggcgcaguggauuacgcuuguaaucccagcacuuugggaggcugaggcaggcggaucacgaggucaggagaucgacaccaucguggcgaacacagugaaaccccgucucuacuaaaaauacaaaaaaauuagccgggcaugguggcgggcaccuguagucccagcuacucaggaggcugaggcaggagaauggugugaacccaggaggcggagcuugcugugagcagagaucgcaccacugcacuccagccugggcaacaaagcgaggcuccaucucaaaaaaaaagguuauacuaagugaaauaaacuagaaccaaaaagacaaauagcguaugauuccacuuacaugaaauaccuagaauaggcaaacucauaaggacagacaguagauuagagguuuucagggacugaggggaggggagaauggggaguuauuucuuaaugaauacaguuucuuuuugagguggugaaaguuuuggaaauaauggugaugguugcgcaauauugugaauguaauuaaugccacuaaauuguacacuuaaaaugguuaaaauggcaaauuucauguuauauauauuuuaucacaauaaacaguuauaccacuguuaaaauauuaaucaguauuuugagaaaaaugcuuauagcuuagaaggcaauacucacaguuuuuggggauucuuguuaaauuccugucacaaacuuugagggccuguuauaaaugaaaaggcacaagcugggcaugguggcucacgccuguaaucccagcacuuugggaggccaaggcggguagaucaccugaggucagcaguuugacaccagacuggccaacuaaaaauacaaaaauuagccgggcguggugacgcgcgcccguaaucccagcuacuugggaggcugaggcaggagaauugcuugaacccuggaggcagagguugcagugagccaagauuacgccacugcacuccagccugguugacagagugagacucugucucaaaaaaaaaaaaaaaaagaaagaaaagaaaaggcacugccuucaaggaguucauaaucuagucaagauguuaagacaugcacacacauauuuugaaugguacuuggaaauauaaauauuauuuggaaaauaauaaaaugcagauaucauguuauaaaguuucagaggagugagagauuacuuugacuuggguuugagggauuguggcuggaguacuuagugaucugggaaggcuucauggaagaggugagaagugggguggggaagaauaagggauauucgugauggaacaguguaagccaagacagcagagggaagacagaaaaagggcacuauugggcagaagugaguaaaagcugugucuagagaggaagaaacauuagugggagaauaaauaguaauagauaaagcuuguguucuucagugucaggcuaagucuuuaaauuuuauuauguagaugcuggagaaucauuaaaaaccuuuugaguaggggcugucauucagauagaguuggcuaucuggauagagacagaguaaggauugaguggagcuugguaggaaccaggagacuuggagauugcuacaguaguuaagguggaaggucaagagggucugggguguaagugguggccuucaaaguggagaggaaagagagguagaagacaguagaauccauagaacuuagccacugauuucgauauggaggacuugaaaaggagucggguucuucuggguguuggggaaguugguggugcauuaacagaaauaaauaaggcaggaggaugaacuggcuugagggaaaaagguuuuguuacuugcuucguugaucacaugcaaugcuuagcauguugcugccacuuaguagguccucaguaaauauuugcaguuugacuauauauuugaguuuauuauuaaaucagucauugaacucccagaucuacauggccuacuuuuagauuagauuagacaaauuaaauagauuauaaacuuccuaaaagggaaggacaaugauuucugucuuugauucugacccuacauguucuucccaacugcuuuaguuugacgauuuucacagcuacaggagauguuaaaagaaugauacagcaagcgcccacccuucaccgugauuccucagcaaaauuacaccauguuugcucugucucucucuuaucucuauaugauaauuuuguggagucauuugaaagugagcauuuugaugcuuccguguguuuagcuuugcacacauugaaucugagguggccugacgguggagcugaggcuggaacugguuuugguaguccacauuagauuugaaaguuugggugauguuaaagugcacaagauugcugagauuggaggaggaaagaauugugcucugaaggaugucuucagauggaggaugggaaaugaagaggacuuggagaaaggaguaggaggaaagccacaagguugcaaaagucccuagagggagaucaaggaaauuuucucuuggggcucuaaaguguaagaacuuagguguauguuuuguaggcugagaggaagaagcaaauauagagagaaaaagaguaaaaauugcuagagaguccgggcacgguggcuuacgccuguagucccagcacuuugggaggaagaggcaggcggaucaugaggucaggagauugagaccauccuggcuaacauggugaaaccccaucucuauuaaaaauccaaaaaauuagccaggcgugguggcacgcgccuguagucccagcuacucaggaggcugaggcaggagaaucgcuugaacccgggagacagggguugcagugaaccaagauugcgccacugcacuccagccugggugacagagcgagacgccaucucaaaauaaauaaauaaauaaauaaauaaauugcuagagaggcagauguaauguuuuauaacauaauuguagagaaacugauggcccuagagaacuuaggcccuaagugggagaauguauguuuagaaaggcugguagccuggaauuuucuagacgauuagaagcauuuuuggugcuugaguagcacucuagguauuuguauagaacugaaaagaagcagcaucuuucugguguuauuugguuuguguucuuucccagcagacuuuaaguuccucgagaguagggauuauuaugucuuuauaucccuacaguguccgagaaaggguagguaaacaauacauauuuguuaaaacacaaaaaccuaauuuggucggaugguuuaauagaacaucuucauuacccucuucagaaaauaguggaaauugcuggggaaauugcugucacauuuuacagcuguccauugcuggcagucuuucugaguuggcacccaagcaguuuuggcaauuuugaccuuccugcaaucacagagaagcucuggacgucaguguggcaaaaaagaugugaucucugcugcaggcucgauugagaaaagauguauuggagaaaauauaacaccuuugaauugcuuguuuugacuucauguaagguuuaucaucuauguaauguggcauagacucuuagucuacagaguuacaaaugguaaccuuauuauaaaguuaccuuauguuaacaagugagcaagggucuaggggugcuaaauacaguggguuccuagagauggucccccaaguccuaaagcuauuccagauaguugguuauguuagaguugcuggcacccgccugagacaucugacacaucccaugucaccagugaagugaaacuggguuucauaauaagcccauucuuauucagccucuuuuaugcagccaugcucuaaagugaaacaaaagaccuaguaacuggugucagaauaugcuucuaauccucugggaaaccuccuccuuuauaggcuaaaagcucaucaaagucccugcuugagaaccguaauccaggaacuuugcuguaugcuaauggcucuuuucuugaaacauauacacagugauuauggauugcuuuguagaguccaugccacauuacauagaugaucaaccuuuggaaggccaaguugaugucccaucccacucaggaaaucuuacaaagccaaagguuuucacauacagaacauauuuaaguugucacuggguuuugcuacagugacagcaaaccauuggggcaguguguuguucacuaauacuuuuaacagaguaguuaaaaacugaauucugucugcucuccaaaguacaugcugacccaaauaugacaaagugaaugcaaagcccucuuauauagcauucaaaggcagauuugccacaggugccacaucugacuugucuguagugaucugagucauuauuaaauuuuaaauaguaauacaacggaguagucuuaguagagucuacuagcauugaaaugaugaucauuauccauacugccaguacauuggccauuuguauuuauuaaaauugaucgauggaaaauuggugugggauggaccucuaguaaauucuacagaaaaaggcauugaggcacauuuccaaacagaugagaguaaauagaguaacuugggaugaucuuacuuggagaaaaguuuuagaugugaugcagcucaaaaagucagcauuauuaugaagcaauguuguacaugugacagcagcaugaguagaucagaucguaaucauuuaaaacauuagagugucugcugugugcuaggcauuguucuguaggugacuaaaacagaccuggccucuggcuugugaaaccugaauuuuaguagacagugcaaacagcagcuaagcaaaaggauuaguacaaguuguaauggcuaguaggaaagaaauugacagagugcagugauggagaauaauuggggagggugugaggguuaccuagagaagccuuacaaagacauuuggucaaagaccuaaaagauaggaaaggaaauggccuugugaaaaguaccagaagacaucugggacagagggaagguaaaaacaggcccugaggcggggacaagucaggugaugcugauuauguaaaccgugcuaaguagagaguuuggauuuuucucaauaaugcuuuaaaagucuuuucccacccucccugcugcauggaaaauagcugggaggaagaugcuaguggaagaagggagaccagaaaggaggguauugcucuguuucaagcuagcuggugcagguggcuaggauuaagguaguggcaguggagauaugguagaacacugggaccuguuguuggauugcaugugagagaugagggacaggaacaaaaaugacuccaaguuucuguguuuuuuugcaauuggcuagaugauagugauguuuuacugauagguagacuccuaggccuagaauagggccguagggcgcgugugugguggguggcaggggagaugagggcaggguggaaaugacuccuuuuuggacuugauagauuugaaaucuguucccaugaggcauccaaaugaaggugucaaaaauaaguuagacauagguaauuggagcucugagauacauacacauuuguaaaggagaccuuaccaaacagaggcucuugggugucuugggaaugccuuucucucuccuagaaaggaaaggcaucaugagaagagugcccaggaugaagacucaggcaucuggcauuuagaaguguacacuaggaaaagccagcaaaggagacagaaggaaaaucaagagagugugguauuagaaagcagugaguggaaaguuuugagguagagugaucaagugggaaauggugcugugcaguagaaaaagaugaagaccagcaaguaaccacuagauuuuaccucagguuuguuggugaccuucacgugucaaaccugguuuagaggagagacaauggaaaaggaggaaugauuuucaagaaugaaaauguguuuguauuacucuuccuaguuaaaauauuucauuguauuuauccagaaaagugaucugguguuaucuacuuucuacacuuuagggcagaauuucuuaacauaguauauauaauuuuguggggaggauggggaaagggcccaccauuuucaguggauucucaaaggaguuuuuuuuuucugaucuccccucuuuccucaccaaaaaaaguuaacuucuacuuuacgagauucaaguccuuugugaucuuuagguuaacguuguaccaugcauguuacaaguaaauagugucagguucauguauuacaucuugaugaaucucuuuuucaagacuugguuugaaauuacuggauaaauuggaaaaucaguaaauugcugcugccauccuuaaaaauauuuuacaugcuuugauuugcaucgaccuuuuguauucuguucaagcuggagaaugcacuagaaugaguuggauauauguauuuacuuuuaacacagcauaaguuacucaucauauuuaauguuuuucauccccucccccauccccccacccccaacccccgccaccgcccuuccagagacggagccuugcucugucgcccaggcuggagugcaguggugccuucuuggcucacuguuaccugugccucccggguucuagcgauucuccugucucagucuccugaguagcugggguuacaggcaugugccaccacgcccagcuaauuuuuguauuuuuaguggagaugggguuucaccauguuggccaggcuagucgaaaacuccugaccuugugauccaccugccuuggccucccaaagugcugggauuacaggcaugagccucugcgcccauccuguuuuucauccuuuuaauaugggcuguuauguuaaugcuuuacauuggauauacuuagaacucuuaaagcaaucauauaagcauugucuuuuuaauuguccacugaucaugucuuaauaauuuguuucagauuaugccagauacucuugguccugcuuaccuugauaauugaggguagaauuaagaaaguuuuaggauuaggaaucauucuucuaauucagagaguaauuaguuggaaucacaaaagcauuaggugcugaacugccagagacaagcaacaaauaauauguggaaccacaacuguuuuggcuacguaggaauuuugcuccacaaguaauuuaaauuguuccuacuaccacuuacaaccuuuccuccucuauggggguacaucucaauuuuuaaguuaauauauuagaauugguguuauaaaaauuuauuucuuagcagacuuugcuacaacacauuuauccuaaauaaaaggagauuguugacuuugcagagaaaaagacccuaaaagaaaacauuuguuuuauuacaagcacccaggaggauuuuuuauaaacaugaaagauaacuuuccucuaaccuaaguaaauauuucagaaccaacguauguuaagugauuauaguaaugugugugcagagacuggcaguaaaguuagcagcgucauauacuacuugcuaguauaucacacugcuuuggccuuuuucugaguaacccucucucuggaagucuucagaaugccuaacuucauccuucagggagacugguagcccccgaaaagacauuuauuuuuuguagcuugguauucugagauguucucacauccaaaguaaacacugucaagugauuuggaccaguccuaaaguaaaucauauauugaggacacaguucuuguuaaaacugaaauuugaaguuguugccauuuucugcauucacacuacuggauucuuuguagaugcggggauuucuacuucuacauuuuacuguaacuauuuacauuuaccuguauugggaggaaauucuauauuguagcaaguuaaaacacaugauuuugguaaaaaaguaaaaacuguuaagaucuuggagcccagacuuauuuguuauggagauuuggagcuaggagggacccgaugcucccuucucugucucuguguccuguuuauugugagguguauauugauaaugaauuugugaagaaaggcauucuuugaugacuuagcagagaaaaaagugauaguaauuuuauccauucugucuccagaugacugguacuauguuuuacuuucuccucuuuucuccagagccacucuuaaaaucuuucugcaguuaaugguuuguuauaguccaauuuucauugcuuuccaagauuugaacuuucuaucugaauguaagucccccuccaaaagcagucaucuuucaguucuguagcuccucugauacucuucaagccccucaaggagcauuagguuugaggaugguaacauuuacucguuguccuuugaccugaagaugcguagaaagaaaugcuauguuggaucucaguauaccuaauaacagucuugcaggcugaauuugcauuuuccuuucugguugaaaucuugucaguuuacucaugcauuucugacuuucucccauucuggugugcuuccuccccuuccugcucccuuaagaaaaaaaaaaugguuagccaguucggugaaguuuucucagaaauuucuuguggacagugcuaacuuaagccggaaaacaguuugugacacuugacuuuucaaggaggagauaagauuuuguguacccagacuguauauaucaauuauuauggggcuaaacuuugaaaguaugacuaguuccccaacaaguauauacgaaaccuuguaggauuaguaauuauauuucuugaauuaauuuuaaaaauauguaacauacuacacacacaucauuugcaccaugagaauuguccauacuaauaagagauuuuuguuuguuccaguuaaaucuuacuccuaguuuugcaaguguauucaggccugcaugguugucagugacucagguggggugggcagggcagucuccaaccugccccaccuguguuucucugccuguuuacuugugaccuuggcugagcaguacaaaucauugacaacacuggcagugcuuuggucugugccugcccuggcuuauuccauuuuuuggcccuuugauugaagaugcaguuacaaccaguggcuccugacuguauuuagucauucguucugauauuuaucggccauuuauuguugugccagguacugaagauacagcagcaaaaaagacacugucucugugcucauggagauuuuauucauauagagggagguacaauaaaagaaacaaauguacaaaaguaauuucagaaaacaguaccaagaaauuaaaauagaguaaaauggcuuggugagugacugcgcagguugggacauugguuggugccacauuggggaaaugacccugaaugaugacaaggacccaaccaugagaagggcauuuuaggcugaaggacagcagauagaaaggugcugagugggguaggccaguguggcuggacauagugaaugagggugagagugguaggaaaugagguaggcaggggucagauuuuauuugaauuucaguagaaagccgugggagagcuuuaaauggaggagugaaauacgagguauuuggagaauaccucacguaaaauuuccuacucaugaaaagagagaaggcaggugcaguggggcaugccuauauuccccgcuguuaggagacugaggcuggaggaucacucaaggcugggaguuugaagcugugguguguacuaugauugcaccugugaguggccacugugcuccagccugggcaacauagugagauccucauuuaaaaaauaguauucuguucaguguuuugaaaaaauuguauuaaaaaauagagguuaugcagauacucuguaaaacuuuuuuggcauuauaugcaguuuuacugaccuuuauguaacaguucuauuauaucuagauaucuguguaucuaacaaauuuagacauuuugcaaaaacugaagacauguuaccaaaaauuggugccucaaccagugaaaggaaguauagcauuacucagcuggucuugacguaaagguuggaugaagugugaauguuuguaaugcauacauaauauuuaaagcuaacagaaacaacuucuuaguugucuuuguagugugcuugccuugguuccuggcuguucaccugaagugaagacagccugagucuggcaguagggaagcaucaagaguuuggcuuccuccuccuucagagcaacaacagcaaaugacacagcagggaaacuaggagaguugggcagcuuggaaacagggaaccucagcagucugggaggcagcuugccagaacuccucccagcccucacuugguuaucugugauaucuaaaagauuuaucucuacagugugaagccccaaaucugugauaugacuauggagggagaaugcuuuccaauuuucuugauuugguagauacuuuuguggaguugucauuuuuucauaguuuuuuguuaugauagcugaaauauuuguucugaaggggaggucuaaacacauguaauaaggcuaaugaagagauuggaguagcaguguaaucauuccuacacguguauuuuaaacuuuagguacuaaaucccuuuuugauauauaugcuauaaaaaugacuuauaaaaugaaauguaauucuagcauaucuuaaacuguugccaggagguuuuuggguugcacugauaagaaauuacaugauuucuugcagaagggucauuugucuugcuaaaggaccaguuucucaugacuccucccucuccccacuaauaaacagcuaagaaaagggcccuuaggacauuuuuuuucacuuauccauuauaaaaaguuauucacaauucuuaaagggacaaaauuucaaugcagacauaacauggcuauuugcucaaagggaaaaaccaccaaauaauaaaaaaaaucaaaauacaaaaaaaaaauccuguauuuuauauuuugcuuuggggugaauuuugguaauucuaaaaugauaugaaugcaugaauauauccaguauucuggguguucauucacuuuauacagaauaaugaaggaacaguagaaagccugauuuaugauauucuggacagcuuuuuagauuuacuauacaaauuuuagcuuaguuucuuuuugcuucacacugugugcgguggagauuuuaaaaauaggauaaagcuuuaauaauaacagcuaacuuuauuaaguaugucaauaugauuguuauucucauuuuauaaaugaggaaagagaaccuuaaaaugcuuaaguaccuugcccaaggucacuaggcucuuaaguggagaagcugguauuuaggcccuggccuucaaagccuaaccauuauacucuacugccucuuauaguggcuuuaugaauuauagaccuucuuuugaguuguugauguuaaauuuuacucauaugcagagcuguauuuaaauuuaaaaagaggcuuauuuuauaacauagccacuaauauuuuucauuggaauugccaucuaccucuacuuguucuccaguguagauuuaauucuuauauucuuuuguuuaaaaaucuaagguccuaacugcccuuagaauuaagugcccaaaaucuuauguaguauucagauccccuacaaccugaucccagcuuuuauauuuccaucuuauuuccucucucuguaacuugcuguuuucaguaugcccccuaggauguucucucucccagcuucuuugcuuuuuauuuuucaaagcucugauaaaaaugauucacuccacacagcucucaucugugucccagggcacuuuaaauacauaccucuuuaaaacauuuaucacauugaguuacggucauuuguguuugucucucugucaagaccgaguuuuuaaaaaauaugauuauuuuuauuucuuguaccuaacaccagaagaugccuaaaaaguaugaaugauuacugaaacaaauuaaaauacagcauuuaguaguaguuguauaaauguuaccaguuacuucauuuagauguuaccaucaaucacagaaacauguaggcugaagcaaugaaaucauaaauacaguguuuuaaucuuccauuguguaaaaagaucaauuucuauauuguauguaaauguaauauaacauuuuaaauauagguuuaauuuuugagaagauacacaguauacuuagugauuaaaaaguuagguauuuaaaucuaugagaaaaugggaucauuauuuggauauuuaccagugcuaaucgaagcaguugcugguaaaggcguuggaguugaugcauauagauagaaguuacuuuugcaauaaaacauuagagucaccaucagaacagaagacuugaaaaauuuuauuugacucaaauuacaaacugagcauuuaugggugucugugugugcauagcacugaauuagaucaucuggagauacaaaagugugauagaugcuuucaauauaaaauaaacguuacauagcuacugaacaagacauuauauaaagguucguuaaugaccuaagauguaaauuuguuuauaauuuuuaucauaguucaauuucaucuaaaccuuaugugauuucaguguuuuccucagauuugucucacacucuagucuggugauuuccaggcuugugccugucccagcacaccuaaggaagagggaaaauguccaucaauaaguaacagggguuuacuuucaguggacaggguggauggaaggagagauuagcaaauuuggggugaaaaauaaaagcccuccagugguucugacaagcuguagcuagagggggguggcaguugcagaaggggcaguuucuccgucuuguauuuuuuauuuuuuucuuugauucuugaaaauaaguucuuauuuuugauaagauggaggauuauuauuauuauuauuuugagacagggccucaaaaaaaaaaaaaaaagagagggccucgcuuuguugccuaggcuggaaugcaauggugugaucauagcucacugcagccuugaacuccuggggucaagcgauccucccaccucagccuccuaaguagcugggacaacaggugcacuccacaaaguccagcuuuuuuuuuuuuuuuaauagagacaggaucucacuauguugcccaggcuggucuggaacuccuaagcucagaugauccuccugccucagccucccaaagugcugggauuacaggugugaaucaccacacccagacccagcuguuuucuaaauuuuuuuggagagguggggucuugcuguguugccugggcuagucucaaacuccuggucucaagcaguccuucugccucaaccucccaaagcacgggguuuaccaguagccugagcccccauaccugccccucuccuggaaaagugcugaagugggaaaguuuacagauuuagggaguccaaggaaaagguugaggucgagcuaauaagagaaggagaaaggaaagaggaacugagaaaggaaaggggucuagaagagcgguuagaaauggggacuuugguuuuccccucaggcuuagcucacuacuuucuauaaauaagagaugucugaaagagaagcagauaaaaggagaaagccuucagcaaauuugugaguugauaagcauggauugauuggcucuguuggccuggguucuugaggaguuugcugcuauuucggaauuucuguagagaaacccuggcauugucaggauauggguaugccacauguuucccuuccucccccuucccuccacuccuucuuauuaccuagcuagcuacaccuggaauuuugguucuagaauaauuuaaaagauacuuugucaagaaaauaucuuuggaaaaaucaugcauauauuauuuuuccuuuuuucuuuuuaacuacuuccugguucuuuaggcuccucuaauucuuacaugcaugugcuugaucucugggccaugcuugcuucuaguuaaguagccuuucaggaugguguuuaauuuauucugagcccuuuauaauauccccugacaagagcauggaguggauagagggagucuuagucaauauguauuauaaauagauuuaggguucacaaaggucagcagccuucaucucuugcccuacccccaucacacacaaaaauaaaaaucacaaauaauaaaggauuuuaagaguuauaccagucgggaguggguucauuuuuuuguuuuuguuuuuguuuguuuuuggcaagcugaagucaucuguuggauccaaaaaugcauaaaaaucuucaggcuuauagaaccaacagcaucaaaggaagagcagugugacucaauauuggggugggggcagguuugggguuuugguuguguagaagcuccuuaugagagaacagugugaugcuuggagcuguggagaauccagccacugcuuuuucucucuuccuuaccuuauuacucuucuugauucaccuggauguggaaacugucccuguuuaagaguggccuugucaaugcucucuguguaucauguguacaguagggaaugugucaagccagaugaguggucucauugaaacaucagcaaaucaguauaucguagaauuuagaucccccuuggaggugguggugauagcuaacuucuguugcggucuuaacugugggucaaguuuuguucuaaggacuuugaacauuagaaacucauuuaaaacuuaaaccauuccuguugguggucauguaaucccauuuuacagauuaugaaaucaacauuaagguuaugugcagcuuaguaaguggagaagccagaagaacccacgugaucuggcuucagggccgauacucaaccacuguacuuuggagagaauuagucauucugauaccacuuuuguuauuagcuaagacucuuuauguugcagguaacagcagucuaauuaauucauuuaaauaaaaagauaauauuauagggauauuugagugugugucugauaacccaggaacugaaauguucuggauaucagaaacaacagaaaccaggaauucucuccaacucucaucuaugcucucacuccaagugcgcuuuauuuuuucucacaucgcagauugcuccuggcugcccacagccugccugaagaacaugaccacaggcacccagagagaaacuuacuuuuggccaguuguaaaacucuugggcgagggaccaguuagucuaacuugauugaguuuuggaucagucagcuauuuugguaauuaaagugaaaggguccagaugacacuaauauugggagcuaguuugacaaaauauuuaacaaaaugaauacuuuuuuuuuuuuuuucgagacauggucccacucuguugcccaggcuggagugcaguggugugaucacagcucacugcagccuugaugucccaggcucaggugauccccucccaccuuagccuccuaaguagcuaggacuacaggcacgugcuaccacacccagcuaaguuuuguauuucuuuuuuuuuuuuucugugagacagagucucacucuguugcccaggcuggaaugcaguggugcgaucucagcucagugcaaccucugccuuccagguucaagccauucuccugccucagccucccaaaugcuggaauuacaggugcccgccacuaugccuggauaauuuuuguauuuuuuguagaggcaggguuucaccauguuggccagacuggucuugaaugccugacugagcucaggugauucgccugccuccgccuccgccucccaaagugcugagguuacagacaugagcuaccaugcccagccaaauacuuuuuucuaaaggaagaaaacuuagucauuuauuuagcuuuaauaauuggcuuuuugaguuuguucaauacuuuaagcucugugagcauauggaucaugucagccaucuagcacaggguuuagaaaacaguaacugcucaaacuuuugcugugaaugaaugaaggagcaaaugaaugauuuuccugaaagggaaauaaaaacagaauucaguuucugaucauuguccagggaauggcuuggacacaaauaguugaccuguuggaagagaauauacauuuuuaauaaaggagaagggacuguguuuuuccuggagggaggagaccuguaaagaaaaauauagagguguggggggcugggcgcaguggcucacgccuguaaucccagcacuuugggaggccgaggugggcagaucaccugagcucgggaguuugagaccagccuggucaccauggcaaaaccccaucucuacuaaaaguacaaaaauuagccaggcgugguggugggcaccuguaaucccagcuacucaggaggcugaggcaggagaaucgcuugaacccgggagguggagguugcagucagccgagagagaaucgcuugaacucaguggguagagguugcagugagcugagagagaaucgcuugaagccgggaggcgaagguuacagugagccaagaucuugccacugcgcuccagccuggacaacagagcgagacuuugucucaaaaaaagaaaaauacagggauguggugacucacaccuguaaucucagcacuuugguuagcuaaggcggguggauugcuugagcccaggaguuugagaccagucugagcaacauggugaaacccccaucucuacaaaacaaauuuuaaaaaauaauccaggugugguggugugccugucaucccauguacuugggaggcugaggcaggaagauugcuugagcccaggagauugaugcugcagugagcuguguuugugccauuguacuccagccugggcgacaaagugagacccugucucaaaaagugggagaaaaagaaaaauauaaaguauucaaguuaauuuuaacuauauaacaccauaccuuuuggucaauuuuucaauuuuugucccuuuucucccauuuuuccucagucuccauauauuugucucuuagcacuuccuuuuauuuuccauaacguaccucucaguagaguauaaaauggagauauuuuuuauuuuuaaaauaugaguuuuguguugcuuguuccuaaccuuaaaaaaugauugguauaugguaugugccuuucuugacagugaacuauuugauagucauauauuuaaaauuaagaauuuaauagaccuucccacuagggaagcauuuguuuccuaggcaccuuuggaaggugcuacauuaaugaauuaguuuuauuauuuuagauaaauuguuuuucccuauuuuuagaauauuaauagagucagguuggaagauacaaauaaacacugauucagaacgccacaugagagucugaaagccaugucauagcaguaguuaaacagaguauuaaaugcagaugaacaagaugucggaaagcaaugguaauguuagcaaagcuagagagaagauaauuucuuauauuuuacagcaaauguuguugucuauguaaagaaaauuauaggcaugacugugaagaaaugagguuuauuuaagaugccaaaaguggcugggcgugauggcuuaugccuguaaucccaucgcuuugggaggccaaggcagaaggauuucuuggggcuagaaguucaagacaaaccugagcaacacagcgagacccuaucucuacagaaaauuuaggaaauuagcugggcaugguggcaugugccuguagucccagcuacucgagaggcugaggugggaggaucacuugagcccgacagguugacgcugcagucagccguguuuguaccacugcacuccagcccugucucaaaaaaaaauaaaaauaaaaagaugccagaaguuuuguaucagaaaauuucaacagugcaaaaaagccuuaugguaaaaaauaaauaaaaagaaauaaaauaaaacuucaagagguuaacucuugguccauuauuuaaaacauuuuuugaagugucuuuggacaaggccuuuuacagcucauuugugauagucauacaguuuucuuugcuguaauaaaagcuugguuuugagucucaccauugaguucaaaucuuaacucugccucuugauggcacuauaaucuugggcagaucauuuaaccucuagcagcuuuauuuucucaucuauaaaucagagcuaauaacccccaucaaauucuccuucagaggacaaauguuugucaccauuuagggugauuuuucuaaaauaugucuaauuguucuacuugcccacuuaaaauucccccaucuuucucacauaaccucuguagcaugucccauuacucuguagcuuuucuguguuugcuucuaaccuuccuuccuccugugcuuuuuccaaguucuuuucccugaacagcacugcuagcugcuccuggcagcuuuuuauuuaaaaaaugaaaaaaaggccaggugccaugguucaagccuguaaucuuagugcuuuggggagcugagaugggaggauuucuugaccccaggaguuugaggcugcagugggcugugauugcaucacugcacuccuuccuggaugacagagcgagaccccgucucuaaaaauaaaaaaggaaaaaaaaacuuacacugcucuuuuuaauacuaggaaagcucuuugagauuagaaauuggcugauguuuuuucuuacaguuuuguuuuauaaauuuuuuaacuuaaaauauuaauguaaugaaagaaaucacuuuggaggaaauuuaaaacuaaaaugaauucauacugaauuauguuuuaagacuugugguauucccuguaaugcauaaaaagcaaugugaggaaucacugcucaaauugauaauguuuaaaauggagaauaagagcauagaaaaaaaaauacgggacuaauuguacaauauuuuaacauuuuuagguuuuacauauugaguuaaccugaucaccuacuugaagcagucuagcauuaacuguuaaauguuuaaugaaguaguucucaaccuuggcugcuaucucaguuacauguaauguuuuaaaaaaaugcaggccagguuggguggcucaugcuuguaaucucagcacuuugggagguugaggcaggaggauugcuugagcccaggaguuuaagagcagccugggcaguauagcaagauccugucuacaaaaaauuuaaaaauuagcuagaugugcuggugcgcaccugugguccuagcuacucaggaggcugaggugggaagaucacuugagcccaggaggucgaggcuaagugagcuaggaucaugccaguacacuccagccugagccacagaacaagaccugccucaaaacaaaaaccagaacaaaaaacagucacaccagggccccauccuauuggaaucaucucuaggggagguucccacaccugcauuaaaacaaaacucagaagccaaggguaagaaccaaggaaguaauguauacuuuuaaaguaauguauacguuuuaaaauuugcauacaguguaccucugguaauuuccaggcuuuuaugacauauaaucaucaauuauucaaaauaaaaagugaaucaauuuuagaaacuccccuccuccccccuuuuuuuagacauuagaaguuaaaucucacgguuuaccuguaucaauuugcagauuauuguuugaaaaauucuggugaauugagacugcauuaaauuucucuggauaaucuacauaaauaauccucaaaauaaaagguucauuucaacacguaauagcuuuauauuuaaaggcauuaggaaagggggaggcagggagggaaaguuagcaucuguuuccugugaguuuuaagcuauuucuaauaacuucuuuucagcugcugcuuuuaugaucuaguuuauggcacagauaagauauauauuucagaaaaaauguuuugagcuuuugcuguugauguuaagauuacgauuuuucuguuaaauaggacauuuggaacaagaacuguuuaggauauagaugaaauacauugaaacagcaagaaguuaaagcauuuuaaaaagccuugugaauaaaucuuuacaagagaguuuuuauaacuaaaguuaauaggaauaucuaaaaugaauauccagcuaguaaaauuagccauccauucaugaauuuaggaaauaacugauuuagaaugcuauauaaaaaaagaguuucucuuuucacuuaguccucacaaguuuucaccuauaauguauuuacucauuaaacaucagaugucuuccacaugccaugugcuguacuggggaagacauaaacaggagagacuagguccagacucuguuggagcccuuagucuaggggaguaagggauuuuaaguaagcaauagaagagauguguguguuccucugaaaacugcaagguauuucagugaggcagcucuuuuguucuuuuuccaaaagagugacauuggcuuuucuuggaaguuuuagagcugaaagggaacuuagaucuaguucaguuccucauuuuacaaaugaacacacucagaucuagggaagugaggugacuuuccuaaaauggcucagcugaggacugguaugguugggauagaacaugggucuucugauucuuaaccauuguacacucucuaccgugucccucaggggcaugugaaaguaaaugacauaugacagacagaaucaugcccaggaaucuauucauucugcacacuaugauugaucuaguuuauguucucuuugugcuagaugguggcaucacucaugaugaagaagauaaagcucuuguuaaguaguuuauggucuaucaugaaaagaugggcaauuugggaaaucuguggcuuguuaacuuguuuggcauauugaguaacauggcagguucuggagccagacugaguuaaaauccuagcucucacauaauagcuauguaauuuggggaaggaacauaaaucucuacucuguuuccuuaucuguaagauagggauaauaaugccuaccucauagaguuuuuaggauuuagaaauguauauaaagcacuuggaacagugccuggcucacaguaagcacuaacacuaacaaaaaaguuauacuauuauuuucaccucaguuauacaggugaggaaguugaaacauaaaaaaguuaaguaacuugccugugaucauaaagcuagaaaguuugggagccagaauuaaaauacaggagucugagugcucuguuuagauuuaggaccugagccagggaguguguuccaaacccagcacuaauacuugagaagcucucaaaacuguaaguauccccaggauacuggugucucaaaaagauaguaauguguuaacuguaagcuauuuagugauacauuugcuuucuucugcagagaggagggacugaauuuugggacuguugccugcaccaucccaguccaacuugcuauguguuuuuauuuuuagccauuggcugauuccaauuugaaauucagaggauuugugauauauuaugugauauguuuuaaaaauuacuagcuccuugcugcauuuuauaaagcguuggagauaguuuuucuuugguuggcugauugguuuugguguuuuguuuuuuagaggacuagccuacaccugguuugaguaagaaaguuuuguuugagaagcagcguuuuuaccaccuucaaucuuuugaggaacuuuuggcauguggaaaauuaaauacuacaaacuuucaauagaagguagacagguaauauggagaacugagaauuagaaaucuugaccaugcuguugggaauuucccuuuucuuucugcuuguccacuaaucugcauugcuuauuaaaacagguugauacuuuuaaggcucugcaaagaaguucuuuucauugguuaguaucuaauaagugauagcugguacaggacuuuaaaaauauauaauagggguuuauuuucuuuauuuuuauuauuuauuuuauuuuuuuuugagacaaggucuuguucuguugcccaggcuauagugcaguggcacaauuacagccuacugcagucucagccucccgggcucaaguaauccuccuaccucagccuccuaaguagcugggacuauaaacgugagccaccacaccugguuaauuuuugaacuucuugguagaaaauguuucgccauguugcccaagcuagucuugaacuucugggcucaagugauccucccuccuaggccuuccaaagugcugggauuacaggcaugaaccaccaugccuggacuagcgguuucuuuuaaacagcauauaauugggacuugcuuguuuuuccaaucugacaaucuuugcuuuuaaauuggaaugguuagaccauuaacauuuaauguuauuguugacaugauuggauuuauuuauuuauuuuuauuuuuugagauggagucuuacccugucacccaggccggagugcaguggccugaucucagcucacugcaaccuccgcccugcaggguucaggagauuucuccugccucagccuccuaaguagcugggauuacaggcaugcaccagcacuccuggcuaaauuuuguauuuuuaguagaaauggaguuucaccauguuggccaggcuguucgcaaacuccugagcugaagggaucugccugccucggccucccagagugccgggauuacaggugugagccacuaccgugccaggccugauauaauuagauuuaaauuaauuuucaauuuauccuauuuguauuuccuuuuuucaugcuugcuuuuggguugaguuuuuuuuuuuuuaaugauacuauauuaauuaauuucucuucuguauuaccagcuauaacuuuuuuuguuuguuuuuuagugguugcuuuagaauacaucuuuauagaauacaucuuuagcuuaucacagacuacguucacgugauaauuauaccccuucacccacagcgaccccucaacaaucccucucccagcauuagugcuguuauugucauauauuuuauucugcauguuauaaaccccaaaauauauuguuacuauuuuugcuuuaaacauuaucuuuuaagagauuuaaaaaauaauuuagccgggugcgguggcucaugccuguaaucccagcacuuugggaggcugaggcggguggaucacgaggucaggagaucgagaccauccuggcuaacacggugaaacccugucucuacuaaaaauacaaaaaaauuagccgggcauggugacaugcgcauguagucucagcuacuugggaggcugagguaggagaaucacuugaacccaagaggcagagguugcagugagccaagaucacuccacuguacuccagccuuggcaacagagagagagucugucucaaaaaaagaaaauaauaauaauaauaauaauaauuuaaaauuuuauauuuuccacacauuuauuaccauuucugguguucuuuuuuucuuuguauaguuucagauauucacucacugacaucuccuucugccugagagacuuccuuuaacauuucuugcagucaggucugcuggugacaaauucuuuguuuuauuaugucugaaaaaaaucuuugucuuuuuuuuuggaaauguuccuguuggauauaggauuuuaggcugacaguuuuguuuuuuacuuaaagaugcuauguaacugucuucugacuugcauuguuuccagugagaacucuguaauccuuaguuuguuucuccauauaaugugucaucuuuuugucuggcuacuuuuaagaauuacucuuuaucacugguuuuacacaguuagauuaugauauaccuuuugauguaguuuuuuuauuuuuuguauuucuugugcuugguguuuguucaguuucuuggcucuaugagcuuauaguuucaucauauuuggaaagaaaguuuguuuucuguguuucauuugaauaauuuuuauggcugacuucaaguuucuuauuuuuccuuugcauagucuaacaugcuguuaauuucaguauauguuuaaucucaguuguuguauuucuucauaucuggaaguuugauuuggaucuuuuuauaauuucuaugaguccacuuaccauggucagguauuuaucauuuuaaauuuaugauuacaguuauaacaagcguuuacugucuuuuuguccacuaauuucauuaucugggucauuucuggaucaguuucuauugauugguuuuuuaccuuauauuuucaagccccugcacaugcgugauaauuuuuuguuggauaccaaacauugugaauuuugccuuuuugagugcugccuuuuuguauucuuaaaaauauucuugagcuuugucguaaggugcaguuaaguuggaacuuagucugauccuuuugaggccugcuuuuaagcuuuuaaggccuccuuuugaagccugcuuuugagagugaccagaacagcuauuaaggcuaauuuuuaccauucacugaggcaucaccauucugaguauucugcuggauggcccauaaguuaccagggucuuuuucuuucugacuaauggcaaugcaaacuauucucagcccugugcgagcucuggggaguguucucucuguucucuggugauucuuucccuggcauugcguaguguccucucaugcaugugcuaauucaugcuuagguaaauacuugacgggacccucuacagaucuccggaguucugucucugugcagcucugguacuugugaacucugaccacuuagguuauuccuuccugcaccacaggcgauuguaggucucaauauauuuaguuuuccuuucucagagaucacugccuugcacuaccugauguccaguguauggaaacugcuguuuuauauauuuugucaguuuuuuuguuguuuaagugguagggcagauuuaguaucugauauaccaucuugguuagaagcugaagugacuuuacagcccaugauacuuuuuguaaauaaagauuagucguuagaaaacaauacuuucaugcuguuucagcuuuuauacaucuauaaugauauuauuuacuuuuagagaugcgggugaacuguuugaaaagauugaaaagauauaaagaguuauuggauucuuuacaucaugagcgaggaaaaaaauuaagcucgucuuaaauggcuauguuucaauuuuaucugcuauaaauggguaagaguuagauuuuauuuaaaauucaucuuggcauuuagagacugauacuguuucuggccauaucagcugaacugugucauuagaauuuuuaauuguuuuaggguuuuuuuuuuaagaauagaugauugauuuuuuucugucucucuacucuucuuacucagaauuagaugugcuuugagcacguauuaauucuaauacgauuaaaggucaagccauaccacaagaauauuuauauuauauguguugauuagaguuggacuuguaauggccgcauuguuagagauugcauuucuacuuuccaugaauucuguuggauuugcagauaaaauguuuucugucuaauagggagaaaauauaaauaucaugcauucaucucucauacuuuuucauguaucaugccauucacaguucuaggauucuggagccacauuuguagccaccauuaaccaaaacaaaaacaaucccacaugacuauuaccuuugaauucaguauuguacuguauuauucugacacagaaauuugaaauccaauggguuggugagugaaaaagucacaugcagcugacagucacaguuuuuauaugacucuccuagaucuuuuuguuuuguggacguauguuuggggguagaugguuuagaguucuauuaggagagagaugaagguauucuaggugaguguugaguggcugacugcuguuagagggcaaaaugggauaaucuuuuacaaaaaacuugagguacaugauuuaguacuuugauuauccuagugauuguuacacugaaucagaaaaugcauuuaccuuaaaaccuuuauuguaacuaggugaaaguaaaugugguguaacuuuugguuugacuauaaugggcaguggaaucucagauguuaggaucagguaagaagaaagauugaacuaugucaugacccaguaagugaaggggugugugugugugugugugugugugugugugugugugugugugugugugugguguuguuguuguuggcgacagggucucaauucgucgccuaggcugggaugcaguggugcagucacgacucacugcagccucaaccucaugggcucaggcaguccucccaccucgccuccugaguagcugggaugacaggcacaugccacgauucccagcuaauuuuucuauuuuuuuguggagacggagucgugccauguugcccggccuguuguucguuuuucuuugaagaauauaccuuuuuauuuuauuaucauuugcuauaaauaucacuaaacuuugucauccuaagugagauaauaaggcaagauauuucaaggccuccuuuuguuauguaagcugaauucauagcuugaggaaauaagucggagucucauaccucugugucaacacugaacagcauuuuuugugacguaaaaucucauuaucacaaauuacaagugcgcuauucgguuuuuaaaaauuuuaauuuugguuuuugaagucacacauaaguuuuuauacuuuuugagggaauaaagauuucuaauuguacaacaguaaauggaauaaacaauaauaacuuugagucuucuggaauagauguucaaaagaucaaauuuuccauaucucuguaaucuaacuauaaccucugagggcaagggcuuguuuuauuugaauaaagaacccuauaguagcaugauuaugguaguuaugguauaacuuuauaccauaaaauaucccaugugcuauuauacuguggcauagcauauauacuauauauguuacaguuacauauaaaaauauauauuauaguaguauauaguaugauuauuuggcuuaaagcuuuuuuuuuuuuuagcaggagcauaguucaaggacaauuuuuuucagauuaaaauggacuuucuuugggaagccaucuguccccccagacuaaguuuuguugagaguagugacagggacagaggcaagaccauuagguuaccauaauaccuggacuuaguuuguauaaucgagguuaaugccagucuuguugacugcaggacauacaguuccuaacauauugcuuagcauauaauauguguuaaauauuuguugacauucggaacugugcacaauguuuuaugagucaggaccauugaguugcacaacuguggcacaccauucacauaaugauaauauagauuuucucaguucugaguuugcuugcugcauaaaugucuuaagucuuuggcaccuacugcuguuagaauauaguggcauuugaacacacaauuaaguauuuagcuuauguuacacauaaucaacuuucaauaaaugagaucuauaauaauuugccuacuccacucucaccuuccacagucauuucuccccugcuuccuauugguuguuuuguuuugaaccagcacccuuccaacucccccagagcaucccacaucauuagcuucacaagcaucuuccauaccagugucaucuuuaacaacuguguggcaguuuggacaaugacaauccaaaugacccucagauguauucuagcuauucuugacugccuucuggagucaguauuuucagccaaacagugaaaauuaacaacaaacuguguccaaaacuuaaaacuuaauucuucuuucacccaaaugcuuuuccuguguuuuuauauuuuuaucucuuuaauguauuuuuuucugguugcccgaguuacagauauugccaucuuuauccugcaguuguacugacuuaacgauaucuucuugauauuucuuccaccauguguaauuuuuuaugcucuuagggcuccuuuaaugaaggcaacucauauguaaaaugggaguauguaaaaauaauuugugggagagccaugugggugggguuugugaguagucucuaaggcgcaggcuacagcuagcuagccuaguguuugugagcccuccccuucccccaguaaagguugauuccuuuuucuccucuuuccugcuuguuuauuuuauucuauuuuauccucauuuucuacuucugccccaaaagcacccauucuaaugccuuucacuauauuguuuguguucuuguaaaauguauuuaguguuuguauuuuuaacuuacauaaaugaugccuaauucuuucuuacauuuuucuaagcacaauguuuuaagcucucucccuguugcuaugcaagcaucuaauucauugcguugaacagccacauaguauuccaagggguauacucauuuuaucuuauagaagaccagaucguuuccagcucuccauccccacuaacagugaacauucugguccguaaucuuuuuuggaccucuguaagaauuaagcagaacugcaaggggaucauagggcuuacuuaaauuugauuugacuuaaguuguaccagauuguuccccagaauggcuguacucaucuccaugcccaccaguagcagagcaugagaauuccuguguccucuuaggugcguucugauuuucuaauuuuugccaaucauacucuacacuuacauauggagaauauguucaugaacauguaggucagucuuagguguuaugcgugggagauggguuguugcucucccagauaugaagacgugcuccaauaauacuacacuguauuuauuaccguagcccugugguaagguaaacagaccaaugaagcugacuuggagcacccagagauggacauguguauauguaggauuuuaauauauaauauauaauuuauggcagcaccaaacacugaggacaagaugggauuguucauagaugguauagggaaauugacucaccacaaggagguaaauaaaaccggauuccuacuuaauaccauauaugaagguagacuagguagauuaaaagcucacaugugaaauuuuaaaacuauacaaugaagaaagaaaaugcgacccacaggccaggaaggauuuccuaaguguagcuucaaaaucacaaaucuugacaauaaacuaaagcaaauuuuaugugaaauuaaaauuuucuucuuaauggacaggauauuuucuucuuuuuaccucaagaucugugugucuggcagaaugcauugcacacucuucaggaguggggaggcugaauuggcuaugcacauauauacucucuugauagaaggaagaaagccucuguuuaccaaguugcccccauuuuauuuagcaaugaaauuguaagccacaugacaauucccuuuuucuaagcauauguaggaguagaguguagaucaguguuuucugaauauauugucuguaucagaauuacuugaggcaguuguuaaaaauggaaauuccucuuuuguccaucuccccacuguuuugguuucucucucucucucucucucucucucucuguguguguguguguguguguguguguauguguguguauguauauauauaauuuuucuuuuuaaacaaaaccucucuaggguggaguuuggcaaaguuauuuagcagaaguccaaguaguaaauauucuaggcgucauaggccauuugaucucuguuagaaccguucaacucuacccauaguacaaaagcagccauauacaauucauaaaugaaaaaaugugguuguguuccaauacagcuuuauuacggacaccgauuucaauuuaauaauucaauauaaaauuuauuaauaguuuucacgugucauaaaauacuaguuuucuuuagauuuuuuuaaucacuuaaaaaugugaaaaccuuucuuaacuaguagaccaaacagaaacagguugagggccugauuuggcccaugugagucauaguuugccaacucuugcuccuuaggcaacuaagguuuucaaaccagugcccuagcuuaucugauaguuaacugucauucucuguauuauuugggaaaaguucuuacaucaguaacaugaauuuucaguaccuguaagagaaaguaguucuuaauggucaggaagggauaauuaaauaaaugucuuacauaaaucuaguuuaagguaaauguaauguugaaacauuugguuuuuuaaauuccuuuuaagccuauucaagaguggguaauagagcugggugcaguggcccauuccuguaguccuagcuacuugggaggcuugagguaggaggauugcuugaggcuaggaguuugaguucagccugggcaacauggcaaggccacagucucuuaaaaaagagaauggggccaggugcaguggcuugcaccuguaaucccagcacuuugggaggccgaggugggcagaucaccugaggucaggaguuugaaaccagcuggccaacauggugaaaccccaucuuuacuaaaaauacaaaauuuauccggguaugguggcacaugccuguggucccagcuacucgggaggcugaggcccggcaaucacuugaacccagggggcggaggcugcagugagcugagaucgugccacugcacugcagccugggcgacagagcgagacuccaucucaucaaaaaaaaaaaaaaaaaaaagggaauggguaauagagauggaaaauggaauguuuaagcuguauuuaauaagucuuggaguauaccauuugagauggaauuguuaaagaugggacauagagaaacagucuuuuuaacugccuauaguaaaaauagcuagguguuuagcuacuuuuuuuuuucuuuuuaaaucgauuuaucaagaugaauaaauagcugcuaucuugaaauauucuaagggcaggggccagguaggcugugcgaggucaauauguuaaucauguuauuacacguuuuaagaagauaagcuaauucuugaaacucaccaaagaggaauucauuguacaaaagaauauaguuuaucccuaaauuugauggaauggucuuugauugauguuauaagaagaauagacuuauuuucccuuugguucaucaguagggcgaucauauaauuacuaauaauuacaucagggcaguaggcauaaaccaagauugucuugggcaaaccaggacauguagugaucuuauacaccagucacauauaguacuuuuaauauaaaggguagauaagucuuuuaacuuccuagaugaaaagaagacauccauuaaugucaugacaucaguaguacguagugaaaagagcauuuucaaagaaaaaaggugauaaacauuaguaugauaacuaugacugaaaugaagcuuauuuuuacacccuuaaggguagaaauacccugugguauuaauaguuuuaaaaauauauuucauaucuguguguguacauguacuuuaaauuuuuuuuuuuuuuuuuuuuuuuugagacagagucucgcucugucacccaggcuggagugcaguggugcgaucucagcucacugcaagcuccgucucccagguucaugccauucucuugccucagccucccgaguagcugggacuacaggugcccaccaccacacucggcuaauuuuuucuaauuuuuauuagagacgggguuucaccguguuagccaggauggucucgaucuucugaccucgugauccacccaccucggccucccaaagugcugggauuacaggcaugagccaccaugcucagccuuaaaauuguuauuuggaaauaaugcacgugauagacaacucaaaacaguagaaagggauauauagaaaaaguaaguuuucccauuuccagccccaaaggcaauagcuguuaucaguuucuugugcauccugugugaauuacuuuagauauacuuaaucuauaauaauagauuauacaccccuuuccccuaccuccuuuuuuaaauaaacacaaaugguaacuugcuguaaacacuguucuguaccuugguuuuuuaacuucagauaucuuggacuuuccccaguguuuucacaauaaaccugugcaguaauuuccuuauuuacaaaugaagaaagucaggcucagaguuuaaaguaacuugcuuuaaggaaaaacguauauuaaauaucuaggcugggcguaauagcugaugccuguaaucacagcacuuugggaggccaaggcggauggaucacuugaggucaggaguuugagaccagccuggccaacaugaugaaaccuugucucucuuaaaaauacaaaaauuagcugggugugguggccacaugcuuguaauuccaccuucuugggaugcugaggcaggagaaucaccugaacucggaagauggagguugcagugagcugagaucgugccccugcacuccagccugcguagcagagugagacucugucucaaaaaaaaaaaaacaaaaaacaaaaaacuuuagcuaagcagguacuuaguaaauguuaguuuccaucacguucucuuacccaaauauguccuuaugcuuaauaagcuuggaggaagauaaucacaauuuuagaaaaaaaaauacaauauacuuaaaugcccacauaaugugauauaaucaguaacuacccugacaguucagauaugggagaaaucaagugguuugguuggggaaaacuucauagaagaauauagagagauuaggaaagaauuuaaacagaaggccaaaagggagggcaucuaagaaaggaagagggaauagcauuagcaagaaaguccuaacuggaaucaaagggggagagguguugguaagccaagggggccuaauaagcagugaagaccaugaguucauguggucuuuagugaguggcuucuuucacuuaguacaguguucucaagguucauccauguugugucauguaucaguacuugauuucuuuuuauggcugaauaauacauauuucauuguagggauauaccauguuuauccauaugguggacauuugguuguuuccaccuucagcuguuaaaauaauguugccaugaacauucaugugcaaguuuuugcauggcuauauuuuauuuuauuuuuuuaggaaccugggagugguuuugcugggucagauguuaaugauuauguuuaacauuuugaggagcugcaaaacuguuuuccuaagugcauuguuuuacauucccaucuagccaguucccaucuugcuauuauccaugguuuuuauuguaguuagccuagugagugugaaguguuguuucauugugucuuugauuuucuuucuuuuuaaaaaaauuuuuaaauuucuuuuugaauuuuacuuuaaguuuugggauacaugugcagaaugugcagguuuguuacauagguauacaugugccauggugauuugcugcaccuaucaaccugucaucuagguuuuaagccccucauacauuagguguuuguucuaaugcucucccuccccuuaccccucacccucugacaggcccuagugugugauguuucccucccuguguccauguguuuucauugcucaucucccacuuauuugugagaacaugcaguguuugguuuucuguuccuguguuaauuugcagaggaugaugguuuccagcuucauccauguugcugcaaauaacaugaacugauucuuuuuuauggcugcauaguauuccaugguguauaugugccacguuuucuuuauccagucuaucauugaugggaauuuggguugguuccaagccuuugguauuguaaauagugcugcaauaaacguaugugugcagugucuuuauaguagaauuauuuauaauccuuuggauauauacccaguaauggaauugcugggucaaaugguauuucuggcucuagauccuugaggaauugccacacugucuccaacaauggugugucuuugauuuucauuuuuaaaaaaugacauucagaauuguauuuuucuaauagcaaugauguugaacaucuuuuucaugugauuauuggguaucuucauuggaucaaaauugacauauucucauuggaaaaaugucuuuuagauauuuugccuguuuuauuaauaaaauucaggcuuuuuaauggcugaauuuuaaaaguucuuauuuaucuaucuaauauaucaaucuauuaagacaagguuucacuauauugcccaggcugguauugaacuccuggccucaagugauucuccugccucagccucccaaagugcugggauuacacgugugagccacugugccuggccauuaaaaauuauuuuuauuccagauaaaaguacuuuauuagauacaugauuuacaaguguuuucuacccugucuguggguugucuuuuuauuuucuugaugguauugcuugcaguacaaaaguuugugguuucaaugaaguccaguuuaccuauuuuucuuuuguugcauguguuuuggaauuguauuuaagaaaccauuaucuacuccucuuuauuauuauuauuauuuuuuuuugagauagggucuuguucagucaccagagcaguggugcaauccuagcucacugcagccucaaacuccugagcucaggugaugguccugccucagccaaguagcugggacuacaugcaugcaccacugcauccggcacaccugauuguuuuuuuuuuuuuuuuuuuugagauagggucucuuucugucacccaugccagagcuguggcaugaucauggcugucugcagccucaggcucaagcaguccucccaccucagccucuccaguagcagggacuacagaugugcgccaccacacccagcuuuuuuuuuuuuuuuuuuuuuuuaagagacaggguuuugccguguugcccguugcccagauuggucuugaauuccugggcccaagcaguuuaccugccucagccucccaaagugcugggauuacaggcaugagccaccaugcccagccuauuccuauauuuucuucuaagaguuucauacuuuuaguuuuucgauuuggaucaguaauccauuuugaguuaauuuuuguguguggugugaagaaggguucaguuucauuuuuuuguuuguggcuauucuuuuguucccaacaccauuugauaaaaaagacuauucugucuccauugagcugauuuggcacucuugucaaaaaucaauuuaccuguaaauguaagaguuuauuucugggcucuuaauuagguuccauugaucuuuguaucuauccuuuugcugguacuacgaugucuuaauuucuguggcuucauaguaaguuuugaaauugagaaggaaguccucuagcuucguucuuuuuaaagauuguuuggcuauucuauguuccuugcauuuccauaugaauuuuaggauccgcuugucaauuucuguuuuucauuuuguuuuuuuuuaaacaguccagcugggguuuuuacaggguuuauguugaaucuguacaccaguuugagaaguauucccauauuaauuuuaggcuggguacaguggcucaugccuacuauauucccagcacuuugagagaccaagguggaaagaucacuugaggccaggaguuugagaugagccugauuaacaaagugagacccucuucucuauaaagaauaaaauaagccagccaugguggugcacaucuguagugccagcuagucaagaggcugaggugggaagaucaguugagcccaggaguucgaggcugcagugauugcaccacugcacuucagccugggugacagagacccugucucuaaaaaauaaaaaaaaaauuaaaauucagaucuguacaguuuggauguuuguccccuccaaauccuguguugaaaugugauccccagcauuggagguggggccuggugggagguguuugggucacagggacagacccuucauguauggcuuggugcugcucucacgguaaugagugaguuuucacuugcuuuguucaugcaagaucucauuguuuaaacaaugucugggaccuccccacucucucaugcucccuuuccugucaugucacaugccugcucucccuucaucuucugccaugaguggaagcuuccugaggccucaccagaagcagaugcuggcacuaugcuucuuguacaaccuggagaaccaugagcuaaauaaaccuuuuuucuuuauaaauuaccuagccuuagauacuccuuuauagcaacacaaaauggacuaacacaugauucaugaacauuaaaugucuuuucaguuauuuauauuucccuuaauuuauuucaaugaugguuuuuagucugcaguguacauauuuuaugcuuauguuaaauuuauucuuauguauuuuacucagauacuauuguaaauuugaauuuuuaaaaauuacauuuucugauuacucacggguaguauauagcgaugguugguuuuuguguauuaauuuuguauccuacagcuuuguucagcuuguuuauugguccuaagagcuuuuuaguggauuugaguuuucucucuacaagaucaugucaucugcaaauacagaucguguuacuucuuuuccaaucugaauacuuuuuauuucucuuuuuucuuuuuuugagacagggucucacuuugucauccagacuggagugcaguggugcaaucucaacucagugcagccaugaccuucugggcucaagcgauccucccaccucagccuccccaguagcugggacuuacaggcacgugccacugcacccagcacacccagcuagguuuuuguauuuuuguagagcaggggucucaccauguugcccaggcuggucacgaacuccuggguucaagugauccucccaccuuggcgucccagagugcuaggauuaugggcaugagccaccaugcccagccuuauuuuguuuuguuuuuuuuuuuguuuugagauggaguuucacucuuguuacccaggcuggaaugcaauggcaugaucucggcucaccacaacuuacgccuccugaguucaagugauucuccugccucagccucccaaguagcugggauuacaggcaugcggcaccacacccagcuaauuuuauuuuuuguuggucaggcuggucucgaacucccaaccucaggugaucugcccaccuuggccucccagagugcugggauuacaggcgugagccaccgcgcccagcugccuuauuucuuuuucuugcuguaauucaccuggcuacaacuuccaguaaaauauugaauagaaguaguaaggguaucaaguucuuuugcucugaaaaaaaugaaaaauaaaauaaguaguagugaggguggacauguuugucuuguuccucaucuuaguccucagaaaucauuuucuugucaccauuaaguaugguguuggcuguggguuuaucauuagugucuguuuaagagccaagcauuuuaauuuugaugaagcccaguuugucaguuuuuucuugugugauucaugcuuuugucuccucagaaaucugccuacccaaagauuacaaagauuuuucuucuguuguuuuuuuuuaauauaaguuuuaugguuuuagcuguuaaauuuaggucucuucauuucuguucacaauucagucuuuaaaugcauauaggagaguuggaggggagaggagacacuugucccucuuaacuuguuucuugguaaugagugaauuggugaaaauaacuacauguacaccuguagucuugcuuuguacagguuuugcauuugguagucugccagugcucaaaaauuccugguggugguuuuucagggauaccacccagugaccaucugugguggucauauguuauuuguucacccaacaucccccugggguaccaacacuccucauuuuauaauaauucguuuuauccacaugguucaagugggucuuuuuuuacccuccaguggugauaggcugacccaagcccaggcccaucagaaugcuuuaucuuggucaggcaugguggcucaugccuguaaucccagcacuuugggagaccgaggugcauggaucaccugaggucaggaguuugagaccagucuggccaacauggcgaaaccccacgucuacuaaaaauagaaaaauuaaccgauugugguagugcaugccuauagucccagcuacucgggaggcugaggcaggagaaucgcuugaaccugagaggcagagguugcagugagccaaaauugugccugggcaacagagagagacucagucucaaaaaaaaaaaaaaaaaaaagcuuuaugcaucuacccacagugauugguucagagaggguauuuaacuuaaucugaacugaugagagauauaccaaaguauuugggagggauguuuuuaaagcuuaccucuuuuccugagauauauuaucuuuuccaagcuauccuauguggagagccagucucaaaaugaagucaacccaaaauugagggguuagugagaaacucuuaaugacacugucugucccuucggguccauccuuggccugaagccuucucauggccuuuuugaugaugugggccaguuuaucuuuuggcccaggcucuuuugagucagguaucuauacuuguaacagaaaaagcccuaacuaauaagcuauuagucuucuugaauaaauuuuuaauauguaggaguuacaaauacauuaggcucugucuuauuaauggacaguaaaaggacaauaacuuuugugugugcucuuggaaguagcagcuccuuguggcuuuaaagaaauucuguuaaauacguaggauuaugauacuguuuuguggaaggcugaauuuaaguccuaagguuacaugagaauucacugagaagcauaucuuuaaaugucugcuuuuaaugaagauauagauuaauuauucacuugacaaacuuguugguauuuuaugggagaauucagugcauauagaggcuucaaaaggcagauuguccacugacagguuaggauucucaaguguaauuuuuuauuacuuuagagccguaauuauuuugugagagacaguaucuuugaauuaaaaugagaaauguuuuucaacuuagagauucaacucauuucagggauguguuuaauccaaaaauagagaguucauuauguaguggugaaauuaaaacauuuauuaaaagcagucuuuggguuuaaguagguagaucucaaaagugucuuuuuccuucuuauugguuaacuaagggacacaaauacacaaccuucucuaggaaacacuucuaccauucuuacuaguuuauguuuuaauuuuucaauuuuauuaaauuaguacaucuugauacguuaauuuucauauuguuucauuucauuauaauaccuucauuaguuauaugggauuuuacuauguuaauuuuaaccuuuaaagugaaaagacuaacuguugauuauuggaaagcaaaaauauagcuuuagauuuuugugacagccguuauuaauacauaguuaagcagucauuauuucuuuggaagaguuagcacuuguuccuuaaaaauaauuguaugcauagaaauagugcuuuaggccgggcgcgguggcucacaccuguaaucccagcacuuugggaggccgaggugggcggaucacgaggucaggagaucgagaccauccuggcuaacaugaugaaaccccgucucuacuaaaaauacaaaaaaauuagcugggcgugguggugggcgccuguagucccagcuacucaggaggcugaggcaggagaauggcgugaacccgggaggcggagcuugcagugagccaagaucaugccacugcacuccagccugggcgacagaguaagacuccgucucaaaaaaauaaaaauaaaaaauaaaaaaaagaaguagugcuuuagggcuuaaaggcacuuacauagcuuauuuccuucaagguucaguuccgugaggugugguauguggaauagcauuagcuguguuuuccagaugaggaaacugaggacugaacuggaauuugcaugcuguucagauuuuuuaaguucccugugugguuuuucuuuucuuuucuuuuuuugagacagagucucgcucuguagcccagagugcaguggcaugaucucggcucacugcaaccuccaccuccuggguucaagcaauucuccugccucagccucccgaguaacugggauuacaggcagguaccaccaugccuugcuaauuuuuuuuguauuuuuaguagagacaggguuucaccauauuggccaggcuggucucaaacuccugaccuugugauccacccaccuuggccucccaaaaugcugggauuacaggcaugagcccagcugugguuucuuauaucauacuguuaaguguacuuuuaaagcuuuaaaaagcaguguuaacccuuucuuaaaacagauuucagggaagacagacguuuaaaacauuagccuucucuccccaucuggaguaugguuuggaagucauugcuuuguaguaaggcauuauuuuccugguacauugccaaggaccaacaacuguuaaaucaacaaacuaagauuuucuucuagauuuguaucggauugugacuuugcuuucucccuuucaucacccauuaaugcuuaguaaagccacuauggaccucacguaucuaaacccuucccugaaaugcaucucucuuuucauaccacuccaaugggaacuccuguugauuuguuucugggcccugacagauuagcaggaaaagaaagcgcuuuagaaaagugagaggggaguucagagguuagaggggaaucagaaaauuaaugucaugauuaucaagaauguuuccagaaggcagggcucaucaguccuugacaaaaaggcugaugaaaaaaauggaguugagugcagccgaucaccucaauaauccuagcaguuuggcaagcugaggcaggaggaucacuuaagucccggauuuugagguugcagugcgcugugaucacaacacugcacucggccugggugacagagcuaggcugucucuuaaaaaaaaaaaaaaaaaagagagagaaugagaaaugccauuuaauuuugagccuggcaggucuuuggugacuuuugagacuaguuuacuguggaauguugagguaaaguaggacugaaucacauguagagggaucuguguguauuuaggagaagcaucaggaaauuggcacugaagggcaggagaaagcuggcccagcagccuggagggguagagguguucaggaguauguuuuagagucuggugguuuuuuuuuucuuucugcauaggaaaguuugaacuuuuuguaaccaaguguucuauucacuguuaaaguaaaagaggaauuagguaaagaccacauguuuaucuuagaaagaagcacacauuuuugugaaaugaaagaagagaggagugaaaauagaaauuuucaugugggaagaauugaaguugagguagcaaggaauaccaagacaacugagaaguccuuauaaagaacacauucaguacuuuuaagauguuauuuuccaaaacauacacuuuuggguugccugucagacuggagauguaugccugucgagucacguuacacugaauuuauuuaggaaauagucugacauacagaaguuucacuucuccugccacuugugaaggauuugucucauugguguggugucagccuggugagauaggacuugcuugugguuuggaagcugucugugggcaacuccaagagcuguugugcucugccucuuuaugaaccuucugugcuuauggaaaugguucccagcgugugcuccucaggaaugagucugagugacagaggugccaguaggcuaugagaugguagcaaugaccuuagcuagucuuuuuuguuuguuuuguuuugagacagagucucgcuccguugcccaggcuggagugcaguggugcgaucucggcucacugcaaccucugucacccagguucaaccucugucacccagguucaugccaccgugccuggcuaauuuuuguauuuuuauuggagaugggguuucaccauauuggccuggcugaccuuagcuagucuuucuuaagaggcugggagccugaggacaguugagagguacugagcuaguuaaaccucaggcgcuuucccugcgaaggcucuauggcagauaccacuuggggcuauagaagcuguuaccuacaguguaaauucuggauuucaaugcagagggcagacauagggcuacuaauuuuauuuuguuuugcaaggacauugaaaaaaagucauuguuuacugucgucagcauuuuauaaaagggaggauacuuuuuaaucacaaaauaugaagaaguuuauuauuuguuuuuugagauggagucucgcucugucauccaggcuggagugcaauggcaugaucucggcucacugcaaccucugccuccuggguucaagcaauucuccugccucagccucccgaguagcugggauuacaggcaugcaccaccacgcccagcugauuuuuguauuuuuuguagagacaggauuucgccauguuggucaggcuggucuugaacuccugaccucagaugauccacccaccuuggccucccaaagugcuaggauuacaggagugacccacugcgcccggccaggaacuuuaugacaauggaagacaaaccuuuauauugaguaaauuaaaauuuaugaaaaaaauguaaugcuuucucuuauucuuaccacucguguguaagaacaacugaccugcagcacugaagcuauucauuuuugagaaacuuguccuaaauacuuguccucccuccuccccacuuucucacaaguaaaagaaagggagcuugaaagcuggcaugcuaucugcuuacaugugagggagaggaggguugcccauaggaaauuuuuauauugggcccauuucuaagccacccucacuugagcucgucuuuaacaauuuaccucauaucaaauaccucguauuuuaaucauuuauuguuggacagucccccaccccccaauuuggcugguaguuuuaugagaaaaggcauuaauuauuuaccauuuuuguguaucuuacuagaauuuugccauauucauuaaauggaacugauugcuagucuaaacuuacuaccaguuaccucacuaaacacuccuggccaaacaauaucuagugccagcucuaguucagccugccuuugccugaggccagauccuucugcucugcccguggaagcugguugagaggaagugauguuuaauccuugaccuacuuuucaucuucccagagaguaaugugccugcagcuguucuuucacucucuuguuaaauucuugcuuucuuuuacuccuuaagggagguaugaggcauggaaauuuuccuccaucuccaacacugcuaccuccucacuucaccugagcacaugccccaugacucuccauauuaccugcucccacccuugugacuuugauauccauguggaugacccauaucuaucugcuuaccagugucugcuuaccagguucuucauccagaaacauuagcccaaaugaagcuucucucaccugagcaacaguuggccaugccauagcaaauggaguggccuuuguaauacagagauuugaguccagucuuugccaguuagcagcugaauggccuuaagguuaauuacuuaaagucucugggccucaguuuccucuaaugcaaaacagagauauucucuccaaaaugguguugaagaacuugcuguggcuuugccuuacccaguucauugaggguaaacugucuucccugguuuuuaaagcccuuaaugauuuggccucaaccugcccauccagcaggcaaaauucuuugguaccuagcauaguauugaacaaauacuaaguaugaauauguauuuuuauugguuuauuauauuauuauaaagcauauaaggauuuauuucguacucucauuguuucaugccuaacagucccgacugcuggagccacugaaauuuucauuuacuuuguuuugaagaagcaguucagaaccacguccugugugcagguuuugcacacagcagauguguaaggaugucuugaaauaagggaugguucuucugacauugcugaaggagaaaaucauuuugcucuaccagacugaaauucagagcucagcccuuugcugccagcuugcucucacagcugucuguccuugguuucugggugcuuucaccuuggcuagaugaagaugaacguucugacccgcucagguuucuguaggguugagacucugcugccacuacugcuccuuugaugcuggugacugcaccucacuaaauuagcuguucggcuagacaaaucuuuagcgcucugguuuuaccuuuuuagcaauguuuuagcugguaugcuuccuuguggcuuuguggggcucauuguuaauggaagcgcacauuaacaaaacacuaaaauggccaaacaucaacaaugacuuuaguuaacaaaauucugagagagguacaauuaguagucagaaauggacuguauuaaaguggcuauccuaugaguuuaucuugauacuaucuuaccucaugcuuacgugguguugaaugugccuuguaucuaaagcuguggguccuggcucuuaacaacaagcacaacccaaccaacguaucaagugaacugacuaaaaguauucauuuugcuuaaauguguuucuuucccauacacuuaccucuuuauuugcuauaagccauaaacaucaaaaugguguuuuuuaaagaauaugaagccuuauuuuuuaacuucuugaaauaaaacuagguaguaccuaaaauagcauguacacuauauuuaaacuauugcauauaauaguaaaugaauucacuagggauguaacuaauggugaacauucuuugaacuaaaaugaagguacaugauuugauuguuuuucgaaauguuaauauauaaacagacaaggagauauauauauguaaagucacauuuuauuuauuuaguaagugaugacugcaccaaaugcuacacagccaugcuuggagugaugcuugggaugucuauuuaacaauaccgcagggagacugcacaggccagaaaaagacaguuugcauucccuucugcuccuuaaagguagaauguagacaucuuauuuguauauguguugaugccuucggaggaucugugguuuauugauaacucuuuaguauuguuacuaugaaguaguuaugauuuccccagagacaauuuuguuuccauugccagugcucuuguccagguuguuagaccuccuauagccucuuuaauuaggcucucugcuucacuuauugaaggcucuaaguagcuucuuguuucugaauuguuugauguuuucaguguuuggaguuaccuauuucugaagacagugacuaguuuucuguuaccucacuccugauacggaagggagacagggaagugcugggaggagaagggugggucccuggcgagggcuccacccccgggccugugcccacagaccuaggugaagacaggcacuccagccuucacguccaaauguugcauuucccaagaccacuuugacccgccacgcccccauucugugccuauaaaaaccccaagacccuagcaggaagacacacaagcuggaugccgagagaaacacauuggcgaaggaauacacagguggauggacgucgagaggaaugcacugguguaggagcacacugggaugccagcaggccaucgacugguggaaugacacaaaguuuggcuggggcaguuggagaagaguugggccaccaagcggccagacuccaggggaaaaccauuucccuucuggcugccccaucugcugagagcugcuuccacucaauaaaaccucgcacucauucuccaagcccacaugugauccuauucuucugguaugccaaagccaggauacagaaagcccucuguccuugccauaaggcaggggucuaauugagcugguuaacagaagccgccuauggacggcuaaacuaaaagagcauccuguaacauaugcccacuggggcuucagcuguaaacauuuaccccuagacacugccguggggucggcgccucacagcccgccugucuguaugcuccccuagagguuugagcagcgggacacugaagaauugagccacacccccaucacacaccugcaagugggacaagggaaccuuucccauuucacugcugugacagugcaaagcuauuaaaaucugaauugcuuagcaggcauguaagguccucucugcucuggucucauuuaaucuuucagguucuaucuucaccuucauuucugcaggagaaacacaucucuguaccaaaaguucuucgguuuggucacccuuuccccugaaaaaaacguauuaagcucuguaagcauaacuuagauaccauuacacugugaaaccuucucaguuuuccauagaauacauuucuguguucugucuguuccuuugaaaacauuuuuuuaguuuguauuguacuauauguggugcagugugcaaugaacuauaugucccuggcauauaguuaucccugaauuauguggugaaucuauaauauuaagcuaauauguuaugcuugauuucuggggaccaaguagaugaucauuuggaaaaauauaccaccauugugcauggcagaggaacuucauuugguaaagaauugugucacaugguuauagguuguaagauacuaucuuuuuccuuuccgucuuaucuuucuuauuauuuauuuuuugagacagagucuugcucugucacccagguuggcauguaguggugccaucacggcuuacugcagccucaaacuccugggcucaggcauuucucccaccucagccuuccaaguagcuggggcuacaggcaugcaccaccacacucagcuaauuuuuaaauuuuuuguagagacaggguuucccuguguugccuaggcuggucuugaacuugcgaccucaagcaauccucccaccuuggccucccaauaguuuucauuuuuauugaaauuauacacuaacauaguuuaaaggcuuuaauauuucuuuguuuguuaaaaaaaaaaaaaaaaacuauucccagcauuuugcucucuaguggcaacuacuuguaccuccuugagccgaguacuuuguuguuuauauccuguuuuuagguauauacucauauuacuuuauauuucaguuuuuaccaauaacucuugauucaugacaauggaugaugacaacuuaguucuuuccuaccuagucacacucuuccuuuauccuguuuugcuuagaucaauguugauaaaauauucacuguuuauauuaugugagcauuauucacaugugguuacuuuuccuuccuugcuugacuaccucccuccccaaguuauucucucaccuuuuccccucucccuuucucccucugugcccuucccuacccacuacauauauauacuugucacaaauucaaccccagaugccuucacaauuaucuaaaaguccucaaaagacauucagaugcauagguuuuauauaaauuuuauuuuacuuuuuauuuuuuugagacggaguuucgcucuuguugcgcaggcuggagugcaguggcgcgaucucaacucaccgcaaccuccgccuucuggguucaagugauucugcugccucagccucccaaguagcugagauuacaggcaugcgccaccacgccuggcuaauuuucuauuuuuaguagagaugggguuucuccauguuggucaggcuggucucaaacucccgaucucaggucauccacccaccucagccucccaaagugcugggauuacaggcgugaaccaccgcgcccagccugaauuuuaucuuuuuugaagaaaucucuccccagagccaucugaccucuucugguuuuaacaggcuaccugcuaacucuguuuauagcugucauaccggauucucgugucacugucuuuuggggaauucucuuuacuauucuacauagaaguuuuguuuccuuuaucuuuuucuuguuuaugcccuuauuuugcagaguacaucccucaguaacuuccugaaaaaggauucuugggagauaauuuuuuagagaccucaaguaucugaaaagaucucuauucuucccuagcacuugauugauaguuugucugguguggaauuuguauuggaaaucauuuugaagacauugcuucagugccagcuuacucccacuauugcuuuugaaaucugaagcccgcugauuugggguuucuuacacauuacuuuuuuuuuucucccuggaaacuugaugugccaccuuguguaggucaguuuuccuccaauguacugugccuuuucaauguggaaacucauggccugguaaguuuuaaguuauuuuggaccuccucucuguuuacccuuucuggaucacucucacuauucaaaucuuuguccuuccuaugguccuuuaauuguuguaucuuuucucuccuauuugcagccuuucuucuacuuucuugggagauuucaacuuuaucuuuuauugaguuuuugaaaucuuuuguuugcuugcuuuuguuuuuaauuuucaaaagcuacuuuuucuccucugaauguuauuuuguuuuggcuuuauucuuuuuucauaagugcaauguauucugucucucuggauauuaauaaguuuauuuugaaauucucccuauaauuucuguuuucuguaguuggcuaucuucuaguuuguuuugauuuuugauuuuuauguuagaaaagaaccauguuccucaguuaucuguuccuuaguuagaaaggucuuuccucugagucgcucauauuccccagaagagacugccuggagggcgaaggccggccuguguucugggagcugaguggagaaagaaaacuggggucuuacuguccugcaugcauaagcucuuuuucaguacagcaccucugcccucauccauguuaaugaccacuggugcagagacccucuguuucaacuucuucugaaaauaaauuucagacugucaggauuucucuuucuguguaacaaauuacugcaaauuuagcagcccaaaacaauacacacauuuaguaucucacaguuacugugggucaggaauccaggcauagcuuagcugagcccucugcucagggucucucuuggcuguagucaaggagucagcuggccuguguccucaucuguagcucuuacaaggucacauaguuguugacagaauucaguuccuugcagcuaugggacugaggcccaggcaacuccuagaggccgcucauaguucucuagcccuuuucuuagguaguuuaugucauaggagcuugcuucuucaaggcuagcaggagacucuucagucaguuaagacuuaguccuuuuuuugagauggaguuucacucugucacucaccuaggccggagugcaguggugcaaucucggcucacugcagccucaacuuccuagggcucaggugauccucccgccuuagccucccgaguaacugcgaugacaggugcaugccaccaugcccggcuguguuuuguauuuuuuuagagaugaggucucacaauguugcccaugcuggucccuaacuccugggcucaagcagucugccugccucggacuuccaaagugcuggcucacaccugugagcacuuggcuggaauaggacauguuuguaagucagcacccuucucuguuuggggauaaugcuuuggacuucuugguauuaaaugacuguuugaaucauuuuagaaaccaacugauaccaacaugaaguagcauaugacucugccgucuguuaacuuacaagccaguuucgugccugaccaguggccaccaguauuugcuuaccagucauucuaggcuuguuacguuuagguagcugugaaaugucccacaucagcccuccaucugugggccucuuuagcugcugcugcugcugcagcaucuagccuuuugaaagcuauugucuacugcucagcuagaaggguguguguagacagcaggaccaaggauucgccugggugaaagaguuggcaaugagaaagcaaccagacccuccccuccaagcccagcccuguauuugacaugcagggcauaaccucacucauucagucucucagcccuaugcaaauauaaacagccuuccucuugucucuccaggccagccggggccaagaaagaagccagugauucccccaagugcaguaaauagcucuccucaccuccugacccuguuauuuccugguaguucugaguuguggauccugcaguggagagggagggaacaaagaaguugcagaggccucagcuucacagagcauugagcagugggugauauuguauccucaggcagggguugaccucacauuucagugcaggucauucuaaugacugcuggaccucccagugccacugugaacuagaauggaauagagugaaguggaucugaauuccuggacugugggaccaaccuaacuucugagcuggagaaaguaggucucauguucuauaccugcuuuuuuuuagcucuagggggaaaaaagaauugugcaucuuucuuguucucuuugcagcuuaggggcauaacguuuggacuguaauugaacugaugcuuguuuccccaaaaugucuuugguuuucauuaaggugggggauucucugcauuuuuggaguugucacauuauuaucgaaauuccucuccacacuaaguacugugugugguaugcuuuuauuuucaccuaauugauuucugcaaauaaagugauuuaauuuuugguauuaagaaauuuaaauaacaccuuuuggcagaucacaagauuuucuuguucuuauuuaauccuggcuuccauccaaaugugaaagagaaaugaaauaauaagguaggaaaggcagaccaguaauugugauuaaacaacuuuuguguugaguccaaagacagguaacuuuauuuuaagcuucauggguguaguaaaaauauaucaccuuaagaaaaccuggauugccauuagccagaacugacuuccaggcuuucugacuuuguacaaacaaaucacuuaauccugaauccuucuccucaucuuuuuuuuuuuucucuuuguuuguuuuuaaauguauuucuuuauuuuguauuacuuucuucuugucuuuuuuauauuuuauguauuuuauuuuccucaucuuuaaaauggauaaauguuaccuuuccugauucaaagauucuaggcaaagaucaaaagaagucaaaguuugugaaggaacuuugaaaauuauauauuucucugcaauuguguuaggguacuuuucugucuuugauuuauguugguucuuggagugauacuuuagauguacaaauaguaggucagaacaaaccuguauguaauaaauucuggagaauugaguucaaacuuugguuuugcuuauauuuggauaaauuaucaucaacuuuguugagguguaauuuauacacaauuaaauucacccauuucaaaucuuccauguguuuugacuguuuagauaaauugacaaauaauuaucuuagauaacaguugguauuucuacauuaaagaagggagaaagagcacccucuuuuggcaaaaguuucuccugugugggcucuccggucccccugucucauuucaaaaucagauuugcauccugcuguuggaguacacuugagcccuuucauuuauacuggugcagguuuuguagucucuuagagauucaguaugucagucccaugucugagagcaaaggagaaggaagaggguaggaaagagcaccugaauugaauagagaggagggagcagagaaggcagaacagugagauaguauccauuuagucugaguauuuccaaauuuuccaauaaaaugucaguggaagcuuuuaucauaaggccaaaaucuguccuucaaugugaccacagagccacaggagacccaaaccccuuguagucacugaugauuuucauugggcuauagaugggaauggcagcagucauaaauauuuccuaugaaugaguguucuagauauuuuuuacccaaagauguagcauaucagugggucacuauugaaaacauguuuggaaugaagcaggaaaauaagucaaaagaucuccccucaguuccuaagcaacuuuguuguaaaaauaacugugaaaacugggcuuaaaugaaacauacauucgaaugccuggaguaagaauuauugauagcccagacuuaguaucccccccaccuuuccaaguccuuaaagcauuggcuuucuacucagaaacgcugcuuacccuagggugaccauaguuacuuuuauuuuuuauuuuuauuuauuuauuuauuuuuagauggagucucccucuguugcuuaggcuggagugcagugacacgaucucacucacugcaacccccaccuccuggguucaagcuauucuccugccucagccuccugaguagcugggacuacaggcgcccacuaacacacccggcuaauuuuugaauuuuuauuagagaugggguuucaccauauuggccaggcuggucucgaucuccugaccuugugauccgccugccucagccucccaaagugcugggauuauagccaugagucaccaugccuggccacuuuuacuuucucuuauuacuuuacuuucuacauuaauagguagauuagauuccaucucuucuaccuuuauuuuguccuucagaauagaaauugggaaguaaacacaguguuguuuuuuuuuuuuaaucucaauaauuggaaucuguuugaaggagaaaauccccugcaucucauccugcaaguauaaccacuauuaaguucggguauauuuauaucuuacaaaaauguuuguuuugcauacuguuguggaacuuguuucuuucaauccuucuggauuucuuuccuugcuuaguauguauaccucauucuuauuuaagagcuguacaguauacugucauaugguuguacuccaaugaaccuaucuccugucaguaaguuagcucauuccaaauuuuuuucaucauauauaaguaagagucuccaaaauauccuuauacuauagucacaugcacguguccaguuauuuccuuaggguaaguuccaagaagcagaauuucuauaucaaaguguuuacuggaaauuuuugccauucugauagguaaaaguaccagaguguuuaacuuguauuucuuugagucuaaguaagauugugcaucuguuuauuugccauauguuuauuuuccacuuuugagaacugccuguguacuuuauccauuauuauuauuuaaauuagucaagauauuagcccuuaaucaugaacugaaaauacccccuccaaccuuuuuauaaacuuuaugguauccuuuuuuuuuuuuuuuuuuuuuuuuaaggauuuucaauuuuuauguagucagaucuguuggucuuuuccuguguguguguguguguguguguguuaacuucagugaugucucaguuuuggucauuccugcacuccugccugcccccucaccccaaggugacuugugagaugagaguucaaauacaaguaguuuauuuccagguacaaagaacaaagggaagcuaaggaagaaaagauagucaauaaaagaugucucaucugggcuuaguggcucaugccuauaaucccagcacuuugggaggcugaggcagucggagauugcuugagcucagggguucgagaccagcccaggcaauauagugagacccugugucaaaaaaaaaaaaaaaaaaaaaaaaaaaagaugucuuauuaagccaaaccccacagggaaaauugccuguguggaaacugggaaauugggcagaacacuugccucagaaugaucccgcccaaauuaucaguuauucauugagggcugcucuuggggggaguguuccaguuauuuauugcuacauaacaaaauauucuaaacaaaaaccacuauuuuuuauuaugauuauaaucuuucauagauauagaguuuggggcugggcucagcugguugguuccuacugaagcuuucuaaugcaguuacaggggcuaggacuggagucaugugaagccuuccucacuuuuacaugucugguuuuccaccugggcugggaaggcccacagcugagggcuguaacaccuugggcuucuuggcuaauucucauucuugauguggucucuucacacggucucugcaguacuaggcuucuuaugugauguuuagaguuuccaaggcacauagaaagggagagacagacagcugcaggaugagauggggggccggggggaccauagcuccuuuuuuuaaaaaaaggagccaguugugaagucacacuuauaucacuuuagacuuaaauaucaccagcccauauucagagggaggggaauuagacucugccucuuugagcaguuucaaacaaucuguggacgguguuguaaaacugccacagggaguuaauuuaccuguauuucugccuauugcuaugggcagagcagcuuuaagcacagaggcgcagauagggguagcuagaacuuggccacagcacaccagaauccuaagggauguguuggugaggcacugacagcuucugcuauaguuuaucagugagcucaggaguucaaguggcuucucuuauuuccaaaacuauaaaacuguucacuuauauuuucuucaaguuccuauuuaaaauucuuuuuuuauuuuauuuuauuuuauugaucauucuuggguguuucucgcagagggguauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugauucuuaacgagcaugcugccuucaagcaucuguuuaacaaagcacaucuugcaccgcccuuaauccauuuaacccugaguggacacagcacauguuucagagggcacaggguuggggguaaggucacagaucaacaggaucccaaggcagaagaauuuuucuuaguacagaacaaaaugaaaagugucccaugucuaccucuuucuacacagacacggcaaccauccgauuucucaaucuuuuccccgccuuuccccucuuucuauuccacaaaaccgccauugucaucauggcccguucucaaugagcuguuggguacaccucccagacggggugguggccgggcagaggggcuccucacuucccaguaggggcggccgggcagaggcgccccucaccucccggacugggcggcuggccgggcagaggagcuccucacuucucaguaggggcggcagggcagaggcgccccucaccucccggacggggcggcuggccgggcggggggcugacccccccacaccucccucccggacagggcggcuggccgggcagaggagcuccucacuucucaguaggggcggcagggcagaggcgccccucaccucccggacggggcggcuggccuggcgggggcugacccccaccucccucucggacgggguggcugccgggcggagacgcuccucacuucccagacgggguggcugccgggcagagaggcuccucacuucucagacggggcgguugccaggcggagggucuccucgcuucucagauggggcggccgggcagagacacuccucaccucccagacggggucgcggccggguagaggugcuccucacaucccagacggggcggcggggcaaaggcgcuccccacaucucagaugaugggcggccgggcagagacacuccucacuuccuagaugggauggcggccgggaagaggcgcuccucacuuccuagaugggauggcggcggggcagagacgcuccucacuuuccagacugggcagccaggcagaggggcuccucacgucccagacgaugggcggccaggcagagacgcuccucacuucccagacaggguggcggcugggcagaggcugcaaucucggcacuuugggaggccaaggcaggcgggugggagguggagguuguagccggccgagaucacgccacugcgcuccagccugggcaccauugagcacugagugaaccagacuccgucugcaaucccggcaccucgggaggccgaggcugacaaaucacucgcuguuaggagcuggagaccagcccggccaacacagcgaaaccccgucuccaccaaaaaaauacgaaaaccagucaggcguggcggcgcgcgccugcaaucacaggcacucggcaggcugaggcaggagaaucaggcagggagguugcagugagccgagauggcagcaguacaguccagcuucggcucggcaucagagggagaccguggaaagaggggagggggagggggagagggagagggagaggccuauuuaaaauucuuaguuuaacuuuuguuuuuuaaugucugggaguaagaaucaagcacuuauuuuaaugguuaaccaauuacaccaaaauacuuuaaaaauaaucugcccagugguucucaaacucuuugguuucaggaccccauuacacucuuaaaauuuauuucaggccccagcagcuuuugauuauaugguuaacaguuauggauuuuuaccauauucacaauuaaaacaauuauuuaaaacaucuaugauugauuuuaaaauaacaaaaaacauauuaauauaaauaacauuuuaaaugaaaacuguuuuucaaaauuaaacagccuaggcugggcgcaguggcucgugccuguaauuccagcacuuugggaggccaaggcagguggaucaugaggucaggagaucgagaccauccuggcuaacauggugacaccccgucucuacuaaaaauacaaaaauuagucgggcgugguggcgcaugccuguagucccagcuacucaggaggcugaggcaggagaauugcuugaaccugggaggcagagguugcagugagccuagaucacgccacugcacuccagccugggcaacagagcgagacuccaucucaaaaaaaaaaaaauuaaccuagaagacugguacuauuucacauauuugcagaugacuuuaaugucugacuucuuagcagacagguagauuuucauaccugcuucugcauucaggcuguggcccucucacaccugguguagauucaggaaaaucucacaguacaaaugugagaaaaugggaguaaaaaugguaagucauguuuuagauuuaugaaaauaguuuugacuuuauggggcucccuugaaagggucuugggagaacugccuaguuuuucccugaugauguaaaugcuaccuucagcugaaggcaucuuuauccuucaaauucacaugagcucuguacugagggaagguacagggagccggaccuaggaugagagaccccauggcccugggagggugcagguggagguugagguugaagcagcagcaaaaugucagaauuaggcagucgggcgcgguggcucacgccuguaaucccagcacuuuggggaggcugaggcaggcagaucaugagaucaggaguucgagaccagccugaccaacauggugacaccccgucucuacuaaaaauacaaaaauuaggcaggcaugguggcgugugccuguaaucccagcuacucgggaggcugaggcaggagaaucacuugaacccgggaggcggagguugcagugagccaagauggcaccacugcacuccagccugggcgacagagcgagacuccgucucaagaaaaaaaaauaagagaccggcaggagaguuucaggcugauugaccagugcagggagguguucugauuccuucauaaauaggguaaccauauaacaugcaaguuggaacacuuuugaaagcaaaagugggcaacaaaaaacugaaaauuauuauuaccagauaaagguuuugccaaacaauaaaauaauagauucauaucacacagugagcaaaaaaucacugugcaagacuguucacacaacucugcuuuguagcaaguuauugaagucuguuucuugaacucuguacuugugucacuucccaugcuucccacugaccuagcagcccccugacugccccaccuggaguuugagauuggcagcaguugcaguguggaagcugcauaaggagcugaguguaaugggagaccuuuagcuaaaauuaauuucguaaucaaagaugugugccagaaucuuuucuuagaauugaguaaaaccugauaagcuccuuuaagagaaucuugguauccuuuuaaaacuuucuuugugacacucuugcuuuuggggaucagcacuaaauguguggaggguagagguguuaacaauacguucuccccucaaaaagucugaacaagaugcucugcuuuucccccagcugacucucacuuaugcacaauauaguuaaucaucccaauagaagagucaguugugcccugugaacugaagaaccaggacuaauaacccguugguauuuacucauucaaauagcaguuuuguguaugguagcauaagcauugcaacugaagaaucuggacuccaccauaaggcagauuccagacacccaagcucuggauucuuuagugggaauagaggagucaucaccacacacacacagcauuggauucuguccugacucguuuuuucuaacuucuugggcgaaagggcagauuagaauuguuccaacucaggcuuguauaauuccugcagaaaagaccuauuguuggauccaccuuuauccugacuuaccuacauguuuaaucuuauagaggaaaauggcuuucaagacacaagggauacugaucuuacuuuaauucuaaucacugccguacccccaaccccugcuucuuucaggcacuuggcauugaacuaguuuugucauuuuacuugcuugccaccuacccccacgacuacccugacaggccagaagggaaagugcgguuccuuagcucacuguacuaauaacuccucauucagccaucccuaguuaagagugacccccuaauguccacauuuuuuaggucugcucuucuuuugucaucccuaccagaguaacuuaacccuuuacuuacaaguuacuuggaaguaguuuucuuuuaaaaacagugucaucuaauuuuuuucaauauuggaauguaaauuuccagaugugcuggacugucccuagagcagcagcauauacaguaagaccuacgauugaaugacuaacugggcaagauugagcuuuugugauguuuuaauuauuuuaccuaauauggaaacacuguuguauaaucccaaacaguaguacauauuugaucaucuaauuaaauauugguaacuguuagugugccaaguccuguaguaugugugggaaauuacuacccccuagagacuuaaauucggauguacaaaagauuguauccaaaugacuauagcagucuguguaaauacccagacaaaucuauucucuuccugguuuggaacaaauuuuaaaaaugaacucuauagcuuccauaggccacaaaucauccuugugcgucacaaaaaguuaugucaaaaauuccuucggaaguuuaucuacuuuaugcuagaggaagacaguaggcaccauuuccucaguguuguuguuacaagacuuuuggagggcuuuguuagaaggccauuaaauggccacacuguuggagaucuuaagugccugggauagucuccuucccauaguuaggaagauauauccccuauuuagccccaccguguuccaguauaacuuccuugauacaguggauaccacuaaugugaauuuuuuuugagacggagucucgcucugucgcccaggcuggagugcaguggcgugaucucaucucacugcagccuccgccucccagguucaagcgauucuccugccucacccuucugaguagcugggauuacaggcgcucgccaccacgcccagcuaauuuuuguguuuuuaguagagacgggguuucacuguguuggccaggauggucucuaucucuagaccucgugaucugcccgcuuuggccucacaaagugcugggauuacaggcgugagccacugugcccagccaaauaugugaauucuuguguguggguacuaguuuuucuggggagcccuuuagguuggcucuaggucugcaaguucuuuccaagggauaguuaaccugaaugguacauuccucacaguaccagagccucuuccuuuccucuuccccucaccuuaggugaggaagccuucuaacuuaguuauuaggacuauggcaguggucgcccugcuuuuuaauagcacuuacaaaaucgugucacuacccuguuaguuucuuuaguaaaguuuucucauuuuucaaguuccuucugccacucgcuucuagguuacaaaagguuacuguuuuaugaaggggugcugaggguaagaauguaccaaguagaucucauggagaaggcagcuuucacccaguaucucugguagauugcuaccuucauagcuuaucuucucuaugaauuucuuagcaauagaagaguaaaucaggaguggauuuuuaguaguguguuugucauagggaauguagauguaauuggauuuuuuuuucauauaagcauuuuguaaauucaguuuuggguuuuuuguuuuuuguuucuuguuuuuguuuuuugucuuaauagagcuaggcauuaccaggguugaugcauauuuauuacugcaaagaguuguagacaagggaggagggagcuaaauaauauuaaugguaauuuaaaucuagaaaaucagaacuguggcucacuacuguaaugucagugcuuucagaggccaagcagaaguaucgcuugagcccaggaguucaagaccagucuggguaaccuagcaagacccugucucuaaaaaaaauuuaaaaauuagccagguguggugaugcacgccuguaauccuagcaacucaggaggcugagauggaaggaucacuugagccagcugugauugagccacugcacuccagcuugagcaacagagugagacacugucucaaagaaagaaacaguugguauucauugcucuuaauaauccucuguagcuggcuucucaaacuuuaaugugcauaagaaucauuuguuaacaugcacauugauagggucugagguggagucugaugucugcauuucuaacaaacucccaggggauggaugccgauguugcuuguccagaggcggcacuuugaauaucagucuacagaacauucaggguauaugcaaauuaacuuuuaauaauaacaacagcaaccauauauauugauccuuuuuugguguaccaggcacagaaaaauaaaauaagacugggcacuggagucuaacagcugggauucagauugaagcucuucccuuuacuagcuuaacccugagcaaauuuucucuaaggcaggguuucucagccuuggcacuguugacauuguaggcugagaucauucuuugugggggcugucuggugcauuguaggauguuuagcaacaucccuggccucuauccaccagaugccauuagcaccucccucccguuuguggcauucagaaugacugcaagcauugccaaacgucagggggugggguaggaggcaaaauuacuuccaguugagaaccacugcucuaagacuacuguugaaauauggguguuuggggggguuugugauaugaaugauguacuuuauguaagugacauagaagcuuaucaugaagcuuccacagacaaaaggagaauaggcaugcaguagcuaauaagcaguccgugccacaucuggcuuucugaggaugaugauaaagcuuauuccaagugccaguucuuuauuuuuacgaaacauuagucauuguacuaugagauaauaucaggaauuacuugagauuuuuaaauagguagaacugaguuucuaauucaguugaucccaagccucugcccuuuuuugaaauacgcuggcacuguugcuacccugccccugccucugccccuuccuucauucuuacuucugcugcuguccgcaugucucuuuuuccccccuacucuuuaaaguuuuauuucacuaacuugaggucaaaugucacaacuguguucuggucaauuuacuauccuugcuuggcuuccccaaaugguaguaccagaagauuugugggguagggagaagagaccacuuuaagacgcacuacauuuacucaucuuccacaaggcaacagaguugggcaucugauuauucaacaaaacaaagcuucaguagcacccaggagggcagacaggcaaaccaggcuguagacacacugcauuugucaaaaucagaccagagaaaaccuacuccccacagauuaaaagguagcgauagucaucauuucuuuuucuguugccacaacguuuuucuucuuuuaauuauuaucauguaguugucucaaguccuuccuuuaguccaggguuccccaaagccugggccacagaccccguacuggucccuggcccauuaggaaccacgcacauaacagaugagcagugggugggcaggccggccagcugagugaagcuccaucuguauuuacagccacugcccauggcuugcauuacugccugagcuccgccuccugucagcucagaucagcaauggcauuagguucucauaggcacacgcaaacccuauugugaacugcucaugugagggaucuagguugcgugcuccuuaugagaaucuaaugccugaugaucugcuacugucacccaucacccccacaugggacugucuaguugcaggaaaacaagcucgggggcuccccacugauucuacauuauggugaguuguauaauuauuucauucuauaucacaauguaauacuaauagaaauagagugcacaauaaauacaaugcacuugaaucaucccaaaccaucccaccccccaucuguggaaaaauugucuuccacaaaagcagccccuggugcagaaaagguuguggacugcugcuuuaguccaucuccuaugauugcacagguaagcugcaaaugccaaggacuugaugagcucaguucaccccuugccaacaauguaucaguuccugagagaaugaguuccugaagucuugcuguuagcaacuauaaguagagggacugcuugguuuucuauauccuaguuauuuuaugaaguuaaguuuuaguuucuuccauccuuccacaucuagaguccacaacaaauacaaugccaucugugcaucuggcauaugacuuccacaguggccuuacuuuguccuaaacaccuacaucccagaagugaaaagggacuguuuuagaauuugccaagauuaccuuaauuuucuccguguuaaaucuuuugguagguacaguauuuacaaauucaugagcugcagccuguauaagacaguugucuugcuagcacaguacaaacccaggaaaacaguguggaaagacugaaaugaaggccgacuggacaggauagaaguguggucugauaguccauuucccaauuucccacugcaaauaaaugucccaaauugaaaugcuuucuucuugcuuuagaacuucucuucguaggugauccagcuauaagacuaaccauccuucccuucucuucacucagcgucuguccuaacaucuggggaggugcucugauaccuguccgugggcaccagggaggccugggccgcggcggaggacagggcaccaggugggugcugugugccuggcugcucuaacagugcucgcccagcaguccgcaagucuguuucuagcaugcuuaucuuccuaucuucccagccucucauccuuucacuuuuuuucuaggguaugacagcagauaacuaagccuucuaaaauuaugccuagaauaauaucugaacuaugguuuauguguuuguaggcaaggguccugucucccaauaaaaaauguaaaaauucauuugauagaaagauacuuuuaaaaaauugauucuggccaggcacaguggcucacgccugugaaucucagcacuuugggaggcccaggugggaggaucacuugagcccaagaauuugagaccagccuaugcaaccuggugagagccugucucuaugaaaaauguaaaaauuaggcugggcgcaguggcucacgccuguaaucccagcacuuugggaggcugaggcgggcggaucaccugaggucaggauuucgagaccagccuggccaacauggugaaaccccaucucuacuaaaaauacaaaaauuagcugggugugguggcggaugccuguaaucccagcuacucaggaggcugaggcaggagaauugcuugaaccugggaggcagagguugcagugagccaagauggcaccacugcacucuagccuggaugacacaagcgaagcucugucuuaaaaauaauaauaauggauaaaauuuuuuaaaaauuagcugggcaugguggcaugugccuuuagucccagcuacuagggaggcugaggugggagaaucacuugagcccaggaagucaaggcuacugugagcugagaucacauugugcuccagccugggugacacagcaagacugugacucgaaaaauauccuaaauuucacuuugcuucaggauguucuuuaaaagaaaucaauaaugucauuugaaaauugaaaugcagauuugguuucugaccauugaaauggaagagcagcagaguagucuguaauaagucuguacugagaaugggaauggggaaagacucacaaaaacaugauuuuaaaacaaaaagaaaacaugaauguuacuuuguggaguuacccuggaagauuuuaagucaguccagggaacacaacagauucuaguaagacugugcuaaugacagucuuugacaguugguuuguuaauaccucaaaugauuuguaguacaguuuauacugugcagaugcuguuuaagacuguauauguguaaagcaaaaguuacuaccaguugauaguuuuuuacuuuguauacuuaucaauauaauauugaggcauaagauauguagccacgcuguccaguggucauuagggggaaaaugucuccaggauuguaggaaaagcugucagaagugaguccuuguuaauugcguuuauucaauggagaguuuccuaucaguuaacagacacagcuuccuguaugacagaagugucguggcucauggccauccccgcuccuauuguuuacauaccugugugaagucagaauccuuuauagaaagaagaaaauauuguguuaaaguagaaauuacucauuuuucuuaaaaucuguaucagaguaauauuuauuuugauuagaagaaaaaacuauguuaucuuuuucuuuuugccuuguauguauuugcuuauauuuugaaaagugcuuuuaguuacaaauaaaccuuaaaccucuguguagaaaaaugugaaagguauaggcauggucucuucacuuccucaguuacauccucucaugcagagguucuaaucacaguuaaauuucaaugucuucaaacacggauaaguggguuuuuuuaaaaaggcacagucuuauacuuauuucuguaaccccaaucauacuuugguuggcugguuuuaaaaaaucauguuacacaaaacugagaugacccaguuuagagaaucccaauuaaaauaagugcucaggugaagacaggguagacuuaaugcaaaauuaugaaauguacuuuucugcucccauuguguccggaauugguggguucuuggucucacugacuucaagaaugaagccgcggacccucacggugaguguuaacaguucuuaaagaugguguauccggaguuuguuccuucugauguucggacguguucagaguuucuuccuucugguggguucguggucucgcuggcuucaggagugaagcugcagaccuucguggugaguguuacagcuuuuaaggcagcacgucuggagcuguucguuccucccguccggaguuguuuauuccuucugguggguucgugguuuugcuggccucaggagugaagcugcagaccuucgcggugaguguuacagcucacaaaggcagugcggacccaaagagugagcagcagcaagauuuauugcaaggagugaaagaacaaagcuuccacagugucaaagggggccugagcagguugccacugcuggcucuggcagccugcuuuuuauuccuuuaucuggccccacccacauguuacugauuggugcauuuuacagagagcugauugguuuuacagagagcugauuggucugcuuugacagggugcugauuggugcguuuacaaucucugagcuagacacaaaaguucuccaaguccccacuagauuagcuccacacagagcacugauuggugcauuuacaaaccuuuagcuagacacagaaugcugauugguacauuuacaauccuccagcuagacguaaaaguucuccaaguccccacuuaacucaggagcccaguuggcuuugccuaguggauccugugccggggcugcgggcggagcugcccgccagucccgcacugugcgcccacacuccucaacccuugggcaggcgaugggaccgggagccgcggagcagggggugguccccaucggggaggcucaggccacgugggagcccacugcagggguggaggggaggcucgggccuggcaggcugcacgucucaagcccugccccacggggaggcagcugaggccuggcgagaauuugagccuguugcuggcaggcuggcacugcugggggaccaggcgcacccucugcagcugcuggcuggggugcuaagccccucacugccuggggccaguggcgccggccggcugcuccgagugcggggcugccaaguccacgcccacccggaacucucgcuguuccaugagcacugcgcgcagccccaguucccacccgcgccucucccuccacaccucccugcaaacagagggagccagcuccagccucagccagcacagagaggggcucccacagugcagcagggggcugaagggcuccucaagcgcggccagagugggcaccaaggcugaggaggcaccaagagcgagcgagggcugccagcaugcugucaccucuccccaucuuuucuuuaguaucaauuucaacccuccuuuucccaauucaggauuuuccauacucuaaucauuuggauuaauaauuuaaauuacauaccauucuaugguacacuucaaccaguauuuaaaauuaaaguuguauuucuuguuguggaaccaaaaguaucuucuggaggagacaggagauuauuaaaggguguacuuaggugaccugagggcaaaccuggucagucauuuuaucgagaaauaggugggaugcuugaacagccucaaguaaagcugagucuuacucccuauucuucugacacuggccuucuuauagaguuguuaauauuguccuccaccccuggggaugggacugccugcccacuuuguagaccagcagauccuaacuuuuccaaugagaacuuaggaaacaaauaaaauuguacgccccugcaucagaauuuuucuguuuuauucucugauuaagaaaguacacaugauaaaaagcuaccugaauucauccaauagcagcuuuaagugacuaucuaaaacuugauauucagggcugagcaugguggcucacaccuguaaucccagcacuuuggcaggcugaggcagucggaucacaaggucaggaguuugagaccggucuagccaauauggugaaaccccagcucuacuaaaaauacaaaaauuagcugggcauggcggcgcacaccuguagucccagcugcuccagaggcugaggcaagagaaucgcuugaacccacgagggggagguugcagugagcugagaucaugccacugcacuccaaccugggugacagaucucaaaaaaaaaaaaaaaaaaaguuugauauucagguaacaaugcuuggucuuuuccaguggauucucaagaccauucacaguaauuccugagggcccacagguuagggaucccucacuacugcauuuucuucagggucaacuacauuugauauuauuucacuuagcauuuaauuauuuucauguuauauugcaccuuuauucuccaguuuugaaguuuaauacaaguguaauacguuuuuugucauuauguaguuguacuugauuucuuuucuguuuugucuacuuuuuucugaacuuucaaaaaaauuaacaccuaaauugcaaacagauuagagagauagcaaucuuaauuggauuucugguuauaucacaggugauaagcuaucacaggugacaaacuguaaaauguucaaacuuaugcuccuaacugguugucccacuaguaaccuguagcagugguucccaaaugcaaacuaccugcuuaaaggucauuguuguggguggggcacuuaaauauauggauucuuggguccccucuagauauucucaaucaucgggccugggguggggucuagaaaucuuuagucuuuaaaguuccaucgauuauuuugaugcacagugaaauuugggaaucaccaauuuucuguacaauccauaaaucugcauguagugacauacugguaaaccuuuauuuuuuuuguauacuaaaggaccagcagaauugggcccaugccaacaugucaccucuagggccuagacugcccucacuuuuguuuuuuucuagguugguuucuuagcacuaccaaguugaacaugaacaguacgacuccugccucuaggaggcagcuuggaauauugucaguacuggauuuuagagagccuggcuucugugaaugaacucuuggccuugguuccucaucuguaaaaagauuuuagaguagccuuuugccuuuaaguguuuaccauaaacuagauaaaagagcauuccccuuuaucugcaaccccuguauuaguguuauuuucauauauaguccacuuuucauuaacugcacuccaggugucauagcuguaucagccagugucucuagacuuucuucaguuugcuauaacaaaguaccaugaauuggauggcuuauaaacaacagaaguuuauuucucacaguucuggaggcuagaaauaugagaucaaggugcuggcagcuucaggucuggugaggaugcguuucuugguuuccagacaacugucuucuugcuguauccucauaugguagagaaaaguuagagagcuuuugagguucucuuuaagaacacuaauccuuuucaugaggauuucuacccccuaacccaguaccuucaaaggcuccaccuccuaauaccgucacauugaggauuaggauuucaacauaaaaguuucgaggggaugcaaacauguaggcagguaggcaaacuuaugaugaccaagaaccgguucuaaccucaggaaaugaagcaauaaugguaauaucauuucacuggagaaguuucugccuguuuccagagggagagggcugauuaagagcucucccuacauuccaccuugugaaaauugccaucagauaucguguaaaacuaugaagucaucuuuuuuaaacacaaaguaugacuucaugguguagacaauguuuaaaaaaucucuggccgggugcgauggcucacaccuauaaucccagcacucugggaggccgaggcgggcggaucaccugaggucgggaguucaagaccagccugaccaacauggugaaaccccaucuauacuaaaaauacaaaauuagccaggcauaauggcgcaugccuguagucccaguuacucaggaggcugaggcaagagaaucgcuugaacccgggaggcggagguugcauugagccgagaucgugccauugcacuccagccugggcaacaagagcaaaacuccgccuuaaaaaacaaacaaaaaaaacaaaacaaacaaaaaaacucucucuguaucuaaaacaaacuuuuugguggcuuacacuuauaaucccagcacucugggaggcugagguaggaggauugcuugagcccaggaguucaagaccagccugggcaacauagagagacccccaucuacacaaauuaaauagaaaacauuagccagguaugguggugcaugccuguagucucggcuacucagguggcuaaggugggaggaucacuugagccuagaagucaaggcuacagugacccgagaucaugccacucacugcauuccagccuggguagcagaucaagacucuguuucaaaaauaaaaaauaaaacaaguuuuuaauaguuuuugguaauacccaucacaaagagauauuaaagaauuaauaauaauggugaucacugccguuuaaugagagauacccauggguguguugcucuacaguuuccuucuuucucucacuuaauucugaaaacauuccugugagguggacaguguccgagcucuuucugccucuuggccaguuugggcccuguucuucccauuacccgcuauucgguugcccauauuuucucccuccuuuuuugccaugucauguuuucuuccccaacuuguauucuccucugcuuuuccuuuguaauaagcucauuccccuaaccuguugcaucucucacaccaaauuucagaccaaaagaaaaaccugugauggguuuggggaaaguauaggcccauggguaggcuuuuuauucccucccucuucaucucuucugucucuuaaaugaaggcaucagacuuuguaaccaguuagcagagggcaucuugaaggaguuugucuuguucagcaucaaaaccccugacauuuaacccucugccuaguacaugggcauucaguaagugagugaauaaauccaauucacaucguacauuuauuuaaaagaguaguuuugcugggugcgguggcacucuagaagccaacacaaugcuuuagaaugguauuguggccaaauuaugguguacccaaguguauguaacagugauuuaugauaacagcuaacaggguuggaggaaugucucaaguauuaguauuuagagaacccaauuauagaauacacauugaaaugaaaauugaauaaccuguaacuggauacuuaccauucuccucccaccuaacauggacauacuuuuuacauuauaaaccaucuauuagauucuuuuaaaggugagauuauggagauagaagagcaaggaagagccaguuagugggucagaaaaugaaacuucugugcuuaaaauggucauaagugauguagcugugagcaaaaacugcucgcauuugucacuaauuucgcuucuaggugcugagauguguuucccauuuuaaguauuguuuacacuuuccuacguguccaggagaguuuugagaauugaggaaaguuuccugcuuauucguagcuagguaggcuuagaaugguuuuaacauucuuuuaucauccaguuugcuugaccaauggcuauggguuuguugcaguucugcauccguuucuguacuuguuuuguaaagagaauccacacaguaaacaaaagagaggagagagguaaucuuuccaucucuuuuaauacacuguaaaaauugggauagugccaccaucugcuuauuuguugacguauuauucacagugcuggucccaaaggcgauaacaucuaugaauggagaucaaccauucuagggccuccaggauccguguaugagggugguguauucuuucucgauaucacuuuuacaccagaauaucccuucaagccuccaaagguaagaaaucucccuguaugcucaaauuuacuaauucccacaagagagcaacuguugagguuuuucuaaauuuaauuuuuaaucacagaaacuagauuuaucuuauguccuaauagaucugaguauuuuaacauauacaaaacacuucuuuagguugauuuugccuuaucuggcagagaccauucuaggauuaagugcuuuguuuugauggugcuuaaaauugugcuauuuauaguaauauugucagcaaccuagaauuaauccccuguuuuccagcccauagagaaauguuuuugaaccuuucucgagguuaaaaauggugucaagccaggugcaguggugugcaccuguaguccagcuacuugggaggauuguuugagcccaagaguuugaguccagucugggcaacaaagcaagaccccaaaaaaaggcagggcaggucagggggccaaacaacuagagaaucagaaucucuucccaaagcuuuggauucuguugugcucccugucauguuuuggucuuguuccuuuaccuccaggccucaguuuucuuucuaggacaggugaggauugcccaagucacccaucuccuguacucaaucuaugauucucauucagucagaaagaaaaccccgucuuggggauuagguagacugccagauaaaaguacaacugcagcaacaagaaguaaucgaaagucacuuuuuuaaaaaauugguaaaauuacagguaauuuuuacuuuguguuuugguauauuucacaaauaaaaauuaagagacccaaauaacaccagcuuaugugacuuguguucugcugugguccuugcccauuacuggcucugcauccauggacacucgauuauauaauaguaaauucugugauguagguagacaggaugucuauaggaccugauguaacggucagaaaaaagcagaaauagacuucucuucaaauuuuguucagccuuuuggguguagucauuguuugcuaaguauguuguuuaauuaucuuuauguacccauuauguugcacuucaguuuuuaagagguauuuaugauucucaguauuuuaaagcuuacuuugaggcaguguaguacuaccagcuaacacaagaggucagcaaacaauuagcuauucaaacuuggaaauguuaauauuuaaaagauuuaaaauugcuaaagaugaaauuaggaaguacugaacuuaccgucaguggacauaacauuuuaaaugaaauugacacagucccugagaugguaucaaugaacacuuucuaaucaaauuuauugucuaucuucuugacagcuuuaauuaaaacugcuuuuagucaccuucuuaagggucauucaguugaauauuuaguaacaaguuuguuugcuguuuaaauauugucugucacuuguuuuuuuuagguuacauuucggacaagaaucuaucauuguaauauuaacagucaagguguuauuugcuuggacauauugaaagauaauuggaguccagcacuaaccauuucuaaaguccuccuuucuaucugcucacuucuuacagacuguaauccugguaagguucauaauucuuuaccuuguuuuauucuuccuuaccugaaaaauacuuguuuccaaaagcuuucaaaggacaaaacuaauuuuucugcacaaguuugugaauacaaaaacuaaucggcuuuucaaaagaaaguuuuaaucaaguucagucuacuaguugagacacacaacuucauuaaucaguauauucuagcaacaagguauuuuaaacugaagacugacguaaguuugccuugggcuuuuaguuucaauuauucuuccuccuuuuuuuuuccuguugcuuaauuucccauagaguucuuauaaaacaaaucagacacuucuaaaugucgagucaucugccuggcaagccucaccugugccucugggguucagugagcaugugucccauagcuggucacugagauggcacucaauuuugaaaaugguaguuguuaaauacuuagugacuauugaauugugacuuuuuugggacuucauuucauuuaaaaaauauuuuucuguagucacagcuacuaggguggcugaggugucaggauuguuugaacccagaaggucaaagcugcagugagccaugagcaugucacugcacugcauuccagccuggguggcaaagcgagacccugucucaaaaaauauauauauauacacauauguauauauauacacacacacagacaaauauauuuucuagguaaaccaaauauaaauuuauuaaagauccuaagauucagagaaauacuauacuuaauuggagguccagguuuugccuggcaaccuggcucuuuaaccagcguaaagguuaauaguguugcacugcaacagccccgaagacuucacaguauucacaaugccguuaacuggugacauugagcuaagggucacaugaacacagcuggauguucauugcagucugaagccuugaccguuccagucucuacugaacucagccuaacacauaagaguaaagaaacuccaauugaguguuguuuguugggagaaaaauggaaugaacuaagauaaagacagaccaguacacuaaagccuaagcauucccucuucccccaacguuauguuuuuuugaaauuuugauggaaaaauauccagcaugguggagugguguuucgaagauggguuugaucacacauacuuugucguacguaucuacccaagcugucacuauucgcuaaaguuuaaaauguucuuuuccuuucuccaaaguaaucuacauucuuuucuuccagccgaccccuuggugggaaguauugccacucaguauaugaccaacagagcagaacaugacagaauggccagacaguggaccaagagauacgcuacauaaauugggguuucacaauucuuacauuauuugucugucacagaagagagcugcuuaugauuuugaaggggucagggagggugggaguugguaaagaguaggguauuucuauaacagauauuauucagucuuauuuccuaagauuuuguuguaacuuaagguaucuugcuacaguagacagaauugguaauagcaacuuuuaaaauugucauuaguucugcaauauuagcugaaauguaguacagaaaagaauguacauuuagacauuuggguucaguugcuuguagucuguaaauuuaaaacagcuuaauuugguacagguuacacauauggccauuuauguaaagucccucuaagacuacauacuuuuuguuuaaaacaaaauuggaauuuguuuucccuucuuggaagggaacauugauauuuaacagaguuuuuagagauugucaucucauauauauaaaauggacacguggcuauaaaacaccauauaagagaugaguagugcguuuuauuuuauaugccaaucuacuuuguuuaaaaaaggucugaaucaggacuugugaaaaccuguagugaaauaccuuaagcuguuaacuaacuguaaggcguggaauaggaguugcucaguggauugguucuauguuguggacuacuuaagucugcauuuguuacugugcuaauaaacaauauuaaaaaccaccuaauaaacacugcuguguucauuuacuuuucuuuugccuuuugguugccauucgcagauucuucugaaaucgauagguaucugcuucuaaaacaagcuaaaaauaaugcauauuuaguagguauuaguuaguuaccuauauuaggaucuguacuuuacacagcuguagaugagguauccuagaaaagguuaaauaaucuaccccauuuaggcuucaaagacgaacccuacugcaucuuuuuaaaagcauuuucugacuugcagaugcuguaguagcaaguacaugagaaauggguuccgucauggauaaauugguacccugccuuagggggca

SEQ ID NO: 192466 - RNA, 64427 nt, Homo sapiens
ucauaggaaaacuuaaaacacuuuauuggaguaaucuagaaaauuuuaaaauuguuacaucuuugguauuuauaaaugugauacuuuacuuucuguggguacuucuauagaggcacuacaggaucagaaaaugcaaauugaaucauuuuagcaccuuuugauauaaauagaaaugcacugaugcagagguaaaaaaucuuagaacuuuuguugggaaacuauaaauaauugguccuuucccaucaguucugcauuggcuucuccaacugucaagguuuaggauuauauuguuauauugaucacaugugcuuuaauuucuuggccagaaggaauccauggcaaaaaucagguuuagagucuuaaacucuaauucuuaguugaaugaauuugaucuuuuaaauauuaaugauaaauguuuacaagaaguugcuuuaauaagcaacaguuaaaauucuguuaccuuuuuaaacuugcaauaacaaccuucauuuuuaaaaauacaguaguaaagauugagguaucagcuuuucacaaaagucuuuuugcacuacaaaauguucaucuuggaugcucaggaacgucuaauggccaauuccuuuuuuacuuucuuugccuuugcagucacuguucuuuaggguccagguucugauuguaaacuccaagucuuccuuuacauuacuguacuuacuuucuuccugugagagaagagcaggggugggacaggguggugggugaguauauuguaaccaaguugcaacagcaagucuuugcauuuuguguauaaacuagguagauuuaagguaguaaagacuggcccucagggcaggaagaaggcaaugguggcagugucacaggcagcagggguaaucaaauaccauauauaucccuucucuacccugcuaauuuaaaggagcauccuaaagcauacuuuuuaccuguugggcaguagggguagacugcaguuaucccguagaggugagaucguuguucugggagauacucaucaguaaacuggccacuauguuuauuuacugauacaacaccaucccugguaacagaaaggaagagugaauucagggacagucauuuacuagauaaagaagucagucagccacagaaaaucaguugcaauagaggaaaauuucuggcagccuucucugucccagggcuggugcuaaagccauacugaaguuugaagaccauugcucuaaauccauugcucaucucuagcugcauguuagaaucacaugaugagcuaucaaaucagaguuguagggcaugguguaaagggcuuagacuuuaauguuccacaguuccucauuugagaacuagucuaaauaguauuuuucggucccucagacaauauguccacagugucaaaagccaacuuaagcccuguaauauagcucaugguaucaaggguagucuuauucucuaaagaacauauuuagauuaauaugcucccuuuugagacauuauccaauagcuuugcuacuuuuuaagcuauaugugagcaauaccauucgauuucugggugaaguaaaaggaugauuucaaaaacaugaaaggaugaaaaacauccuugaaggaucuuaucugccaaugaggaggugaugaaacaaaagccucagagggcuuaaugagucaagucagguacugacuuuugguaaaacaagugguguguccucuggaacaguuggccuuuucaggcuuguccagaauuuguggggcucaccuccuccagucugugugguagaagugaucugcauagcuuacgaugcugaagggguacuugagguuguuuugaaugacacgccguccaguuccaucagguaguguacacuccaguuuuuugguuccuuuuaaaacaaagggggaaaaugagguccuucagcugcuuugccaaaaaugauagugacauagugauagugacacagugauagaauggggaaauaggauauuuuacuuccauuacagucauagauuagcaacuguaaaauuaccuguccuauuacuagucuccaguuuuuaguagagauucaaacuuucaauccuuuuuuggaagacaggauugcauuuacugaaaucugguaaguuucugccaaaguagggcauuaaacauaauuauuuuuauaauuugugugauuucaagccuuagcuuauaaauuauaacaucuggguaaauacuugcccuuuguaagcuaugucuauaauuacugaggcaaccuuuuaaccaaaauccuuaguauuuuuaaaauauuuucuagguaggaggaaaaaagugacuaaaaugguaacauaacucauauuucaauguaaaggaaucagucuuaaaaauuuuuacaauagcuaaaccauucaagaauuuccaaguuucacauuucucauggagccgauuuaaauuucaaauccuuuuaagaaauguaacuuguuuuaaacaacuggguuauaaaagugaccuauguacauuaggcccuuuuauuagauuacaaauucaagaacagucuuuuucauauucuuuaguauagaacuagacacacagcauuuuuucaguugugcugauaaaagcaaacaaauguagguugcuaauacccauguuauuacugaaggaagcuacccugcuacaaugcuuuccaaagaauguccuuagcauuauaacagauguuuauagguaaguuauagugacccucuccccgcauaagaauaacuucacuuaaguuugucaauucaacaauggcuaauucuuuuaacuguuaaaaauaugccaggcacucauggucaggcaagcaguacaaacuuacugcuugauauauccuucccuccacccaaaccccagaaaguucauuuuaagacucauuuacuaguacuuaaauuuacuaguacuuaaaaguuuacagaccaaagaaaggagaucuaagugaugggauuucauuuuguaguaaaaucuguuagugcucacauucacugugaugagagguuaucuauuugcauuccaucaguaguauuaccugcaucugcccagcagagcaguuuagagaaagggucaaagguuaagccauugggcaauccaaugucuguauugaucagaauucuucuguuuucuccaucuaaagaugacguuucaauuuuaggagcuucucuauuccagucuguccaguacaaguugcuguaaguuaaaaaucaagauuguaaaagaauagccauguagccugugguaggcagcaucuaagcagcccccagugaucuccaucuccucauguauuauagccuuaagcaauccccuugaguuugggcugcauuaguagugucuugcuucuucuagugcauagaguauagcagaagugauaggcuaucacugccgauauucggucucaaaaaacugguuucugccuuaggggcucucucuugcucccuuugagggaagcuggaugccauguugcaagcuacccuguaaaggggaacaugugccaaggaacugauguccuugagggcuguuggccagagacauuagucuugccuguagcccaugugagcaugcuugggcugugucuuccccgagcugagccuugugaucacugcaguuuggccauuaccugauugcagccuugugagagacuccaugccugagggagcucggugaagacacacuuggauuccugacucacagaaacugugagacuaaauguuaucuuacacugcugaggguuugggcaauuucuuacacagcaguagguaacuaauacacagccauauuccacuuuuaccuguaucacaagguuuucugauuauugucacuaugugggagaagucauuacuaaguuacuaucagaaucccugccuccaagauaccccuugacucaacugccccaaaacccuccguuuguugaagucuugaauuggaucuuggguuuuagaauagaaacaaauacagcuguuaggaauggcuucgauacaaacuauggaacuugaagagauguggaccagggauuugagaaggaaacuguucuuucuucugccaaaaauacaauuugguacuugaagggguaccuggcacccagggauggaaacauuuuaaguuaagcacuuuaccuuuuaaaugccacguuaaaaaugaaauauauucauaacagauacuaacgaggaaauaugguccuauuaaguggaaauagguuauaaggaaacaaacagguuuaucguuagagcagaaauaauguugaaagcacuuuuuauaaaauacuauuuuauaaaagcuauagaagcuuugaauaaaucaguugggcuacagagaaccucagugagaggagaggaagaaaccauagguuuccccuguugcgaauuucaucccuuaugcccaacagaugaagcagagagaagcugagagcaaaagcuagaaagcaguuuccacuuugcgcuaagguggagguggccagaggguacagcaugcauaucauugcuucaucgcuucugaucagucuccuccccaaaaugauuuaauaucaucaacaacaauaagucugaaacaagcucacacagauauuugguguaaauuauuuggggauugccagaggaagaaaguuguaaaggugaaaucuauagaaagcaaaugagaaauaugcaggaaggcuugacaaccauucuguuacgcaguugaaggagauguaauuacauguguuauauugcaaccugguucaagguggguuuucuuuuuauuaaaaauucaaguccuuuagcauuuauauuugcugucuggauaagaaaguucuacuuucauauuuaaacucauggcugugauguggauuucagcuuaaaaguaugcuuuuuccccagacuccagagacauggccaaaguuucauugccuacaagauggcagcucuccccaguuuucaggucaagcaccaagaaggaauaaggggccgggcgcaguggcucauaccuauaaucccagcacuuugggaggccaaggcagguggaucacccagggucaggaguuggagaccaaaauggcgaaacccugucucgacuaaaaauacaaaaauuagcugggcaugguggcacaugccuguagucccagcuacuugggaggcugaggcaggagaauugcuugaacccgggagauggagguuguagucagccgagacugugccacugcaccccagccucggcaacaaagcaagaccuugucucaaaaaaaagaaaaaaaaaagaaaaaaggaccuuccaaauguccaaaugucagaaaggcaagccuaugcaaagaguuuuuaagagggcuauuaauuccuguuaagucaacuggaauagagaaggauacagguacuuuuccuguguguagaacccaaaguuugaaaccaccuuugaggcacugcacuaaguauuucauagucaaaaagcacuuaccugaaaauuaaagcugaagguuuucuuuacugauuugaagggcaucugggaauuucauuucguagaaacuccacuuaaacauggcaagaguuucucaagauauaaaaauucucccugauuguaacaaguacugagacagugaacaaauccuguaugucacauuugaugaccuuagcaauuauacagacagggaaaauguuuaucuugauuucugcuacagcaacacugaagccagaggugucugagcuuuggcuaaugucacuugauguaggucagcccuacugugagcgucaacccugguuucuaaaugugcugcuggaggaaucccacuucacuuccaguuuaagugucagcugaggccucgccugaucauuugauucagaguagcccuaguucucacaacacuaucugaauuuucuacauaucacaucacagacuaauauuguuuauaccagucuuguuuccuccuaauaaaauauaagugccaugaaagaacagaccuugucuuuuccuagaacagguccugacaccucuuagauccucaguaaaucuuuguuacaugaaugcauuugagcuuucacucucuuguucugaccuuccccacauuguauuuaaaacccaagggcuucacaucaggaucuacagguaagagaagaauuagggaagcccagcugacccucggauuggauccacagcgauggcacggggauucaccagaucuguguagaagaggaccuugcgcucagagccauccagcagggcgcucucuaucuuauccaggacacuguccguccaguacauuguucugcggauguggucuauggcaaguccuucagggcuuaucagaccuggaaauaaagcaaagucaggacuggaguguuugcaggauauggagggcaaaccugaagcccuccaacggucgggugggcaggggggucagcaggggaaagcaaagcccaagugucuccaaguccccaagaaccagguuaauagagaaacaaguacuuuuguuacauauuccacuaccucuagcuucuagaccagcagaccuaccaguuugaugacaaccggcauccacagugccagagccaggcugaauaaacgaaggcgucacccugaauucuuaccaugaauucuuuuaagaagugcgcacaguaggaaucaccuauuucauuccguauguaugaagguguuugcuuacagagggggcuagucuuauacagcucaauaaaaugacuugccuagaacuuaaccuccccuaauggagaaaaaucgaggggagacuucggcguaaaguagacaagugacuuuguagaaucaaaugaaaugcagacugcugagugaagcugcugaccugaauucacgaucgucucaggcucugcucccaguuccagaccagcacggcugauuguccguccagcaacaucuguccaguacaccauccucucccggcagucguaaucaauucccacgauuauggagcccuuugugcaucaaaucauagaauuagaagaauuagguuacauuuccccuuuguucacacucagcugccuugcucaugcacagcugcagugagcaacacugcacugugauccugcaggcaacagagcagaguagcuggacaugugggcacucgggugaaaucuaggcucagccacuuaguagccauguggcuuugggcauuuaaccucuaugcguuugucucauuugcaaaaugaggccaauaguguaccugccucauaugguugcuauaaaaauuaauacuauaagugcuuguaaaguguccuaaucaguaauuggcauacaguaagcccuucaauaggugcuauuaugacugaugauuuaaaaaaaaaaaaaaaucagccccuucaguaauuagaggacauggccuuaagcaaaauaaguuuuuaauauuuuacuggguaaaaacugaaucuuuucccaaugucaucagcacuuuucccagagccuuaauaaaauuugccacuauaugccaacaaaaucuacucuccccuccucugugaaugagaucuuuccucuaccugaaguacaaucaccuauacuccugccccugacucuuaggaggcaagauguugguuauauccuguacuaaagaaaguguagucaggcacagugacucacgccuguaaucccuguccguugggaggccaaagcaggaggauugcuugagcccaggaguucgagacugagcaacauagugagaccccgucuaaaaaacaaaaaauaaaugaacugggcaugguggcacgcaccuguagucccagcuacucaggagaccgaguugggaggaucgcuugagcccaggaagucaaggcugcaccaagccgagauggugccacugcacugcagccugggcaacacagagcuacacccugucucaaaagaaggaaaaaaucuaauuuauuggguuaaggaacuagggaguagugguuauccaaccucuggcuagugaggucucuccuccucauugcuaaauaaaugacaagucuuuuaaaaaaauaauaaaaauaaaaaaaaugcugagucugauauuuuuccucaacuccaugcagaacuugcuucauucaguuuccaauccaggcuccugcucugagaagcccagcagaugugcaaagccaacauucagggguuagcuggcugucccugaggucauacaaguuccugccuugccuaacagccuccuggggcuuggcuucacuuacgcccccugggagcguagucagccaagaaagauuguacaaaacgggauuuggcuucaguggaaaaacaggcagcuuauauggggggcgggccuaaggucaacuacacuuuuauuugaaaauugaaaagucguuugucccaggcaagaguacacauucaaaugagcuuccauuaacccgggaaucaugggauucauaaacccaugucauaaccucagguuagagaaaaagucccaguuuaaguaaauuuccuuaaaaugugcaaauaacccacgucccauuucuuucaguuccacuaccacuaccaucaccacccuguccuggucaggggcauguucagaaaggcaaucaagcucuaugacuugaauaaaagaggguuagcuuaaagugaugucaacuucuuagucucuaccucuuccagagaaaguuuuacaaaacaaugugagaguuuucuugggggaggggacaggacccaacaaacucgaaucuuaaaaagaacacaucucuuccuaaacacuggcugccucuaagcuuuucuggaaccaaauaagugucguucauuaacagaaguaaauguaaacuugaaugccguacuauucuuucucagggaugagcaagugccuggagugugaaguucaacaauggaaucagaugauuuuccacugugucgaugccauucgagacagccacccuuuuuuuuccuccauuuuugagaaaacccgcuccccaaaauggggugccuugcauuagggaggcugcuggcucaggaagcaucaaacauccccuggggaaggcuccauccacuccucucccagcaucacacacuccucaaguuuucaucuauggagucagggaagguuaggaaagaagugggucaaagggacagaaccaaagugaaagggaagggcugcaacggugagacagucauuaacugacuuccacuuggaguccccaacaaaccgcagagaucacaccuugugacuaguuguccugucacuuugauuuccaggauuuccauggagauguuaugacauacaacccuggggacuuaggguaagagucgguccauuuucccuuggaucaccauacagccuccaugugcugacaacucuaaaguucccuuuccauauuaucugaaacuccaugaacgaaccagagagcacagccuuggucagugacaggugacucccagcaagagagagcccugguccuauggugguggcaucgggcccaugccgaugggcugcagcucagaaacccuccaggacuucccugcaccaguccaccucacugcaacagggccugugagguggcucccacugggaaagccacgcagcccugcccccuacaggagaaauccacuuuacaugcagagacagcagggucuuagcugcauccuucugaagccuggugccauugagggguaaguagccaaucugcuggcccugaguauagagcaggaaggugcccacagauggaggggucacaucuggccggggcgugggccggaccauggguggagcgacgguggguauaccugugggagagagggugggagagcaggaaggggaacaagggcaggcagggagaugggaagaaaaguuacuuuaccacauaccagagccuccaaaaauaucaaaaguucuucgcccuacgcagaugugcuccagauguucuucaaaagaaauucuaauuucuaggguuuuuuuaaggaucaauuauguaaaucugccauuuacuagggaagaagacagcaaaacacuucccucagaacaaagcagaacagauuuuuuuuucaagagaaaaaaaaaacagagccagcauugugucagcuuccuuuuaggacuccagagugacacguguccccugucacccugggcuggggagggggaguaacugccugcugaaccgaguugcagauguuccaauuauggaagcugcuaaugacaaaaaccagacaccaaacgcaaauugggaucuuguguggaccagauuauaaaucaacauagcacauagugacuucuuucauuagaccuggugaccccacauguccccccacuucaccacagcaggcaccaucccuagcaaaggccuuagauacagcugaggggagcgggggcggccaggugcuuacacgcagggguggugccuggcugggagcgggugcccugcaccucucugccaucuuuguccacacaccagcagaagucgcucuuuccguggcacugcagggggaugaaguggcccaggucaucgcacuggggcacguacuggucaucccggggggugccaccguagugcuccagcagguuuucccuccagcgcucacagauggucgggggccucugggugggcucugagcagauggggaagagggaagaagaaaaaccuuugauugugagucaaggacagaaugcaaaauguagcucaagaccccaugccuggccuccuggccuuccuucuccuacuguccaggucucagccaagcccguggacaccaaacuugggaagcaaauguguucuaaguacuucuccaccaugggaaucagaaauagaucaugugaugcuucuuucuugccaggagggucugucaucaaggcccagccacaucaagaaagaacaagaggagguaagaucagcagugcagcucacucagccugggaaggggcaugaucuccuucuggccaggagaggcccacaaggcccauccugccuguaccucgggcgccucugcugacagagcacuugugcaggugauccuuggggacucaguagccgaggugaugcuuaaagccaauuuguauucauuccccacuugcuucaagcuucaagcucgaagcugcugaggagagggccaucuugcgacuggccagugugugucuuagaaaguauuacugaaagcccagcgccacggugcccucugucuacccacuggaaaacuacauggaguaaagguaaaacugaguggaauuaguaguaaagcauagcagaggugguggcaaacagcuuaaaaaugguucuuccacagcccaguuuccagaauugcuuuagccacccugcgccugggauuaucucaaagcugaaucuuuuccugcaggcucuagcuuccugccguguugcccuuucccccccuuucuccagcauccucuccucuuguccccucccucacagcucacuccaugguugaaguccugcuggcuuugguugcaaagcaguuuccucccaggcugcuuccacagugccauugaggcuuuguccaaaauacagguuguucugagaagacucugcugcagaagguuauugagauaacuuguucauuuauguuaggacuacccaaaggaacuuaaacaagaggaggugcuucuccuuccuuuuuaauuccugcaacuuaaagcacauggucugcagaaucacauagccaauaacccuacuugcuaccaccauuuagauguauaauagaaaucagaaacuaauagaaacugagccccugccuucaccaucaaaccagcugcuccccuggucuuucccauaugaguaaauggcaccuccauuuuuccacugcucagaccuaauuauccuugacccuccuuucucucaccauccacauuugauaugucaaaaacucuuuuuagggguaacuucagaauccacuuagaauaucuuuacuucucacuacugcacccccucacccuggucaaaaagccucauccucucccugcaauuucugcaacagccuucccacugguuuuccugcuuccacccuucuaugcccucacucucuccaaaaccaguguaaauucaauuagcagcagccagaauggcccauuuuaaacauaaaggcauuucaugucacuccguucaaaacccuccagugacucuaaagaacaaagcugggagcauuaugaucagguuccagcaccuacaauuccucuuggaacacaaaagacugcgaaugaaguugucagagcucaaacccaacuagcucuagcucaacugcacgacucaccagaauugggggaagcgaaugccguuaaguugucacuguagcucaugacccaugggagacaaagcucuuuuuaagaccccguggagaagguaagacucugacuucuucagccaaaugugucucaaggaacacagagagggaaaugcuacuuccucaaacacugcaggauuuccuggagaaguucccaauuccaccccugcuccacauucagaacuccaaggauccauuuuugcuuuaagggaccacccugugcuaugugucugcauuccaaacaaagagacaugccuaacuccugggaaaugggugucccaaaucacucauacaugggcaucccuuucauucguuacuauuugcuacuuuucaacccaaccaugaauuucuuucucuugugcuucugguuggcaaggguuuaaguauuuugaaauugugggcacagagcguccuuacccucccucaagcugaccccaucaaacaugagaccagucagagauagcaguuggggccaaaccagcgccgagagagugugggcaggaaaaaguccgcacaagagaacacgacccuauuuucgucauucacuucucagucucuugguuccccccccuuuaaaaucuugguucccccuuuaaaaucauuguccuuaacacaugccugucuuaauaaauuuaaucgaauucugaaccauuccccaaaggcaccucccaaccauuugauuucuucaaaucccagauggaguuagaaccaagacauuuucaaagagaaggcaugagggaaauagaauuucucuguaccuuuuuuggaccuuuaaaaucuuuuccuaaaaauagaaacaaagagcgacuauggaucaaaccauuaccaauuuuuaccuaucugagaaccgccaagaccugaccuuuuuuuaaaaaaacaaaaaaaacagagucucacucuguugccaggcuggagggcaguggcaugaucuuggccuacugcaaccucugccuccuggguucaagugauucuccugccucagccucccgaggagcugggacuacaggugcgugccaccacgcccagcuaauuuuuguauuuuuaguagagacgggguuucacuauguuggccaggauggucucaaucucuugaccucgugauccacccgccucggccucccaaagugcugggauuacaggcaugagccaccauacccgggcaacaguuaacaccauuaaaagggaaaaaaacuauugguaauucuccaguucuucuuacuuucacacauuaaaagccaagacuaguauuuauggaacccuucucaauaguaaaaauggaucuuuggauagcaagcugugucggaaucauuuuggcuaaaacgguaucaagccaauccuaugcucuucauuaaauaaaguucuucuguaaugauuaaagaaacaaguuuuaccuaucccugaauaauucaacaaggaacagaaaguugccuuaucugccugcuguuggaaucgacugugagcacuugaucaccaugccccacccagcuggggaaugcucuagaugguagcaggcauguucucagguuguaugggcuaacagaaaccagaugucugugccuccucugagauguugggcuggguuacagagggcugggauugucaguuuagagaaaacuaacuggcuccacuagcagguguuauuuuucuaauuuuuccuauugauacuaacagagcguucauacuguuuccugccauucagaaggcagagguaagugagauaguuacauaggaaagcaguuuuccuucuggucaaaacgccagucuggccagaucuucuaacugucagaucucccuaagcugcucuauaacaggucuaggguaguguucucagucugaccuacauacacaaucucaacuuucaguuuguacuggacaagggucuaagaggcaaauguguaacagaucauaugugucauguauugcauaucucuauguccuuaugacacaaacaugcauauuuguacgcacuauuauucaagucuucucaggaggaaagaggcuaugaaggauggugacuggccccgugccugcguggucugggcaggaauuaugaucuaccuaccaccagugccauucugcuucuugagccccaggccuaagcucaccuggugaugguccacagugaggcgggguggagccagguggagucuggguaccaggaacuucaugaccaucaggguccacgcaccagcagaaaccagugcugccaugacacuguaggggcaggaaguugcccugcucgucgcauugggggauguggaaccgggccccaggguaggcauacugggccugggcauggcgcugcuguuguucacagggugucaggcuugagguggagucuuccaggaucaaggcagaggaagacacaaaagagaaauagaaggcauugcaacccauccacuucaccagcccacagcguggcauggaaaagcgcugggauuuuggagcccgagauucuuauuuuauaauaccuugccacuauuuaccucauuucucuccaguucuucuaguucauccuauaggucccuagcuggcucuaaguguaaagcagcccggccccucccuauugucaucuggggaaaaugagggauagcgguggcaucugcccaacaucccaagagacucuggagaaaacaagccaaagcucauucaugcccugaggcccacagguuaagucugagaagcugcaagccaacggcacucaccacucacgagacugcaccaagcuagccaagcuccucuaacacggucgccacgggcuuaacccuggcuaccggcgcauaaggcucugcuuaauaagcuugaucucaacacuucauccaaauugcacucaucaaggucaagcagaucacuagggcaguuaaccagaggggcuaugagguaggacgaugggugggucgucucccgcaggccuccagaaauguuacgaaucagugaacuaucaguaaacuaggcagcaggagguaaccaaggaaaaaaauccacagcuuggaaaauccaccaaggcuccagaccaggcuaaaucaagagugggcugucauagaaaaauauccuugaaggagcuaagagauucaugugccuaaucuggcccucugaaacuuaccagguaugcacugaaauccauccccauaauauccggguugacaacggcaggagaaggaaccaggaguauuguagcagguagcugcagggugacaucuguuuucugagcauucaucuacaucugcagaggucagaaacagaagaaagaagcaaagaacacuaugacuucacucacacaaucugugcgacugcaugggcuuuggauauguggaucaacacccagugaggugucagcuucagaagaccuuugagcaugagcagaaaaaugcugacaccuaaagguaagcuuaauagaaaggaagaaaaaaaaucaaggaacaugugaguuaacacacuagacuaaacguguucaguguagaaaucaaauggguagucgcucacagaaaaaaacaacacaucuuacagcauguuucauugacagugaauucaaggaaguuauuaccuuugaacuaaccuuuagacuauaagucauuaacuuccuuucagcaaugcugcaauaaagacaaauauauccaacaaugguuuuuuuuucuuucguuguuggcaccaucucccuguaacauucgucuguagaugcaaaggagccagaugaggcccaaauauuuuucagcuaagaagcacauucugucuugacuaauuagaaucuuacuaucuagaaccacacccccauuaaccagguauuuucuuuacuuuccacuuuuagaagaaauaagaaaaaaauauuaucuaggguuuugaaauaauacuuacaaaauggaaaucuaaauuugccaggcauaucaguacaaacaauucaggccccuacacucuccacauagcaccaugaggauuaauuuucaccaucauauuucucaaaacaacaaaauccugacacuucaaacaaaagccaacuuacauuccuuuuauuuaaugaaauccgcauaugccgacaauagcaagucacccaccccucccauccccagcagaaaaaaagcagcucugagaauugaaugguuaaaacuaacgcccaagggaugagauaagcuacuuuaagagacaggaagucuuucagaguaaaaggaggauaaacaaaggguguagguccgauuaaggcuuggcugaaaauaaaacaaagcaguaguuccauccauaguaauaaccaaguuucuuuaaaaugugugaauagaaaaaaaaaaaaugugggauggugugaucagugugaaaccuagaaaaugagaauguguugcaucaauacggugcagcccaugguagagacacaucagcaugggaagacagauauuugaagcccuaaauuugaugugaauggguugggaacagggcuagcuccucacccaggcucccaugacccacauggaaccucuucuagaguuaccugcaccacccuuuguccagaccacacugucacugggucauccucuaauaacuaaugugcuuucucgaauaccauuaaguacacacacugggcauuaagcguagguguucuguucccuagagaggaaucucuuauguuauaauuagaagguaaguauucugcuuaucuucugucucuggggaguuuagucagcauauaucaguuccuaggaguccucccccaaaaauucugaacucaaugcaacccauagagucuccacccaggugagugguuggccucccuggauaccaucauuucgccuauaaaggcaagaaagcagauaucaauucaucugcaaggguagaaacaaaccagauuggcuccucaguuacccugaaaucaaccaauguugucauaauuaucccugagcuuggcucugccucuucaacaggacaauucaaaugcccagcugggcaaaacuggugaccauccaauaccuuggaccuggaauaggcuguaaaacuggcuguaaaacuaaaccuguaaaaauuaacauucagccgaaugcaggaaauuaaagcuauucacaauacgcaugcuaaaaguacuucuaaugguaacaggaaccccaagcaaugacaggaagcaggaauuccugagacacagggccuauuucuggagcccauggagcaguuucuuauuguuacuuuugaacucaagagagaggggauuccccagagcuaccaaauaaaucaacggugugcuuagaaccuucagccuaagaauucugacucaaucugaaagaccagccuuccuccccacagauacuguuggcaucaucaaagauacuaaaguucuggguagacagaaacuauuagaaaugaccaacaaggaggagaaaguccccaaagagacugaagauaucacaagugagaaauuccugccccaaagauugagacucccugaauucgcaguccugacuccuccuuggagggccucucacaccaugauagagacuagagucccgggaccugggcaugcacaggacaucagaugucaagagagaaaacauggaaagacuuucagcccccuggcaagggaggaacuuuauuggagaaggagaaggaggccacugcuuaugcuuagucauuacuagcaggggccuguagggacugcuauaaagacaaaaacguucaagaagucguagagccccuuuaucacucagguaaugagagguagcuuaaucucagugcaauccuacacucuauuaagcuaguaaagaaccuguuuggaaaauguguuaaaaauccuucgaguucaugcuuucgugcuucaacauccuucucacugcccaaguacugagcaaaaccagcaggaacuguuggaugauaaaccuaaccccuggccucgaguucccccaggcucccgccccuucaccacugcccacuugccuuugagcccagugaaauuucuuggcaucaauuaaccucaaacccaucccagaucccaauaaaggauucaacccacaggucccacucucucucuacugcacaaucuguucaauugggcacccugcugauuguaccccuguauggcauguggugaacccacuccagaccuguaaguguaauaaacuacuuccuuucaagcuucauccuugccuccuccuauaaccacacugauuuuaccauaccauacccaacaucuaccuacauucuuggaacaggaaaccuggccaggcacauaauggagaucaugcuuucguuaucaaagaagagagaagcuaggccgggugugguggcugacgccuguaaucccagcacuuugggaggcugagggggguagaucgauugagcucaggaguuugagacaagccugggcaacaugaugaaaccccaucucuacaagagauaccaaaauuagcugggcaugcuacuugggggggcugagaugugaggaucacuugagccuggaaggcugaggcugcagugagcuguaaucacaccacugcccuccagccugggugauaaaguaagacccugccuaaaaaaauaaauaaauaaauaaaaauuaaaaaaaaauaagaaaagaaaaaacgccaggaaacccaagaaagaauaaugucaguaucuucccucaggccccugaguaaugauggcucuggguaaugggccaucuguaacccagcuuccucaacucacacuugcuccuccugggaaggucccaacucaagacaaucugcuuuugcaccuggccaagucacaacaauccaaaaggacaaacaugucugagaaauauccagcucacaccaacacaaguuugaaaucacuccagauugagggaagcugcagaggauuuaacucuacuuggauaaaagccuccuggcuagugacucagaccagacugagaacccaaauccaagugcagccucuccagggagccgguuuuuuuaacaaacuauggcuggagaaaaacucccacacccccuuauuguuaguuugauggaguaaaagagcaugugcuuuaacaaugcauagcacccacaaaauacagccucuguucuuuggucacugagacacauguacccuauggaaugccuuuaaauaugcacacauacacauauauuucaauauuuauucuucaaguuacuuucaugauuagccuagccugauuuaugcaugggucuuuaggaaaaugaccauucauucucuacuacuccacaaucugaaaguuuagaagacaacuacaugguaaguggcugugguaggcagccucuaagauggcccccaacagucccuaccuagugguauucauggucuuguguaauccccacccuuucaguaacuugcuuuuaauuaauaaagcaacauugaagggaugucauuuuugugauuaugacuuccaucuugcuagcagacuuucucuggcauuaauaaaguaagcuguaguguuagagaggcccaaguggcaagaaacugaaggcagccaacaaccagcaaggaaccaaggcuuucaauccaaugguccucaaagaaccgaauccugcccauaaccacgaguggaucuuuccccaguuaagccuucagaugagaccacugacccaccagacacuuugacuguggccuugugagagauccuaaagcacaggacccagcugagccauucccaggucccuggaccacugauauuaaaugucuauugcuugaagcugcuacauuuuaggguaauuuauuauacagcaauagauaaccaauacacugggggaagcaccugauggguuuggcauauuuuuaguuuguaggcuuuggaaagaauccuaaaagcagagaaccagaaauaaaauagggacaauugaaaaugacaaaaauagggcaaauuaaaaaaugacaauacuuaaauucccaauauggaaaaguagucaauuucagagcccuaacaugaccccagaagguaaucaaagucuugcaggacaaguagaagaaaaaaggagggagagaaucauuguagaagugaucaaagcaugcagcaucuaaucuaaauuaauauucugauuaacacucaucauaucuaggcugaaauuaauuucaacuucuuugcuuuaaaccagagagcuaaggaacuaaauauuuuaaaagcaccaucucugcugaucugagcagccagauguuuaaauaaauucuacagacaagauuuuucucaguggauucacauuucuuagagcugguacuaggguuaaaccaaacaaacgauguguuccacacgaaggaaaagcaucauucccacugucaggcuuuggcaccucacccugaacuccauaccuguagaggguaucuguaaagaguguaucuauuauagauauacucaauguuuucucaccaguauaucuaugacagauggagcuccuggcugguuaagugggacaaacaucugugaauuacaaaucuaccucauucuaauugggaaauacucuuuaucuagagcuagggguguuuauucaagagguccauagucuucuuacauuacugggccuaauaccaagacacacaggaaucccaacugaggguuaccaucuguauuagucaauuuccuguuguuuauaauagaauaucugaaacugagucauuucuaaaggaaaggaauuuauuucuuauaguucuaaaggcugagaagucuaaggucaaggguugaaaucuggugauggccuuccugcugguugggacucucaguagagggcugagguggugcaggacaucacauggugagggggcugagugugcuaacauguuauuuuaggcaggccucccuucuuaucaagccucuaguuccauucccaagauaacccauuaauccauugauaggggcagagcucucaugauccaaucaccuuuuaaaggcccuaccucucaauacugccacaguggaauguaaguuucaacaugaguuuugaagaagacgaauauucaagccauagcuucaacuuucaauaccaccaccaaaaguaucuauuuagugaaagaaaaaaauaaaagggcugaacugagccacggcuuuggguuaguucagcauaaauuguucgagaaaaccaugcagcagagcuucuguacagcacaaguggaaagaguaagaaugaggcucagaaaccaccaugugcacuugccccauccagagagaaguggagggcugagcugcugucacagugaccuuuguucugucaguaacacauggccucagccugcuguccacucagcccauccugcugaaaccaaaggggaaaaaggaaugggagaaggaugagaaucaaacaucuggugaggaggagggaggcccgugcuauucggaucugguauaaagcucccaggaauugcaaagcuguucuuagcacaucagcucggugggccugggcggauggaggcagaugcacacagcaacaccaggagcaggggaaagucugccuuuuaagguucauguuccccagcaggcccuuucccauucuaaacacguuucccaccauucucucauccccagugugucguuuuacccuaacugugugugugugacucacgugaaacugaguuucaaucugaucacauaccacaggguauguuuggaaaaccuuuugugauuuaagauuuauuuaaugauuucuauuuuaaaguacuccuaauccuaguuucauggacauuuauacucagagaguuaugucgagccuuuaaauaacaaccucacacauucuuucuaaguuaaauuccaauggcuagccuugcaaaugguuuggugcuuuuauaaaauacugcauuaagucuuaaagauagauuucugggagaaaaguuuugauaugugucuuuuuauauauguggaguucucucuuuugaaagaggagaaaaauuagaaauuacauauguguuuagagauugcuuaaaauaucacuuaaagcagaagagcacaaccauaaguguugaauuaagguggagaccgccuaacaggaagguaugcaacuuucccuaaauuccuccagccugcgcuggcuccaaggaaccaagguuagaagcucccgagugcuacaggaacgucuccgccaaggaagccauauaugcucgcccaucuaguccagaggaaaucacccuuggcuccccuuucuaacucaaaggacgcuuuuuucucacuauuuuggcagccacaaggcuguuagagucaaaggaaguccuuugucuuuucugggagagcuccaucuauguggggaugugcauccaaagcaacuuuccagucauugaggcugaccugcaguuacucaccagugcacuggugcccaucgccggcauaaccaggcaggcaggcacagcugaacgugcugccuccauggugaacacaccgggccugcccagcaggagcacagguaugacugccauccucacagggguuggcagguggggugaucacugaaaagagaagaagauaagggcauccagaguuuaggccugcaaaggaugagccucacuccucauggcaugauccacagaccaacagcaacagaccagggaaugcagguucucagacccuacccaagguccagugauucagaaucuggauuuuaauaagauuccuagaugguuuguaugcuauuaaaguucaaguacugguaugaauuugcuguuaaaauacuaagcacaaaaacccaucaccuaagcaguccucaauuaaaguuuauaacacuccagagcaauugcuacacacacacacacacacacacacacacacacacgcaguuucuccugucacuuuuacccucaucccacugaauuaaagagugcauuuucuuucuuuuuuuuuuuuuuuugagauggagucucacucugucgccaggcuggaguacaguggcgugaucucggcucacugcaaccuccaacucccugguucaagugauucuccugccucagccuccugaguagcugggauuacaggcgugagccaccaugccuggcuaaagagugcauuuucuuuacucucauccaucuuuaucaaugggaugaauugggauaguucuuuugauccauuuuuaggucuguaguauuuucuggaaauacagaagagguaauuuguuacagaaggagcucuuuagccagucaaguaggacaugcaucagugaauuauaaauccaucucuucuaauuugaaaaauacuuuaggcucuaucuaaagagcuggagguguuuacuagugaaguucaucaucuuguuacaugacugggccagaaaucccaacugaggugggcauccuucaauaacucaacaccaaaaauaucuauuuagggaaaaacagugaaaauaaacagggcugaaacugagccauagcuuugagagauuuuguuguuuuuuuuuuuguuuuuuugagacagagucucacucuauuaccuaggcuggaaugcacuagcaugcugucaguucacugcaaccucugccuccugcgcucaagcaauccuccuaucucagccuccugaguagcugggacuacaggcgugugccaccacaccuggcuaauguuuuguauuguuuguagagacgggguuuugcuauguugcccaggcuggucucgaacuucugaacucaagcgauccaccugccucagccuuccaaagcgaugauuacaggcgugagccaccacauccagccagcuuuggguuauuuugauguaaacugucuucuuaagaaaaccauauagcagagccucugaauagcagaagucaaaacacugacagauuaaagagcaagauuaaagagcaccauuuuggccacacaggaaaaugauuuuggaacucacagaugcaaguaugccggucaucugcaaacucauaaccacuccggcacucacaccuguagcuuccaggcaaguugauacauacagaguuggggccacagcgaugaaagccaguugcacauucauuuucaucuaagaagaaaugagaagagaaaaauucugcuuaauucaagggucccagaaguggagggucuaaaaacucaauguuuucucacuaguaugaugcuucaaugggacaaaugguuggcagauguagaauuuuuaaaaaucagauaugaaugcauguugcagauaaucagaaauaguaaaaauuucaugccauucaaguaaacaccacaggaagauaaauuuuuaagugaauauucuaagaauucuuuaacuguuuuaaaaagaauggauacuuggaagaaaaccaacaauuuuuuuuaauaucaagaaauuucuaccguugccuuuuggggauauaagacacacaaugucugucuaaaauuuaaagaaaaucagaaaaugugcuuuuugguaagucuaagaacuacuuacuacaaaagcucaaaauuacaaaacuuaacucaaaacauccaggaacugcaacagauguuuucuuuucacagccccggugcaaaauccacuccacuccaaaccaucuuuucaaacauaaacagcuaugcuuuaauuuuuaaauaacuauauucagauuaacagcugcuaaaaucauugacaauggagguuguaaaggugacagauacuugucuucuacagacauaaggcuggggagggcagaggaaaaacaagggcuacaagaaggagacacgagaacauggcucuuacccacacaguuccguccaucucccugguacccagaugcgcacucacagguguaaucuacaccugucccuggauggcaccgugcuguugugucacacauguggcucccaucauagcaaggauuccccggaguggggucugaauccucugcaugaguagaggggaaauaaaagcacaaucuggcuauugguaagcaaaugucacggagauagaggaguccucggaacugacugcaugucuguguuuugugacacaccggaagaccuuacuaaauuauccauaucugaagcuaggguggauuuucugcacuucaguuuuaaacuccagcauggcuuccuauugccuacccuauagacaacuaguaccuuuacuugcuuucaguagguuugcauccagggaauaaaaacgcccaaaacaucuguuuaaaagugcuuuugcucuauuauuuccugugauucuugggaugauucuauguggugaguuguuuuccccauuauguguaauuuucacagauaaggaaaucaagugagacaugggaaaaauugcccaagcucacaaagucaggaaguggcacagcaaagacucagacuccaacuuccugguucuaaaucuguugaucucuuacuaaaauucccaauuuuuauagguaaauccaauuaauuuuaaaaaucuuguuuuuuaaagauuucuaagacuaaacaggaaugacuuucccaguauuuacucuucaggaguagccuuaccaaggauccaucuacucacuagguagcgauuacuuaacgacugaaaucuccccuagagaaaucuauuuuggcugagcaugguggcucaugccuguaaucccagcacuuugggaggcugagguaggaggauaguuugaagccaggaguucaagaccagccugggcaauaugccaagaccuuaucucgagagaaagaaaagaaagaaagaaagaaagagaaagaaagaaagaaaagaaagaaagaaagaaagaaagaaagaaagaaagaaagaaagaaagaaaggaaggaagggaaagaaagaaagaaagaaagaaagaaagagaaagaaaaagaaagaaagagaaagaaagagaaagaaaaagagaaagaaagaaagaaaaagaaaagaaagaaaaggaaaagaaaagaaagaaaauuagccgagcaugguggcccaugcuuguagucccagcuacuccagagggugaggcaggaggaugacuugagcccaggagcuuaagcuugcagugagccaugauugugccacugcacuccagccuaggugacagaacaggaccaugucuuaaaauauauauauuuauuucuacauaauagucaaugcucauugagcauuuaugugugaggcauuguucuaaacagauaggaggaugccugauuacauccuucuaacuacauggugaggaaaauacuaucuccacuucugcugcaucacagagaggccaaauaaccugcccaggguuacacagucagaagagguggauggagcuggaauaaaagucuagcagucugguuccauagcucaugcuuuccaccgcuuugcugcaacccucacugaaggaacuucaugaaguuaucuagucuaagccaauggcacagagguauuggaaggagugucagaugcucagguagaaugaaucuaucaacucuggcacuucuguguacuucugagucugccauguaaaauggaaauaggaacauguacaucugccaauccugcuaaagaaaauuaagaaaacccaacagaacauauuugaaaggcaauuccccauuggcaggucuacccagucucuacugacugcacuccuucugccuucucaguggggccacuguucaucauuauuugagguucuagcucaaccucagucccuagaauuaacucuaaucuuagacucaaaagauuuccagagccccagcuaagccugucagguucuacauugagccaucucugcuacaaagggagauccaucuaaguuguaauaacucaggcuucugccucauacuucugugccugaggcccugucuugauagccagcuuagcauccucugagucccauccugcucaccaguucucacuacucacagacaccagcaucauggcaucuguaggcagacacuggcaguaccacccauuuuaccaccuccuccuggauucucuaucauuucacucuuucugacccgugucucccaccccacuuuguacagaaucuucuauuaaaauggagaaauaacaacaggagagaaucagguucuugucuuauacugagccuucaaugaggacaugacccuguuguucuccauuguaacagaugcugacucaggaaccuggucuauacucucaaguuaacuuggcaaccacaaccccacugcuauggggggagacuugcccagagugacuccuaaucuagaucccaagugcugacugcugcagcugaccucauagacuggacucgcucccaaguccuucagggugucuggcauucucccccgugccugcccuacugcccacguuauggcucuuccagugcccugucauagccugcugugagcugggaugccuuggcugagacagccuuguuuucugguaaacucuuuccaucccacuuuauaagaaacaccacagugcauucuuguaguggaauauucccguauuauugauucccguauuauuggcugaaaauaaggagggcuauggguuuauccucaguucaccacaauguugucggcuggaguaacagaaucuuugccaaaacaaaggaccaauaaauaauuccagcacuuuuuaaaccugaugaacuaugucagcauaagccuagcucccugaagcaugcagacauccuuggagguccguuccucuggaucucuuggcugacaggaaagaggcaccgcacugggguugugguugccgaguuaacuugagccuagaccagguuccugagucaguccucaauagguuauaacuaaggacaaggucaugucuucauccauuaggacccaauguaagacaagaacgugaucaucucccaucauuucuccauuuuaggaagauucuguacaaaaugccuggcauaccccaccaaagcaggaaguaauugucaacauguuuugauuuauaaauacuaaugcuuagccuucuuauucaguacuuuccagcaucaaaauuucaccauggcacauuccagcaaagauuaguguguucacauggacaucaagagcuuaccacccugcuaggcauuaaaagaaaaaaaaaaaaucucagcucaaaaguugacuugcaaacuuggacaggauauauuauccuaccuaaaauugagaagaaagugucccuaauuacucaauacugauuuaaaauguaugucacugacaggauuaguuccauaauuugcaauccccagugcaaaaugaaaauguggagcccaugguucaaagcaaagcguuaaaccaagcauggggcucuucugagcacagggccccauucacugaacuuggcuucccaaaacauuuuuaaaauacauuucuaaaaccauuucacgacucauucucuaugacuuguaagcuuuucuccuauuauaguaaguaaagaacacaguauccuucuuaagacauuuucuauuucgcccucacccucuuaaacugccugacucucuuaacagaggaucuggaacuaauuuacucauuuaaucaaggggaagagcgguuuuccuuaaaggaacagucccuucagcuucacugcacagcccucugcccagagccuccucaacucgccaaaaggacccgugaaguggaaggacaggaagcauuuuuggaucguguuuuaugaccccacaaaacaaccaaccaaccaacaacaacaaaaaacagcugacucacacuuaaagcuuaaagcucaaacaacuggugggggguggcacugcugguugagaagucaccgagggacagaggcuccaauuacucacugggaaagacaccccaguucugcauccucgcccugggaagucgcaccacacccacaucagguguggacagcugcgcuguuucacaugaauuccaacaacuaucguucccucuggaaaaacugagcaguucuuaggaagauacugcuguguaccaagaggggaaagaaaaaacuuuuggguguuucuuuuuuguuuuucuuuuuuucccuccuauucagguagaaugaacaguacugcuguguguggaugaaguaggguucaaacacaaaggguuuaaaagacacacauugccucuuucaaaguuuggucuaaauuaugaggcagucaugaggccacuguggaacagcagagccaugagggguaagggugugcguacuggagccagugccugaguuugagucccagcucacccaggucacuuacuaugaccaggcaaauuacuucauuucuauaccucagucucaucaucuguaaaaugggauaacaaauaaccccacccccaccccaccauuggguagaggucauuguggggauuaaaugaguuaauucauguaaggugcuuagaacaguacuuggcaccaaguaaaccauccuuugauauuauuauuugacuggggugggagggaaaaucauaaaauucuaaagaaaacaagcaacuugguaccugccaguuugcuuucucugauccuuucuuacucucauuugguaugucucuaggaaaaauauacccagagacacaucuuuuuccuaaaugguuccagaaucugaaugggacuccauagccugggaaauuucacuaacaguugcuuuuacagaucagaugccuacacccaacacagggcugaccuggacauuuaaagguaaagaccauucuccccaguagguuuaaaucucucuuugagaaaucuacuacagcaaucuuucccuuucuaauuuacauguuccucuaaaaucaacucacauuuucauguguucauuugcuaccuuacaauccaauaucugggcaccuaaugccuacauucccaaccaaguuucuuaaaaccaaagcaccucgggauucucauuacaagucacuuucgcauccuagaaaagagucuaguccuuguaccuuaaucuugucauauugcugaagcaacacuucuuuauugagccugcugaggcuuaaggagcccucagcuccaauaacaaagcacagaaccgcguaucacuuacagauucaccucacugaggagcuaacucugggcucaacaguuucaauacaguggcugaauugaggaagaugguuuuuuucuccugguguggcucuuacauucuaggggaaaacaugaccugguuuucagaauuaaaauguccccuugaucugacaaagccacuucccaucuguagaguucccugacuucacaagcucauccucuggcuugcuugaaacauuuuuuaauaauuaagaccuugcuuuuuaggaugguuuuacauuuagagaaaaauggagcagaaaguacgagcucccauauccccccacccaaaaugugcaguuuccccuauuaucaacauugugcauuaguguggugcauuuguuauccccaaucaauacugacacauuauuaacuaaugcccauagucugcaguagggcucacucuugguguuggacaguucuauagacugacaaacgcauaauggccuauaaccaacauuacaauaucauacagaauaguuucacugcccuaaaaaucccauguuccaccuaugcauccuucuccuucuuccuccugaaccacuggcaaccacugaucuuuuuacugucucuauaguguaaccuuuuccagaaugucaugguuagaaugauucuguauguagccuuuucagacuagcugcuuucacagagcaacaugcuuuuaaguuuccugcaugucuuucugugacaugauaugccuagaacauuuuaaaaucagucuucacaggugaggcuaauggucauuaaaauuugagaaccacugcuuacuuugagacggggucuuguuauguggccaacucuggccucaaacuccugggcucaggugauccucccaccucagccuccagaguagcugggauuacagguguaagccacuguacccgaugagaaugguuuuagaguuuuguuucuacuacuauuugcuuccauuuauuuuuauuuuuugagacggagucucacucuguugcacaggcuggaaugcgauggcacaaucuuggcucacugcaaccuccgccuccuggguucaaucaguucuccuguuucagccuccugaguagcugggacuacagacacaugccaccacaccuggcuaaauuuuuuuguguauauauauauauauauauauauguuuuauuuuguagagacaggguuucaccauguuggccaggcuggucuugaacuccugaccucaggugauccacccaccucagccucccaaagugcugggauuacaggcauaagccaguaugccuggccuucaguugagaaguaauucacauaccauacaauucauccguuuaaaguacauaauuaaacaauuucgucuauucaguguuauccaaccgucaccacaaucaauuucagaacauuuucaucacccccaaaauuaacccuguacccuuuagcuauuaacgcccuaugcucucauuaucucuuagcccugggcaaccaugaauaugcuuucuauguauguggauuugccuauuuuggauauuucacauaauuguaaccauucaguaugcuguccuuugucacugacuaccuucacuuaagguuuucagaguucauccauguugcagcauguauccguacuucauuccuuuuuaugguugaauaauauuccaguauaugaauauauuuuuugguguccaucaacugaugggcauguauguugcuuccaccuuuuggcuauuaugaauacugccacuaugaauauacacgaauaaguuuuuguggggaucuauguuuucauuucuuuuggguauauagaaaggaguagaauugcuccauuaaaugguaacuuuguguuucacuuugagaaaccacuauuuuguuuuucacaguagccacaucauuuuauaaucacaccagcaacguaugaggguuccgaauuuuccauguucucgccaacacuuguuauuacccguuuuuugauuauacucgaccacaugauguaaaguaguaucucauugugguuuugauuugcauuucccugaugacuaaugaugcugagcaucuuuacacaugcccauuggguaucuguauaucuuuuuggagagagguccuugcagagcuuuugcccaucuuuuaguuagcuuguuuuuuuauugaguuguaagauacuucguauacucuagaacaaauaucacaugauuuaaaauacugucucccauucuauggcuguguuuucacuuuguuaauaauguccucugaagcacaaacuguuaaaauuuugaugacacccaguuuauuuugcuguugcuugugcuuuuagugucguaccuaagaaaccauuagcaaauucaaagucacaaaaauuuacccauauguuuucuucuaaaaguuuuaacucuuacacuuaggucuguuggcccauuuugaguuggauaugcugugagguaaaagguucaacuucauucuuuuguauguggucacucaguggucccagcaccauaguuaacaauaguuuaaaagacuauucuuucuccauugaauuguuuuggcacuguguuuuuuguuuuguuuugucuuuuaaccaucagaauucuauuauuauuauacuuuaaguuuuaggguacauguuuacaacgugcagguuuguuacauauguguacaugugccauguuggugagcugcacccauuaacucgucauuuagcauuagguauaucuccuaaugcuaucccuccccacucccggcacuguuguugaaaaagcaauugacuuuuaaugugaguauuucuggguucccacuucuguuccuuugaucuuuacauguauccuuacgccaggaccacacugucuugauuacucuagauuucgaguuugagaaauacaagucugacuuuauucuuuuccaagauuguuuuggcuauucuguguucuuugaauuuccauauaaauucuagaaucagcuugccaauuucuucaaagagccagcugagauucugauagggauuauguugaauuaauagaucaauuugggaaguauucacaucuuaacaguauuaagucuuccaauccaugaauguggaacaucuucccauuuaacugggucuuaaauuuuuuuccaaaaauguuuugugggaugcaauguacaaguacugcacuucuuuuuaaaaauuuaucucuuuuugaaacaauuucuuaaucuuuaguuugcucauugcuacuauagagaaauacaauuugguguacugaucuugcauaucuuauaacauugcgaacuuguucuuuaguucuaauaguguuuuagugaauuccugagauuuucuacacaaaaugucaucugagacuaauuuuacuuuguccuuuuccaauuuagauggcuuuuauuuuguguucuugccuaaucacccuggcuagaaauucuaguacugaauugaauaaaaguggcaacagcagacauccuugucuuguuccuaagcuucagggaaaagcauccagucuuucaccauuaaguauaauguucugggaaucauggagggggagguuauacaucaaguucuaugauguuugguuuuuccagauacuagcucuuugcuccaccuuaguuuuggaugaaauucuucucaucuguuuuagcuaaaaugucacuuucuuggggacaucuuuucugaaucuucaaacuagacucacagugcccugcucucaucacacuuguaacaaauacuugucagcaucacucucccuccuaauuccagucugccuuguucacagguauauuccugauuggcacgcacaguuggguauugcuauaaaccagcuucacauacuaugcucuauuuccugacuuuggcagggacacuguucccugcccuaaaacucuuuucugccucuguuuccaacucaagggcaaggaucugcucuauucauccuuauaccuagcacauaacacagcauggcacuagguaacccuuaguaaccucugugaaucauucuaacucuacuuaaaaggaugucauuuuuacccaacaacaaaaaaggaaaccuuaccuuugaccgggccaauuugauuggucacagcaaaucuaagcacucuuucuucgucauuauacaaggcaaagacccgguccacguucagcugcugggugguggggaaggacgggugucugggggcgugccugcacaccugguaagugauguucugguggaugcgguaggaccauguuugguugauugcaccaaaagucagagaguagucucuggaacuuguagaggucacagcugcaacaaacacagugguaauuuuuuaaaaauauuaaauacagagauuuucaugugagguggauuuuucugcaguuuuuuucaucuaauucuuggaguguguucccuugggaaccuccugaguuuauaugaaaaaauguguaaggaaaucccaaaaaccugaguggaugcaaagccacagugcugagagggagaaggcacuacaauuguccauguuauuauacacaaagaauaaguguuacuaagggccagccaugccaacagugcucucuacauacugccucauuuauuccucacaacagccuggugaggugggcacuaaaucaugugaucagaggcucacaaagguuaaguagccuaagaugcaaugcugccacaugguagagcuggaacugaaacucacauugguuugacucuacacccuaaauuuuaaaccaauccaucuucuacauuucacagaagugacgacuuccaacaccucgcacuucaguaaaucugaaggauuccagagaagggaaaggguugucucucaccaucugagucuaggagucaagcucaggucagugauccggacacugaccauuuuguucacagcccaggucucugcuuccccuugucuucccuacaucuccugccaggcugccagcucucagcauaggagcagcaggggucagaggaaaggcacaacucaauccggauugcugugcugcacaacagcagcugugauggaggcagcauccugugcgcagguaguacuuucacagaacacaucacgcuucgcacacauugaucacauaauauagaaaaagcauuuuuaguuccaugugaaagaugagaaaauacauucucagauauuaagaggccuuucccuauagauauuaaauggcaaguccaggauauaaauucuuaucuuuugacuccaaaucuagcauuaguuuuauaauaaauuauagcaucucuguguuuuuugguuuuguuuuugagauggagucuugcuuugucgcccaggcuggaguacaauggcacaaucucggcucacugcaaccuccacuucccagguucagaugauucuccugccucagccucccaaguagcugggaucgcaggagcgugccaccacacccugcuaauuuuuguauuuuuaguagaaacagguuuucaccauguuggccaggcuggucuugaacuccugaccucaggugauccacccaccuuggccucccaaaguggugggauuacaggcaugagccauugcaccuggccucuuucugugauuuuuuuuuuuuuuaaagcagccugaacucaucagcugaaacaagguugagauaaauauaaauuccaauaaucacuauuuuuccauguugcagaaaguaggaugguuaaaaacuguauauaauuauaccaucccuacccaccccauggacaauguugcuauugauuuuauuauuugaaaauacuauguagggauauagauauucuuauguauagcagccauucugcucacuuacacgauauauuucaugguaacaauaagaguaauaacauaauagagcucauuuuauguuccaugcacuguucuaaggacaugccauguaagucauuuaagccuuguaucuaucuugugagaugggcauaauccccauuuuacagaugugaagacugguuauacauacuggagucggaguagugguacagcuccuuguagggagagaugugggcugugaaauuugcugagacguaaggcaccuggccuugaauguuggucuuaaugcucagguaguucucugggucaagucccucagcaguuugagugauacgaaccgucuccucucccggguagaauguaacuuccaugucauggguaaaggcagcaccuggagaugaaaaacauucagcacagggaugaaaagaggucuugcuuaaacaguuaccaguauauacugcccgcucccaauuucuacugcuguuggagaucgugccuaaggagauuaucugauaucugagaguaagcacuaucagcuguugauuccauaaguucccaaacuuuuccauugaagaauaugguuucauccugccuuaccucacccagcuucucuuugaacaagcuuguauucugugagaaauacucuugggaacguccuugacuuuucucuaagguugcuagacuuagcaaaaaacaaacaaacaaauaaaccuaacaacaaaaaaacaaaaacaaauaaacuaccaccuaagacauucaggguuuuguuugaauuucagauaaguaugucucaugaaauauguggguaauacuuauacuagaaaauuguuuaucugaaauacaaauuuauccaggugugccauuuuuuaucuacuuuugacccaagggcuuuauucaaauuuugauuaaagcaagaaccuauuaacagcuaccgagcucugcaguuaaagauggagaaagaacuucucacaaaacuauuuuuaaugcaauaaagauaaaaccucuagcaaacaaguuuucagguuggaaggugagaauccaaaaaguaucuucuaaauccuuguugucaacggguggccuuuccagcaacacugguaccucaccuccuagcuugguagaaaagcaaaaucacggaccccaccccaggccugcugaaccagaauuuacauuuugacaagaccuccaagugaugugugugcagguucaagucuggggugcaccggccuauacuauuauagguuguggagcugggaggagaagagcaccccuuccccaugaaguaaaaucauccccaggugccccaaguaccauuuuugcauuugacagaucugugcauaauuuaaaaagccugacaaauaugcugcaacaaauugggguaagaggacacaaauguucugaauggaaucauccuguuucucagaacagcugggagaacauuuagacgaaaucacugccuuucaaaaaucagugaugugaggucaaaccauucccaacaaccuguggccagaaaacuacacacauguggcucuaguacauuaaacaagugauuccucugucacugcguaaaggccuaaagacagugccccaaggagcaccacugccaaagcaaugcugacuaccggccuucucagaggcccuacucaccugcgaggcugaagccguucucagagccagguuuuucuaaagcaaagagccagccaaacaggccuccaauuggugugagggggaggagggccugggcugcuggcugugggauguggcugauggccguguaggcucugccaucauugcccacgauauacgcaugcagguccacaucagugaagugcacggguguauggcccacguggagguggccacucacuuucccauucacucggugaggugccccuaaaagacagcaaauccaguuaggcuuggacgucauccuggcuagagauggguguacccagguauaauuauuccacugacaacuuccaaaacucacucuuuagcaagucacuuuaaugauuuccuaaccaaccaauuauccaucuaugaaacaguccugccuccagucuguuuucuccccuccuccuucuacuccacuacacuuuggcucuaaugagcuggcagaaggaagcauuucuggauaauccucaaauugggaaucagcccaaaccaguucauuccucacacauuuauugagcaccugcaaguugauagcacucugauuuaaguaguggagauguuugguccauaaagcagagcucacagugguagcuggaaacagguaagcagcaggaauagacacacaggaguuccuggccccagucaauuaccuucaggcagacagugcuucccauuuccauaaaacuuggauuggcaguggcagcagaagccaguggcauaguccgugcagaaggcaugccgggagcauugucugugguuguguucacagguuuccuuguuggcagcauuauacgugaagacugaaaaauaaaacaaacuugccuuaaaaggacuaaaugauuccaaugucacugcugcaucggggacacaacaucugcuccauagaagcaguuuagaucauaacaaacaguuuuugauguuuaagagaccggcauaacauucaacccaagggaauuaaucugcuuugucugcuggcaagaagaauugcuuacugcucccggcugggucccauugcagaguuggugaacuaagaugagacugcacccguggguuugagugcaguaaaaugaaagcaaaccaguaaguacauguuagguugaacuucaugaaaccacuauuuuugugggucaaaaagggcuaaauaucagcacuuuuauaugguucaaccuaaacacauccugagaggaagacauaauagagaagcuaacaaaugucuuaugucuaaccauccuucuuuuagggaacacugaacuuaaaaaagauaauagcuggucucgcuaccaagauuguuuugagggaagggucuuaaagaacacacgcaccuaccucaaagaaaaggcauggggagaaggggacagaggagggcaaaacaacagggauucaagcuauuaaaaugcccuaugcccuuggcaggguuuaacuaugauggguaugguacaagcaugauuuccacgcaguagcagacagcuugggccccacucgcagaucuuccaagaaauuauggaggacuaggauaaauucagugcucuggcagcuguuucuuccauuuccuacuuauucugcccauuaaaagaagagggccaucugugcugcaaagaaauggggaaacuggagcaaaugccauaguucauaaaggaaauagccaaggggguaggguguggcggggguuguggauggacaggagggugcuuucuccggggcacuaggaaauaugccaaucccaagcauggccaccaggaggccaagcggcugcacacaccucugccuccacauccccaggagguggaguuggcuggagacuccaggagcaugcuguugagcagggauggcauggaauucuagugugagacacggaugcuggcaugaaggaggacacccacccuacucuuaggaaaaaccaagugguaguuguguuccaggucuaucuggaaacgaggagacaggaggggaggaagaaauccaaagaucaaucuuuacccaguauucccagggagaacagaaaguaaaggagcuaaugagacauagcauuauagguacaaugucaccaagauaaagaccuccaucagcaaauaaaaauauaacaaaguuaacacuucaaucgcgcuuaacauauacaagcuuuacauuuaacaaccuuuuuuuuuuuuuuuuuuuuugaaacggagucucgcucugucgcccaggcuggagugcaguggcacgaucacagcucacugcaagcuccaccucccagguucacgccauucucuugccucagccuccugaguagcugggacuacaggcacccaccaccacgccugacuaauuuuuuguauuuuuuaguagagacaggguuucaccauguuagccaggaugguccugaucuccugaccucgugauccaccugccucggccucccaaagugcugggauaacaggcgugagccaccccgcccggccaacaacucuuaauuugcacaacaacccuagguagcagggacuuuuuuuuguugcuguuguugagacaggguuuugcucugucacccaagcuggagagcaguggugccaucucggcucacugaaagcucgacuucccaggcucaagugauccuccuauuucagccuuuugaguagccgcagccacaagcaugcaucacaccugccuacuuuauuuuuugguaggguggguuggggggaggggucucccugcguugcccagguuggucucggucucgaacuccugggcucaagugaucuucccaccuaggccucccaaaaugcugggauuacagguaugagccaccacucuggccagggacaauuuuuuaacccguuugcagauaaagcugaggcacaguagacuaaagcaccugaagucgcauaggcagugaguggcaaaggugggaaccgaaccuaggacaucuagcuggagaaucuuaacugcuacucuccacgaccccuucaaugggauccaaguacggagaucaugagcacuagauuaggggucaccacaugucugggguuaaucagcacagacuucaaguauaauucgagucauacuuuauaaacuggguuuaaugguagaagcaagcagggaagauuaucgagaugacuauuacagcauguugaaaaacagcacagguaagaaaugagaguagcagcagcggcauuagcuuuugaacaguacuggagugcugccugcagauccuugggaaagcagcaagcugaggguuggcaggacagacaguguagguucaaguggaaaaucugauuagaacauaguaggaaugaaguuaugacucaagauuuaguauagggccuugaugacuuggcuaagaaauuccaguuugauaaaaauagaaaauuaggcaugacucaacuuuauuuaaacaagaaagugacaagcuuaacuuaaacagaaaagugauauaaaacucaaggcagaaaaaaaaaaaaaaaaaacccaggauggaucaugguaaaauagauggcugugaagaaaacuguaucacugucuauuaguuuaagaaagggaaaaaaacauuuagaguaaaaggaaaugaauguaacuuggaugugucaaaaucucagguuucuccagcucagaaauucacaacuaaguguaaggaagcagcuacaggagggacucacacacucaccagugugcucauggcuuaagggccaucaggacuuucucccagagcucaaggaaugaggggcugcagaaagcgccaagcucuaggacucaaccucagcccucccucgggggcuuuguggaaacuaugcaaacugucuuucagcuuccucaucucuaaaauaaguagaacaccucuuccucaccccugcauugccagaagucgcauuucuucuuaauguacuucugaacaccaaguaaaaaggcaaucugcuauaggucuaaagaacagccauuuggcugggcccggcagcucacaccuguaaucccagcacuuugggaggccgaggcaggcggaucacgaggucaggagacugagaccauccuggcuaacacggugaaaccccgucucuacuaaaaauacaaaaaauuagccaggcgugguggugggcgccuguagucccagcuacucgggaggcugaggcaggagaauggcgugaaucuggcaggcggagcuugcagugagccgagaucgcaccacugcacuccagccugggcgacagagagagacuccaucucaaaaaaaaaaaaaaaaaaaagccguuuucauaauauucagauaaaaaucaauccaaacuuuacaagcuguucugcccacaaauuaaggaaauaacaggcuuggauuguaucuuauuucaguuauuuugugaagccuuauucugcaacccaauucuuauucugaggcugaauuaugaaacaaggagagagaagauggaggagagacagucuagauauggagaguuaaacuagguggagucauagcuuuuaucuaaguaaaaagaggcagggcgaugcagccagcaacuuacaagugcaacugugcaaagguuuauaaauagauuggaagcuguacuacauuuuucuauuacagaaaaagaaguuauaacaaugagcaggcucccaugaaaggcuauuaugagacuuaaacuguaauuacaaugggcuaacuaguuacuguuaagcuaaccugggagucuuuuuaaacaguuuuguggaauauuguauuuuuaggaugguacuuacugagccaagaacacacacugucucuuucagcuucauaacagccacaugaaggaaagaagauggaucagccccuaauccgggggaaggcaagccuccauuuauaaucccucuuccacgccugccuucauacccaagugcacacacagguuugcacacuuaccauuuacaauggcagcuuguuaggugaaagguaaaugcuucuuacaauuuuuguucauucauucacuaauucaacaaguauuuacugagcauucacuauagaccuguaccuagucuagaaacugaggacauggcagggagcaaaagagacaaaaauucacauccugaagcuuacauucuccccagcagcagucaauaaacaaguaaauuacuuagugggguggauguguaagagcugugcaaagaaauacagcagagaaagacaagagggugggagggggcagguguacauggcucuuuuuaauagcauggucagggaagaccucaggagaaggugacugagcagaggccaggaggaggugagggagugaaccccacagaugagggcaggcguggugcugugucaggcaggaggggugugugggcaugugggagggauggugagagaagagguggccugggucauucaugcagggucucagagaucacaggaaggauuugagcuuucaucugagugagaugggaagcacuagaggguuucgagcagaagaguaacaugcuccgacuacaguaaaucagacaggagcuggucccuuggugguaagaagugcugguacaggggauaagaagggcccaggucugggauauucugaagguggaaccgagaggguuugcugguagacuggaugugggaugauguucaguccugaugugggaaaccaaaaggguggagcugccaguuacugagauagggagacugaggaggagcagguuugugggguucaguucugacaacagcaugaggcaucaaggaaauucaccaaggggugaauaacaacuuacacccucagcacagcaccaugcaguccuucacacggagagcugcauuucucccgguggauuccagagaccacugcaucaggaucaccugagauuucuguuaaaaaugcaaauucugagggcccaccuuagaccuaccaguuccacucucugggugcauccuagcaaucuacacuuuagccaccccgccagugauucucacaccaauugguguugauagaaggcuugggauacaacaagccuuggauuucugagcuagguguugcucaucaaugucguuaacaaauuuaaucugaccaauuggcagcuccuggggugggcagaauguuaggaaauuucucgugcucauuucuggccaccugagaagcugagcucagugcuuacggcccauuugggcauccauccacaagaauacaacgugaagauucuuuagugaaaguaauacagacgcacagcagccagauagcccuucccugaagaagggggagaccuggagcuagaacggugcugagcccacgugcagcuauuuauccagggcgagaaaagccagaccuccggccaacgugacugcucaaauuucuaugggaauugcagugaaauucaaagaggcugaacuucuugaaggcugggaaucaagaucuggaucccagcuagaugagaugugcaauaaacccacccgaggaaaaguggcacuuuuucuuuucgguggucauuuucaugucccuaucauggcuuugaguguauuuucaugcacuucuuccuauucuaguuagaagauaucuccauuuuauaaaugagaaaauugaggccuacagagaugaaacaaucuucuggcucuaaaucccaucaaauugagggggcaucagaaucacugaagugcagaggaauauggcagggucagacaagagggugagagagggcaggcacaccuggcucuuugaaauaguauggucagggaagaccucgggagaaggagacauuugggcagaggccuggagguguugaaggagugagguggcuuaaaaaugcaguuucugguucagaagguagaggaggcgcuuggaaaucaguguuuuuaaccaggcucccagcugagugagaggaagguggaugagugcccacacuuugagaaauacaguuucuaguccauggccuccucugggacccacacuaugccaggaagcuccugccacggagagucagaccauaaagaaguuugcugacaccucagggcacagcaggaggguggaggcuggccagguuugaaugaacucauuuugucauggauuuguuaacugagguuugauaguugcuaaaggauucuuaacaugaagauuuuuuaaaucucuuuuuuuucuauuuaauguuuuuuuuguuuguuuuuaacuuuucucauguccuuaauagaaagaaaaaugggguggggagauaucagaggaaagaaagaaaugcccugccaaaggacuugagacuuguccuaacuaggaguucguaacaaaaauggaaaauucuccucugcacuuguucugagccaucuuucaaucuucauuuucccagaaacacuuaagcaccugucugcagcccuuggccggccugcccuucuucacagaaggcccugggccagacacaggggagguuccauggugucgacuggguucacugggccaacacagagggacacaggaggcuucgugcacagggcugcuucaggacagcuggagcaacuacuaacaauuuuuacugcuaccucaaaaaaaaaaaaagucauuuucaccgcaggaaaaauucuucuaaguuuucccaucucucagaaugacagacuaguuagaaaaaccauauccaacuuuauaacaaacaguggaaugcuuuuucguccaguuuucauguuuguuuaauuuugauguguguggcauguaaugaugcugguggcagugaucacgacccuggggguggccuuuuacaacugcuggcaugacacuaacaggcucucuccacuucuggugaagggagaggggcccuaccauggaaucuccucauauaggugucuucacaggcaucggggggcggcggcuccuggucacagacccucugcaaccuggaggugcacccaggggauggucuuuggcaccuggaggguugcacuggcagcagaaccugcuuaaauucuucucaggguggaaguugagcuugcaacacacuccugcagccuuucacaaggccaaaaguggagugggacuacaugagguuucugaaagccagguguccuuccuccuaacucaucaugcagauugagauuaaauuaagcugcguauagcacugccucagcaggcuuaagaauaacuaagaccccuaucaguaaaccucauuccuuucuacucacaacacaggcagucccauggucccaggcagcugaagcccucacuggcaacucucucaccccacugccuuaaucaaccuuugucucugucucucucccuccuuuccucccuccucauucccaucucugcaacuccgcucuugucacuucucuguucauaauguuuucacacauucucccucucagacuuugaccccaggccuggcucaagccccuccuuccucacaaagacuuccccaacagcagugacacuccuggacagugccuuugacucucugucacccuacagcuuucucuaauuucuucaugacuuuguugcagucuuugcccuugcuagacaagucacuaaguauuuccaagcucaguuuccaucucuguaaaaugggaaggaugauuguaccuacccuacaggacaacuuuuuuuuucagacaauauuucucucuguugcucaggcuaugcagugguacaaucauggcucacuguagccuggaacucuugggcucaagugauccucccaccucagucucccgaguagcuaggaccacaggugagcaccaccacacccggcuaauuuuuaaaauuguuuauagaggcaaggucucccuauguugcccaggcuggucucgaacuccccacagggcaauucugaggacuaacugugauaaugcaaucuaaugccaaguucucacuuuagagcagcaggcugcacuuagcaaaugccagccaaaacuuccacuagcaccgagucagagacagguacacggcaggugcuuggguaacuuuuugacuugacaacaaaacgaccagagcucccuggaaacaagacuccucagagaaagcaugcuugcacauccaucuacugcuguucuguggccuaggaagacagagcucgaguguggccaggacauuccugccugguguagauaugaucugaaaaucuaaauuucugaacaaaaagaaaggucuguaaaaugagucccuaaggggaaaaaaauguaaaaaggagugauauuuucugggccuuuaacuaaaucuuaauuucuugguuuagcaagaugacuacccuaaagcuucaaagggaaacuaaaauguauugggcagggugcuucccaagcucaauuucaguucuugcaaguauaugacgaggucuucauuaacucuguuuuagagcugaggagagccaagggucaaacagacuacaugucuugccccaaaccacauagcagagcugggagucaaggucaaguccaaccagcaccaaaaccaugugcuuucuauuccaucagcagaaaaagccaggcagaugccacauggcuggguacuuaguaccggacaauguucugugucucugccacucccaccccacagcuucccggaggaagcccacacuuaccagacagaccucugagccuccaauguuuuaugugaaagaaacagucacugcauccccucaaaaguauuuaacaauugcaugcuucuauacuucauacauccccguaaauucuuuuaaaacaaaaacuggauuuuuuuugucuaaguuucaaacacuucuagauuucuuccuccaaaaugcguauuaaccagcuuuuucacaggcguuuuuugccauuaccaggaugucuauaguagacugcauccggcagcugauaaauaucauaguucaugccccacaaggguuauagcugugccucuguucuacucuauggcugguuccugaagccuccugcacuuuacuccagugaucucaagcucucagagcccaaagcagggugugcagucccuucuuaacccuuuaauacaugacuccauagaucugcuuuuuaauauucccacgcucuucccagggaaggaaaucacaacccacaaaugagaaggccauucaggaaugcgucuuuaccucaaaucccuuugugaaaaucuuugauacuuggccuuaaaauguauuuagaggaaacucauacuguaaauucuggagauucucagaaggaucugaagguucuaaagacuuccaauaaaauuuacaucuucaacuucauggaaauguggucccuuaggcacaaauuaaugugaaacucuuuaauaagcacauucuucauucucuacccauccuccaccccauucccacuguuuuaaaucuucuaaaauuaguaacagcagccacuauuuauuaagaaccagugagugcagacacgaagccaagaacuucacauacgcugucucauugaauccucccaaguaauuccugagaaaucagaggcuuauggguuacauaaguuacuucaggucacccagcaagcuuggcagccaggauucaaacucgaagccgacaccaauguacucccucgaauccuuacacaaugccacauuagucagaaaauauuuucuucccuccugaaauuaguaccucuccaugcaauagccugcagauaauaccagagcagaacccagaaggcccucucugcuaggucagccauguuuuugccacaacagugacaggaaacagaaaagguggaaaaacauggagauucagaacaaagcagucaccucugaccucuuucuuccuaucagaggucagaugagcagucccuggaacaaacaaucuggagucaguuucccauucacaucuuuccaugucugauggggaagaaacagcuggcaugacaagucucaacaaggacuagaagacugacauagaccccauguccaugauaauuaaccaccgccugcuuucgccaucucccuccucgccucucaguccgaucagugggucaugaaaugaggacaaggcuccagggagguucaugccacagcugcauagccaugaaccagaaaugacaacagacacagguguuuagucauuuucuuucccugugggcucuccucucccacacaucacaagcauaucuccccaaccaagggaagcgcuaggcuugucucacaacagaguaugaaucuggcauguucaucugagccagcacaacucaccacuuuaaaaagcacaaacccguccaucacuggaauguguaugaagccgcaaaauguuuuaccuuugcugaacuuucaaacugaaauaguucauuacacuugagagcguagcuggcauaacaaacccaguuuucccccacucacuucaugaggcccauauuuuaaaaaaacauuauuaaugaucaagagauuccgaacagaaucugccugccaagauuuauuuggcaaaggaaauuuacucuaucucuugaaacacagggauuaaaaauuagauccaaucuucuuuuugcuaaacuuuucaccuacccacuuaagagaaaaaucacaacgcuaugcaaaaccagcaugguuaagaugaaaccuuagcacccaguuuucuaaugcacucacccucgguguuggaaccuauguugucuuccagucccaccucauacgucccucgacuuaaggguguagugugaccugaagcaggguaacuucgaagaacaauuucuucuucaggaugagcugggggaacauccauuuccgaaggcacuggcccuccaucuggguagggcuggaugcuuccguuuucgggguacgguggugggguuucccaggaaggagccagugaaucucugucuaccucugguggagcugggcuucuggucucucucucaucccagggcucaacuuggccuuuuaaaucugggcccccuaccucucccagagauguuccuucuuuggugugaggauccaagguggaagauucuguuucaggauagaauggccaauaaguagguguuggaugcaagggggaggacagaucagaaucuggaggggagauccuacccucuaaaggcuuuguauccacuuuggauuggaaggaaacaucaaugcugcuguggccauucaaugccuccucugguucacccggaagguauucagcuuccuccucauucacaucauaguaauccaaauuguccucauuauagucacuuuccagggcuguagcauggcugaaggaacgucccaggggaacagaagagugggcagcggaaaggucuccaacugcagcuggccugacauuguccaacggggaagugcugccgauauggaaagcccacacuccagggauccccagguugcuuagucuaaauaaaaaggaaacagucauuguaacaaauguaacaaaaguguccauucacccaccuuccuagaaggugaacaacuuauuuuaaaacggaaagacagcugggcaugguggcucacacuuauaaucccagcacuuugcaaggccaaaguaggaggaugacuuaagcccaggaguuugagaccagucuaggcaacauagugagacccugccucuacaaaacccuuuucuaaaaaacuuagccaggcauggugccacaugccugugcuucuagcuacucaguaggcugaggcaggagggucacuugagcccagcaguuccagguuacagugggcuuugguugcaaccacugcaccccagccuguguggcagagugagacccugucucaaaaaaacaaaaaaccugaaaggcuauuaagaucagguucaguuuucacugguauauaaaaccaaauaaaagcagacuuacaugguaacuaaagggaucauacuggacuuuugaugugaacuaccuuuuauuuaacauuauguuucaaagcuguaugccacagaaugccagaucaucaaauuaucaaucugccccauaauccaaaugguuuaucuaaaaucuggcuauuugaaaauaaacaaggaauguaggaauguuucauccuuccucuacuugucuggaaacauaacacauuuuaaaaauguaugcuuaaaacucuaccaaauacugacacccaaaugacuacgacauacuuucaugaauuggugaugccccuucccugugccaaguguuucacauucuucaauacaaucugcaaauagaggugaucauauucaauuuuauagaggggaaaauaggcuuuaaaaggcuaacugaucuucugaaggucacauaacaaacaauuggauccgaauucaguuaacaccaaagcccaugcucuacucaucuauguuauauuaugacagaaaaccauaccacacacugcagucaauaagcaucugaauuaucauuacucuacagaauauuaaagacauuucauuguuuauucacuugaacugauuaauucccuaauccacaaagaauggugagucaauguaaaaaaauucaaauaaauacaaaugccaaaaccuaaaaaauuuguuuuugcacugaaaaaguuaaggagcaaauaagaaaguagcuuagaagucuuuuaaagacuucuggaaacagcucucucguuuucuccaugagaaaagaacaugaacuccauugaguuuccaaauaucccaauaacccauuauuuuagagucaaugguauacccuaaagagaacaacuacauaugauuucuaaaaauaugggaaaacuugagugaacaagagucugguuagguugaauaugccaguuuguauacuccucugauauuuguacaaaacacuaugcucacauucucccaagcaauggaauuuccucaaaagucagucaaugaggaauaacaguccaugccuaauaagauaauaaaaacuucacuaaauuguauaagaacaaaagauuuuccuucauuuggguggguacucaucauguucauguggauuucuauaguaacaauauuuuucaguacaauuugaaaaugucuuucucuuguguguguuuguguguguguguguguaugcauguacauauauguauaugcugugguuacuguugugguaaauuuagggaaaaaagcauagaaagaaaaacugauuuugugugcaauaugcuauacauauuuguuaaguucauaagaauuaauguugguguuuauuggcaagcaaauaaggaaaacuaaagacaguaggagaaaauccugaaguucugaggauauugaguuuauuaucacauuagagguggugcaacuaugaaauuucuucuugaaguuagaaacagaaacuauaaaaucuucaaacaguggaaaaauacagauuauggccaauaaaagcuaaauaaaauaaccuucuaauuauauauaaaucacuaucuggguuuugucauuaugcauaauggaaaaguaaccaauuugaguuuauuuuaaaauccaaggucauuuggaaagcuuaguaauagaaagaacuuaauuuauuucuacaaaggaaaauuggguuacaaaaugggaugacaaugccuuccucccuggguuguuaggagaauuaagugagaaaaccacauuaaaaugccuagcacugaccagguacggugguucaugccugaaaucccagcacuuugggaaaucaaggugggcggaucaccugagguuaggaguucaagaccagccuggccaacauggugaaaccccacuauaaauacaaaaaaaauagucaggugugauggugugugccuguaaucccagcuacucuggaggcuaaggcagaagaaaagcuugaacccaggaggcagagguugcagugaaccgaggucaugccacugcacuccagccuggaugacagaacgagacuccaucucaaaaaaauaaauaaauaaaaugccuaucacuggcccuaaacaucauaaauacuuauuaacuacugucuugucuuccagaagauagaaaaguaugauuucaaaauauacacgugugaauucguauuuaaauuugcagaggaagaguaugacaaacauuaugaacuauauaauuuaugaccuuugagcucacaguugugagacaaauuugaggaagaaaacaauugacuaggaaaauaacuuuacucuuaauuacuuauuuauuuagagguagggucucccucugucacccaggcuggagcauaguggugugauugaucauggcucacuguagccucaacccccugggcucaagugauccucccacuucagccucccaaauagcugggucuacgggugcacaccaccacacccagcuaauuuuuuaaauuuuuaguagagauuaggucucgcuauguugcccaggcuggccuugaaugccugagcucaagcaauccucccaccuuggccucccaaagcgcugggauuagaaccaccuugcccagccuaacuuuacccuuaagagaugcauacuaaggcauuuagcaaugaacuggcaugauguuugugacuuacuuuaaaacauuuaaacaggccggguaugguggcuuacacccauaaucccugcacuuugggaggcugaggcagguggaucaccugaggucaggaguuuuagaccagccuggccaacaugaugaaacccagucucuacgaaaaauacaaaaauuagccgggugugguggugggcgccuguaaucccagcuacugggaggcugaggcaggagaauugcuugaacccaggaggcagagguugcaaugagcacaagaucacaccacuacacuccagccugggcgacaagagcgaaccuccgucucaaaaaaaaaaaaaaaaaaaaaaaagaaaagaaaaaaauguaaacaaacaaaaaaaugaauauggcaaaauguuuacaauguauaaaucuaggugaugggcauuuggguguucaucuaguuauucucuccacuuuucuguauauuuuugaaauuuuaaauaaugaaaagugaaauagaagauuauauugaaggacauuucuauaaauuugauguacagaaguucuuccuaagaauaacaacaagauccaaaaucagaaaggaaaagaccaguaacuuugacaaucugaaauguacaacuuuuaaaucauacacccuuucucagcaauuccacuuuuaagaauuuguuuuagggagaaacgagaaugugagcaauguuuauuaugcuguuuacugcaaugauauuuauaacaagaaaaaucagaaauacaugaaauguucauuaauaagcugucuuuauacauauaugacauaacguuuuguagccuuaaaaugguaguauagacagacaucugacuaaaagaccccuauaagaagugauuaaugugaaaacaccacuuacauagcaaaagaaccauuuugguuuuaaaaguuuuguauauaccuaaauucuagaaggaccauuaacacuuguuaucacuugaaguagugaucauggauaacuuuuacuuuuauuucacauuauucugcauugcuuguacuuuauuauuuguauuaagcauggauuacaauaaagaaaaauacgugagucauuuggccccauaucuuacucugcuuucgccaagcaauucagagauuucugggaaguaucaaagauaaaaaugagggaaggcaugaaaggggguaaguggaaaugcugucuguguguuugugugucacacgugauuguggauguuaguuccaagagaccuuuauggcucugcucagggaacacaacugcuuuuucccacaggucuuuuggccccacugucuccugucuccuguguagaugccagcacuuacccagggcucuguaauuguugaucuauuugucuaucaacccuaauaggguacaagcugcugaugugcaggaccagugucuuagaaaucuuuguauuccaugugcuuggccauugugaccucucuauaauaauaaaucuauggaauaauaaaucuaugagcucccaaguagaagagaggguggaaccagaggagggagaguaaggaacugaguuugcuccagaguccagacuaagcggcagccuagauggagcccuaaagaugcccaauguggaucauaaggaugggaaaggaaacaaggacucagcauaagauaaaauaaguaguucagcacuccagacuugagcuuggauuuuggcuuugccacuuaacuuugagaucauaggcaauuuacuuaacuucccuaagcuccucuguaaaacugggaaaauaguaguacuaaccuacaauucuugugaguuuuaauuaagauaacaucuggaaaguguuuagcaugaugcuuggcaaguaguaaguuuucaauaaaugucagcucugaguaagcaaaccuggcuauaguggucucuuucugguagccgagcagaguggauggcaugcuaaaaguguaagguguuucuauaccuacccaggauugauuuaaugaagucaagaagcaguuaaaggaggccaggaaguaaccaauguauucuaucuggcuucuauauucaggaaacgaauaaaagcgagggcaccccuaccuccccucacacaccccccaaaaaacccugaagucaauaaauauccuacuggcacuaucuguacuggcaaaaugcagaagagcuuauuauugcacuagcuaaguaagcccucuggaucauucauucauucacccaucuauuuauuaaaugcccauuaugggcagacacugaugagucuaaggaauggguucaauucauuuuagguaaugaagccagagagacauccucagacuucuggaaaccuauaaaucuuaguuauuuuuccugcaaauuacauugcucaauuuaauguuuaacaguaucuguccaaaagacuaaaucacaauguuuccuccugugaaaugauuaaucuggaaaaccucaaacugggcaguuuaugacuggauauuuuuaugugguuccaagagcaauguuuuucauagcaagccucaguggcucuacaaauacacacacauacuguucuguuuccaguaucuauacccaauagagcaggaaaaauaaaggaccuuuuauguuuuggugaacuugauccuuccaggguugaaucuaguuccuugguuuugacuugaugccuuacuuagaagccaccaauauauuauguaauggucuuauggucacuuguguucagguacuuccuaaaaguccuuauauucaaauaggaaagggcuucagcucaauguuacuuacugauagagauuuuucacagacuguucagugcuagucaagcugaaauaugguccuucugacuucagaucaucagccuccccucggcagaagcccacccgagcuggaagcugaagcuggacauuguaagacucuuuggggcggguuccaaggaacugcaggccguuggcaggauaaagaaagagggcguagcuaucagacccaucagaugccaaaacugccuggaaaguguucagcugugaggaaaaaaaaaaaaaaagagagagagagagagagaaacauccuguaaaaaacaaauaaaagaagaaagaaacagaaugcaagcaaagcaucauaacgugcaaagaacuuccccuuuuucaggauuccuccaaauuguuuuuaaacauaaccuucuuuaaaauuuccucuucaaguuaacaauauaauuucauaagcaauauuauuuauuauugcaaauaccauuugucaauuuagauuaauaguugaaauacgcauugguaaaacauagguuaaaaaauauauacuuuguaagguuucaaacuucucucauguaaacucuuucagagcuaagagcaaucagcaaaauuaacuuguccauccugcagucacugcccuaguuuauaacccuaggcacucagcaucucucauuugcaucauucauucauucauucauucauccauuuauuaaaugaccacuaugggcaggcacuguguuaggcacuaguuggucaaaaggccuccuuacugucucacagcaucacucucuuuccucuuccaucuacccuuucauacgagcaucaggguuauccucauuucacagaugagaaaaagacacaggggcuaacaggucuuccucaggucagguggcaaguaugugguggugggccagccagcucuagagcccacacccuaggacacccuaaccccuccucaacauggcauucaaggugaguuguaaccuggcugcauacgucccucccaggcucaguuccacugcaucuuugucagacuauuuaauaguccccauuuguaccauguccuuggaugcuucuacacuuuguucgugguucccugugccuagaaagccuccuaaccuucaaaugcugccacucagagguguuugugauucccuauagaauaauuucuguucucugaaccucuguaacaccuuuaugggcaucucuagugagcauucaccucauuaugcuugguuaguuguuuauauguuuguaaacaccauucauuuauucauucauacacuaauucaaacagccaagugucuacuuaagcaccagacguuaugcuugaugcugaggaugugaaggagcaaaagacaggcuuugcccaggagagucucacgguguaggacugggaaacagccaugguugaaaugguaggagagucacuggagaaggugguagaggccaagagccgggguguguguccaggaucucaggguggagguugggaggugucacagaggcagcuggugaauguuauaaacacugcaggagccaacacagaccagagagggaccaggagccugaaucagcugccaauucaacacccagguccuuauaggaucacuccuuaacauucuguuuacccucauauuuucaacaagaugagauuuuugccuuuaccuucauucagcgaccgcuccuccuaaagaucugugaacagugcuugauucucaaaaagcuguuauguuuaggcuucugaaacugucucucucucacuaaaucacacuacuuuuacaauuuaguaaggaacugggaagguauuuuuaaaacacaacuuacuucacaaauaaugugacucuuagaaauauuauuuacugguaaguaucauuaccuuuccauucugcuagacagacaaacucgggcacagagaagaacaucacauuucacugaaggaaacagcaaggaaggaaugggcucuucccuuuguucuaagucuacucccacaguuguucuagcucuuuucuaauguuaauuuuuccuuucaauguuuaauuucaaaguaagguuuugagguuuugcuaauaggauaaagaaauauagauguaacacacuuuucaagagaaaauaaaauacaaucagcaguucuuuuaguucucuaacccagaaaaaacaacaucuugcuuugcuuuuuucauucauucaauucacaaaguaacaggugccuaguuuauuuguuauuguuccaguuguugauuguucaucagcaaagcuugacuuuuccaaaaacaaaaagcaagaaauguuuuuagagcuucucaauacuaggaagccacaacuacugccaaauauaaacaaaggcuguucugccucaugucuauccauaagauagucgacaucaucaacuaauguggacucaauaacuucagaguuauacauuagucagaauaaagaaaaaucaacuagggaaagaaaaguacuagaggaaggagaaaaaaccccauuucaaaaagcuaagcuuucaaagcuccuggcauugaucugccauaauaaaugugagauaggagagaauccugguucuaaauuuagagaaauuccauaagauaaggagguuguagagacugugaagaauugaaggggauggggaaggggggaagagaguaguaaacagagcugugaagaggagagucugacuuuuugcugugaacucugggcauuuagcacuuuauuuuauucauucauucauucaaccagccaacaaauucauuucaauuaaaauuuauucaacaucuucuauauacuguucuugagaugagcacucauuauggguggcaaguauuuaauuucuuugucuccaccaaaauaggcaaauaucagaggaaggaaacaacuuccuuuuaaguagaauuuaugaucccaaaguacacgccaaaagaguuuggcuguuuaaaagccacccacacacuaaaugaucacuuguaaaguucuuggucaguucuacaaaauucuacaucuaauugcuaaagagcccacuucaugaagucuugaagggcucccccucucaaaaaacuccuugacuggcuuccaaacaggaaagguccucacauuccuagauacaagcuuuugcaagagccgcacaggcucugucuccaaagagaagcccucagaugggcugccaaaccugacaaacgagucacugguucccagcucccccaggaucccagagaggagagaggggccuccacagggagaggagcagcacagagaggaucagggugaguggcugcaggcccuguuaucagaaagagagaaaagccagagcccucugcagaaaccagagccugacucucccucccagguacaggacaucccaaucaauguugaagugacacucaucagagccaggcugaugcaugcaacauacaccccucuaagaguuucuaauuuuuucaauucauuuaauuaacugcagcuaucuggacaaaaaucagaauagugacauccuuuucuucaaggggcuugccuauagaggcuuaucaaaaugaaaaugaaaauggaaaugaagaauuagggugacucuuauaggggucacaaaguucucuuugucaucuuccucaggaccacauguccucuagagcucuaggaucauugggucuggccuccaguguuugcugugaacacuaaccuccauuccuuaguguaguucuucaucucccacugccuguaggacacugucacaugggggacugucccucauuuauuuuacugcacuaaauccuacagauccugccaaaaauucaaagacaaaugcugagugcuaucacaucccuaauacuauauccuuccugauacucuucagcaaaacgucagcauuucuaauuuccauauaugguucagcauuaaccaauuuccauauaugucucuauucucuucaucuucacagugauaucucagacucagucugaacucucuuggaugggcuguagaccaccccucuucuaaaccuugucuccagaagucaaaaagcuacaauaaaguccugcuuuuaccucucauuuucucugugaaauccaaccaccuccaucaaugacuaucaaccuuugaaccaagucaacaugucucagucuccacccagauggaggccuccauugggcagugucuuaauuugucuucuguuguuuacaacaaaauacuugaaauuggguaauucacaaagaaaaggaauuuacuucuuacaauuauggaggcugagaaguccaaaguugagaggucacaucuggugagggccuucuggcuaguggugacugcagagugccaggguacuuacgguaucacauggcgacaaagcugagugugcuaaugugcuagcucaggucucaauuccucuucuuauaaagcaaccaggcccacuccaugauaauccaguaauccaugaaugaauaaauuaauccauuccugagggcagagcccucaugacccagucaccuuucaaaggccccaccucucaauacugucacauugaggauuaaguuucaacaugauuuucagaggggacaaauauucaaccauagcgggcaaccuugcacucaucugucuuauguuacugccugugacuccuucauccauuucucuggccccuuugcuaauagguugcucucucaaccuucuccugggucauguuuuugcucagaacaaucucucuugauaccucauucucaauauccauucuuuuuagcccuuucaaccugacuuaaauuccagauaaacaaaacauuccccacauuacagagaucuauauaacucagcugucucuaaccccaucccuaaaaugacaaaaacaaaacacuccucuuuccccacaaaaagcacagcuaaacauuaguccucuaugucucccaucaauaaguauuucaaaggucuacaccauaacuuuuuugcucugugaacuaccuaugagaguucaagaaaucucagauuaacugaauugacaaacacuauuuguucacauuuuuuuuucagauacaauuacaccuugacauuccugcaauaucaggugcaacaucuggucacaccugacaggaauauccauggagaaaaagggcaccaacugcaauuguuuuuaauggcaaagaugccauugcuuugaaucuuccaguuuccaguaacuuugcaauauaaaguuaguaagccaaacuuuaagaacgccauguagaacucaguccuucaagcaaauuagauuacuguuugccaaagucuaucuccaaagaacuauuaaaacaagaacucaagucccagagcucuuuaaaauauuggaagaaacuucaauguggguaauugaaagaacauccccuauccaaacagaauccuccuuucuuuuuuuuuuuuuuuccccuuucuuuuuuauuuauuuauuuauuuauuuauuuauuuuuuauuauacucuaaguuuuaggguacaugugcacauugugcagguuaguuacauauguauacaugugccaugcuggugcgcugcacccacuaacgugucaucuagcauuagguauaucucccaaugcuaucccuccccccucccccaaccccaccacaguccccagagugugauauuccccuuccuguguccaugugaucucauuguucaauucccaccuaugagugagaauaugcaguguuugguuuuuuguucuugcgauaguuuacugagaaugaugguuuccaauuucauccaugucccuacaaaggacaugaacucaucauuuuuuaaggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauaguccuuuggguauauacccaguaaugggauggcugggucaaaugguauuucuaguuuucuuaaugaaacauucugaagccaacuagcaaaugguaaugucugcagguggauuuuaauuagaaaaguaaaagagagauggaauuuacaaaucucuucuacccuaaaccucccccaccccagaaaaggaccagacaaaaguuuuaauuccaaaaaccuugcauuuaaagaguccuuaugcaacauagagaguaacaggaugguuaccagaggcugggaaggguaguaggggucaggggaagguggacacaguuaacggguaccaaaaaaaaaaaaauagaaggaaugaauaagaccuaccauuugauagcacaacagggugacuauaaccugugauaacagguuauuauagucaauaauaacuuaauuguacauuuuuaaauaacuaagaguguaauuagauuguguguaauacaaaggauaaaugcuuggggggauggauaccccauucuccaagaugugauuauuacguauugcaugccuguaccaaaacaucccauguaccccauaaauauauacaccuacuauguacccucaaaaauuaaaaaauaaagaguccccauacaaaagauauaagucacagcauccuuacaagauagagaucagugacaugggcaagcaaccucaccucuuacagggggcauguaccauccuucuauagugaagaagcauuuccguaaguuaaaauugagaugaaucauaugguuucagccccuagaguaugguauuuuagauucaggucuaauuccauagaaggaagcccuuacuuucuucaggaaugaggcaguuugccauuuaccaagcacgcuggccccacucauauccauuuggaggacuucaaauguugaugacaagacuaaagaccaggagccuggaauuuuuuacuuuccgcagguagagacuguaaagcacauugacggcagacuccuauaaacuaagaaacuuguaaacugguaccuggaaggcaauuaggcagaaguuaucaagaacuuuaucaaaagugcauccucucugaccuaccaauugcacuuccuggaaugucaacuaagaacaugugcaaagauuuagcuuuuuaaaaagugauucacgcuauuauuuauaauaaugaaaaaccagaaaaagccuuaauggcccaacacugguugagcauacugugguacacccacuauuauacaggauaauagcaggauacaguaguaugcaucauuauaaaugauguagaaauacauuuauugacauugaaacauauuuacaauacacuauucugugaaaaaagcaaguuauaaaacaguaugugcaguguaaacucaucauuguuaauagacagcaauaaagauaugcagaagaaaaaacucugaaaauguacgcagaaaaauguuuaucaguggugggaaaaugagugguuguuuucuuuuuuaaaauuaucuguauuuucugauuuuuuccccuucaaugaacauauaauuagaaauacuuguauacuuagagaugguucuaaaaauaagcaaccaaacaguaaauugccuuauguucaaaggggcucccacaucugcacucccgcucucauauccgcuaagcauuuuuuuccucaagggagugaccaccugccagggccucagaagaugccuagagacaacgucuuuccucacucccaagccacuccagcccugcugccuccaaggucagguucagcgcaagaguaggcucagaaacaacuccgagccagucccugggucgcugccccagaauuuaagcccauccuucaauuuccucagcagucaaauaucccuggucacuuaccucucccgagggcagcgccccgcgcuugaccuccucguaagcgccuaccugcucccagguggccaggaaggcguggguggggguaaagcgcgcagagcgcgggaagccagcgcgcacauagcgggcggccaggcccagcacugcgggggagguguccucucgguacaggacucggccucugccguggcucgugucgauguccgccagaaaaggggcgauggccgggaagucgguggggaaaucauaguccacauacugcguuucccuggggaaguccugaguggagaugaugccguuggugcccaccugggagaggagagggacaaaaaggugacagucgcucaagcccaaggacgcuacccuuucgcgcagggagggaagggaacugacuuaggcaaaaagccucucucuccuuccccacuggccagggagucuggauucagggaaacaagcgcaacuuuugcgacugucccagcuccgcgcugcaguagguccaggggcccuaaaacucguucaccuaucuucucacuccccucacaaccccggagccccauguccucggagaggaagccuccaggucugaagagggaacaccccagcuccgcagacgggcacagccuucucgcgguccuaacugcaaagcccgcuggccgcccuagcaacgccaccuuuucugccugggacgcguacguggcugcgaacaauucuugcucuccccuccaggucauucuugcuccccuacagcagcggggcaggcagcggcaucgcucucuggccggguaccaccgcaagggugcuggggggcuccaggaguggggucuguuuccuccccucuggaggcaggguuuccgugagaccgaccccagggaagaagcugcgggaaaagugccaggagggggcugaacuuacguagagguugcugaaucgggcuucguagaagugcaggggauucgccagcuucaccacggcugagcuuucgucgucgccuuccugcaggagcugguccccccacgacuccccgugugggaagagcucgucugggugcagcgccgcggcccgcaacauuagcaacggcagcagcaguagcacugguaacgacgacagcaccggccgcccggccacccggucccccuccaugcucgcucggccgugcgcuuacccgcugcacaacgcgucccgccccggccuccagcccacucuccgcgccgcgccagccucgaaccuggaucuccgcgggcgccugggcggggcgggacuccaggcccacccagcaagcuaauuggcugaggcccucggcuggggaccaaucaccggcucugagaaaguucggcaguggccaccacaucugguucucguuaacuuuucuaaggc

SEQ ID NO: 192467 - RNA, 11026 nt, Homo sapiens
auggaacagcgguuagcugaguuucgggcggcgcggaaacgggcgggucuggcggcccaacccccugcugccagucagggcgcacaaaccccaggagagaaggcggaagcagcagcgacucuaaaggcagccccaggcuggcuaaagcgguuccugguauggaaaccuaggcccgcgagugcccgggcccagcccggccuaguucaggugagacgauggaaacuucggcccuaggaccuggccucggagccacagucgagggcgcggcccuagcugccggggguguggcccuagcugccggaggcggggcuacuggccccccauccugaucgagggccggaccgcucaucuccggccacacgugucagcacuguuaccaguuuugacauuuucuuuccagcccgcgacccacgcagguccugauuccagcgagagucgaggguccugggagaaagcaccucugcucuuaaauuauucacuccgaauugaguuaucgugacgcccuguggcauugggaaaccucuccacaaccaaguugagccacagcccucugcuaauggaggaggguaaaaggucuaauuggauaccgaucacaaguagcaguaauuaaaacuucauuugauucgcaccuggggcacaugcagcuaguagcccagauagccugugacuuagaaaugcguuugaauacagaauuuaccaaagugugguagcuguaacugccgguaguggcagaagcuuauuccaguuccauagugaauguucaagacacaaacaaaaaaaagugauuuaguaugauaaccuuuucacauuuaauuguuuugguaaucucuuguuuugcagaugaauuuaauuugcauccuuuuguguuuucauuuaguuuuaacucaguaaaaugguaagguggcuugcagugagguugaaaugucuauguggaaauacaagacaaaacauaucaagggaugagugcuuuguaacaauuugugcccagugcuuuguuccucauaagugcaauaagaacuaaaaaauuccuuuuaaaaugaaaauauacuggaagaaaaguguaccuugcucaccuuaaaauuauuuccuguaaguucaucuauuauugcacaacauuugauuugagggaauuuuuaaaaauuacugaaccuauuacucaauuuugauuugauauucucagugauauacaggauuccagcugacuugcagaaaggugaaaagagcgcagcagaguucagacaauccauuuccuugugugcaguuuguguuaauugucuuuggauaauuuuauuguugacuagaacuuucuaaguacaacacuugcuuaagauuuuagaaaccauuucccuuauucuuuuucucucugcaguuaaaaaacaaugucuaacccaugcaaugaacuuuugacuguaugucucauuuccaaaggaaugagaucauugagguggacccagagaaacugaauucagagaaaaacuuccauuauugagaacccaaacgcugauugccagacaaaaggaugagaggaaaugcuggaccuccaguuucuuguuaauugcucuguuuuuccauaagggacucugccuuaagcucauuuucauugacuuaucauuucuggguuugcucuggugugaaaauucucauuuaauuuuuuuucuucagauucugccucuaguuuagaaaagaaaaagucuaauuuacaauucaugucagacaauuuugauggcacacuguggccugucagagauuucuuuagcauucuauuuuuuuaaauuauuuuuaauuuuuguuuuuuuaauugaaacagcuuuauugaaauaagguuuacauacuacagaauuuaucucuuuuaacauacaguucaaagauuuuuaguaaauuuauugagucaugcaaccaucacugcaacuuuagaacgucucuaucacuccaagaagaccccucuugcacauuagcaguuacuacccauuuccaaccccagccccgcacaaaugucagucugcuuucuaucuauacauuugucuuuuccggauguuucauguaaauggaauuauacaguaugguaaacacauuuuuugucuauuaauuuuuauauucaacuagguucaacauguagccguagccaaauauuuuaaauuuuccuucuggaaguuugaaaauauuuaucuuuuuugauacuuacuucuccuucugcuuucucuuuuucauacugaaacagucuuuuaaaugauugcauucauugauuaauuccuuauuuuucccuucuagcagaagaccuuccuuuucacucucaagacagcauccuuggauauuaauuaccuuuuguucauuauccccuuucuuaugagcaccaucuaguuguugaagcaacagauuuucauguuguaguugagauauucucuccucuacguagucccacuuuccaaaggauuuacuuggcuuagguccuuuuguacacuuuauaaaaccaaaaccuuuucucugagagaauuucuugugucauggaguuuacuuuuuaggguauugaauucgagcuucggaaaguugcucaguuaaaaacucauuauuaucuuuuaguucagaaauaucagaacucauuuucuuucuuguaaagaaacgucuugugcucucuguaaagcaaguucuaggucucuuuuuguuuucacacuuugaucacacucacuuauagcagcagccagucuagcauggaaugacucaacuucagcuuccagucuuuccuuguuuugauuuuccuucuccaguuuagacuugagcauuguauucucaguuuugaggucguuaagcuguugaccauacugggauacuguuuuuguuaauguuuuuccauucaguuuuauagucucuugaaggucaucauucauuucuuuaacaauuucaauguccuuuuucccuuucgagguuccuauuuuuuauuguguauacuuacauacacaauaaaggcaauaucucucuucaacaagcaauuuucaugcaucagaucuuuuuuuuucuuaaaguauuucuucaagccuucaauucuauuucuagugauccgauagucaguuuaagcuguucuuuuacuucaacuucuuuccuauguugcuccacuuuccuuucuaacucuucccuaauuuuuucauauaacauauuagcauuucuucucaucuucuucuaagcugcaaacuguagaguuccuguuuccauucuacuuuuugauauugaacugugacuucguuucuuguguuuuggauagcuccuucaguacacuaaacucaguuuucauauuucuuauugucuaguguaaguuguucacagauaauuuuuuuuaagguccagugacuuuucacaugaaagaaaugcauucuggacuuccauuaggauacgagaaucauuacaauccauuccauauugcuuaaugagcaucauaaacuucuuacaaugaggguaagguuucucaugauccucugaagcuguuucagagggccgaguuaagucaucagguucaucucuaaaugaguuugcuuuuugaccuuuuucuuuucauuugacauuuucuuugcaggccuagcauacucuuuguucuccuuccuaggaaaucgcugaugguaaguuuuuccacucuuucuuuguugaauuaauuuaucaucaucgucagcagauguacuaucauauacguuuuuuugauacuuuuuuuuuuuaacuuucgugcuucuuucuagcuucuucaaccuguggcuguuuauuuucacuuucaagcuuuuccuguucuuccucugaugucacuuguacuucuuguucugcuuuggauguuuguucguucuuccuuucuauugcuuucuucacaacagaaucuuucauuuccaugguaggcuuuagggaaggauguuuuucaggaggcccuucucccuuuccauuuacuauauauuuuuuccuuuuuuauaugaagguccaaguaaagacuuugaaacacucucagggauacacugcuugguaguaaaagucaagucuucaucaucugguuuaggccaugagucaacacacaguuuuuuuuuaaauacugaaugcagaugcuucagaacucccagaaucuuuugcacuugcuccuccuguuuucaaacuugcauucuucuuggaugcuucuucuggguugucauuuugaagaccauuuucaaguaucuuuuuuuuuuaauguugcaaaauuuguugugagugcuugucagaccaccagaaauagcauaaucugcagucuguucauacauacucuugaguaaagacaauauuuuguugaagaagaaugcuaacuauaccugacaagccauaauguacaacaggcaugagagcuguucuuuucaaccuaucaacagcauguacauuugcuuguuucuucacuaaaauuccaccuuuugcuguguuuugcaaacuauagcaaguaaaagugguguguuugcauccuuguucagcacuucaguauccuuguucagcacuucaguauucacauggugugagggcaguuuuucugccaguaguguauucucauuauacacagcauaguguagugcauuguugcuauagacauccauaagaucuggguuggugccacauucuagcagaaugaugacacaaaucucuucuuggcaauguacagccuucaucaaaggcauccuguuucauuugucaccaaugucagucuggcacuuucaguucaccuggagagugaccacuuccacauggccauuggcacaggccaaauguaaagcagucguguucauccacagaugaaggaauacagaaacuccaggauauuugcacaauggaauacucuucagccaucaaacuuuaggacaucaccccacuuccagcaacguggagagagaccuguucauccacagaugaagggauacagaaacuguaguauucauucacaauggaauacccuucagcugugcacauauacugaaaucauaucaccuggagccacacaguugaaccuguucaucccuugaugaagggaugacaaaacugaaauauauauccagaauggaauacccuuccacgacagaaguggaugaaauccugucauuugcagccauguggagaaaccuguucauccgcagaugaagggauaaagaaacuguaguauauauacacaaauggaauacucuucauccagaaaaauguaaugaaauuacaucauuugcagccacacuguugaaccuagaggacaucaugguaaaugaccuguccuguccacccacagcugaagggauaaagaaaccaccauacagauacacuauggaauaugcuucagccauaaagcuuugggaaauccugucauccacagccauguggagaaacccaagaaacccagaggauauuagguccaaggaaaugagccugguagaggaagucccacaccuuuuaaucucaggcauggagauuccaaaaacuuuaucuccuguccaucuacagaugaagggaucaagaaacuguaauguauaugcacaaagaauacucuuuggccaucaaaauaacuaaaccaugucauuuggagcaacaaagccacugcggccuccauuugggccaagcucugacugcaaugaugccucugccccgacccgggccucgcugugacugacaaugccgcugcaucuuuucagcagucauugaugaggaaguaucuacauccuccuucccacuaccagauuuugcuuggagaaaagcaguuuccugaaauaauucugugacgagcuucuuccacauuaggacaaaaaugcugguaacuuuuaaaaauuccuacagaaaccuccugcuucccucuccagccauaucccaggcaagcccccagcacaccacccugccccagaacccauuucccauacccauccaccacuccugaccuccaggccuuggcucaggcuggccuucugcucaaaggcucuccuuuggagucgccuggcuaagcacagcugugccucacccccgcaaaaucuaguagucaucuugaauuucuuccuuucccucacuaucauucauucauucaacaaaaaucuugucaugugcccgcuguguuccagcuuuuguucuaaauccugggagacaguguaauuaagacacacaaguccuacucuuguacaacuugcauuugagcuuggggcagcagggaaaggaggacaauaaacaaaaccagauaaaugcuaugaaagaaaaaagauaaaaccaguagacugugauagugaauuaggggugaggggagcagaguacuauuuuaaaucagcugagcagggagaacucacuaaggaggagacauuuaacaagaaggaaccacccuggcaaaaacggggacuaagccaagggcacauacggugacauuuuugccguuuguaguaggaggggucaaccaagugauaugaggggaagggagcauuccucucagagggaaccacaagugcagaggcccuaagguaagaagcagcuugauauuugaggaauggcagugccuuccuugggccaugccugugugugauguaacagucacaaacacuucuucacccagguuuuacagcagaagggaacugguacuccgacaaguuccaaaugaggcagaagaauguccguaucucuccucuuguuuguucccuucgucaguuuguuuacccccccacccccacacccaucuaccucuagcucccuaaccuuucuccugccaccccccauaaaggccccuaauuaaauaaaauauauuuuggaggagaccauccuaggauccgagacugaccucaucucugccuaucacuaguuuuauggcuuuagggaaauuacuuaaccucucaguguuuucuuaucaguaaguugggaauaauaaugccugcuuccuggauuaccagaguucauacauuggaaggcucucaguaaauggugacauaggaacauucuucuuuuuauacucccuaaaugauaaauuuaguuuauugugaaucucagcauguauauucagaauguauuuuguguccaucaguccacuauuuccaucugacugcugucaccacccuggucaaugucuggcucucucuugcuaggccuccuccccaaccuuuuuagcaccagggauuucaugcuuuugguuaguucccugcuuagaccuucagcuguuucccauuuccagaaucuucacugcaaccugccuggcccuacuuuaucuggcucccacccucaugcccucccuccuuagccccgucaucucaugcuacucuccccuuugcccagaacacugcccagaugcauucuucuugggccagaacgcauacugugcaugcaugucaaaucugaaacagacauuucuuucuuuaaugaguaucaggggucagggauguggcugauaauauaagggccucuccaaucagacuuucuaaucuaacugaaaagauaauaauuacaauguugaugcuaaaaaagaagguucugacaaaauagaacuucugaaacaucauaaaucagaugaccaguauuugugauccccuuuuaaauaugcacgugaagaagaauaggggauguaacugaagagaugaacugaaaguucugcuaugaauugagaaccuaaguaugggaugccauguuuggaucuggagacacguggcuuccugguacuuaaacaaucuggcaucauacaugacaugaccuauaguaaaagagagacacuguagugcugaauaguuuggugcuuaaugaacgggagagcuaguucugggggaggcagagggggcacccucccugaugcccagggaggucagggcugacaguucaugaacggugcuugccuggaaggaaggcaaagaguuaaggaagaaagaggaaguggacggaauucuaggcuugagaugaggacugagaauaucuuuggguaauaagaccaguuaagcuggagaagaagggucauuuauggaacaaaagauuguggaucguguugucauggaauuuccuagaccacugugacccauuaguggauggugaaauuaauauagaagaucuuguucccuauuaaaaauguuuuuaaaguagaauaggaaauacaagagaaugucucagggaggguaaguguugacuugugaaacuuuguugcauauauguauucuggauuacagucuaaaauguauuccuuauuguaggucauguucaaaagaguuccgaaaacaguggacuggacacagagcugucuaaauaccugugucugccauuagcaucuggcacaggggccugucuacuggcauuucaaucuguugaacaaauugagggucuuggguuccagcccaaggaguuuggauuuuauccuguagacagugaaaguuuuugaagguuugugaacaggaggguaauaggucuuuaagaaaauucauuuagcaguuguacauaggauggcuuggggagggaagagauaggaggcagggagucuaguuaggagacauuggcugggccuugggugagugacaaugaccuguguagguuaaucacgggaugggaagguaagggggcccaguaauggcuguaacagugguuuuuguuuguuuuugagacagugucuuggucuguugcccaagcuagagugugguggugcaaucucagcucacugcagccuccgccucccagguuugagcgauucucaugccuuggccuccugaguagcugggauuacagucgugugccaccaugcuggcuaauuuucguauuuuuaguagagaugagguuccaccauguuggccaggcuggucucaaacuccugagcucaagugaucugucugccucagccucccaaagugcugggauuacaggugugcaccuggcugauuuuuuuuuuuaaacguaaaaaggauuuuuguuuccugucucuauuuuagaaucaugucacuuguaauauuuuaggucaucuaauccaaucaacaaagguauauugacucuguauuugaagcauuugucaugacuguugcauuaucaguuauucaggaguuucuguauggggcacaaauuagcucuucuuagcagcagacuaaucugaagaaaugacucccacgaauaagaaucugucugaauacguagggcuuuuauuaggucacaucucacuaagugcugaucaguuuugauucaguuggaguagagcacauagguucuuuggagaugauuguuuuagagaguugcaugaaagaauagaaaucaaugagccagcagccuucucagagcaaugaaaacugccuuuucagauuaguuuugaucaucucagcuccauuacccuuuauucuuucuuuuguuuguuuguguauccuaggaagcggcucagccccagggcagcacaucagagacaccauggaacacagccauuccucugccgucgugcugggaccagucuuuccugaccaauaucaccuucuugaagguucuucucugguugguccugcugggacuguuuguggaacuggaauuuggccuggcauauuuuguccuguccuuguucuauuggauguacgucgggacacgaggcccugaagagaagaaagagggagagaagagcgccuacucuguguucaauccaggcugugaagccauccagggcacccugacugcagagcaguuggagcgcgaguuacaguugagaccccuggcagggagauaggacccagcugugcugucaugcagcuaaccucugauguggucuuccucaccauuggcuauggauuugauuucagguguauaggacuaagggcagcuugcggguuagcucugugacugcauaguuuuucuaccuucuuucccugaucuuuugcugccauuugaucuuugauaguuuuggugaaacucucuaaaauacauucacuguggguccgacgcaauuuauaaaaauuauguacucaagaagggagaccuguuuguuucauuucucaucuguuugggagaugauuuuagagcacuagaaaggcacuggggagauucucagcuuaaaacauccagcaguuugaaguaugauuagguacaucagggcugcauugucaauguucucuuuaagucuuuuaacauuuauagcaauuuuuuuuuucccggagaguuuagguugcaaguuuuggguuucuuguuuguuuuuguuuugcuuccugcuuuaauucuuuaauuuucagucauuacugguauugaaaaauaaaauaucuuuaaaacaucuccucuucagaaauaggucccucuucauugcccaucaccaucuuccacucuccuauuauuuugccacuacucaguaaaggaagguaggaagagacaaacgccuaagugcagguguggggagggauuucacaagugguuauuaacggccaguucagcaagaaguguugaguguguacaaaggggagggcuggaaguguuaacuccagacccguuggcugcuugaguuguuucuuauauucuaaagcagcagucccuaaccuuuuuggcaccagggaccaguuuuguggaacacaguuuuuccauggacgggguggugguggaggaugaaacuuccaccucagaucaucaggcauuagagucucauaaggagcacgcaaccuagaucccucgcaugcgcaguucacaauacgguucuaagggcuuuagaguaagcagcuuuuucaccugugggccucuggugagaaauucuguaaauugugauaaucaggcuggauuuuaaugcugcuuuuccaguacaauguuagaguuuggguucauuaaaauuaggcaaacucccauuggguuagggcuucucucauuccauuuuguggcuaaccuuacuguguuucagcccuugcugaaaauucuucugauauguguugcccuuccucacagcccuuuggccauugggaguuuggcugucccucagagccauccggucaagcagauggucuguucuaucucacagaaaagucuuuucuuccaugaguucugucugaacugaacauguaaaaaguaugggaaacagaugaaucccuauuaaacaugaaguuuugauuguauuuaagau

SEQ ID NO: 192468 - RNA, 21372 nt, Homo sapiens
ggcagaagcagcaauggucccuccagggaacggaagccguugaacgugaacauuuggaguuuccucuuuugugcugauuccugaggacuaggaaggugccccgaaaagaauucagagugaguacagugaaacagaaaccugcucagcuucuaagugcaggaaggacuucacagggaggcaugaucagaacuugaaaaaaggucguggucacagcauuuuaacauuuuagcuuaaucucuuccuuuuugcagaaaccagggauauaaccauaguuuugccucauaacuguggagcuacaucaguaaccacagcucaucauuuucugauacuuuuuuggagagucauuuaaaaauggaacuugccaaccucucacauugugccuuaauuuuuauuuuuuuuuaaaggagggaaaauuauuuuuuagaaagcaaacuauaaagcaggucagugagaccuucaaagcuguauucccgugguuccucaguuuuccauauuucccugucccauggagguccacagucguggagaaacggacucuaaacacaggcgaaguaucacuuggucgcccaggcuggagugcagugacacgaucuccacucacugcaagcuccgccuccuggguucaugccauucuccugccucauacucccuaguagcugggacuacaggcgcccgccaccacgcccagccacuuuuuuuuguauuuuuaacagagacgggguuucaccguguuagccaggauggucucgaucuccugaccucgugauccgcccaccucggccucccaaagugcugggauuacagacgugagccaccgcgcccggccuaaaaaaaggucucuuaaauacuagggaaccuggccucuucacgguggaaguaaccacuagauucaagaugggcuuuuuuuguuuugucuuguuuuguuuuguuuuuuuguuuugagacggagucucgcucugucgcccaggcuggagugcaguggcgcgaucucggcucacuacaagaugggcuuuuuugucacgcuguaguacuuuauaaucuuucuucuggaaagaugaacaggauaagaaacgugugaaucauuuguguuggggaguucaaagaaacucuuaauguuaaagcaccuugccucaucauuuaguaguuggguaagacugcuauuaccuuucaucucuaucaaacauuguacuuuuaaaaacauaaauagcucugugaccaucagcucaugagucagcagccaugauaaucuacaacuggcuaagguuaauuuaguagcagaaacuaggcaaaacaucaggcagcaguucccaagguccaagaaacucaccaaaugaauucccuuuggcucauggaauauggugagguguuuuggggaacaguggcauggagguagccucauuaaccaguuagucucaggaacuacuauuuuauuaggcuuuucuuuugucuuaaaaggaauaaguacacauggcuaauuuuuuuuucaguacagaaaaaugaacaaaauaaaaauuacaggcaccuuuuucaauauuugucuucaucccacucccccaaauuagucacucuuuaauaguuugguauguauacuucuagucauuugaaaaauauaaauaaggccgggggcaguggcucuugccuguaaucccagcacuuugggagacccaggcaggcagaucaccugagaacaggaguucgagaccagccugaccaacauggagaaaccccaucucuacuaaaaaaaauacaaaauuagcuaggcgugguggcguaugccuguaaucccaacuacucgagaggcugaggcaggagaaucgcuugaacccgggagguggagguugcggugagccgagauugcgccauugcacuccagcccgggcaacaagagcgaaacuccgucucaaaaaaaaauagaaagaaaaauauaauuaaauacauauaauuuauguauauugguaugucuguguccuuuuuuuuauaaauaauuaggucauguuaaccaacuguuaccuguuuuuuucuccagcuuuauuaagguauaauauuaagguauuaaaguauaauauauacuuuuugacaaaaaaaguauauauuuauaguuuacaaugugauguuuugauacagguauacauugugaaaugauuaaaucuagcaaauuaauauauucaucaccucacauuuuuuguguguguugagaauauuuaauaucuacuuucuuaguaauuuccaaguauauaauauauuaugaacuauaguuaccauacaacacaauagauauccagaauuuauucauccuaacugaaacuuuguacacuuugacuaguaucaccuccaauuccuccuugcuuuuuuuguuuacuuaauaauguguucuaagucucucucccuguuacuauauauauauauuuuuuucacuguuauauuauuuucuauuuguucuuuuucuuuuuuuuaagacgacguuuugcucuuguugcccaggcuggagugcaauggcacgaucucugcucacugcaaccucugccuccuagguucaagcgauucuccugccucagccucccaaguaggcaggauuacaagcgugugccaccacgcccagcuaauuuuguauuuuuaguagagaugggguuucuccauguuggugaggcuggucucgaacuccugaccucgggugauccgcccgccucggccucccaaagugcugggauuacaggcgugagccaccgcacccagcccuucuauuuguucuuaagucgcguauuaauccauuuuaucauaauuuucaguuaacguucuuguacauauccuuuccuuccuaggguaaauuccuaaacauggaauugcugaggaaaaagagaggcuuauuauuugacacuuuaauagauauuuccaaaucaaccuguaaaaauaucauaccaguuuacauucugagugguguaugagccagaaauaaugacuuuaaauacauuuuuuauaguauaucacacuaguuuugggguuauuaaaguaggaauaauacuuuuaauaaucuccuagagugcuuugcaacccacauauugcauacugccuucugugaaagcuggcuauauauuuguuuucucucuccugcuagaguuccuugagggcagggauuuucaucuuuuacauuuuuguguucuuuaagggacccugaauaaagucaguacucaauaaauacuuuguugaaugucauuugcuaaauauauuuuacccauggcuaggacauagauuguagccaaaacuguccaagaauucaucaucagugauucauaauuaugcaaccaagaaguaggacuaaauuuuagauguuccucggucauuuagugucaaagcuggcuuuccucagacacagugaaaagggugguugguuauuuaacuguaaugaauucuugacuuuuuuuacugccaaugugagagguacuuuucauggggaauaaaauacugauauacaauuuaaagggaccaucuuggccagaauggauuauuuaguuacagauuuuuuuucuuucccaaugagcaacaaaaaaauagaaaauaucuuggauccaugugaauuugcauagcugccuucugaaaaaauuuccuaauguugugacuuuauauauucuuaucuacaggauuccuucuacuucauucuuacucuaaguggguagaacagguuucaguuuucuagaucaugaaagaaguacugaaauguugagaucccauagcuacuuagggguagaaaugcaauuuagaaacaagaucaccugacuccuauugaguuugucuuuccuuaauauuacagagugaucccauucuggcuuaaaguauaacccucuuggcaauucauuacuuuaaauuucauauuaugacuuuuuuuaaaacuccuuuuuuuuuuuuuuaaggaccugacaaugucccuguauuguggaauagcuugcaggagaaaauuuuuuuggugcuauaggcugcugucaaccuauguuacuaagacacggugaguuuuagccaaccugagcuuugauuauucuguuuggcccauuaaacuauugugauauuaugauuuuauauauauauuuagguuuaugauuauuauauauacauuauauauuacuauauuuguguguguguauauguguguguguguauauauauauauucauauauauauauauucauccaugguuucuggcucauaacuccuauggcccuuauuacagucuuuuguuauaauguggggcacuuuagaccucaggggcaggccucaggaaacaaaaucucuuuuaccuucuccuguccuccuuuuaccugcccauggcaggacucuaaucugauugcggguccaaagacccucauuccagagaggguugugccccauacuccggaggaaggaaggcugcacagagaggccaaggagaaccugaacagacaggcauugcuggguuuccggucagucuauuauuaugaaaucauaaccauuuuguccaaucagauuucuacaugguugucaaucaugccuauguaaugaagccaccauaaaaacccaaaaggacaggguucagagagccucuggauagcugaacacauggaaguuccuggaggguggugcacccagggagucauggaagcucugcacccuccccccacauaccugaccuaaaugcaucucuucauuuguauccuucguaauauccuauauaauaaaccaguaaacaucaaaaaauauauauuuuuacuuuuuuagagauggagucucacucugucacucaggcugaagugcagugguacaaucuuggcucacugaagccuugaucuccuggggucaagcgauccucccaccucaaacccccaaguagcugggacuacaggcauaugccaccaugccuggcuaauuuuuauauuuuuguguagagacaggguuuugccauguuguccaugcuggucugaacugagcucuggcaauccaccugccuugaccucccaaaguguugggauuacaggcguaagucaccaaaccuggccgaaaaauuuuaaacaaacuaaauauccaauaauaucuaaaauaucucacacacuugaauauaaguucuauuaagaucagacuuugucuuuccacugugguaccccuacuucauaaaacagugccuggcacaugguaggcacuaaaguacuguugaaugaaugaacaguaagggagaaauuaaguaaauuaagguacuauaauagaauaauaaacauguuaaaauuauauuguucuauuccugucacuucagaugaaaaaaacuguauugaauaauauuucaugaaguuuccuauaaauaaaguagauaaccccacccccuucccccaagaacuaaacuucagugaaagguagaguaggaaaacaaaaucuacaauagcacaugaagaugauaaagacuuuuuugucuuagccuagggaaauuagaaaucugugaauuugaaaucacuagccugcuuucauacaguuuuggggguuaaauuuauaccaucuauguggugugguucuagaacccuuaaccuaagaaauaauuuuuuuuucuuuuuuuucuuuuugagacaggaucuugcucugucacacaggcuggagugcagugcuaugaucauagcucacugcagccucaaccucccaggcugaaucaauucucccaccaaguagcuaggaucacaugcguagcuacuuguacaccaccaugccuggcuaauuuuuuuuuauuguuuguaagguagggucuugcuauguugcccaggcuggucucaaacuccugggcucaagcaauccuccugccuuuaccucccaaagugcugggauuauaggcaugagccaccaugcccagccuaagaaaugaauuuaaguaguaaucuuggacugaaaauaccccuggggcaccaugugaauacaaauauaaaacuccuuaggaaguacacacucacaaccagugauuccaauauauaaagcccuaucaagcuccaaaauuuagaggcauauaaaggcugggugcaguggcucaugccuguaaucccagcacuuugggaagccaaggcgggcagaucacucgaggucaggaguucgagaccagcuuggccggcauggugaagccgucucuacuaaaaauacaaaaauuagccaggaaugguggcgugcaccuguagucacagcuacucaggaggcugaggugggagagucgcuugaaccugggagguggaaguugcaauaagccgagaucgugucauugcacucuagccugcaugauagagugagacccugucucaaagaaaaaaaauuagaagcacauaagcauauaauccuacaugaacaagagugaacaaacaacaaaauugugauacuuguuucagauauuguuggacauuuagauugcguguacuccuuuaacagacuacaagaauuuuuuuuuuuuuuuuuuuuuuuuuuuugagauggagucuugcucuguugccaggcuggacugcaguggugugaucucagcucacugcaaccuccaccucauggguucaagugauucuccugccucagccuccugaguagcugggacuaaggcacacgccaccacgcccagcuaauuuuuguauuuuuaguugauaugggguuucaccauguuggccaggauggucuggaucucuugaccuugugauccacccaccucgaccucccaaagugcugggauuacaggaguacgccaccacgccuggccaagaauauuaacauaauuauuaaauagagucuaaaauuuaaguauguuaaagugauuaaauaaaucuauuuaagaaugaauaaaaauaaugaggucaggcacgguagcucacaccuguaaucccagcacuuugggaggcugagacggguggaucaccugaggucaggaguucgagaccagccuggccaacauggcaaaaccccaucucuauuaaaaauacaaaaauuagccaggugugguggcgggcaccuguaaucccagcuacuugggaggcugaggcaagagaaucacuuggacccgggaggcagagguuacagugagccaagaucgugccacugcacuccagccuggaaaacaagagugaaacucagucucaaaaaaaaaaaaaaaaagaauaaaagucuaucaauaaagaauaugaugugaaaauguuuacauauguuuaagaaaaaaggcuacaaauuaguagguuugauggauucuaaauauacuuauauauguauugauguauaauaguaaucgcuuagagaauuccaaaguguaaacagugauuaucccugaguggugggauuuugaugauuuucuuuucaaaaaauugacaauuguauauucugauuauuaaagauugacuauuuuuuacuguuaaaauaaggaaaaaguuuguuuuaaaauaaucuaaauauuuucaacuuugauaaucauagcaauuucuaugcuauuauaacugaaaagggaaaauacauuuuuaaaaauaagaguucccaauccagaggaguguaaggaacuuuuggaucucaauuccaguuccagugaggcccugggucuaagaccuuaaccuggguguuuuuguagguguuuugcuuuuuagggucauuagggcaaguacagguuguaccacucuuucuguucuuuuacgaaggcagcaguguuuguucuauuguuuauauuugguaacuucugagugacacgucucuccuuugacaugcauugagucuuugccccaggaggcuacagugacucauaaguuuaaaaauaucacaauucuuaaaagaucagguuucuuuugucuucuauuuauaaagagcucaucguaaccccuuuuaucacagucaagaguagguucugaaagauagcacuggggugcauuugucuuuuugcuuuuuauuuucauguugagcaaacucugccuacugguauuacaugaguucucagaucccacaggaaauaucugcaaacuauuuuucccacuugacaaaagaagccaguuuuuaccugagcgucuguuuuagggcuuuugacaggcaaaaauggcuaaucccaaggccccaggggagucugcauucugucccugcugaucacaaggauuugaagggagagacucagcccacccuuaaugaagguacuggaaaagccugguacuuaccccauuacuauugccuguuuuugagaaaccaagaauaggaggauguucccuuuuuccacauuuucauuuuggcuacugaaaauacuauggcugggugugguggcacacaccuguaaucccagcacuuugggaggccgagggcagaucacuugaggucaggaguucgaaaccagccuggccaacaugaugaaaccccgucucuacuaaaauacagaaauuagcugggcaugguggggcaugccuguaaucccagguacucgggaggcugaggcacgagaauugccugaaccugggaggcagaagcugcagucagcugagaucgugccacugcacuccagccugggugacagagugagacucugucucaaaacaaaaaaagaaggaaaaugaaaauacuauccuuauuaaauagguuaaguauagguuucaucaaugcucccuuuguuuucuuuuuuuuugagauggagucucgcucugucauccaggcuggagugcaguggcgugaucucugcuuacugcaaccuucgccucccagguucaagcgauucuucggccucagccuccugaguagcugggacuacaggugcgugccaccaugcccagcuaauuuuuguauuuuuaguagagacaggguuucaccauauuggccaggcuggucucgaacuccugaccucgugauccaccugccucagccucccaaagugcugggauuacaggcgugagcuaccacgcccggccaggugcucccuuugcuagagauaaggaguuaaugguaucuacuuugggaucuagaugucugaaguaaggguacauugaagguaaaauuuguucuuuaucuucccuagauugaaugagggucacugaagauacaguguuuacucuuugucugcugugaaaaagucuguucccaucucuagguauuuugugguugauguuuuaucacuguacuuguuuuccuuucacuccacugcauguaaauucuugccucacaguguaauauuggcagaguaacuugaaguucaauucaguaaauauuuauuacccuugaaguucaauucaauaaauauuuauugaaucgagccauucaauaugcuaacuacagagauacagagcugaguaaagcauaccuuccccuuaaggagaucauagucucucagaggagacagacaaaugaacaaauaaaccaauagugcaaccacagaaguaugggugagguacacaguaagacaaaggagggaaugaaugauuaucuauagccaccucaaacccuuuuuggagcaaauuagguuguaaauaaauaaagggaaauaaccaugguaagagagggaugcagcgacagcauucucaaagaugaaugcuauacagguaacuaagggugguuuuguaaugguuugauuauuucccaaauacagguauuuauuugaacugaaggaagaugaugaugcauguaaaaaagcccagcaaacaggagcguuuuaccucuuucauagucuggcuccucugcuucagacuucagcacaucaauaccuggccccccggcacagccuguuagguaaguccagaguggaccaguggcguugaccagccuguggccacuacgcagaauucagcccauaaugaauucuaagaaagauccuugaacuuuggagucuagauuuuucagaaagcuuuugagucucaugcuuguauaacugcuucugccaacuaauaauuuauuguaugaacucuaguuguccagucaaauauuauuuggugaugaaaugaaccacuaaugccuuaaaccagggguugguaaaacugcuguccaaauuguaucugcuaccuguuuuguaaauuaauuuuuauuggaacauagacguacucauucauugacauauugucuauggcuacuuuugcacuacaaugcagaguugugacagagacuguaugacucacaaagccuaaaauauuuaguaucucuuuccagaaaaaguuugccauucuuugccuuagagcagugaauuccagccuccacagagguacacaguuaugcuaauucagaguuccaucauggccaggcgcgguggcucacgccuguaaucccagcacuuugggaggccgaggagggcagaucacgaggucaagagaucaagaccaaccuggcuaacacggugaaacccgucucuacuaaaaauacaaaaaaauuagccgggcgugguggcgggugccuguagucccagcuacucgggaggcugagguaggagaauggcgucaacccgggaggcggagcuugcagugagccgagaucacggcacugcaccccagugugggugacagagcgagacuccaucucaaaaaaaaaaaaaaaaguuccaucauaacuucauuuuuacuagaagggucaagauuaaaagugaauuaaaaugaauuugcuuuuagaacccuuuuagcauauuuaacuaaagauaucuaagccauugggguuugucauucaaaaugcaaacuuuggcuggguuggguggcucaugccuguaaucccagcacuuugggaggcugagguggguggauugcuugagcccaggaguucaaaaccagccugggcaacauagugagaccccgucucuacccaagaacaaaaaauuagucgagccuuguggugucucaaagacagaaaacaaaaugugaacuuucaguuuuauaugagucacuauauacuaacuuccguauugccagugaauuucucccauaggucagaaguuggaguacuuggauaaguaguuucuagcacugcagaagaaucugaggacuccaucagaaggcacuaaacauuauuuagagauuuagcaauguuuauguuguauuacgguuuuuguguguguuauguuguauuaugaacaaauaaauaugaguccuucaugaacaaguguauaggauuucucccuacacaucacucaucucuuagagauuggcaucucagaugaguauuuuacucucguccacaaaaguagcacauucuggagguuaauuauagaacuggauuggucuuuaccugcagccuugaacuccuuggcucaagagauccucccaucucugccucccaaguuuuugggacuacaggugugcacuucacugcacccagcugauuuuauuuuuuguagagacagggucuuugcuguguugcccaggcuggucccaaacuccuggccucaagugauccucccugccccccagccuuggucuguaccauuuuaagugugauacuuauuuuuuuuucaaugacuuaauaaguuaacuaucaugcaucuuacuaacuaggggauauuuuccuuucaugauacagucauagaguaauacaauguuauacaagaauuccuucuuuggucuaaaguccucagacugcuaaugagaaaacaggccuggagagguuaaaugguuagaccaagguuacauagcuaauuagcugcaguuggaagccaaguauacccacuuuaagcugaaguagaugauuuucugugagucuaauauggcuguagugauuuaauagaaacccuuguguuuugcuuuucucccuuccccuuucuguuucuuagaguuggaaaggcuccuggguaaauuuggacaggaugcacaaagaauagaagauucugugcugauuggaugcucugagcagcaggaagcaugguuugcucuggaucuaggucuggauagcuccuuuuccauaagugguacaugacauuauuccuaacggguacuucccaguggucuucagaauuugggauuucacauaaugguaaaauuuaaaggaaaauuuggggaauacaaaagguuaucaacuuucuauuuuuuaaaaaaggacauuaaaaagugucaucugcuaucaucaucauuuaaaugacaauaaaggacauuuuaaugccuucuaaguuaggugauggguacaugaauauuuaugguauuagucucuguaccauuauacauuuuauuuauuuauuuuaucuuauuuuauugagacaaugucuugcugucacccaggcuggagugcagugguacaaucacagcucacugcagccuugaccuccugggcucaagugacccucccaccucagccuccugaguagcugggaccaugggcauguacuaccaugcccagcuaauuuuuaauuuuuuuuuuuuuuuaauagagaugggggucuccuuauguugcccaggcuggucucaaacuccugggcacaagcaauccucccuccuuggccucccaaagugcuaagauuauagguaugagccaccacaccuggccuauacauuuuguauauuucuuuuuuuuuuuuuuuuugaggcagaguuucacucuuguugcccaggcuggagugcaauggcgcgaucucggcucgccacaaccuucgccucccagguucaagcgauucuccugccucagccucccuauuagcugggauuacaggcacgugccaccaugcccggcuaguuuuguauuuuuaguagagacgggguuucuccauguuggucaggcuggucucgaacuccugaccucaggugauccgccugccucagccucccaaagugcugggauuacaggcaugagccaccaagcccggucacauuuuguauauuucaguauuucauaagaaauguuaaaaaacuuauaacaucauucuaauuucuuuuuugaauacaggugaauaaaaauguuuccauauagcucuggguccacagaccugccauugggaaccacuuugcuauuggcucauggcuccugucaggcuuuccuucugucuuuaauggucuagguguaaauguagugaugcugggaugagguucacauaggagccaugaggucccacuucaucucuuuuccacggauaagcuaaugcaaauguucuugccccgaagaagaucuugagaaauacuaugugcuaauguuucccaaacuggccugaauguaagaaucaccuggugcuuguuaaaacaaaaauagagauugcugggccucacuccaugccagcugcuuuagaaucuccagguaggggcuugagaaucuugcuuuuuaaaaaaauuuuauguauauauuuauuuauuuugagauggaguuuugcugucacccaggcuggagugcaauggugcgaucgguucacugcaaccucugccuccuggguucaggcgauucuccugccucagccuccugaguagcugggauuacaggcgcccaccaccaagcccagcuaauuuuuguguuuuuaauacagacaggguuucaccauguuggccaggcuggucucgaacuccugaccucaagugauucacccgccucggccucccaaagugccguaccuggccuuuuuuaaauuuuagagauggggucucacuggagugcaguggcuauucacagguaagaucauagcgcacuguauguagccuggaacuccuaauggccucaagccauccuccugccucagucuccugaguagcugggacuacaggcacacgccccccacaccuagcugaaucuuacgaggcaaguuugggaaacacuauuuuaacaggauagacuggagagaggcccugaggcaaaguuugucauuguuuaauuucauuaucuuuucuaauuuucuagccuccuuacacaaaccugaaauggagacagagcucaaggggucuuucauugagcugagaaaggcacucuuucaacucaaugcaagggaugccuccuugcuguccacgguagauucugauuucucauucuguaggaaauuuaguagagcaguaagugugggcaaauccauguguacacacaaggcuagagugacguuugauuucuucuuuugcagauuauaguccuuucuacaaacacuggcaggacaaugugcuguagggagauugcuuauucuuccuucuucugcccuuguuuuuggcagaaccacugucaagaucauugucuccuaaagacaugcagaucuauggcaauaggaucugucagccucauaaacauuuuuaaugacccacauagcaugacauauacaguaucauguuuucccuaagagaaauuacuuuacauugcuuuaaugacuugcccucacagcuuuagauuucacuugcuaaaguauuuugauugugcauuuaauuuaaaaagaaaccucuaaacauuuuuuuaguugcaaaaaauuccaacuuuaccagggagaagaacauuuugggguguucaacuguacugggaauguuuuauuuuuaagcugguuagugaauacauggguguucauuuuauuaccucauauacuucauauguuuuaaauaauaauacauuuaaaaauaugcuuucuuuuauucagauuucugaugcuagaggaauauguucaguuaguuuacuuguccugaaauuuaaacaguaaccauuuaaauuacgugagcuguaaagagauuggcauuuuucugugaguuguuccagacacuaggcccagugcuguuaaagaugagccccgcauucucuccaaaugacaccaggcccaucauuguguuccuaggcucaagcucuucuccgcuggcaugaugcucaucaguucugcagcagaagugggcagcccaccaagaagaacguggcuggcagcaagcgugugugcccuuccaauaauauaaucuauuauccacagguaauuauugcuguaagaggacaguaauccaagaagacugugcgcugcuuuguccuggggaaggaagccugugcaauuccuuaauuauacacugcuuuagcucauuggcagggcccaaagugccagcaucucaguuuccauuccccuuuccuagauggcuccuguggcgaucacgcuggugucagaugggacccgaugccugcuugcccgccaaagcuccuuucccaagggaauguauucugccuuggcagguuuuugugauauaggugaggaguuuaggggauauacaggugacacuggaagauauacaaucuuacuaauacaaucuucucugucuuguugcuauagagcuugaauucccaagcacauucuuuucuaucaugucaagaaaacugcuuucuggcauuuuauauauauauauauauauauauauaaaauuuuuuccuuuccuuuuuuuugagaugggagucucacccuguugcucaggcuggagugcaguggugcaaucauggcucauuacagccucaaccuucuggguucaagcaauccucccaccucagccuccugaauagcuaggacuacaggcacaggcuaccaugcccggcuaauuuuuaaaauuuuuuguagagacagggucucgccguguugccuaggccaguccugaacuccuggcuucaagugaccuaccugccuugaccucccaaaguguugggauuacaggugugagccacacuauuuuuuuaagcaaauuuucaaacauaggagauuguugaaagaauuauacagugaacacccauacacccacuacccagauucuauaauuuuuuuuccucuucacauguaggcauuuguuuguagggaggccacaagcuuugugccucucaucacauugaccccagauuccuguuggguguguuauaaacagaggagccauucuuuaggcccccugcucugagcacaccccuagauuccaugaauuuuuacuacacuuacuuuaucacaaagcuguccaucuauccauuaaucuaucuuauuuuuugaugcauagauugaagauauuaguacacuucuuccuauuucagcaugcguaacauuugcuagaauucaguauuuauuuacagguugguuuuuuucucuagucuauuggggucaaauuugcaaauggugaaaaguggaauuuuaugaaagcugagugcaguagucccuccuacugucacacuuacuuuagaccuagcagacuuaagcacugugguucaacacacagcucuggaccugauucuuauuguuggaaugacucagaguuuuaggacacucccaagagcauuucauugaaacuuuggagccaguguugugcaccuuucucaaaugggcugucuguaucacccuucuagccuacagggcuguccugaauuaaucugagugcuuguaggugaaaguguggaagagaccauccgccgagaaguugcagaagaggugggauuggagguggaaagccugcaguacuaugcaucccagcauuggcccuucccuaguggcucacucaugauugcuugccaugcaacugugaaaccagggcagacagaaguaaguucucaucuucccuuauacugugauauuucuuuugcuucauccaaccugcucaucagcaaguacuuauuaagcacuugucuaguccagcaucaucuagauuacauaaacauguguaaaauaugauuuagggcugagcacgguggcucaugccuguaaucccaacacuuugggaggcugaugugggcggaucacuugaggucaggaguucaagaccagccuggccaacauggcaaaacuccaucucuacuaaaaauacaaaaauuaaggccgggugcgauggcucaugccuguaaucccagcacuuugggaggcugaggugggcggaucacgaggucaggaguucaagaccagccuggccaagauagugaaaccucauuucaacuaaaaauacaaaaauuggcucggcaugguggcaggugccuguagucccagcuauuugggaggcugaggcaggagaaucgcuugaaccugggagguggagguugcagugagcugaggucgcgcuacugcacuccagccugggcaacagggugagaaugcaucuugaaaguaaauuaauuaauuaauuuaauuaaauaugauuuaugcccucaaggaauuugcaaccuaguaaaggaagcaaauaaucuccauucucccuugcauauaugucaaucacgagacaauuuauuuuauuuuauuuuuuuugagacggagucuuacucugucgcccagccuggagugcaguggcgcgaucucggcucacugcaaccuccgccuccuggguucaagugauucuccugcuucagcagagaaguauauacccuugaaauuaucaaaccgucaucacuaucaaugccauaaacuuauucaucacuuacaaaaguuuccucccaccccuuuuauuuuucucccaccccacuuuuuuuuuuuuuuaauuuugugguaagagcacuugaugugagaucuauucucuuagcaaauuuuuauguguauaauauaguauuauuaauuguagaccuuaugguguacagaucuucaaaacuuauuuugcaugacugaaaccugguacccuuugaccaguggccacccucccuucagccccuggcaugcaacuuuuuccauuuuccccucccuucagccccuggcaaccaccauucuacucucugcuucuguaaguuugacuauuuuagauuccacauauaagugagaucaugcaauauuugucuuucugugucuggcuuauuucacuuagcauguccuuugggccuaucuaucuuguugcaacugcaggauuuccuuccuuuuuaaggcugaauaauauucuauuauaguauauaccacauuuucuuuauccauucauccauugugaauacugcagugaacaugggagugcagauaucucuucaagaucuagauuucaauccagaagugggaugcuagaucaaaggguaauucuauuuuuaauuuuuugaggaaccuccauauuuuuuuccauaguaggugcaccaacuuacauuccccacaacaguguacauggguucccuuuucucuacauccuuaccaauacuugcuguccguuguacuuuuuuaaugguagccauuaaagaagguaugaguuaauaguagccaucaaagaagguaugagguuuucauuugcauuucccugaugauuagugauguugagcaccuuuucacauaccuguuggccauuugaauaccuucuuuggagaaaugucuauucagauucuuugcccauuuuuaaauuggcuuauuuauuuuuugguauuaaguuguagaaguuccuuauauauuuuggauauuaacuccuuauaagauagagggucugcaaauauuuucucccauucugcagguugucucuucacucuguugauugauucccugacucugcagaagcuuuaguuugauagaaucccuacuugucuaucuuugcuuuucuugccugugcuuugguaucauaucuaagagaccacugcccagucuaaugucuagaaauuuauuccuuuauguuuucuccuaagaauuuuauuguuucagguuuuauauuuaagucuuuaauccauuuuaaguugguuuuugcauaugauguaagauaacgguccgauuucauucuuuugcauguggauauccaauuuucccaacacuguuuauauaagacaauuuaccuuuuauugucaggaguuaagagugucuuacauauaguaggcgcacaaucaggcaucauuuaaugacugacugcaggauuggucuuauugcucaagucagucaggaugcugggaacuaaaaauauaaaacuauagguacuuguaguugaaagaaacuuaagacguugucuuuuuuuuuuuuuuuuuuuuuugagauggagucucauucuugucgcccaggcuggagugcaguggcacaaucucagcucacugcaaccuucgccucccagguucaagcaauucuccugccucagccucccgaguggcugggauuacaggugccugccagcaugcccggcuaauuuuuguauuuuuauuagagauggggguuccaccauguuggccaggcuggucucgaacuccugaccucaggugauccucccaccuuggccucccaaaguguugggauuaugggcaugagccaccaugcccggcuagacauuguuuuauccaaucucaucuugcacuucucuagcaucacugacugauggucucugccugccaaaguuugccuauuguauguuuugguuuuuauagaauaucuaaucuauuucagcuuccuugggaugaaguuugcauuacuuugcuucuugcaaagaugagacuaugcuuuugacuaucauuaacccuuacccuuuaaaaaaaaaaaaaaaagaguggcugggcacaguggcucacgccuguaaucucaacacuuugggaggccgaggcagguggaucaccugaggucaggaguucaaaaacauccuguccaacauggugaaaccccgucucuacuaaaaauacaaagaaauuagccaggugugguggcgggugccuguaaucccagcuacucgggaggcugaggcaggagaaucauuugaaccugggaggggagguugcagugagccaagaucacaccauugcccucuagccuggguaaaaagagcaaaacuccaucucaaaaaaaaaaaaaguaauauuuguauguucuuuuuuaauugaaaaauuuauacaaucaauagagacacaaggaaaaauagguauuauucauaauuuauucucaauguuaaccacucuuaacauuuuaguauuuguacuuccaggauuuauuuaauguaucuuaucuuuuuuuuuuuacuauguuagaaauauauuuaacucggccgggcacaguggcucacaccuguaaucccagcacuuuggggggccaaggcggguggaucacaagaucaggagaucgagaccauccuggcugacacggugaaacccugucucuacuaaaaaauacaaaaaauuagccgggcaugguggcgggcgccuguagucccagcuacucaggaggcugaggcaggagaauggcgugaaccugggagguggagcuugcauugagccaagauagcgccacugcacuccagccugggcaacagagagagacuccgucuaaaaaaaaaaaaauauauauauauauacacacacacacacacacauauaaaacucucauuucuuaauuaugccucuuuugcuucugggcaguaucuagaacugacuuucaccuaaccugaagaucccagguauuaucuucuaagauugcuuaguucuagaaucauuuucugaccuuuggccauaguauucuaaauuuuguagcuccugaccuuacauccuuuucuuccuuaugucuuucagauccaggugaacuugagagaauuagagacagcugccugguucagucaugaugagguagccacagcccugaagagaaagggccccuauacucagcaacagaaugggacuuucccauucuggcugcccccuaaguuagccaucucccaccaacugauuaaggaguggguggaaaaacagaccuguucuucccugccugcuuagcccggaucaagucacuuagaucgcuccuugguauuccugagggacaaacuagagaucaguugacaaaggagaagugacaaaagauaagcugcagaaggaccucagaagggcagagcaaagggugagccuacaguaagacacuucuaucagcaguguuaauggaagaaauuccuaccaaugggcaaucaaaaaagccagugugagaagaaaacugaugagcugucaacugucaaaaaucagggggaagggggaagcauuaguuuggauguaggcccuuguucagucauuuucucuaaggccuuggaagcaaacaucuucuggcauauggcuuguuaauguuguguuuacacuaacugccaaaaugugccuguuguaaguuugguuaaaacuuuuaucuuaguauugaaaauauauagcaaguuuuaagucauuacugaguuacuuguuacccuuacagaauuaagaaaaauagcacaguaugacauuuuaaaauucauguacaggugcauucuaguuacaugaacaugcuaguuaaauaaaagucacaauuaagucauuaugacucagaguacuuuauaauaaaucagaugcccugaggcucuguugaggaaguagaaucccaaugggacuccagacaguaaaucuuuuucgcuguuuucagcucugucacaugcucaguuugugacccagggaaaagacuauugcuuugccaugccuguuuuccuaaauaaaacaguugcuggcauuugcacauccacaacguguugauuaacaaagggauugguggagauaaacagaugccaaaccugaccuauuucuuaaacuuuauggaauaaacuaaauuuaggauuucucaucauucauauaugaugccauaagggagaagaguuuauuuggggaaaauaaaagaaauuuccaca

SEQ ID NO: 192469 - RNA, 74063 nt, Homo sapiens
acuuccgcccccgcggcaaagcagggaggucggaggacuggagagguggggacccuggggagguggcugcucggagucuaggugacggggcgagacggggccgguagguggcgggaggggccgggccggagccggcgggagggccaggcccggaggcccccacccuggcgugccugccccggccgcggcugaggaggaggaggaggaggaggaggaggaggaugaucuccagauacacucggaaggcggugccacagagcuuggagcugugaguggacugcucagccaccccagccggggcgggcggcgggcgcucuggggacccuccuugaccaguccuucguuccuuuccuuucccagggcuggggagagauuuuucuucggaauucucuccucucagcccugcuggacccugccccuucuuccuccaucuccagcugagggcgugucgcccuucgucugaaauuccugaaaucaagcacugggucugcugaagcauuuguagcauccgcagugcuucaggucccauuguuaauggccaugguagcucgagaaguuauuaauagcuaacugagggcuccaggaaagugcucacuugacacugugcaaagcuauuuacauacauuugcucauuccuaucaaugauaucagauugggaacauuauuuugcacauucuacagauaaagaucccagaauuaaagauuguagcaugccaaagaucacacagcuugaaggugguagagcugagagguacaaaccugaugucgaucugauuccgaagccuguggucauaaccaucacacauacugccuccccaccucugcaauuaagcaccagaauccauaaagaucaguuuugcuuuugagacuuuaaagagcaaauauuucuggcuuuaaaaagauccacccucacggccggccgugguggcucacgcuuguaaucccagcacuuugggaggcugaggcgggcggaucacuugaggccaggaguucgagaccagccuggccaacauggcgaaaccccaucucuacuaaaaaugcaaaaaaaaaaaaaaaaauggccgggcauggaggcgggggccuguaaacccagcuacuugggaggaugaggcaggagaaucacuugaacccgggaggcagagguugcagugagcagaggucacgccaucgcacuccagucugggugacaagagugaaacuccgucucaaaauaaauaaauaaauaauaaaaaaauaaaaagagcugcccccuacccugaccgaagugguguauaauaauuuagaaaguaauaauagugucauacauuuauuaaugcuuuacacuuccaaaagggccuucacuuuuuuuuuuuuuuuggagacagggucuugcucaguuguccaggcuggagggcaguagugcaauccuugcucacugcagccuccaccuaugggcucaggugauccucacaauguagccucuugaguagcugagacuacaggugcacaccaccacaacuggcuaauuaaaaaaaaauuuuuuuuugguagagacagggucccacuauguugcccaggcuggucucaaacuccuggacucaagcgguucucccacuuuggccucccaaaguguuggcgugagccaccaugcccagcucacuucacuuuuugaucuuaacaacucuguaaaguggguaugauuaucuucagucuuucagaagaugaaauuauaucagaaauguuacauauuuuaagauuauauagccaaaaagucaggaguugagcuugggcuuuaaccccaaauuccaauuuuuuuuccuucauggagcuauauaauuuuagcaaccauaaauuuauuaauuaaauauuaacuuuuccuuucauuuagcuauguaauuuuagcaaccauaaauauauuaacuauuaauauuaauuauuaacuauuuaauuuauuaaauauuaauuaugcacauacaugauaauugcaagcaugcuauuuugaaucauucuuggguuucuggcuaggcugucuucuagccacgugacuuuuaggcaaauuacuacaucacugagccuucguuucugcaauauaggaguaacaccuuauccaaaagcuuauuuaaaaugaugguguggacccccacaccuguaauccuagcacuuugggaggccaaggugggcgauugccugagcucaggaguucaaaaccagccugggcaacauggugaaacccugucucuacuaaaaaugcaaaaaauuagcugggcaugguggcacaugccuguaaucucagcuacuugggaggccgaggcaugagaauugcuugaaccugggaggcggagguugccgugagccgagaucacaccacuguacuccagccugggugacagaggaagacucugucucaaauaaauaaauaaauaaauaaaaauaagaauaaagugaugguguggagcuugacacauauacauccucaauaaaugguauuuuccuugucccuucgcacuuuuacuugggauacaauaggcauacaaagaaaauaagucuaaaaccucucuuugccuuuuagaagcuuauuauuuauuaaggaauaagauaucuacaugguagcaguuuaguuccuaguaaacucuuugggaacuaggaagaagaaacagucaucucuuagauuugggauguguuguuccuacuuaaaaaaaaaauugugaggaaacugucuuuucccaauaaagugacugagguuuagcuaaaaaucugcuuuuaugauuaauuccaaccauucugaaaguuaaaaaaaaucuuguauggaaaaaaaugauaggcacuuguugggccagaauuauuauuaacuaguauaguuguaucaguuuucuuucuauuuuuuuuuuuuuugagacggagucucuguugcacagguuggagugcaguggugccaucuuggcucaguugcaaccuccaccuccuagguucaagugauucuuccaccucagcuucccaagucacaggacuacaugcccagcuaauuuuuguauuuuuaguagagaugggguuucaccccaggcuggucuugaacuccuggacucugucugccucggucucccaaagugcugggauuauagaugugagccaccgcgccuggccuacuuguucuugauuguugauuugauacucccuauaaggcccaaaagaugauucuguagcuggagucaggaugaagugaauaaugaagauaaugaagauaaaauguaucuuaaugggagcaaauucaaagcaauuuuuacuuuagauguuauaauaaugauaaccugcuuugaagccguaacuuuaguuuucuaccuagccauuaaaaauuauaauuguugaaaagaguaugggaaaggaaugauuuucaacauacagcuuaacauuuuuuaaugaaaaauuucaaacauaaacauauagagaauaguaucaugcacuaccugucaccccacauucaacaguuaacaaaguuaauauauuugcuucaucuaucuuccuuauccuuuucuuucuuuuuuuuuuuuuuuugagacagagucucacucugucgcccaggcuggaguguaguagugccaucucggcucacugcaagcuccgccucccagguucacgccauucuucugccucagccucccgaguagcugggacuacaggugcccgccaccaugcccagcuaauuuuuuguauuuuuaguagagacgggguuucaccguguuaaccaggauggucucgaucuccugaccucgugaucugccugccucagccucccaaagugcugggauuacaggcgugagccaccgcaccuggccuccuuauccuuuuauuaacuucucugcaccucucugugaaauaacgaaagcaaaacugcagauacugccauuucaccccuauauaugucauuaugcaucucuaaaaauuauggacauuuuuguauguagucauagugccauuauuaaauuuaaugauauuuuuuguuaucuaauugucaauucauagauuucccuggcagacuaaaaaaugucuuaagucucuauuucauagcuugaauuuguauuucuuauccuuuccacuuuuucaaagacaagcucuugguuguaggaccacugaaugagagacauacagguaagucugcacaaauugaucuccacaauuugagaaauaauuuaaagugcaagcuccacugacugggcucuuagcuuuaucuuuauauagaacaaugguacaauucacuaaaaucucaaacucuucauuuccuucuagaggccuuccucugagagccagauuacuaggauuugaaucuuggcuucaucgcuuacuaaccaaaugaccuuaagcagguuacuuaaucccucugugccuuaguuuccuuugaaaugagaguauuugagauuuaugauaaacauuugcauauuaaagaccuggaagaucucuuguaaagaaaucuguguaacuuuguucaaccuauuacaguuccugaauguauuugacuacagaguuuugugaggaaagucuaccgcagauuacuaggaacauauauugauugaccccauagauuacuggaacauauaaugauugaccccauagcuuaauccagugcauacauuggagucucuagagcagcaauauucaauacaaauaugauauaagccacauauguaauuuaaaauuuucagguggucacauuaaaaaagaaaggugaaauuggccgagugcaguggcucaugucuugaaucccaguacuuugggaggcugagguaggaggaucauuugaggccaggaguuagagacagccugagcaacauaacaagaucccaaucucuacaaaaaaaaaaaaaauuaaagauuaaauaauuagccaagugugguggugaguaccuguagucucagauacacaggaggcugagacagaagaaucccuugagcccaggaggucaaggcugcagugagcuaugaccacaccacuguacuccagcuuggacaacacagcaagaccccaucucaaaaaauaaaauaaaagugaaauuuuuuuaccuuuuuauuuugaaauaauuauagacucacaggaaguuguaaaaauaguaccaagaaucccaugaacuuuucacucagcuucccccaaugaugacaucuuauguaacugugguauaauuuaaaagccaggaaaaugacguugguacaauacuguuaacuagaccuacagaccuuauccaguuuuuacauccacuccuguguguguguauguguguauauaguucuuucuaugcaauuuggucccauuuacagauuacugcaaauacgacuauaaaucaagauagcuguuucauccccaccaaggaacuucacuggguaucccuaucccuuuauaguuauauccacucuugucuccaucccuggcaaccauuaaucuguucucuaccacuauaguuuuguccaauguaccauuauauaaauggcccuuaaacaaugcagggguuagggguauugacccccuguacaguaaaacauccauguucaacuuuugacuccccagaacuuaaccacuaauagccuacuguugacuggaagccuuaccaauaacauagucaacacaaaaauagacugguaguuacauauauuuuacacauucaugacauaccuuuuucuuaaauuuuuucgauauuucuaggcuacaugguucaucuguugaguuucuucaaauuguugcaaaucuccaaaaaauuuuccaauauauuuauugaaaaaaaucugcauauaaaugggcucacacaguuuaaaccuguguuguucaaggucaacuguaguaguuaaugguuuuucuauuggcuuuggcuuuuugcacuaaaaagcauggugcuuuugagauccauccaaguuguugcauguaucaauaguuuauuucucuuuauugcugaauaauauuucauuauguggaaauaucaauguuaaaggacauuugaguuguuuucaguuauuuuuuucaacuguaaauaaagcugcugugaacauuuguauacagauuuuuguaugaauguaaguuuucauuucucuaggcauaaugcccaagagugcaacugcuagggcucuggguaaaugcauauguuuaguuuuauuagaaacugucaaacuauuccagaauggcuauaccauuugacauuccugccagcaauguaugagacauccgguuucuccacauccaugccugcauuuuguguuaucauuauuuuuaauuuuagcuguucuaauugguguguggugauaucuacuauauuuucaacuuguagugacauuaauuuuaagaauauauuuuaacaacccaauauauccaaaauauuaucauuuuaauauguaaucaagauaauaaaugaaguauugcaaauucuucuugaaauccaauguguuuuacacuuaaaacacaauucugacuagccagauuuuaaucacugguggcuaccauaucagacagugcaguuccagagcagaggaaguaggugacuaacuucuagauuaaauuauugaauuguauguauuuuuuuauacaggaaauauaacuuuguuuugucuuucacaggaaaggaauaacaaaacaugcucuuaaccaucaucccccuccagagaagcuggaggaaauuucccccaccagugacagucaugagaaagacacaaguucccaaagguaauaacacaaaguguacuuguuuacuuauugcacuugcucauggcagagguuuuguuuuuuggcuuaagauuggugucaagccuugugcuaaugaaaacaaagcaagaauuuuugucauguucucaguaccauuuaguuuucauucugaaacagcuaaugacaacaucauacauauuuucauaaccuuugagaaguaguauuauaaaguaguuaagaacacggauaaucugccaugggauuagaaugaaaaaacaaacaaacaaacacacaaacaaacaaaaaaacagaacauggagcuugguacuuacaaucccagcacuauaggaggccaaaaggugggaggaucauuuaagcccaggaguuuaagaccagcaugggcaacauggcaaaccccaucucuacaaaaaaauaaauaaauaaaauaacauagccaaguguggggaugugcacuuguggucccagcuacuacagaagcugacaugggaagauugcuugagcccagaaggucaaggcugcaguaagcuguguuuacaccacgauacuccagccugggugaaagagcaagacguuguuucaagaaaaaacauaaauagggccgggcgcgguggcucacgccuguaaucccaacacuuugggaggccgaggugcacggaucacgaggucaggagaucgaaaccauccuggcuaacacggugaaaccccgucucuacuaaaaauacaaaaaaauuagccaggcaugguggugggggcccguagucccagcuacucaggaggcugaggcaggagaauggcaugaacccgggaggcggagcuugcagugagccaagaucacaccacugcacuccagccugggcaacagagcgagacuccuucucaaaaaaaaaaaaaaaaagaaaagaaaaaacauaaauuaaauaaauaucagaaagagcaagauuauaaaaaacaaacaauaaaauaacauaacauaaauaaaaaagaacauggacucaggaggaguucaacaucugauuuuuaauccugguccuacaacuuauuagcugaguaacauugggaaaauuacuuaacugauaauaguguaucuuauagcagcaguccccaaccuuuuuggcaccagggaccaguuuuguggaagacaguuuuuccauggacugugcaguggggugagggaugguuucaggaugauucaagugcauuacauuuauuauacacuuuauuucuauuauuuuuacauuguaauauaugaugaaauaauuauacaacucaccauaauguagaaucagugggagccuugagcuuguuuuccugcaacuagaugguuccauccggggaugaugggagacagugacagaugaucaggcauuagauucccauaaggaaugcacaaccuagaucccuugcaugcgcaguuugugcuccugugagaaucugaugccaccacugaucugacagaaggcagagcucaggugguaaugcgagccauggggagcugcuguaaauacagaugaagcuucaugcacucaccugccacuuaccuccugcucugcagcccaguuccuaacaggccacagaccagcaccggucugugaccccgggguucgggaccccugucucauaggauguugcaaauauuaaugagauaauguauguaaaacuuggcacgaugcuuggcauguaguaaaugcugaguaaauauuagcuguaguuauuuuaaguaauagaacagggaagaugguucuucagucucucagaacuucuauuagugucugagaugcaaugugugauuaaaaaaaauauuguauaaucauaggccgggcgugauggcucacaucuguagucucagcacuuugggagcccaagacagguggaucacuugagcucaggaguucaagaccagccugggcaauauggcaaaacucugucucuaccaaaaauacaaaaaaaagaaaaggcugggcacgguggcucaugccuguagucccagcacuuugggaggccgauguaggcggaucacuugaggucaggaguucaagaccagccuggccaacauggcaaaaccccgucucuacuaaaaauacaaaaauuggcugggggugguggcgcacaccuguagucccagcuaccaaggaggcugaggcaggagaaucacuugaacccgagaggaggagguugcagugagccgagaucacgccacugcacucagucugggcaacagagcgagacuccaucucaaaaaaacaaaacaaaaguacaaacaaaauuagccagucaugguggcacacaccuguagucccagcuacuugggaagcuaaagugggagaaucacuugaacccaggaggcggagguugcagugagcugauuucgcaccacugcauuccagccugggugacagagcgagaccccaucucaaaaaauaaaaaauaaaaagugccauacaagaucagauacuacuauuagcauuucugaaaugucuuuaguugucaagaguauguuauaggcugggugcgguggcuuaugccuguaaauccuagcacuuugggaggcugaggugggcagauugccugagcucaggaguucaagaccagccugggcaacauggugaaaccccuucucuacuaaaaugcaaaaaugagcugggugugguggugcacaccuguagucccagcuacuugggagacuaaggcaagagaaucauuugaauccaggaggccgagguugcaaugagucaauaucgugccacugcacuguagccugggcgacagcaugagauucugucuccaaaaaaaaaagaguaugucauaggugagauguugaaguauucauuguaaacuaugacuagaauuauuuggaaugacugccaucaauucuguaggaauuaggacuuuuccauaaugcucaaauuucaaguucuucauuuauuuuugccuauguggauauauuuguacacauguuaaucaccuaguaaguugcugaguaguuaaugccacagaaacuugaggacauaugaaaaauuuucuuuuuucucuccuccucccaaauugugccuuuagcaagucugacaucacaagagaaucaucuuuuacaucagccgacacugggaauucacugucugcuuuuccaaguuauacaggcgcagggauaucuacugaaggaagcucggacuucuccuggggauauggugugaguuauauguuaucagucugauagagugcuugggagaugauucugggaauuaggauuugucaguauauuucauuccuucacucuccugcauuguuucuuuacauuuaucauacuucauaauaacuguaaagaaguaucaguccucaucuucuuucaguauuggcuuuguuuuauugauauaguaguugagccuuagacaugcuuaguguucaauuuaaacagcugcauguuggccgggcacgguggcucacgccugcaaucccagcacuuugggaggccgaggcgggcggaucaccugagguugggaguucuagaccagacugaccaacauggagaaacccugucucuacuaaaaauacaaaauuagccgggugugguggugcaugccuguaaucccagcuacuccagaggcugaggcaggagaauggcuugaacgcgggagguggagguugcugugagccgagaucacgccauugcgcucuagucugggcaacaagaacgaaacugucucaaaaaaaaaaaaacaacaacaaacaguugcagguuaauauggauuugggcucugggucuauuccuuuugccaugcccaguccaguaauguaugucuuuaccacuaauguuaccuuguuguuuaaaauguuuuugaaaguuuauuauuaagccauuauagccugggaaaauauuugugauauauugguaaugaaaacaaacagguuauaaaucauauguguagugucacucuaauuuuguuuuauauaaauucugccuauauuagugaaaaggaccaaaauauuuacucaaaauauuguucaguuguuauuaauuaggugaugagaugagugauuuuuacuucuuuacuuauuuuuggcuauuucccauuauaaaauauuauuuuuaaaagaccaacaacucuaaaaauuuuuuaaagacaauuuuuaugcauaauuuuaucaucuugaugcaagaugcaauagacauuuuuauuucuuguuuuuuguuuuuuuuggaacggagucucgcucuguugccaggcuggagugcaguggcacgaucuuggcucacugcaaccucugccucccggguucaagcuauucuccugccucacccuccugaguagcuaggacuauaagcgugcaccaccauggccagcuaauuuuuguauuuucaguagagacaggguuucaccauguuggccaggauggucucgaucucuugaccuuguaaucugcccgccucagccucucaaagugcugggauuacaggcaugagccaccaugcccggccaacauuuuuauuucuauaucuuuuuucaaucuguauuuaauuuggcuuaguuauaaucaugauguacacauaauauuaugcugcauuucuucaccuaauauuuuauaaacacuucuccacaauauugacuuuauauaauauuauuguuaggcucuuucuuucugucuuuucuuucuuucuucuuucucugucacgcaggcuggagugcuguggcaaucauagcucacugcagccucaaacuccugggcucaagccauccuccugccucagccuccugaguagcugggaccacaggugcaugccaccacacccugcuauuuuuuuuuuuuuuaagagguaggaucuggaacuccuggccucaagcaauucucccaccucagccucccaaugugcugagguuauaggcaugagccacugcacccagccagaaaccugcuuuuuuuuuaacaaaaagccugcuaauuguuaaaaccuauuuucuaaucauuuugaauguacauauacuuuccuuauauauaguuguaugauacauguacauacuauuuuguggccuauuuuuuucauuuaccaucauuuuauauagacauuuacuacuccacacuggucaaucugaauguuauauaauauuuuccugucuuaauauaucauaauuggaucuuucccuuauuaucugauacuuggguuuucacguuuuuuucguucauuccacaaauauuuauugagcaugguuguuuucccuguacuuggccuugggaauauggggugagugagacuuacaugauucaauagucuaaugagggagauugacaaaaguaaauacaaaaggugauaagugcucuaagaaagaugacagggugcugaaauagaacauuaucagggggauucauuaucagggaucucugguaagguagaucugagacuugaagacagaagagcuagccaugugaagagugaggaaaagaguuuuccagacagguaaccagcagcauaugcaaaagcccaaggaggagaagagcuucauguuuccaagggaaaguguuugguguauucuugcaacugauaaaaggucagggugguuggaugauggaaaaccagggggagaaaagcacaaaugagauuagagagguaggugggacuagaucauuagggcccugcaggccaaagaauuuaaauuguauucuaauaauuagaugccucaucaggaagauuuaguauacugacuaaauauuuccauuaguucucucuauauuaugauuuguaucucuuuauaacuuauaaacgucauacagauguuucccauguccuugcuuuccuuuuggcauuuauagucuaacagguuuuuaaaauauauucacauauagccaucuuacuuuugaccuucauuucuucacuagucaggauuuuaucuuuagaaaaauugaauguuauaauauucuuuuucauggcuuaaaacaaaauccauuccuucagguguuuauccuuugaauuacaaacaauccaauuacacucuuuuaguuauuuuaaaauguacaauuaaguuauuauugacuauacucacccuuugugcuaugaaauaguaggucuuauucauucuuucuguuuuuuuuguacccaauaaccaccccaucuccccaauccucacccccccacuacccuucccagccucuaguaaucauaaauuucauuaauuucuacccugaucuuuauuauuuauuuuggguuugguuugcucuugcuuuucuaguucuuuuuuuuuuuuuuugagacggagugucgcauugucacccaggcuagagugcaguggcacgaucucggcucacugcaagcuccgccucccggguucacaccauucuccugccucagccucccaaguaggugggacuacaggugccugcuaccacacccagcuaauuuuuuguauuuuuuuuaguagagacaggguuucaccacguuauccaggauggucucgaucuccugaccucaugauccgccugccuuggccucccaaagugcugggauuauaggcgugagccaccacacccagcugcuuuucuaguuucuuuuaagauguaucauuagauuguucaugugaaguuuuuucucuuuuuuguuguaggcacuuacagcuguaaacuucccuccuaguauugcuuuugcuguuucccauagguuuggauauguuguguuucuaguaucauuuguuucaagaaauuuuucagucuccuuaauuucuucauugacccacuggucauucagggggaacuuguguaauuuccauguguuuauauagcuuucaaaauuccucuuguuauuaauuucuaguuuuguuccauuguggucagagaagaugcuugauauuauuucaguuuuuuuggucuuaagacuuguguugugaccuaacauaugguccauccuugagaaugaucaaugugcugaggaaaagaauguguauucugcagcuguuaggcgaaaucuucuguaaauauguuagauccauuuggcguguagugcagauuaagucugauguuucuuuguugauuuugucuggaaaaucugugcaaugcugaaaguuggguguugaagucuccaacucuuauuguauugggaccuauaucucucuuuagcucucauaauauuuccuuuauauaucugggugcuccaguguuggguucauauauguuuaaauuuguuauauguucuugcugaauugaucucccuuuaucauuauauagugaccuucuuuaucucuucuuauaguuucugucuugaaaucuguuuugucugauacaaguauagcuacuugugcucuuuuuugguuaccauggguauggaauaucuuuuuccaucccuuuauuuucagucuguaugugucuuuauaggugaaguguguuucuuguaggcaacagaucaaugggucuuguuuuuucauccauucacccagucugugucuuuuuuuuuuuuuuuuuuuuuaaauggaguuuagcucuuguagcccaggcuagagugcaguggcacaaucucggcucacugcaaccucugccuccuagauucaagugauucuccugccucagccuccugaguagcugggauugcaguuuugcaccaccaugccuggcuaauuguauuuuuaguagagacgggguucugccuuguuggccaggcuggucucgaacuccugaccucaagugaucugcccaccuuggccucccaaaguguuaggauuacaggcaugcgccacugcacccagccuugcugcaugacuuucuagguuagaaagcaacacagcuucuggcuggcucuuuccaucucucucaucugaaugguggaccucagaauccagccaucauauugcgaggaaguucagaccacaugaaaaggcucauguagagaggaauuaaagccccaguugaaagccagcaucagcugccagacaugugaguaaaugagcauuaagauguuuucagcucccagccuuugagucuucugacuaaggccucagauauuguggagcagagauaagccauuccugcugugccucuauauaaauuccugacccacauaaacccggagagauaauacaugauuauuguuguuuuaagcuauuaaguuuugcaguaauuuguuacacugccagaguaacugaagcacuccucucuugcugcuuaaggucauaaaaacugcuuaggcacucucuuaccuuucuugggcuccuaucgcacaccaggccuuccuccuguacagauccccuccuguugucucugucucccugccuggggacaauuuucugacuguguaagagugaacuagaguccaagcaaagcaaugguggucccacugugcugaggagcagagacgagaguucaggguagaggaagagaagagaaccagaaauuaauuaaugggugaauauaaaagucuauauuuuuuaucugauuucuuuaaaggacaacugacugauuaaagcaaaauauaugcuuguauuuaauauguauaugauauauaaagugugugucugaaaugugucuaaaauguauaaagagggaguuuauacuuguagaaguaaauauagcucaaauaaugggugacuauaaguggaauuauacuuuuauaagguuauuauauuuguggauuauuguaaaauuauucaagaaauuaaaugaaacaguucucacacagagaaagcucuaggcccaggugaauucucucauccauuuguggaagaaauaacaaugaugcaaacuuuuuuccaaaaaguauaaggaauacuucucaauucaguucauaauaaggucagcagagucuugaugcuaaaaccugagaaagacaauguaauaacaaaaaauuaugaggugggacuuuuaguaucagaauaaauagcucggcaaauccuccuccccaaaagcaacaaugaaacuggacaaaauggugaggugcaacuguuuaaaggcuuugcaaauugacaaaaagcauauaacaaauaaagaagcaauuauucaugaaaaucaauagaacuuuggguuaagaacagugagagacuauucuacuacagagggacacgcugugaaaacuagcagccucacuguuggagaaggcucaguagguuuggagugaaccuggagagacccuaugcccaacagcauguaaguaacaguaguaaacuugguaggaaaaacaguugcucagauagcuugagguuuuaguccuggcugggacaaacaauggauuggcaaacuauccaggaauuuauuaaggauaucugggaaauaagacggucacaggaggccuugauaagcuuuccacacauccacacaggacugacuaagcuaucuacacaucccuggcugaccgugagucagcuugcaaaugcagagaagauacaagagggcauccagaaauuaaaaucagaugcaaaaacugcuugaauuugaacuaagacaaaauaaacuuuaaaagaaaaaauacuacuagaaacaaagagggacauuuuauaaugauaaaagggucaauucaucaggaaaauauaguaguuauaaauguaacaucuaauaaccaagucuuaaaguuggugaagcaaaaaaugacugaauggaaaggagaaauauuguagcaauuauagcuggaaacuuuaauaccccacucucaauacuuguagaccaccuagacagaaaaucagcaaggauauuaaacaccugaacaguacuaucaaccaaccugaccuaacugacaucccacccagugacagcaguguagauacucuucaagcacacauaaagcaaguuuuuuaacuauaaaaagauuuaaauuauacaagguauguucuccagccaccuuggaauuaaauuauaaaucaacaacauacaguugggauauccucaaauauuuggcaauuaaacaucacucuucuaaauaacccauggguugaaaaaggaaucuauaagggaaaguagaaaauauuuugaacugaaagaaaagggaaaagcaaaauauaaacauuuaugggaugcagcuaggaggaaaugaauagcuuuaaaugucuacagaaaaacagggaugucucaauaauuuguuuccaccuuaagaaacuaaagaagaacaaacuaaauccaaagcaaagcagaaagaaggaaauaauacagauaagauagaaauuaauaaaacagaaaaacaauagagaaaauaaagucaaaagcuguuucuuugaaaagaagucaguaaauugacaaaucauuaguugguuugaucaagaaagaagagagauugacaugaucaggaaugaaagagagggcauaacucaacccuacagaaaguacucugagaauucaguaaacaauggcaacaaauuagauaacuuagauguaauggacaaaucccuagaaagacauaaauuaacaaauugacuuaaagaaaaauuaaaaauuuaaacagcuccauaccaaucuaauuggguuauuucuaucuauguaauuucuauuuaaauaaacuaaauuaauaauuaaaaaucuuucagcugaucacaguggcucaugcccauaaucucagcacuuugggagguaaggagggaggaucacuugaacccaguaguuugagaccagccugagcaacauagugagaccccaucucuaugaaaacuaaaacaauuagccagguaugguggcacgugccuuuagucccagguacuugggaggcugaggugggagaaucgcuugagccugggaggucaaggcugcagugagccaugaucacacuacugcauuccacugggcaacagagugacucugucucaacaaauaaacaaauacaaaaucuucccacaaagaaguccaggcacagaugcgcuaguaaacucuaucaaauauuuaaauucuaguaaacuuuaucaaauauuuaaagaagaaaucagacucagaaaaucaaagaacacuuuccaauucauucuaugagaccaguauuacacugauaccaaaaccaaagacaagaauucuucauauaagagauucuaaggaauagaaggaaaagaaaagaaaaaaauuagaacugauauaugaauuuaacaaugccacaaggugcaagaucaauauguaaaaaucaacuuauuucuauauacacuuaaauauuuaaagaagaaauaauaccaaucccucacaaacucuuucagaaaagaaagaacaguuccuaccuaacucauucuaugaagccaguaugaccuugauaccaaaguuagucaucacaagaaaacuacaaaccaguaugccucuugaaauuagacacaaaaacuucauuaacaaaccaaaucuagucacauaaaaggauuauuuacccugaccaagugaguaaauaggauuuaucccaggauugcacggcugguucaacauuagaaaaacaacucuucaucuggguagacggauggugaaaaaaagaaaaacaacuaauuuaauacauuauauuaauagaauaaaggacaaaaaugacaugaucaucuuaacaguaacauagaaaaaacauuugacaaaaucuaacacccauucauaauuaaaaaaacacucaacauacaagaaauaaaagggaauuuaaucaaccugaaagguugggcaucuacaaaaaaguuagaacuaacguuauuauauguaacaagaaaagacuggauaccuuccccuuaagauuuagaacaagguaaggauguccacucuugccacuucuauucagcauuguauuggagcuagugcaacaagacaaagagaggcauucaaauugaagaggaagaaauaaaaaugucuuuauucacagauaccaugauguaaagaaaauccagaaaauuuacauucccugcauuaccaccccccaaaucuaauaggacuaauaaauuaguucaguuaggucacaguauacaagaacaauuuacaaaaauaugguuuucauacaaugcgauuauuauucagccauaaaaaugaaagaaguuccgauacauguuacaacuuggaugaaccuucaaaacaugcuaagugaaagaagccagacaugacacaucacauauuguuugauuccauuuauaugaauugcccagaagagcaauuccauagagacagaaaguagauuauugguggccaggggcugggcagagagaggaaugggggaugacugcuaauggaaacaguuucuuuuaagggugauaaaauauucuagaauuaagauacuggugauaguuguacaacugcgaauauacuaaaaacacugaauuugacaauuuaaaagggugaauuucauggugugugaauuauaucuaaauuuaaaaauuuguauuucuauacauuggcagugaacaaucugaaaaugaaaauuuaaaaaucacaauagaauaaaaaaaguucuuagcaauaaauuuaacagaagcaacacaagacuuguacauuggaaauuucaaaacauugcugagagaaauuaaagaagaucuaaauaaaugaagaaaauuccuuguucaugaauuggaagacaaaauauuaauaauauggcauuucuccccaaauuaaucuauauaucagugcacucucuaucaaaauccuaggagacauuuuuauagaaauugauaagcucauccuaaaauguauaugcaauugcaaaggauccagauuaguaaaaaaaaaaaaaaaaaaaaaaaauugaaacagaaauagaaaauuagaggacauauggccaggcgagguggcucacgccuguaaucccagcacuuugggaggccgaggugggcggaucaccugaggucuggaguucgagaccagccugaccaacauggagaaaccccgucucuacuaaaauuacaaaauuagccgggugugguggcgcaggccuguaaucccagcuauuccggaggcugaggcaggagaauggcuugaacccaggagguggagguugcugugagccgagaucgcaccauugcacuccagccugggcaacaagagugaaacucugucucaaaaaaaaauuagaggacauauacuaccacaucucaaaacuuaauaucaaaacauuagucagaacagugugggcagggcaugguagcucaugccuguaaucccagcacuuuggaaagccaaggcgggugaaucaccugaggucaggaguucgagaccagccuggccaacauggugaaacccugucucuauuaaaaauacaaaaauuagcugggcacgguggugcaggccuguagucccagcugcucaggaggcugaggcaggagaaucacuugaacccaggaggcagagguugcagugagccaagauugugccacugcacuccagccugagugacagagcaugacuccgacucaaaacaacaacaacaacaaaaacagugugguacugacaaaaagauggacguguagucaauagaacagaauugagaguccagaaauaaacucuuacauuuaggauccauugauuuuugacaaagguacaaaggcaauucaauagaaaaaggauuuuuuuuccuuaacaaauguugcugggacaauuggauauccaugugcaaaaagaugaauucacaucauauaaaaaauuugcucaaaaugaauuauaaacuuaaauauaagagcaaaaacuauaaaucccuuagaagaaaauguauaaucaaaucaagaccuuggauuaggcaacaaguucauaaauaggacacaccaaaagcauaagcuacgaaaauggauaaauuuaacuccuucaaaauuuacaucuuuuuuacuuuuacauaccucauuaagaaaugaaaggacaccagccuggccaagauggugaagccccgucucucuuaaaaauacaaaaaauuagccaggcgugguggcaggcaccuguaaucccagcuacucuggaggcugaggcagagaauugcuugaaccugggagguggagguugcagugaggugcaggaggucgugccacugcacuccagccugggcgacagagagagacucugucucagaaaaaagaaaaaaaaaaaggaaggaaggagggaaggaaggaaggaaggaaggaaggaaggaaggaaggaaggaaggaaggaaggaaaggacagaucacagauugggagagaauauuuccaauaucugacuuguauccaaaguauauaaagagcucuuaaaacuccauauuaaaaagaaaaaaaaaggcuagacacaguggcuugugccuguaaccccaacacuuugagaggcugaggccaccagaucauuugaucccaaguauuugagaccagccuaagcaacaaagugagacccccaucucuaaaaaauaauuaauuaauuaauuaauuaaaaggugaaauaaugggcaaaagacuugaaaagacauuccaugaaagaaaaagacauaaauggccacguagcauguagaaagaugcuccauaugaugaauuauagagaaaaugcaaauugaaaacugggaagauaacaccacuccacauuuacaaaaauugcuaaaauuaaaaagacugacaauaccuaguacuggaauggauguggagcagguuuaaugcucacacauuucugguaggagugcuaaauuguacauccauccuauaaaauaguuuaguaauuucuuuaaacauacauuuauuaugugacagcaauuucacugcuagcuauuauccaagaaaaaugaaaacauauguguagaaaaagacuuguacaugaauguuuauaucagcuuuauucauaacaaacaauauaaacaaauacugaaaauaacauaaacgucccuuaacaggggaauggauaaacaaauugcagcauagucuuaaaacaaaauacuuuucagcaauagaauguaaugaauaauuaauacaugcaauaacaugaaugaaccucaaaaagauucuccugaaugaaggaagccaaacacaaaaagugcauccugcacaaucccaauuauaugaaguucuagaccagacaaaaguaacuuacagugauaaaaauaagucaacauuuuggaaaagcugcaaaggagugugaggagaaauguuuuauaucuggaaaggaauguuaguuacuagggugaauauuuugucaaaucucauuugcuguacacuuaaaugugcauuuuguugaauguaaguuauuccucaguaaaguugauuaaaauuuuaaaguccucaaagaguuaaaggacaagauaacaucuauuuaaauuauuagagguuuuaaaacaaagcagguaaagauauuaacuuaagaacaggcaaauaugaagaaccaguuaaacaucuucaaaaugaauagcauuugaaauaucucaauauacaagguaagcuggacccagugaaacagauaguagcuaauugaaugcuagaacuaagaaaaucaccuagaaccagggaacuaaagacagaauuugaagaguaguuaggagacauggaggauggauuaagaaacugcaauauauuucuaacagaaauuuuagagaauaagaaagaggcaauguucaaagaaguagucacugauuuuuuuuuuuuuuuagacccgaagaaagacauguuugaaaagucuaucaggugaaagacaauuuuuuuagagaggggucuugcuauauuguccagguuggaacacaauggcuagccacaagugccaccaugguccaguauagccucaaacucucgggcucaagcaguccuccuaacucugcuuccugauugauucacugcgacuacaggugucggccaccaucgccagcuuuggacaaauuaaaaaacaaaaaacaaaaaaaaaacccacucccagacagauagauauaauuuuuauuggguagggguugacuuucauuuuuagggugaaaauacauuauuuucaaacauagauaugacuuuucucccacuggaacacuggaauguaaaaggauguguaaauuuagauguaguagaggauaagcaaggaaucugaagaaaaugaucagauuugcauuuuguaaccaucccucugacugcuuuuuuuuuuuuuuuuuaagagaugaggucucacuugguuacccaggcuagcaguagcacaaucauagcucacuacagccucgaacucuagggcucaaguaguccucccaccucagccuccugaguagcugggacuauaggcacagaccaccaugccuggcuaauuuuuuauuuuuuuuagagauggcagucuugugauguugcccaggcuggucucaaacuucuggccucaagugauccuccccacucagccuccugaguugcugagauuacaggugugaaccuccaugcccagcccucugacuauucugguuuuuggcuuuuguuuucuuuuuugagacggaguuuugcuuuuguugcccaggcuggagugcaauggcacgaucuuggcucaccacaaccuccgccucccggguucaagagauucuccugccucagccucccaaguagcugggauuacuggcgugagccgugacgcccagcuaauuuuguauuuuuaguacaggcaggguuucuccaugucggucaggcuggucucgaacuccugacuucaggaucucccgccucggccucccaaauugcugggauuacaggcaugagucacccgccuuggccuuuuuuuuuuuuuuuuugagacggaguuucauucuuguugcccaggcaggagugcaauagcacaaucucggcucaccgcaaccuccgccucccagguucaggcgauucuccugccucagccucucaaguaacugggauuacaggcacccgccaucacacccagcuaauuuuuuuuauuuuuaguagagacaggguuucaucauguaggccaggcuggucuggaacuccugaccucaggugauccaccccaccuuggccucgcaaagugcugggauuacaggugugagccacugugccuggccugacuauucuuaaaggcuggauuacagaggucaaggacauaaguugucaauugucaagugaaagaugcaguauaaaaaguaauauacacaggguuuuccaucuaaaaaauagugaaaccaagcaacuguacuaaaauuagcaaucuaucuuugaacgguggaauuacagguaauuuuuauuuuuucuuuauacuuuucuguauuuuucaaaguguuuacaauuaauacuguauauaagaauauguuacuuuuaaaaauauagacuuuuuuuuuuugagacacagucuagcucugucacccaggcuagaauagagugcaauggcacaaucuuggcuugcuacaaccugugccucccaggucaagcaauucuugugccuuagccucccaaguagcuaggauuacugguguguacuaccacgccuggcuaauuuuuguguuuuuaguacagauggaguuucacuauguuggccaggcuggucuugaacuccuggccucaagugauccacccaccuuggucucccaaagugcuggguuuacaggcgugagcuaccacgccuggccuuuuuuuuuuuuuuuuuuuuuuuuuuaggcuaaucaagugaagcaguaggaguggagaggaaacaaagaaauccauaaagugguugugaucaauuagcuguaaacaccacuguacuuggaccagccuaaaaaacagacauuuaucuaaauuuucuuuaaauaugaauggagaagauaccugaaaauuccgagaucugaaaacucacuaauuuaacuuuucuuucguggaaacacagcaguauuucaaguagacuaaauauguaaacaaaacaagucuuacugcuuuuaaucuuuauaauuuuuaacagagagugaaucagcucaccuaaauauuuggggggaauauuuucuucuaggaacucgaucaaaaugccacugaaaaaguccagacaauguucacagccauugaugaacucuuguaugagcagaaguugagugugcauaccaagagucuacaagaagagugccaacaguggacagcuagcuuuccucaccucagguacugaagcccuccaguugacuuguauucauggcuaauacuaaaauuuaaaaaguagauuuaaaaaaaaagcuuguauucugaaaucuuuaugagcaugacuuuaaugaauguaaauaaggccaugugguauaaagccuuggcuaagagaaaacuuaaguugguagaaguuucuuagaguuuccuuaacuaacaauaugugauccuaaucaaguaaaaacuauuucuacaacagcagcugaggucugaguaucugaguaucaaaaagcccuucuuuugaacaagauggucagaaaauguacacuguuguauacaauuaaauucuuauguauacuugaaaccagacauaggcuauucaagagcuuccuucagaaacugcaguaguaccacuuauugcacauacucaaaauuuacaaagcuucacguuuuuaagaauauaauucguaguuuuuacuaauuuggcugggccuccaucccauuuugacugauuuaaugaggacuauuauagagcaugaagggcagauuacagauguuugcuuagauuucuuguauuuuuuuuuuuaacagcugggcuauagguuuaucuuuuccaucuccauucuauggaagagauauaccuguaguaaggcucuggauucacauuuucucauucuuaaucaguaucagacuguauacuggacuuuuauguugagccaucaaauguguccaaaauauaucuagauuuuguauguaugccagugaagguacuuaauugugucuguguuucuucauuuugaaggauucuagguaggcagauaaucacuccaagugaagguuauagauuguauccuagauccccuucugcuguuuccgcuucauaugaaacaaccuugucucaagaaagagauucuacuaugugaguauuccauuauguaaguacuucaaugugcccuaauaugcaaguauuauguccuaccaguuguauuaagggauuaaaauacuucuuccuacuuauuaguauuuaguaaagcauagcaaauucuguaagauuguccauagucuuuguguauauuaaaauuucauuauguaauuuuguucaaaaaguuagaccuuuccuguaguggauuagucuguuuucuguugcuuguaacagaauaccugaaacuggguaauuuauaaggaaaaggaaguuauuucuuacaguucuggaggcugagaaguccaaggucaaggggcaggaccuucuugcugguggggauucucugcagggucccaaggcaguacagggacucacauggcaagggggcuguacaugcuaauaugccaacucagguuucucuuucucuuauuauaaagcuaccaguuccccuuccaugauaacccauuaauccauacauggauuaaaccauucaugaggacagaacucccgugauccaauuaccccuuaaaggcuccaccucucaacacugccaaauuagguacuaaauuucagcgugaauuuuggaggggacaaauauucaaaccauauaauagugcuuaaggauauucuuauuauucaggucuauauaucuauauauauuuacauauauccaaaaauauggacacuuccuucuuggcauaaauguguaaauagaaugguuuuuuaaaaugucgaagucuaagaaaaagacuuuaaaacuuuuuugaaaaaaaaguugaaaaagugauuuauuuuuuauuuauuuauuuuuuuugagacggagucuugcugucucgcccaggcuggagugcaguggcgcagucuuggcucacugcaaccucugccuccuggguucaagugauucuucugccucagccucccgaguagcugggacugcaggugugugccaccaugcccgggauuucaccauacuggccaggcugguuucgaacuccugaccucaugauccacccgccucagccucccaaagugcugggguuacaggcaugaaccaccgcacccagacuuuuuuuuuucuuuuuucuuuuuuuuucucuugagacagaaucuugcucugucaccaaggcuggagugcagugugcaauggugcaaucucagcucacuguaaccuccgccucccagguucaagcaauucuccugccccagccuccugauuagcugggauuacaggcgcccagcaccaugcccggcuaauuuuuguauuuuuaguagaaacaggguuucaccauguuggccaggcuggucuugaacuccugaccucaggugaucugcccgccucggccuuccaaagugcugggauuacaggugugagccaccacgcccagcccaaaguaguuuuuaaauggcaaaaucuuuugaacaccucagacuuuuuaaauaguagcaaaauaaacccaaauaggauuacuuugaaaccuaugccuauacuuaaaucuacuguaaaauauaauaucauaguuuuaauucauuuaaaaaauuauuccuauacuuuuucccagggcuccaguuuuacuuauuugauaccuuccaauaguuguaguaauacuuacuuuuggugccuccuugggcuugugguagucucaccagaccacaaagugaaacauuacuguuaggguuaugagauuuggguuaucaacugauuuuuggucagauaaugauauuuguuugcuauuccugaagugauuuaaacucaagcugcuggucauuaggcauucuuuuuaaauuuaaaucucauguauuauaucgauaaguuuacuccuuuuauauaauauaaaaaauuuuacaaccuaaugucacccacagaaaugauguauucuuucauucucucugaucaaaauuacauaacucauauucuguuauuaggauauaucgaccuaaucuguuaguguaaacuuuauaugugccuuauuuuacaacuaucaaugguaggcccauuuagaaauuuaaucuucaaggaaauaagaaaucaagucugagcaguuaguucauccuuuuuaggacaucugacuauaucaccauucugcaacauacugcuaauacccuuucuuuccuuuuuacuugcuaccaccacuguugauuagucuuccuauuuuuggugcuacuuuuccugggauauuugacuuacaguucucaauaauuuucuuuacuuacacaaguaaaacaaauaccuauuuauacuuuauacacagacauauacuuagaagaaacaaauuauccagguauauuagcacaccacuacuuauuggaagccauaaaaauuaaacaaaaucuaugauauuuacuucuuuaauguaacaacuacuuuguucauacuuuauauuuucacucgaguaccauuaugaacucauagcauuucaaaauauuuauauauuuacuuagcaauaauuaguauugaugcucuaauuauuacaacuuagccacuucaagcuaguaccuuugguuuuguuuugacuguuucuuuguuuucugguacaguaggaugugccaggcccauccuuaacuuuuucuuccuuuaacauauggaaucagcugaacuuuaaggagacuuacuuugagaggcuccuuacuuuaaggagacuccuuugagaggcuaauacaguaguauuaaagaaccaaguuggguggugaggguauguaaguugugcuacugcuauuuugccccccacccuuuuuuuuuuuugaagagauggggucuugcucugucacccaggcuggagugcaguggcacaaucagagcucacagcagccuugagcuccuggccucaagcaauccucccacuucagccuucugaguagcuaggcuauuuugccacuuuuuguugugagacguaugaagaaaaugugucauuaauucauuuugaucuuacaguuuaacaaaucagguugucauaaaauauaagauuuaucaaccgcuaagacuuucuauaaaaauaacauuucaaauuauauccauucuugcccucuccaauauauucuccacauuaaaucagauuuuuuuuuaauucaggguugauccuuccugucucccacuuaaaaacuuucaguagcuuuccacugaauuuaagauaaaagucuaaaauuauauuaucagcuggccccugccuacuucucuaagacaucuaucagucucucucucauucauuaauccuuccaacacuggcuuucuuucagaccucaaaugcaugaaacuagguauuugguucaguucucuaggaguucuugggccagaagaaagugcuagaguaaacaacauaguaauacagcaucuuccucuuuguaucuguaacaccuaggacagugccuguaacaugguuagcagucaacuugcugcuuccuuuucuuuuugguuuuguuuuuuguuuuuugagacagggucuuacucuguuguacaggcuggagugcaguggugcaaucacgggggacugcagccuugaccuccugggcucaagcaauccucccgccucagccuccugaguagcugggaccacaggcgugcuccaccacaucuggcuaauuuuuguauuuucagcagagauggguuucaccauguugcccaggcuggucuugaacuccugggcucaagugauuugcccaccuuggcuucccaaagugcugggauuacaggcaugaucugccaugccuggccacucuuuuuucuuaacuaaauaaaagcagaucauauuuacauuuuuuaaaaaacgacacaaaaaugaauuaauguaugcauugaaauuaugguugcaaaagagacugauuagugucuaggucaaaaugaaauuccucagcacugaagacggugagaaaaacaaacacacaaaaagaagaaauuccagccaggcacgguggcucacgccuguaauccuagcacucuaggaggcugaggcggguggaucacuuaaggucaggaguuugagaccagccuggccaacauagugaaaccccgucucuacuaaaaauauaaaaauuagccaggugugguggcgcacgccuguaaucccagcugcuugggaggcugaggcaggagaaucccuugaacucaggaggcagagguugcaguaagcugagaucacgucacugcacuccagccuggugacagagcgagacugucucaaaaaaaaaaagaaauuccaggaauuuaacaaaagaugguggcagcauacaggggaaacacaggccagaaaaggauccugaagagaugaguuugaagacauuuccaccugagaaaaacuaugcauucugcuacuucaaguuagcuaaggggcuuaucuguacuuagauauauaucccaacaaaaauaacuaacuauaauaucuaaugaguggcuaaaguacaugacuacaugcugaauuauaacccuuuaaaaaucauuaaaagaauggagagcucaaaaauaaacccuugcaauuauggccaaaugauuuucaacaagagugccaagacuaccuggguaaaggacagucucuuuaacagaugguguuagggaaacuggacacccacaugcagaacaacgaaguuggacccuuacuuauaccauauacaaaaauuaacucaaaauagaucaaagaccuaaauguaagauguaaaacuguaaaacuccuagaauaaaacauaggguaaagcuucaggccauuggauuuggcauugauuucuuggauauaacacuaaaagcacaggcaacaaaagcaagaacagacaaaugguacuauaucaaagguaaacacuucugaacaucaaaagaagcaaaagaaugaaaaggcaauauguggaaugggagaaaauauuugcaaaucauaucugaugaggaguuuauauccagaauauauaagaauaaucuauaaccuaacaacaacaaaaaauaguaauucaggcugggcgugguggcucaugccuguaaucccaacacuuugagaggccgaggcugguggaucaccugaggucaaguauucaagaccagccuggcuaacauggugaaaccccaucuccacuaaaaauacaaaaauuagcuuggcguggcagugugcaccuguaauuccagcuacucaggaggcugaggcaggagaauugcuugaacccaggaggcggagguugcagugagucgaguucgcaccauugcacuccagccugggcggcaagagugaaacuccaucucaaaaaauaauaauaauaauucaauugaaaaauggacaaaggacuugaauagacgauucuacacagauaugcaaauggccaacaagugccugaaaagauguuaggcaggaaggguagcucuuggccacuuguuccuuccaaucauccuggagggccuugcaguaaucacuuucauuagagaugcggaacucuacuuccuaaugccuacaccuggaaggacugguuccaaauauaaacucuuuguauaaauaagaaaccuagcaaagucauuuuauccuccaugcaugugggagaagaauaaaguucugucacacaagaaaacacaucucuauuuaaauauaacuauaacuaccagggcaacacaguauuagguaagauaacuguuauccuuuuuuguuguuguuguuguuguuguuguuguuguuguuguugagauggagucucgcucugucgcccaggcuggagugcaguggcacaaucuccgcucacugcaagcuccgccccccagguucaugccauucuccugccucagccucccgaguagcugggacuacaggcgcccaccaccacgcccggcuaauuuuuuguauuuuuaguagagacgggguuucacuguguuugccaggauggucucgaucuccugaccucaugguccacccuccucagccucccaaagugcugagauuacaggcgugagccacugugccuggccaauaacuguuauucuuuuuauuugguuguuuguuuuaggagacagggucucacuauguugcccaggcuguccucaaacuccugagcucaagagauccuccugccucagccucccaaauagcugggacuauaggcacaugccacuguacccagccuauuccuuuguuaaauaaaugaauuacagacauuauauaaauuaaagguuauuuuccagauauaguaauauccaaaguccaaugauuuaaaagauuccuuuguuaaaaauaacauaggcagcuuuucagucgggugcuaagucguuuuucacaucaugucugguggcuccguggauuauaacagcagagaacauggagacccagagagaauggacccugauggugucaucgagagcaacuggaaggagguuguugauaacuuugaugauacaaacuuuaaaaagucucuucuuugggguaucuaugcuuaugauuucagaagccuuccgcuauucagcagagaacuauuauucccuguauuaaagauccaaaagguggccaggcgcaguggcucaugccuguaaucccagcacuuugggaggccgaggcggguagauuaccugaggucaggaguucgagaccagccuggccaacauggugaaacccugucucuacuaaaaauacaaaaauuagcugggcauguuggcgcauaccuguaaucccagcuacucgggaggcugaggcaggagaaucaucgcuugaaccugggaggcggagguugcagugagccgagauugcaccauugcacuccauccagccugggugacaagagcgaaacuacaucgcaaaaacaaaacaaaacaaaaaauacccaaaaggugauucuggcacuuggagauuauaugggagcaaccugucaugccugcauugguggaacaaauguucaaaaugaaugcaaaaacugcaggcugaaguaccacauauuguugguacaccagggagaaugugugauauguuaaacagaagauaccuuuuuuccaaaauggaucaaaauguuuguuuuggaugaagcagaugaaauguucagccaaggguuuaaggaucaaaucuaugagauuuuccaaaaauuaaauacaaguauuuagguuguguugcuuucugccaugaugccaacugauguguuggaagugaccaaaaaauucacuaaagauccuauucaaauucuggugaaaaaggaagacuugaaccuugaaggaaucgaacaguuuuauaucaguguugagcaggaggaauggaaguuggauauacuuugugacuuguacaaggcaccauuaaacaggcuguuauuuuucucaauacaaggugcaagguggacuggcugacugagaaaauacaugccagggacgucacaguuuuugcucugcauggcgacauggaccagaaggagagagauacuaucaugagggaauucugaucagggucaagcccuguucugaucacuauuuacuuguuggcacgugggacugauguccaacaagugucuucgguuauaaacuaugaucuaccuagcagucaugaaaacuguauucgcagaauuggcagaggggucaauuugguagaaaagguguggcuaaaaacuuuguuacugaggaaggcaagaggauucuucgugacacugagauuuguaugcaauacuacagugaaggaaaugcccauaaauguagcugaccguauuuaauuccugggaugacagaguuuuggaugcagugcucccuguuguugaacagacaauuacaaugugcauugugcuucuuucuuugggaauauuugaaucuugucucaauucucauaacagaucagaaauacagauuuugauaccaaagcaacauuagucgugagcucuugugaggaaaaucauuggcuuuauccucuuuagaguuaaacuguuaggauagguauaaaagaugaguucuaaaauuuuucuuucuuagaaauuuauuuccuaguucuguagaaaugguaguauuagauguuuuguauuauuuaauaauguaucuggggacuaaaagauauaagugcuguauaaaaucagccaauuacauuaaaguagcauaccugcccuuauuguguuugucauuagccugaguaggaaggccuuuaaaauugauuuuuuagaaggcauucgaaugcauuuuauuugguauuguauuuaugcaaucaaauauuuaauuagugcuaagugugaacuggacccuauggcuaagccccagcaagcaaucauauccuaaauaggguuaaauucccaguaaaauugccauauugcacaugucuuaaugaaguuuuaguguuaaauaaacuguauauucacuuaagaaaaaaaaaaggaaauagcagccaggagcgauggcucacaccuguaaucccagcacuuugggagggugagaugggcagauaaccugaggucaggaguuuuagaccagucuggccaacauggugaaaccccgucucuacuaaaaauacaaaaauuagccaggcgugguggcacacaccuguaaucccagcuacuggggaggcugagacaggagagucacuugaacccuggagguagagauugcagugagccaagaucacgcuacugcacuccagccugggcgacagagcgagacucugucucaaaaacaaaaagaaagaaauaacauuuacaaagacaacuuuaugguguagaauacuaucuuauuuuuugcugcagcuuuaggggaaaugggaauauuuuuucuucuuaucuagcuaaaauuucuuuuaauaguuauaaaggccuauaguuguuagaaauuccuauuuauuuuucaacacaaagaauuccauuaguuaccacugacuaaaaauauaauugguuauaaguggaauaauacgauagcagaauaacguaauggaauguuggguauacauuccauauguuugauagcuuuuuuuuuuuuguuacccaggcugcagugcaauggcgugaucucugcucacugcaaccucugccucccagguucaagggauucuccuuccucagccucccaaguagcugggauuacaggugugagccaccacgccuggcuaauuuuuagacauauuggaucuccaaaccgauucccucccucccucccucccucccaaccgcccuucaucccuucccucuuccuuuuuuuguuuuguuuguuuguuuguuugagacagggccucgcuuugucacccagacuggaguacaguggugcaaucucagcucauuacagccuugaucuccugggcucaggugauccucccaccucagccucccgaguagcugggacuacuggugugcaccaccucaucuggcuaauuuuguauuuuuuguagagacaggauuucgccuuuugcccaggcugagcuucucucaucucuuaccaucuccaucccagugccaccugccaugguuaaggaucuuaucuguuuaccaacucuugcauaagagaaguuuacuucuuuuuauguaaaagaagucuggaggaaggcaauguagaguggcggcaugguguuuucagggacugagacacuucauccuucugccauaucauguuagcccacgguguuuuuucugaaguuuucuucaugguucaagauagcugauagagcuccaaacaugauauucgcuuuccacguagcagaaaggaggaaagacagaagggcuaaaugguaucccuugcagucacaccaguucccuuuaaacagccuucccagagucccacagaauaauucugcucauauugcauugacuaucuuuggcugcaagguaacugggagaugcagucuuugagguggauauguuguuuucaugaauaaaauugggaugauuuuacuagaaaagaaggagagaauggauauugaggggcaucuagcauucucuaccauguauguauaugguuuuuaugaaauuauacauuuuguaaucucuuuauacuuaaucuuuuauuguggacaucuucuauuuuucccaauauuaacuuaaggacuuuauuccauugcaugaauauaucacuauuuaaggaacucauccccaaauccucuauuuugaaacaguugggcuaguuucuauuuuuggcaauuauaaacaauucugugaucauaauuuuuuuuuuuuuugagauagggucucacucuguugcccaggcugaagugcaguggcacagucauggcucacugcaacuucugccuccagggcucaagugauucuuccacuucagccuccugaguagcugggacuauaggugcaugccaccauaccuggcuaauuuuuguacuuuuuugcagaaaccaaguuucaccauguugcacaggcugguguuaaacuccugggcucaagcaauccacuugccucagccucccaaagugcagagauuacaggaaugaaccaccgugccccaccaaucauaauucuuauagcuaaaucuuacaggucauauccuuaaaggaaaucccuacaaaugaaaccacugaaucaaagaaaauguuuauuuuaaagcuccuaauacauauucccaaaaugucuuccaguaagauuuucccaccagccuuguuuaaaagugccauggguuuguuuuuuuaacuauuauuauuuuuuugugugugugacagagucuugcucuguugcccaggcuggagugcagugguguaaucucagcucacugcaaccuccaccccacagguucaagcaauucuccugucucagccucccagguagcugggauuacaggcacaugccaucacgccuggcuaauuuuuguauuuuuaguagagacgggguuuuaccauguuggccaggcuggucucaaacuccugaccucaagugaucugccugccucagccucccaaagugcugggauuacaggcaugagccaugggcccagcugccauggguuuauucuauuuuccuaauaaaaaaaaauacuuaaggcacaaaaaaauguaaagagcaauacaaaguguaaauugguuauauuuaacauuugguuaaacugaguuccauuuuuuaaaauuuuauuucucagauuggauugacuuucuccagaguaaacccacugaaacaaaugagucaucacauauuuacugaaugccuaggaaggaagagaaauuugaauauuaauaagauaagaucccugcccauaaggagcauauauuuugggcaaugauggaguuacugaaauaaggauauaaccucgugagauaucuuaagauguaauuauaaaugugauuauucuuuuuuuuuuuuuuuuuuuuuuuugagacggagucucgcucugacgcccaggcuggagugcaguggugcaaucucagcucacugcaagcugugccuccuggguucacgccauuuuccugccucagccucccaaagugcugggacuacaggcacccgccaccaugccuggcuaauuuuuuuuuuuuuuuuuuuuuuuuuuuuuuuuuuuuuuuuuuuuuuuuuuuuaguagagacaguuucacccuguuagccaggauggucucaaucuccugaccuugugauccgccugccucagccucucaaagugcugggauuacaggugugagccacccgccuggccaauuauucuuaguuuuuaaaaaacuuguuguauagcuuguuauaguuuagauauuuguccuugccuaaaucucauguagaauuauaaucccuagugcuggagguggggccuggugggaggugucugagucauggggacaaaucccucaugacuugguaugaucuuugcaauagugaaugaguucucaugagaucuagucauuuagaagugugcggcaccucuccacacacacacacacucugucuuucuucugcucuggucgugugauaugccuacuccuccuucacuuuuuaccauaaguuaaagcuuccugcagccucccucaaagcagauguuagcacuauuagcacuaugcuuccuguacaaccugcagagccauaagccaauuaaaccucuuuuccuauaaauuacccagucucagguauuuuuguuuuuuguuuuuguuuuuuuggguuuuuuugagacagagucucacucuguugcccaggcuggagugcaguggugugaucuagacucaccacaaccuccgccucccggauucaagcaauucuccugccuuagccuccugaguagcugggacuacaggugugcaccacugugccuggcuaauuuuuguauuuuuaguagagaugaggguucacuguguuggccaggcuggucuugaacuccugaccucgugauccgccugccucagccucccaaagugcugggauuauaggugugagccaccgcaccuggcuagguauuucuuuauagcaaugcaagaaugacuucauacagaacacugguaccaaggaaugggguauugcuauaaggauaccugacaauguggaagugacuuugaaacuggguaaugggcagauguugaaagacuggagggcucagaagacaacaggaagagggaaaguuuagaauuucuuagagaccaguuaaaugguugugaccaaaaugcuaauagugaaauggacaauaaaguccaggcugacaaggucucagaaggaaaugaggaacuuacugggaacuggaagaaagggcauguguguuaugccuuagcaaggaacuuggcuguauuauguccaugcccuagagaucuauggaauuuugaucuugagagucaugacguaggguauuggguagcagaaauuucuaaguagcagaguguucaagaaguaacaugccugcuucuaacaccuaugcucagaugugggagcaaagaaaugacuuaaaguuggaauuuauauuuaaaaggggagcagagcauaaaagcuuggaaaauuugcagccuagccacaugacaaagaaagaaaaagcuuuuugggaagaggaacucaagcaggcuguggagcaaccacuugauagagauauuugcauaacuaaaaagcagccaagugcuaauagccaagacaaugggaaaaaggcauuucggagaccuucacagcagccccucccaucacaggcccagaggccuaggagggaagaaugguucuguggggcagacccaggaccuuguugccuugagcagccuugggacacugcuuuuugcuggggcucagcggggcccaguuacagcuugacuugccgcuuuagagaaucuaagauguccugaucucaagugauccauggugaaaccuugucucuacuaaaaauacgaaaauuagccaggugugguggcggacgccuauaaucccagcuacuugggaggcugaggcaugagaaucccuugagcuugggagguggagguugcggugagcugagaucacgccacugcaguccagcuugggugauacagcaagacucugucucaaaaaaacaaacaaacaaacaaacaaacaaauguugcaagcaagcuguaagccuuggcagcuuccaugugguguuaagcuugugggcacacagagggcaaagagugaaggcuuggcacuaucuguguagauuucagaggauguaagagaaagccugggugcccaggcagaagccugaugcagggguggaguccucacagagaaucucuauugggcagugcagagaagaaauaggggguuggaggccccacacacaauucccacuggggcacugccuaguggagcugugggaagggggucaccaucuuccagaccccagaaugauagauucaccuugcacccuguaccuagaaagcugcaggcauucaggccaggugcaguggcucaugccuguaaucccagcacuuugggaggccaagaugggcagaucacuagagaccaggaguucgagaccagccuggccaacauggugaaaccccaucucuacuaaaaauacaaaaauuagcugaguguaguggugcucgccuguaaucccagcuauucaggaggcugaggcaggagaacugcuugaacccgggaggcagagguugcagugggccgagaccccaccacuacacuccagccugggcgacagaacgagacucugucucucaaaaaagaaaaaaaagaaaaaaagaaaaaagaaagcugcaggcauucaacuccacccaugagagcaaccuugggagcugaacccugcaaagccacagggguagagcugcccagggucuuggaagccuaccgcuugcaccuugucaugggacaucaagggguucuaagaguuaaugacuccccuacuggguuuugaacuugcaugggaucuguagccccucucuuuuggaacagaaauguuuaucuaacgccuauacucccauuguaucuuggaaguaaauaacuuguuuuugauuuacaggcucauagcuggaagggaugugccuugucucagaggagacgugggacuuuggacuuuugaauuaacacuggaaugagucaagacuuuugagacuuuuuggaaaccauaauuguauuuugcaaugugagaaggauaugagauuugggaggagccaagggcaggaugcccaaaucucaugcugaauuguaauccccaaugcuagagguggggccuggugggagguguuugggucaugggggaggaucccuuauggcuuuguacugucuuugcgauagugaguucccaugacaucuggucauuuaaaaguguguggcaccucucuugcuccugcucccacuuaacauucccccaugaguaaaagcuuuguaaguccucugcagaagcagaugccagcacuaugcuucuacagccuccagaacugugagccuauuaaaucucuuuucuuauaaauuacguggucucagauauuucuuuauagcaaggcaaggaugaccuaauacauagcuauagcuguuugcaucugaaaagacagcaagcaguaccagauaguccauaguacauguaggcagaauaguucugugaccagaauuuaaucuuccuguucugagaaaugguagguuauugaggcuuagaauaguccacgaagguauugccagggcaaggggaguuugagccaaaacucauguaacuguguugccauaagaacuguuuauguuuacauaauuaauauuuacuucuuuuuuccacuccaagauuugguauaaggggaaagaaguuacauuuuucaucuucuuaugcucauaaagcaucuuccauugccaaauccuccagcuuuuguucuauggaaagagaugaggaagacucuauaaucgucucagaaggaauaauugaggaauaccuagcauucgaucacauagauaugugaguauuaugccuuuuaagcuuuuuacuccccucuuauuuuguguauuaauaccuauuuuuucuaaaugaugcuaccaauguauauuauuaaauauaugccaguuucuguuauuuauuuuauguuauuucucagguauccagaauuuauguucuuauugccuccauguacuagacuuccuuguguauuuuauaacuucacacaucauuugccuguuccugagauuagagauuuuaaaauaaguuuauuuuuuccccacauaguuugauuuuacccuuuugcaaauuaccaccagugggaacuuugaaaccuuuuaaaagagcaguugaagagauauggacuuuguuuacauaaauucuguuugaaaaauguauauacaggcugggcgcgguggcucacacuuguaaucccagcacauugggaggccgaggcaggcagaucacuuugggucaggaguuugagacuagccuggccaacauggugaaaccccaucucuacuaaaaauacaaaauuagcugggcauggugaugcgugccucuaaugucagcuacuugggaggcugaggccagagaaucgcuugaacccgggaggcggagguugcagugagccgagaucacgccacugcauaccagccugggcaacagagcaagacuccaucuccaaaaacaaaacaaaacaaaaaagaaaagaaaaagguauaaacaguuuguuuaaaaccuuaugguuggcacagauuuuauaauuaauaaugucuauuuauaucuauucuaacuauauucuaacaguagaccuaucacauagauaugauuuaucuucuuuacuggauaggugagaaucagaguaguuaaugauuugucucaaguaaagcuaaaaccaaaaccuuauucaucugauucucaauccagucuucucuucacuauuccuugcuaccuuucugugacauuaaccuguuaaacuauuccucuaagccuuuaaaaguuccagauuugauagucacagcagcauauuugaaaauaagugagaauuucuuuuuaggcugugcagcugugguuaggucuaguaguuaguauugugucacaugauucuggaugcauuuuuuuuuucccauugcauuuuuuucccauuguauuuccugcugagccauguucacucacguaucacucaugugcacacagcccuagggccagcuaaauauaagccaggcuucuauacauaauaccacugagcuagaacuggaagcagauucuuuugguuuuccaaagauugccuccuucccuuucacuucuccugugucaaauuacuucuauuuucuauuuauuacuucuauuuggccuuugucaaauuaauucuauuuuccauuuuuccucaaaucaaagugaauuuucagguaauacacagacaauuuuagaaaggcagccuucccuucagcaucaugaagucuuuccuucuugcuucuguuacagagaagagggauuucaugggaagaaaucagaagcagcuacagagaaacagaaauuaggguauccucccauugcuccauuuuacugcaugaaagaagauguccuugcuuauguguuugacaguguauggugcaagguugugagcuguauggagcaguugacacguagucacugggaaggauuugccucugguaaggaucuuugugaaaauaauguaaaaaucaauuguuuaugauuucuaaacccuaaccagucuauuagaugauaugcuucuuagugcaaaaggugcguaugggccaggcacaguggcuuaugccuauaauccaaacacuuugggaggccaaggggaaggaucucuugagcccaggaguuugagaccagccugggcaauguagugagaucccaucucucuaaaaaaauuaaaaauuagccaggcaugguggcauucaccuauaguuccagcuacgcaagagacugaggugggagcaucacuugagcccaggaggucaagucugcagugagcuaugacugcaccacugcacucuagccugggcauaagaugagagacucugucucaaaaaagaagaaaaaaaaaaguggguaugagagagaggaaaaacccaaauguuuuucccuaaauguuuuuuccuacucucacauaccacaacaugucugacaccaguagguaggguuuuuucccccacaacccaagcaauucugacaccacauccuauaauucaguucaguucugacacagucuaccaggagauauugucagaucccacaaauuaagggcccagucccacaagacuacccccaacuucagaugcuaguugcaagcuccaaguugugaccuguacuucugaccuaccagaagucuaccagagagacuaggucucucugaaccuaguccuuuaggauuuuuauggagguuucauuuuguaggcaugauucaauuguuggccaucgcugauuaacucgaccuucagccccugucuucucccuagagguuaagggguggggcugaaaaagugaaaaaguuccaaccuucuaauuacaugguugguuccccugccaaccacuaucucccuacccaauccucagacuauccaagagccccuaaccaccggucauaucauuagcauacaaaaaaaaacaccacuuuggguauuauaagaguuuuaggagcuaugugccucaaccaggggcagagaccaaauaucuguuuauuaucaucucaugauaugauauggaaugacccauauauuuagucucugccccugauuucagaucauagugggucugacuuauguuuguauuucccacaaaaacuaacagguauuuaguaaauauuugagaaugaguagaucgauaaaaaggccuagucugugaugauuagacagagcuuguacuuucucuuugaauauaaugauuuaugaagaaaaaucaugugcaaguagcacuuuuuuaaacugcuuuauuaaagcauaauagauauauaauaaacugcacuauuuuuucuuuucauuuuauuuuuuauuuuuauguauuugaaggguccaagugcggguuucuuaugugcauguauuucuuaguggugaaaucuggguuuuuagugaccucaggugguacacuaaaauauucacucaaauagugaauauugugcucaauagguaauuuuucaaaccuugccucccucccaccuucccaccuuucggagucuccaguguuucuuauuacacucuguauguccaugugaacccauuguuuagcuuucacuuauaagugagaacaugugguauuugacuuucuguuucugaguuauuucgcuaggauaauggccuccaguuccaucuauguugcugcaaaagacagccuuuauggaaaaaagcauggauauuucucagauuucauuauuuuguauggccaaguaguaguccauuuuauuuauccaguccucuguugauggacacuuaggcugauuccauaucuuugcuaccgugaauaauggagcgauaaacauaugagugugaauaaauauauauuuuuugagacagaguuucacucuugucacccaggcuggagugcaguggugugaucuuggcccacugcaaccucugccgccuagguucaagcgauucuccugcuucagccucccgaguagcugggauuacaggugugcaccaucacgcccagcuaauuuuuuguauuuuuaguagagaugggguuuugccauguuguuggucuugaacuccucaccucaggugauccgccugccucagccucccaaagugcugggauuauaggcaugagccacugcgccuggcuguaaauauuuuuuugauauaaugauuucuuuuuguguauauacucaagagugggacugcuggaucaaauggcaguucuauuuuuaguucuuugagaaaucuccaugcuuuuuuccauaaaggcuguacuaauuuacuuucccacaaacaguuuauacaguguucccuuuucuucacauccuugccaacaucagucguuuuucauguuuguuggaugcuuguaugucuucuuuugaaaaaugucuguucauguccuguuucucucucucacucucucucucucucuguguuucucucucucucugucacccaggcuggagugcaguggcacaaucacagcucacugcggccuugaccuucugggcucaagugauccugcuaccucagccuccugaguagcugggaccacaggcaugcaccaccacgacuggcuaaucuuuugguauuuuuuuuguagaggcaggguuuaaccauguugccugggcuggucucaaacuccugggcucaagcgaucugcccgucuuggccucccaaagugcugggauuacaggcaugagccaccaugcccagccuguucauauucuuuuuccccuuuuaaauaggguuauuuauuguuuucuuauuggguugaaauccuuguagauucuggauauuaguccuuugucagaugcauaguuugcaaauauuuuuugccauucuguaaguagucugcuuauucuguuauuucuuuugcuaugcagaagcuuuuuaguuuaauugaaucccauuugucuauuuuuguuuuuguugcuuuugcuuuugaagacuuggucuuaaauucuuugccuggacaauguccagaagacuuuuuccuagguuuucuucuaggauuguuacaguuucaggucuuggguuuaagucuuuaauccauuuuuguauacggugagagguauggguucucuuaauuuuuguauauggugagagguauuuuucugcauauggcuagccaguuuucccagcaccacuuauuuaauagaguccuuuccccaguguauauuuuuguugacuuugucaaagaucaguugauuggcuuuauuucuugguuuucuauuccauuccguuggucugugugucuauuuuuauaccaguaccaugcuguuuggauuacuauacccuuguauaauuugaagucagguaaugugaguccuccagcuuuguccuuuuuacuuaggauuauuuuagcuauuugagcucuuuuuugguuccauaugaauuuuaggauuuuuuuucuaauucugugaaaaauggcauugguaauuugauagggauuguguggaaucuguagacugauugaucuguauggucauuuuaacaauauggauucuuucaauccaugagcaugggauguuuuuccauguguuuguaucaucuaugaauucuuuagucaguguuuuguaguucuccuuauagagaucuuucaccuccaugcuuaaauauaauccuggauaguuuacuuucuuauagcuauuguaaauugaguugccuucuugauuugguccuuggcuagaucauuaaugggguauugaaacccuacugauuuuuggaucuuaauuuuguauccugaaacuacuaaauuuauuuaucgaaucuaaguuuuuugguagaaucuuucagguuuuccagauauaagaucauaccaucagcaaacagggcaauuugccuuccucuuuuccaauuuggaugccuuuuguuauuuucuuuugccugauugcugugacaaggacuuguugaauaagaguggugaaagugggcauccuugucuuguucuagcuuuagggaaugcuuucaguuuuucucuguuaaguauaaugcuagcuauggguuuguuguuuauggccuuuauuauguugagguauguuucuucuaugccuaguguguugaggaccuuuaucaugaaguaauguugaauuuuauccagugccuuuugugcaucuauugagaugaucauuuguuuuuuguccuuaauucuguuuauaugauguaucacauuuauugauuugcauauguugaaucauccuuucaacucugggauaaaucccacuugaucauguuguauuaucuuuuugaugugcuguuggauucaguuugcuaguauuuuguugaggguucuuguccauauguucaucagggauauugggcuuuucuuuuuucauuguguccuugucugauuuugguaucagaguuauacuggccucauagaauaaguuaaggagaauucccuccuuuuuaauuuuuuuggaguaguuucaggaggauugguauuaauuauuuguauauuugguauaauuugacugugaauccaucuguuuguuuguuuguuuuaauccaucugauuuuuaggcuuuuguuguuguuggcugugaaucuaucugguuuuuguuguuguuguuguuuguuuuucaguuuuugguuuuuuuggaacagagucucacucugucacccaggcuggagugcaguggcaugaucucggcucacugcagccucugcgccucugccucccagguucaagccauucuccugccucagccucccaaguagcugggauuaugggugcacaccaccauaaccagcguauuuuuguauuuuuaguagagauaggguuuugucauguuggcgaggcuggucuugaacuccucaccucaagugaucugcccaccuuggccucccucccaaaguacugagaugacaggcaugagcuaccaugcucggcuuuguuuuuuuaguuccuugagguguaauguuagguaguugugaucuuuuuacuuuuuuuuaauuaaaaaaauuuuuuuuuagagauuggguuuugcuauguugcccagacuggucucaaacuccuggccucaagcgauucuccugccuuggccugccaaagugccaggauuacaggugugagacaccaugcccagccaucuuucuacuuuuuugauauaagcauuuauugcuauaacuuuccucuuaauacugcuuuugcuguauccuacagguuuuaauagauuguauuuuuauuuucauuuguuucaguuuuuaaauuucugucaauuuuuucauugacccagugauuguucaggagcaugcuguuuaauuuccacauauuuguaugguuuccagaguucuuugugguguugauuuccgacuuuauuccacuguggucugagaagauacuugauaugauuucacuuuuaaaacauuuguuaagauuuguuuuauggccuaauauuuggucugucuuggagaauuuuccaugugcugaugaaagaauguauauucuguaguuuuugaguagaccguucuguaaauguuaaguccauuuuggucuaaaguccaauguauguccaauauuucuuuguuuucugucucuuugcucugucuagugcugugaaugggguguuaaaauccccacuauuauuguauuguugucugcucuuucuuuaggucuaauaauauuuguuuugugaauugaggugcucugauguuggguacauauauauuuaggauuguuacaucuuguugaauugaucccuuugucauuauauaaugaccuucuuggucuuauuuuuauguuuuugauuuaaagucuguuucaucugcuauaaguguagcuacuccugcucacuguugauuuccauuucuguggaauauuuuuuuccacuuguuuacuuuaguuuuugugucuuuauggguaagaugaguuucuuguaggcagcauauaguuggauuauuuuuuuucaauccaugcugcuaaucugugucuuuuaaguggaccauuuaaugcauuuacauucagguuaacauugauaugugagacuuuguuucugucauauugaugauuguuuuugaguuguuuuauaaauuauguuucuuuuucucugucuuuugucuuugugguuuaaugaaauugcagcauuaaacuaucaaaauggugccagcuaugaccuugugaccacagaggaugggaccucucuuaggugagcaguaugagcaagaagaugugaggaguacaguccauucaagucuuggucucacagcagccuauaccagggaauuagguauuguccuagguaugcauagaagagcuuggcuucccugucccuccucuaccagguggcagcugcagcaacaucaacucaaacuuggcccaaggacagggugcaccccaguauuaaauucugaaaaugcacuugggccugccaccagggaggguagagccccucaaacuacauauuuaaaguguguuauaaguucugacauauguauacacccaugaaaccaucaccacaaucaauauagugaacauaaccaucacccccaaaaguuuaugccuuucauaaucccugccuccugcccuugccuaucucugcaucuccaaagugauuaucacaaaaagagugaucugcuuucugccacuguagauuaguuugcauuuuguagaguuucaugugaguggaaucguaugcacucuuugucuggcuucuuucacucaggauaaugauuuugagauucaucgcugucauuauguguaucaauaauuuauuccuuuuuauugcugaguaguauuccauugcaucacaauuuguuuaucuguugauggccaguuugauucuuuucagcuuugagccauuacauguaaagguguuaugagcacuauuguacaagaaauuggaggcauacauauuuuuuucuguuggguaaauucuucauaguagaauggcuggcuuauaguuagauacacauuucacuucuuaagaauuguuuauguagguuuucugugcugcuuaacaaacugucacaaacaguggcuucaaacaacauaccucacauauuugugagucugaaguccaggaacagcuuagcuaguucucuguuuaggguuucaccuggcugcguuuaagguguuggccagggcugggcucucauguggagacucaacuagagaagaagccauuuacacuuuuguguauucuuagaagaauacaguuccuuauagcuguaguauuuaugucagcuuuauucuucaaagccaguaagaaagacugagagcuaguggacuaacaagacaaaagccuauauaauauaacgugaucaugggaaugacaucccauuaccuuuaccauuaucuauuggucugaagcaagucacaagucuugcccacacucagagugggggaauuacacauaggcaugaacaccaagagguaggaaucaugcaugggccaccuuagagucugucuacuacaugccccaaugauucauguucucccacaugcaaaauacauucaccucacucacgugguuuucaagagucccaucccauuguagcaucagcucaaagguccagaaucuuaucaucuaaaucagguccugguguggaugauguuccuagauguaaucuauucaguacagguucuauacacaauuucucuccaucuguagaucugugaaacuaaagagacaaguugucugaccccaacacacccaacauacaagagugggacaggcaaaggauaauaguuauagauagcacaguuaaaaggaguggggaauggaagguuaaaaaaaggguucauagcaauucugaaauccagcuggguaaauauugggaguuccaugacuaaguuucgagaccugggacuaauccucugcaguucuuugcuccauucucugggugccugguuucacccucugaaucaucuuucauuuuuucaugaaagguagcauguguuuguagcuaaguaguucuaucaggcugcuucuugccaguagaacuuugggggucugacaaccuucuuccauuuuguagugacucugucccuuuaguccaaauuggcaguuuuucuguugaaauaauuuucuuaaaaacuuuuuggcucuucaugguaucagugggguuuaccaaauuagacaaaagccauaucuguaucuuuucagauaauuucuucucuaucuuaggguccugcuugaauggcuggcugagagacaaagcccuuaaguuucauaaagacucugugguuugguuaagaggaucuuugagauaaacccuuaaucucuugagagaacccuuugugugagugaauacucuaaucuuuugaucuuucugagauauuaguaaaagguugucuacucacaccuuuuuuucucuagaucacucuguccaauguuagcaucuuucauccucuagagagaccgagaauuuucaaaaucaucaaguccugguuacuuuuuguugaacaguuuuccccucaauuuaucucucucaucuuacauuuuauuauaagcagcaagaaaaaacuuaggccucacuuucaacacauggauugggucaucacuuacaaguugugcuuucuacgagacuacaggagaccauuucacuaagcuuuuugccacuaaauaacaagugucucccuccaguggccaauaacauguuccaggucuagauuucugcucucagucuguucagggcaauuuaugcauuuuuuaucaugcuucucaaaauucuuccaaccuguaucaaugaauagucaaaaaggaaauuaagaaaugaauucauuuacaauaguaucaagaagaauaaaauaaauaaauguaaccaaggaaguacaagacuuccacacugaaaacuauguaauauuauagaaagaaauuagaggagaccuaaugaaauggaaagacaucccauguuuacggaguugaaggcuuaauauuguuaagauguuaacacuccccaaauagaucuacaguuucaguacaaucccuaucaaaauuccagcugccuuuuuuuguagaaaugggcaagcugauccugaaguucacauggaaaugugagaggccuugaauagucaaaacaauauuucuaaagaauaaaguuagaggauucacacuuccugauuuaaaaaguuacuacaaaacugcaguaaucaaaacugguugugugaaacuggcauaaggacagacaaauagaucaauggaauagaaucaaaaguucagaaauacacccacacauauguggccaauuaguuuucaagggugccaagaucauucaaugggagaagaauagucucuuuaacagaugauacuggaacaacuguauauucaccuguaaaagaaugaaguuggauccugacuucauaccauauacaaaaaucaacucacaauggaucaaggaccuaaauuugagagccaaaaucauaaaacucucagaagaaaacaaaggaguaacucuucaugaccuuggauuugacauuacauucuuuagauaugacaccaaaagcaugagcagcaaaagaaaaaauaauuuggacuucaucaaaauguaaaacuuugugcuauaaaagacauuaucaaggaagcgaaagacaaccugugaaaugggagaaaauauuuagaaaucauauaacugauaagcaucuaguauccaggguaaagaacuauaacucaauaauaaaagcucaaacaacccaauuuuaaaaugggcaaauaauuuggauagauauuucuccaaagaagauacaccaauggucaauaagcacaugaaagacgcuguacaucguuagucauuagggaagugcaaauaaaaaccacaacgagauaccaccucaugcccacuaggauggcuauguguauauauauuuuuaauuacauuuuauuucuuaaaagaaaaauaacaaguguuaguaaagauacagagaaauuggaacccucauacauggcaguggaaauauaaaaugcugcagcuauuguggaaacaauuuggcagcuccucagaauguuaaacacaaaauugucaaaagaccaagaaaauuccacuccuagguauauaaaaaagagaacugaaaacauauauccauacaaaaacuugaacaugaaugcucauagcagcauuauucauaauagcuggaaacaacccaaauguccaucagcugaugaaugaacaaaauuggguuuauccauguguugugggaugaauuguuuccccccuaaaauucauauguugaaacccuaacccccaaagugacuguauuuggagacaggcuuuuagggagguaauucagguucugagguaauaagagugggcuccuaauccaauagggcugguguccuuguaagaagaggaagggacagcggagaucucuuucuauuuacacguggagaaaaggccaugugaggacagagaaagaagguggccaccggaaagccaggacagcaccuugaucuuggacuucuggccuccagaacugugagaaaauaaauguccauuguguaauccacccaaucagugcuauuuuguuauggcagcccuagcagacuaguacaccaugcaauggaauauuauucagccacaaagaggaauuaaguacugauacauguuacaacauggaugaaccuugaaaauaugcuaaaugaaagaagccaaucacaaagcaccauguauaugguaugauuccauucauaugaaauguccagaauaggcagagccauagagacagaguuuagugguugcugggggauggaugaagagggaaauugagagguaccauguuucuuuucggagugauagaaauuuuuugaaauuacauagugguaaugauugcacaacauugugacuauauuagaaaccacugaacugcauacuuuaaaaugguuaaaaugaugaauuuuauguuauaugaaucuuauuuuuaaaaaaauuuuuaaaauucuuucagccugaaaaauguccauuaauauuucuuguaugugggucugcuagugauuaacuguuucuuuuguagauaugaaaauuccuuuauuuugcuuucauuuuugcaagauaauuuuaugaacuaugugaauaguuugccuucuaguacuuuuaaaaugcuguccauuucuucucgcuugcauuguuucugaaaagaaauuuguugucauccuuaucuuuguuccuuggugcauguauuuuuuuuuccuggcugcuaagauuuucucuuuaucacugguuuugaacaauuugacuaugaugugccuuaauguaguuuuccccauguuucuucugccuggaguuuguuuaacuucauagauuuguagguuuguuuucauuguuuggaaagcuuucagccauuauuucuucagauuuuuuuuucugucccccaucauccgucaggacuuuggucacucauaaauuaguccauuugaucauugaucccucagguaacucaugcuuuaaaaaaauuuuuuuuguauucuuuuuuuucuguguguauuucauucugggcaauugcuauuguuaugccaucaguguucauuaucuuuucuucuacaacguugaaucugcucauuuaguguauuucaugugagauauugucauuuucaucucaaaguaugauuugagagagacauauauauuuuccaugucucuauuugauauuuugaaaauguggaauaauuugaauaucuguguuaauucuagguugguuucaguugauacuuccuucauuauggcuuguauuuuccugccuggugaucuuugauuagauuucauacauugugcauuuuaccuuacuaagggaugaauuucuuuuuauuacugcauauuuucuugagcuuuguucugaaaugcaauuaaguuacuugcaaacaguuugauccauucuggucuuucuuuuaugauuuguuaggucuggagcaauguucagucuagagcuaauuauuacccaccuauggaggcaagaucuuauucugcccagugcuccaugaauugaguuuuucuggucuggagagugggaacaggcaguauuccuuguuccacgugagcagcaaguacuguucccuucuuucacuuuuuuuuuuccuagccucagguggcuucuucucauaugugcacugauaguacauuuugaaugcucaaaugaugccccacccucugcagauaucauggguucucuuccuauuucucuucuuuaagauacucuguucuaugaauccgagcugccuuggucucuggacucucaacucagggaguccaccaggcugugccucaguucccacucuuuaugccauaucuuggaaacuuuuucaaggcaauugcagguccagucucauuuguuuaucaucucaggguuuacugacuuucauuaucugauauacaguggucuugaaagccauuguuucauuguuuuaggagaguaaacccaguucauguuacuccaucuuggcuggaagcagaaguccaacauuuuuaaacuuuuuauugaaucacagcuugccaagaguaaaagggaaaaaaaaguuuuuauugaaguguaauauacacauagaaaauuacaaaguaaauuuacaucaaguaagcuugaggauuuuuugucucuacaaaaaguaaaaauaauuagccagggcgugguggugcaugccuguaguccuagcuacucaggggacuaaagcaggaggaucccuuaaucccaggaguuugagacugcagugagcuaugacugugcuaauauacuucagccuggaugaccgugcaagacccugucucuaaaaagaaaaacaguaugcuuuuaugaccagcacccagaucaagaauauugccaguacuccagaagccuuucucaugcuuucuuucagucagcuacuuaauccguacccccacaagauaaccccauccugacuuccaacagcacagauuaauuuugccuguuuuaaaauuuuguaagaauggauucauauaguauauacccuuaugcaucuggcuucuuuuauucaauauuauauuuguuaaauucaguuauguuuugcucgcaacaaguuuauucccauugcuuauaguguuccauuguaugacuauaucacacccuacuguugauggauaugugggugguuugucuagaauauaauacuauuaugaauauuuuuguauaugucuuuugaugaacuuaaguacuagacgcauaaggguagaauugcuaggucagaggauaugcuauucuaacuucaguggauauggccaaaaaaauuuucaaagugguuauaccuacuuacagccucuccaguauugugugagaguuccaguugcuccacauuugccacacuugauguguggucuuuguggguuuguuuuauuuuuaagccacuauguuguauguguguuagguuuuuuuuuuuuuaagcuuguauuagagaauaggacuagcacucucuuuaaaaugaacuaguuuauauuauaugagguuaauuuuuuugagacacaggacaggugguaauuaaaaguccagagucauacccagacucccauaauaauaaacccugguaauaaacaaaggaacuccuuccaguuucaguguaucaaccaccacguaccagauaaaaucuuauuucaccuuucacaauuuaccaguguugggcugugaauuaauauuuuuauuuuucugugcauucauaaauuaagauuauuuuauuguauuguaacuguaauuuugagacuaaagucuaaaaacaagacaucaugaaauggagcuggaggaucucuaauuggcauuuaguagguugacugaaauaccuuaaaacaggggucaggaaacaacugucuaugcagaggcuggugguaaagauuucagucuuugacaaccauccagucucuguugcaacuacucaacucugcccuuguagcaugaaagcagccauaaauaagauguaaaugaaugagcuuggcuguguacacuaguacauacucaguacauauguucaccaaaagauaggugcaagaauguucauaaauaacuagaaaacauacaucagaaacuacccacauguccaucaacaguagaaugugauauauucauacaauggaauacuauaccacuaugagaauaaacaaaugauuauuacaacuuuuuuuuuuuuuuuuuuuugagacagucucgcuccguggcccaggcuggagugcaguggugugaucucggcucacugcaagcuccgccuccuggguuuaagugauucuccugccucagccucccgaguagcugggauuacaagugccugccaccacacccagcuauuuuuuguauuuuuaguagagaugggguuucacuauguuggccaggcuggucucgaacuccugaccucaggugaucugcccaccucggccucccaaagugcugggaucacaggugugagccaccacacccagccacaccguuauuuugaaaaacaggcaguaguaacagguaugggguuucuuuuuggggugauaaaaaguuauugaacuagauagagguaaggguugcacaacaucaugaauguaacuaaugcugcugaauuguauacaguccuguguggcauaaugacacuuuggucaauguuggaccacauauaugauggucucauaagauuauaauggagcugaaaaacuccuaucaccuaaugccauuguaguugucguaaagucaaagcacaacucauuacugauguguuuguggugaugcugguauaaacaaaccuacugcacugccagucauauaaaaauacagcauaaacaauuauguacaguacauauacuucauaauaaacgauuauguuacugguuuauguauauacuauauuuuuaucauuagaguguucuccuaccaugucuuuuaaaguuaacuguaaaauagccucagguagguccuucaggagguauuccagaagaaggcauuguuaccacaggagaugacagcuccauguguguuacacaaccuuugaagaccuuccggugggacaggaaguguagguggaaaacagugauauugaugauccucauccuauguaggccuaggcuaauguguguguuugugucuuagauuuuaacaaaaagauuaaacaguaaaaauuaauuaaaaaauaggcaaaccucauagaauaaggaaauaaagaaaaaauauuuuuguacaguuguacaguguuugugccuuaagcuguuauuucaaaaggaucaaaaaguuaaaaaaauaaaaaauuuauaaagucaaaaaguauaacuaaggguaauuuuuugaagaaauuuuuaaaaauguaguguaaccuaaauguacaguguuuauagacaguccaguaaugaccuaggccuucacauucacucaccacucacucagugacucacucagagcaacuuucauuccuguaagcuccauucaugauaaguacccuauacaagguaccuguaccauuuuuaucuuuuguaccauaauuuuauuguaccuuuccuauguucaggcuuguuuaaauauacaaaugcuaaccauuguguuauaguugcccccaguauucaguacaguaacaugcuguacaggccugugccuaggagcaacaggcuguaccauuuagcuaagguguguaauaggcuguaucaccuagguuuguguaaauacacucagacuucacacaacagaaucaccuaauaaugccauucucagaagguaucccuguuguuaaguaacaugaguguaaaaugguaagucauguguauuuuaccacaauaauuuuuuuuuuuuuuuuuuaaguagcaggccagauuugacccaugggcuauaguuugccaacccugcucuacaaugugauccccaugagaagcaguggcauauaaugauuaaaaguacagacuuugggccgggcacagugguucacaccuauaaucccagcauuuuggaaggccgaggcggguggaucaugaggucaggagaucaagaccauccuggcuaacauggugaaaccccaucucuacuaaaaauacaaaaauuaagcgggugugguggcgggcaccuguagucccagcuacuugggaggcugaggcaggagaauggcaugaacgugggaggcagagcuugcagugagcggagcuugcaccaccacguuccagccugggcaacagagcgagacucugucucaaaaaaaagauacagacuuuguugccacacgaccuggguuugaccacugggucugacacuaacuuuauuuagauucuuggcuaguugcuuaacuucuuugagccucaguuuaucuauaaaaugaguauaaauacuaauaucuauuucauaguauuguuuaagaaauaaaccaguuacaugaaaguauauagaguaguuccuguaauauuuaagagcucaauaaauguuagcuauugucauuacuuuuuauuauaauaccuggaaguacagaaagagaacacuugcaguuuuggcuuugucauggaccaguugguucauuguuguuagaacaaacugacaggugcugguacaaaccuaucucuauuauuagagcaacuuucccaaccucuaugugaagagaaaagccaaacugcaugcagguuugcaguauaugcaguagggcuacauggucugugaacuguaaccucaaaguauauaaaacucuggugaaauguaaucaccuauuuauaacuuguuuuuauaaugauuuuaacuuuuaaucaagacaguuuuaaagucuaaauuaaugaagaaaaauauuuauuuuuuauuuuuauuuauugaaacaggguuucacucuguugcccaggcuggagugcaguggggccaucacagcucacuacagccucaacuaccugggcugaagcuguccucccaccucagccucccaaguagcugggaccaagggcacgugccaccaugcccagcuaauuuuaauuuuuuuuguagagauggcggucuccuuauguugcccaagcuggucuugaacuacuggccucaagcaaucugccucagccucccacagugccgggauuacagaugucagccaccaugcccagccugcuuggucauuuguauggugucuugcucuuagucauauuuucuauuucugcuuuuguuuuacauucuacaucugucaauuccaauuucugaaguccuugcugauccgacuaugcuguuucugccugcucuuuuucaagaugccuuguuucuucguggaugugauucuuaaaagugauuucuaaucucauaacuuuaccugugggaauugaggucuggauuaaugaagguuucccuagagcuauacuguccaauagaguaggcaccagccacguuuggccauaaguuaaaauuaaauuuaaaauucagcuccucacucccuagccacauucugagugcucuauagcuauaggagggugguggcuacuaccacacuggacagcacaguuguaaaauauuucugucaacuccaaagguauguaggacaacugugcccuagagaucuuuuucucuuucugccagguaccaguaggcaucaucagccugggaaaccacuuucaacuagucuugguuugagggguuuuuuugaaccaugcagguggcauaaaauuguacugcaaagauaagugaagccuuguuugagauuaugaauucucaggagagaucuuuuuucacaauacuguugcugugggccagaagauuauccauggauaauauauccuguuccuuugcccagaugaugagaguaauguugcaguuaccagacccgauucagaaaguuccugugugcugagugaacuacauccuuugguguuaccgcgagugccacagucuaaggugcuguacauuaccucaaauccgguaagccccagagggaucaguuggagaccccagggcuacucucaccagaggaaauuugcucagaguuguuugccuuacuuguaugauuucugacucaauauguuuuaguacaguuauguguuuaucauaauaauccagugacucuucgcauugguuuguuuaaaauauuaauagcaaauuagaguugauaaauauuucucagucagcucuucuaaggaggcaucuguaaguugugcaaccuagaaucaaccauguggucagccuaagucuguuuugggaagaauggaggauacccuuaugauaaaaaugacucaucuuagauucucuauggccuugacauuguccuuugaacgccuccuuccuuuugaguuuuuccuuccuuuuucucucaacuuggcccacccuguuuauuuuuuauuuuuucauuuuuuuugagacagucucgcucugucacccaggcuggagcgcaguggcaugaucucggcucacugcaaccuccgccucccagguucaaccaguucuugugccucagcccccugaguaccugggauuacagaugugcaccaccacucggcugauuucuguauuuuugguagagacagaguuucaccauguuggccaggcccgucucgaacuccuggccucaugugauccaccugccucaggcucccaaagugcuggaauuacaggcaugagccaccaccgcaccuggucccuguuuguuuuuuagagagaggagucucacuauguugcccaggcuggucucaaacuccugggcucaagccaccuucccaccucagccuccugagucgccaccauacccaggcuguuuuuguuuuuuaauauuuaaaucuguuaacuuuuuugccuuuuggauguuuaguacucauaaaccagguauaaaaaucaaacaaaaacaaagagaaaagcuauuucaagugagucugaacaagcacaaagaugguauuucuugcaggaggcagaugagauuggucuuaucccuguguaaugauuuauguagucucaguuccuacacaauaguuuccugguguuacuuuuaagguggaaaaaaaaaaccagagaaagguguuggcauauuggccagauguuauacagcuggauuuacaaaacagguauuuaaaaagaaaauuaggccaaggugggugggucauuugaggccaggaguucaagaccagccuggccaauuuggugaaaccucaucuauacuaaaaauacaaaaacuagcugggcaugguggcaggcaccuguagugccagcuacucuggaggcugaggcaggagaaucacuugaaccugggaggcagagguagcagugggcugagauuacgccacugcacuccaaccugggugacagagcaagacuccgucucagaaaaaauaagagaaaauuaugaaggcucguaagucaccacaccagggaugaaccagguaaauuaauguuccuuuugugguaguaaagcacugcugcauguugaacugguguggccgugguuuagugaccuaagcccugaauaguuagacguucuggucgcugaugaccuaagaaaggagaagaguuaauucaaacauucugaagagaaagaggaaggaaaauacauucuguggcagcggagacugccagaaaagccaaugagcugaugaccugagaaaacaagcagggcucuaggggggcaaugccaguccaagaaacauuacauccugcuaaaauuagaacagauaagcuuaccuccuaguacagagucuucaggauuuagguuaucauugagggcugaccugcuccacagguagugaaagagaaggauuaguuuguacagagugcaggauugugugaugaugaaagagauuaaguuacaguuuccccuuacuauuuucuauuauuguuccauauuuugucugugaguuuucucuucuauuuuaauguaaacaauaauaauaaagguccucacucccuguaagagggcuguuaauuguuuucauccagauugaucaggcuuccccuaccugcugucauuuaggaauggagaggaaaggagggacccuaucacauggacaguugacuuggggccccagcuacgggccccaagauguuauaaaaauuaaagcauggggaaaaaguauaaauaaccaaauuggaaauauuaacuuuuggcaaaguuggaaaaccaaacagguaucuucuccaaccgaucaagaguacugucuucuuucaacacguagaugagucucugucaagcaagcagacaucagccaaaugugaaugaucucuugguucauggaaugccucuacagccaagaaaucucucccuaauggacaagcuccuguaagaaguucaacauuuucagacuauacaguguaaaagggaaacagagggaaagcaaaaucaguuuaucaguaugcauguauugagugccaaccaagcaaccacaaaaacuccuggggaguaaaacauccaagggacauggucuccaccaucagggggcugauaauguaacuggaaagagaagacauacguggguaaaaaaagaccuaaccauauguggcauuuuuguaacugagugccaugugcgugcuguccagaaugagugcuaugacagccccaaagcauucugguggguaaguguagguuuugaacuuguccuugaaagauggggcuuuggauaagcaaaggagagcagcaagggcauucuagguaggaggaaugauauggggaaagguuuggggauaagaaaauacaaaauauuuaggaaagauagcagaucacuuuugacauagaagaacggaaaauaggucagaacuuuaaugcuucugaucaaagauaauugacaaucuucuagaauuaaaauagaccauggugugauuagcgggaaagaagugacuauggaacuaaugaauguuaggaccagauuguggagaguuuugagugucagguuuuugggauucauccacguuguuguguaugaccuccucccuugcugaggaguauucuauuguaauacacacaauuuauccaucugcucuccuguuaauuaauuaacaagggucauuuccagguuagagguauuacacauaauaaaguuacucuaaauauucuuguauaggucuuuuuugugguuuuacggucucauuucucuugaguugauaccuagaaaugaaagggucauagcacagguauauguuuaguuucauaggaaacugccauacgauuucccaaaggaguuguaccauuuuacacuccuuccagcaauguaugaauuuugguuugggagcacauauauuuaaaucaggaaucugaaagaucgauuucaccauaguguaaauggauggaguggaaggaacugaagguaaggggucaaugcaggaguccacgcaugagcuacuaagggucugcacucaagcggccacacagggugagaaacgaaugagcuauuuugggagugaaauuuaagugaaauucuauagaaauagaggaaucaaaguuaucucgauuucaagcuugagggaagccucuguuggcggaaaagauggguuucuucugggguguguuuacagugaggggccaucucacuggcaauguggaagaggucggaucuagagaccaaucuaaaagucaccuggcuagagaagacaaucaaauccagaaguucauagaacaaaauaaaggugaacauagggcagcuaaagccuaaacauuuuguaauuagaaagcaguuaggguguguuaaaaaaaaaaaaaaggcauaagugaauugcuagagaggcaggaagaccagaacagucuccagguuuagcccuguuccuugaugggcagcaucccuucaaaguccuccaagcacggugccauguuuugcacuagaggacaccaaaguggccugaaagguugaggaacuugcugaaagcuauaggagcaaauggcagagcuuagcugcguuauucuuucacuucucuuccauuuaauugugcggauacucuuagaugucuuaaaauagucaaauguccucucacuugcuuuaaaagaaaaaaaaauacacaccugaaucuguagggcaguauuuaagcuacugaacuguuuaggugugguauuauuuuauuuauuggacgacuuacagaaaaggguuguauuucaguuauuuaugcaaauagggcuacuguggucccaacagcucuggcucugggcagcacaagacccuuugcccacucccagcuuuccaaagaacccaaacccaaaucccugccagcuccaacuugcucagcacuuuaauugcuacagugggagccacacuggugccacaacugcucccaagcagcaauauuugucuuucaguugucuuucuggugacaaucuuucagcacaaaagaaugccucaaacagaguaggaaucagccccuguggcaaauuuuugggaagcacuuuggaguagguguccuucaggcuugccuucacuggugacuaaaaaagugacugugauggcagguggauaauggacuugcuuugccaaauguccauucuaguaaauuauguuuaugauugaaauaaugucccacuuuuaagaacagauucucaugccugagcuagaguaccaucuggaaacuaguguuacuuauugaaagguuuuuauuuuugcuuuauuucccccuaaauguaguuucuagucuaaggcuuuuuaccccguuagucuugucuuccuugacauacugaucuuuacuucauuguggguuucugauuuggcuacuagagaucuugaugacaagcuacuuaugaggccuggguccaguaccauccuuucaacucgaaauuggccaaaucgagcuguggaguuuaguacaucaucucugucauacacagugcaguccaccaggagacgcaauccaccaccacgaacucuucauccgaucagcacgagccauucaugugcugaaacaccaagaucuguggaagaaauccucagaggagcccgaguguagguuucaaaagcagaacuucuggaaaccgugguaaaacuaacacauuuuacauacagaauuaauuuaaauauaagacugaaaucuaugccuagaaacuaaucauuaaguagucuuaugacagauugcccauggguuuagauccaacacaaaauuuuuuaaugugguuaaauuuuauuuuauuuuauuuuuuuagauacagucucacuccugucgcccaggcuggagugcaguggaugaucauggcucacugcagccucaacuucugggcucaagugguucucccaccccagccucucaaguagccgggaccacaggcggguggugccaccaugccagguuaacuuuuuguguuuuuaguagagacaggggucuugucauguugcccaggcugguuucaaauuccugagcucaagcaaucugccugccucagucuccuaaagugcugagauuacaggugugaaccaccgcacccagcagggguuaaauaauuuuaaugaaauagauauugaaucuuucuguugaucuagcuaaagaguucuauuuguaaaaauaaaauguuggcuagaauacuauauugggguuacaaaaggaauaaagaaccuauuuauuuaaucaaacauuuuccgugcugggaacauauucagugaaauucacuccaaaauaauaguuaauuccccuuuaagguucuucuguaccauugggaucugcuuauuccauugacaaugaaaacuucauaaaccucagauaaguaguugcuuacauaccagcaaaaauaucccuuagcacuuccuaggaagugacacuaaaaguaaucgccuuucccacccuucauucacuacacacucugagccucaucaugcaaaaauaccuaggagccaauuuuaaacauagaauucuuuuagcuguugauucacaaaaugucuuaggaugauuaauuucuaaaaauauccucaaagguaugagauaauaaggccacagcaguguuuucaaugcggcuuccaaguuaagcauuauuauguggauguagcuauaucuauaccaacagagcuauaaaugcauucauuuggggaugaguagucuugauguauaauuaaucucucauuccuucugacaguacuuuuuuucaaaguugaaaaguaaguugcuuuguuacuucugggacaugaaaguaucauucaguuucaauuacugucuuaaggauaaggaauacugcaagcugcuccagauccuacugaagggaaugaagguuuaggaacuuuacccgagaacuauaguuauuagggaaaacgauaaccagaagguccagaacugucaagaauuccaucaucagcugggaauuuacaaauccaaaucagcagagaagugcaauaccagauagggacaaauguuuuauuccaguucugugggagagaaaaggccagcuucuguuguguacccagaguauagagcuucaaaacaaaaucagaaaacacuauuuuaaaaacuaauuuuccaaaaauccugagaucucuacuugaaaacauagguagccuaaagcuuucugugcacauuaaacucaucugcuucauuuaucugauuucuaaucaauuugcugguauuguuauaacuucaugcuuucauaccuucguguuuguuggugggaucugcagcccaguggcacccgacucgcucuccucucccucaccgacgccccugagucgaaauaaucugcuaccaccuauuggcacagcugaaguggaacaugugagcacuguggggccacaaagacagaugguauguuucuuucauauugccucuccauguacuuaccauacaaccuaaugggcaguaauucugcaggaucugugcccugaucuugauuuauacuguguuuugucaaaaguacaaacacagugcuaauuuaugacguggaauuggagcuguuuggccugcacuuaccauaucugccauggucgauaggguuuuaacuacauaccacauuacagauaguuuucacuguuucuguaacuuuugucuccucugcagaaaccccauggcgacucuagucgagcucaaagugcggugguggaugaaccuaacuaucagcagccacaagaaaggcuccuuuugcccgacuuuuuccccaggcccaacacaacucaaucauuuuugguagagugacguacuuccuagaauggucuugauaguuggggaaagaaaagguggggggaauaauaguuuggcagacuuaagauuuuaucuagaggcuuaacccagaauaaaaguugaguuuccaacaauaaaaaguguuauaaauacauuuuguucaaauucuaacuagucccugaugccuauucuuuaaugccuuauacagaaaucacaaauauucuaagcaauuuaacacuuaagauaugucugaccacaagcaagaauauuaaaucccaguacacaucagauaagcauaacuuuauuauguaauccuguucuucuggaauuacaucaaaaguggucucagauuaugaugaguccugguggaugagugaguugggacuuuaauaaaaaauuuuuuucagaagcaggcucuugccauguugcccagacuagaccuggaacuccugggcucaagcaauccugccuuagccucccgaguagcugggacuacaggugcacaccacuguacccagcuuaggacuuuuucuuucuacugguguuuuaaaugcugacacugccuaccauuuauuaggcauuuacuagcccuuuuaaguaauagaaaaaaccugaucagcaauggggucaugcacugacccuccccauuuguaggcugggagcucgaccccacauaaucugcuuuguggcaagagcacuuggagagccuggggaaguaaccagggaccccacauccugacaguuuucaggaugguaguguuugcagcacacuugucccaacucaugacccuugaaccacagcaggcuaaagcacugcaaaguuuuucuucuaugagaagagugguaaggauaaucaauaucagaccucuguauuaguuuccuagggcuuaagaaaugaccaaacaacugggugccuuaaaacagcagaaauuuuuuccucacaguuccagaggcgagaaguucaaaaucaaggugucaacagagcuaugcucccuuugcaaggucuagggaagaaucuuuuugucucuuccuggauucugguggccaccugugaucccugguguuccuuggcuugcagcugcaucacucccaauuucugccuuuuuuuuuuuuuuuuuugagacggagucucgcucugucaccuaggguggaguguaauggcgcaaucucagcucacugcaaccucugccuacuggguucaugugauucuccugccucagccucccgaauagcugggacuacaggugccugccaccacgcccagcuaauuuuuguaauuuuacuagagaugggguuuugccaucuuggccaggcuggucucgaacuccugaccucauuaucugcccaccucagccucccaaagugcugugauuauaggugugagccacuguacccggccuuuuuuuucuuuucuuuuuuuuuuuuuuuaagacagggucucacucuguugcccaggcuggagugcagagcacagcucacugcagccucaaccuccugggcuuaagugaucaucucaccucagccuccugaguagcugggacuacaggcacaugccaccaugcccugcuaauuuuuuuauuuuguagagauagggugucacuauguuggccagacuggucucaaacuccgagguucaagugauccucccaccucagccucccaaagugcugggacuacaggcaugagccacaugcccagccugccucugucuuuacauggcuuuccucccugugugucuguguccaggguucccucuucuuauaagauaccagucgcugaauuuagggcccacccuaaucuagugcgacuuuaccuuaacuugauuuaucugcaaagacccuauuuccaaacuuggucacauucacaaguuccagguggacauaaauuuugagggaacacuguucauucuaguagaccccacgaggcugacuuagggagaaacucaccaaaaacaagaaaaggaaacaugagcauuucugauucuugggguucagugugaaccccagaaaguuugagaacuucuacugaauuugccuucuuauaaucugacacaggacauuuauuaaguaguacuugaugauuauauuacacagcuagauucucugaaacuuuuuuuuuuuuugagacggagucuuacucugucgcccaggcuagagugcuguggugcaaucucagcucacugcagccuccaccuccuccuggguucaaucgauucuccugccucagccuccugaguagcugggacuacaggcaccugccaccaugcccagcuaauuuuuguauucuuuuaguaaagacaguguuucuccaaguugcccaggcuggucuugaacuucugaccccaagugauccaccuaccuuggccucccaaagugcugggauuacaggcgugagccaccgcucucagccaaacauuucauuuuuuuuaagagacaaaguaucucgcuacaucacccaggcuggaguguaguggugcaaucagcacacugcagccucaaacuccugggcucaagugauccucccaccgcagccucccaaguagcugggauuacaggugugcaccucugcaccuggcuaaaaacauuuaauuuuugauugccuuaggaauaaaacugaacagaugaaaauguuucagucuucucuuuaaguuuauuaaaaaaaaaguaaaaauuacuuaccauuucucuccccauuugcugucauaaaaagggagauagcuaguuguuuaguuuauuaggaaugcuagcugugagccggcugcaguggcuuacaccuguaaucccagcauuuugggaggcugaggugggcagaucaccugaagucaggaguuugagaccagccugguuaacauggugaaacccguuucuauuaaaaauacaagaaaauuagccaggcaugguggugcaugccuguaaucccagcuacucgggaggcuaaggcaggagaauugcuugagcccaggaggcagagguugcagugagccgagaucgugccauugcacuccaaccugggcgacagagcgagaagacucuguccccccacaaaaaaaagaaugcuagcuguccugggccuggcacuacagacuagcacuuugcuccuugcuguuuucaucuagaauaggggccaguaaacuacaguuccugggcuacucacuuggccuaccgccuuguuuuguaaauaaacuuuuauuggagcagugccaccaagcucauuuaugugcuaucuauggcugccuucauaccauaacagcgaagcugaguaauugcaacaaccacccuaugguccacaaagccuaauauaauaacuaucuggcccuuugcaaaaaauaaguuugcugaccccugaucucuaaaauauaggggcuucaccagaaaaagcuuccugaaaucucuugauuucagugcucucucaagggaacuacugggggauguuuuuauuccagaagccccagcaggaugucauauauagcuuuauuugauauuugcauuuuaauauuguagucguaucucuacauuuuuuaauuccuugagguaacugugaaauauuugcauuucauaaugcuaaaaaguaaauguaaaguuaaauuucgauauggugguaaagucauaaguauuucaauguugcugaaaaggcugguuguuuuaaaugaaagcauucauuuaaaauauaugcagcagccaacaaaaagaaaugagacgaacccccuuagaacuaacugaaauauuaaaccauauggauuauuuauaacuccugauuuccuuaacggcauaguaauaauauugaagaaucugcaauuuuuacaauaaauggcuuugugggcaucuggcuugggauuuucuacuugaaauucaacccagugcacucagcugacuuuucccucaaguugguagucuaugccuuuuaccacuguugauuucaagguguuccugugaaccugcuaaaauauuauccuuugugagaagaugcaucauaagaagugucuccucuuuugucuuguagcuggauacacaguaucgucgcucaugugcaguugaguauccucaucaggcccgaccuggcaggggaucugcagguaaagguggggccauggcccuuauuuacuacugugugguuguguuaagacccagccuuugucuuuuuuccuacaccuauuuccccuucuuucagauuuucuuggauuuaauguuuucccacaucuuuguaaaucaccuaaaauucauuuuggaacaugggguauaauaaaaagcuaggagaguucuauugcucagagccaaaaaguuucagauuccuauuuucuucauaccauguaaauuaacuucucacuacuuugguaaacugccuuuuuuuuuuuuuuaaaucuaaaaaguucaacccaaauuaguccuuguuguaauguucaaaauauucuuuaagaacauagcauggauuuuauuaugcaggcaaaauccauauuccuauggauuaaacugcuuugaucaguuaaucuguuaggccaagguaagaaaagaaauucuaaaccaucaggauaugcugagucugauucuaucgcauuaacucuuuuuaucuuuaaauuauacucuguagauguacuaacaaagaagugaugggagaaaauugagggaugucuuuuuugagacagucucacucugcugaucaggccagaaugcaguggcaugaucauggcucacuguagccucgaacuccggggcucaagggauccucccaccuaagccucccacauagcuagggcuacaagcagugccaccaugcccagguaauuuauuuuuuguagagacagggucuugcuauguugcccaggcugcaggaugucuuaauucuuccugugacagucuucucaccaccaucagggucauucuuauuaugcugaagguaaauuuagaaguaauggacagcugagauguuuccuguuaaugaucaaaauaaucagcaacuaugguaaaaaacuagucugccucaaaccaucuuuguaguccaagugauuucucagcucaguuccccgcagcauugucugguagucuuugaaugcuuuugucagauuaugcuuucagaucugcauuugagcuacaauuucagccacauugaaagucagguauaacuggcugggcgugguggcucaugccuguaaucccagcacuuucggaggccaaggcgggcggaucacgaggucagcauauugagaccauccuggcuaacauggugaaaccccaucucuacuaaaaauacaaaaaauuagccgggugugguggcagaugccuguagucccagcuacucgggggacugaggcaggagaaugaggugaaccugggaggcagagcuugcagugagccgagaucaugccacugcaccuccagccuggggggacagagugagacuccaccuccaaaaaaaaaaaaaaaccucagguauaacuuauguaacacugaaguggaagugaguaaaucagacaucuugcuucuuuuuaauuagugggcucuucuacaaaacuaguuuacugcuuucauaccuuaagaaaguccaauucauaauuggagcaaaaaagcccuuagcuauaaacuugagagugauuaucaaaccuagacugucuacuaauguuacucuaugucaucugacagguccucaguuacaugggucuacaaaaucucaaagcggaggcagaccagucucucgaaccaggcagggaccauaaggcaaaugagaagaaucuaucaggcugcaggaaacacgagauuucaugaagcaguauucagucaucaagugaugcagagcuuguauagaagaucgacuagaaaucaucuucaugaagagugauuuuggcacaagugaccgaagaacaaaacaccauagcagccaaaaaugacaugaguguuguuucuaucuccaguuacugucucuuucagcagaaauuaaccuaucccauuggaaaggcaaguuuguacccaaagaugcaacagugaauaauacccaaaucacugcucauguuaucucuuaacaaugaucaguucaaucauauaggauuugaugagcucacacauacacaaaaagcagcaaaucaucagugacaauaucacuggcuucagaauacuucagccuguguucauuucuggagaguuguacucaguuuuaagucauuuugcuguugaaaaucugaccucaucaaauagaugucauuccuaaaacucucuuuagauguccuacccuaucagcagauuaaaauggaagggguguguaacuaaaaacauaaauguuaagcauuaguauaaaguaacuucuguaauaaauuauaucgcauauuuuuucagauaggacagcucaaccuuacgaugccuaccugaugccaggugaugcuuauuuucuuccuaaaguagguuacuggucauaucuuuuuuccaaauauuaaaugcaccuugccagauauucuccugcagcucuaaggaaaggaaaucaauuuaaaaauaauuuguagaaucuacuauugagccaccaaaguauaauucccuaaaaguuuaagaaacccuggcaauuaauucagcauaaacauauccuauaaacagcaggagagguucagcuuucugauuuuacuguggaccuuuuccuaagggcauucaugaaugcagcaacaguuuuaacuauggcuuacauuuauuuuaaauuucacuaaauacaaaucuugauugucaugccaguuuuagaucuuauuaauuuucagaauggauaaauucaaauaaucauaaauuacgguaacuuuuuauuauaccaagguguucuaaugccaucauaugaagacagaugcuucaaacaaccugcauuaaauuauauuuuuaauaaaauuaaaaucuauuuuuaaccua

SEQ ID NO: 192470 - RNA, 122043 nt, Homo sapiens
guagucgcugcacagucugucucuucgccgguucccggccccguggauccuacuucucugucgcccgcgguucgccgccccgcucgccgccgcgaugccaguguuucauacgcgcacgaucgagagcauccuggagccgguggcacagcagaucucccaccuggugauaaugcacgaggagggcgagguggacggcaaagccauuccugaccucaccgcgcccguggccgccgugcaggcggccgucagcaaccucguccgggugagcgcgcagggccuggcgcgggagcgggcgcgggagguauccccggggccccggcccgcgucgcggcugccuguggccggcucgcuggccguggcuuuccgcguggguuccggagccaggcgccgaggguucgaauggccucuucuccgcccugugaccuugagcgaguccugagccucuccgggccucaguguccucaucuauaaaaugggagcagucaugaaaaaggcugccuugcgggcuugucgugaagauauggcgagguauuauucguggagugccucgcgcggcguguggcccacagcagacacccaauaaaugagaguugcugggauguccgagggucccugccccgcgcaggcuucgcccccacguugacuuccucgcucucagcgccuuuuaggccuccucgaucuggcugugcgggggagggagagcgggccuucccacggaucccuugccuucucuucuagggauccuuauuugagccacguuguccuccuuucuaauacuucugccccucacccugagacccgccucgcccacccccgcuccccagagcucccuguauuccgcccuuuuauucacuugccucacucucugucgccuccuccucccuccugggcauuuuacuuaugcucacuccucuggcacucucacaccuuuaugcagucauucgugaccacaagcccgguuuuuccuuccgcucagcccugcugcccuuccuuucauucccuccuguggacauuuucaccuggcguuaccugcugucaaacggccuccucccacuggggccuuucuagacucgggggcccuccuuggccccuccuccuggcaggaagcaagauggagcuguugggagaggccuguggaaucugggaucugccgccccugccggagagaaggcuggggcauccgcuccccauccacaacuuuccugguggcucugcagaccccuguaacccacagcugugacucauaaccgaggugauuccuggaggagguggagcccacgucugaaaugggaaaaaagaggugcugagaccagucucccaagacuccccuggcuaaugucacacuuuucuuucccacccugggugggugacucagacugguccugcuugugaggaacaauuuuggaaaaaguucauacugcucccccacugagcuguguaaauagugugugucagggcaguugggcggcaacugugggucugucuggguggggcuuggguuacuuuucugauuugagcacuuuagugcacuuagaggcucuuuagcagcugaaagucuuccucagucuucaggggucccuggacugucucaagcaauuuaggagacugguagcuaggaagacagggugacaccaccgaccaaauuccugaucuuucuucucuauagcuuuaguaagaaucuauucauucaguaagaaugcuguauucauucacaaugucuacuuguacauuguucuucuuuuuauaacuaauuugaacagaacacuccagaguacauucuuauguaguguugucuaacauggcugcauuccaggccuccauuuuucaacaaauaggaaacaauguaaagagacaagguaauagugucucuccauguaguacuucaggaaaugaaaucuuaaaaccacauguugcacuuggaacagagcuaguguagucuagggguugauaucugguuaggcuauuuagagaaaaguuauuuaugggcuuccaugccaugaauuaauaagcauugaaugucugcuauauggaaaacacugcaauaaaucagugcuucucagcuuaagaguguucaugaaaaucaucagugaggcuuuuuagaaauuaagauguccagcucccacgggucaaggccuuuguauuuugcuuuuuuuuuuuuuuuuuuuugagacagggucucgcucugucacgcaggcgcuggagugcaauggcgugaucauagcucacugcagccuccaucuccuggacugagaaaaauccucccaccucagccucccaaguagcugaaggccuuuguuuguuuguuuguuuguuuguuuuugagauggagucuuccucugucacgaggcuggagugcagugacacgaucugggcccacugcaacguccuccucccagguucaagugauucuccugccuuagccucccgaguagcugggacuacagguucgcaccaccguggccagcuaauuuuuguauuuuuaguagaggcgggguuucaccauguuggccaggaugaucuccaucucuugaccuugugauuugcccgccucggccucccaaagugcugagauuacaggcaugugccacugugcccggccaggccuucguauuuuuuaggaagcuccauaggugauugugauauacggccuuaguuaggaaacacuguaauacacacugugagacaaauacaaaagaaauaagguuauaagaugaaaacaaugauauguaguuaaguuauauacuuuccaacacauacaaaagaggggacuugagauuggugguagcuauggguuagcagagacaaaguagggaggauugugcugauaaauaguuaaucaugaacaaagguacuugugaguaagucacuuccagguuacagcaaguagauuaucuugauugcagcucaggagacaaguuggagagaaauuggagaugaaguuagugcgugacauaugggcaguguaacauaggccuuauccaaaaggaugaacaaagagagcaggaggggaaggaggaugagaauagugugugagaaagacugcgugagaauggcgugugagaauaguauaguguguuuuggggaggccagaggaccuacccauugcuucacauucuuggugccaacugugaccguuaaauauguggauucuguacaugcuucaagauuguuccuggaggucaagccuugucugauauuccucucuuuuuaaaaaauuuuauuuugguuuuaaauagagacagggucuuguuauguugcccaggcuggucucgaaucccugggcucaagcaauccucccgccuuggccucucaaagugcuggauuacaguugugagcuacugugccuggucugauauuucuuuauaugguccucaguuccugcccucaaaauuggcacauaggaucacucaauaaauauuguugaaggaacuaugggaagggagacaaauugggaagcuuuuaaaauugguugguuaugaagaaaaugaaggccuggacuugcgaguggcagggaaaauggagaaggaauuaaucagaaauauauuagaagaagaaauaauagaacuggauaauugaacucugaauuugcuagaaaagaaacauaguauuacgguaaaauaaugaaacugauuuuagaacaaaucuucuggaauuuauguaaucugggugaguauuucuugggaguuacuuugggagguuauauccuuauucuagugcuuuucuuugggaauuucuuucagauuauuuacauacguaugccaaauuagucuuauuuuggucaagaaaguguacauuuugacugaaguaggcauucuugagcucaacuacuucauuuacuguucuugagccuaaaugacuuuuggauauuuccauaauuaaaauuuacuagaugaagaugaaauuuucaauuguuguaauagucauucacuuaucaagcagguguuuauugagaccccuuccaaugucaaagcaauaagugugaugccugucacaaucaguaugauacugaauuggaagucuuuuuuuucugagauggaguuacgcucuuauugcccagguuggagugcaguggcaugaucuuggcucaccgcaaccucugucucccagguucaagugauucuccugccucagccucccuaguagcugggauuacaggcaugugccaccacgcccggcuaauuuuggauuuuuaguagagacgggguuucuccauguugguuaggcuggucuugaacuccugaccucagguuauccgcccgccucggccucccaaagugcugggauuacaggcgugagccaccacgcccggcugaauuggaaaucuuaaguggcacugaggaaacagaguaugauggaaagucagaggaagacgagauuacuuuugauuggagaaucagggaaggcuucacagaggauauaacauugaguugggucuuaaagacagauaggauuugaauauuuagagaugugguaagaaagguauuacuuggccaaguaugguggcucaugccuguaaucccagcacuuugggaggccgaggcgggcugaucacgaggucaagagauggagaccauccuggccaacagggugaaaccccgucucuacuaaaaauacaaaaauuaacugggcaugguggcacgcgccuguagucccagcuacucgggaggcugaggcgggagaaucgcuugaauccgggagguggagguugcacugagcugagaucuugccacugcauuccagccuggugacaaaggaagacucugucucaaaaaaaaaaaaaaaaagaaagacauuacuuacuuuuaugggggcagaacucauuaggauuuguaauuucauguauauuugcuaagcaaaguagucuggucacugauauauauauauaaauauauauauaaaauuugcaacugggucaucacuuuuacuccacaauuagggaggggguagggugggaguauuuauuuauuuauuuaucuugagauagagucucacuguguaguccaagcuggagugcaguggcgugaccucagcucacugcaacuucugccucccggguucaagugauucuccugccucagccucccagguagcagggauuacaggcauguaccacuuaaaacucuauuuaaggcaguuuuaaacacagagagugaguccaauucaauaaugaaacaaggaagaggagguagucaagggaagggugggaaaggaaaaauaggagaagggcacaagaaauucuaagaaggcuuggauucagcaggcagugugaaaaagucacaagucuuagacugaguacuuuguagcaugguauauaaauuuuucuuuuuuucauuaaaauggcccauagaaaugugucagucugugaugugacauuauagucaugccaguuuuguuaauggggcuucagauacuuugcuuucuccagugcaucugagagcauguguuguaaguacuccuugggcucaugaaauauuuauuuugggaguuuuuuguggccuugacuuuuaugggccucacuuguauaucauauguucuugggaccagcucugggacaaauagcaguauuaucuucacuuuacacugauaaaugggaaagacugcucugcucuuguuuuguuguuguuuagagauggagucgcucugucgcccaggcuggagugcaguggugugaucauagcucacugcagccucgaacuccugggcccaacagauccucccaccucagccuccuuaguagcugggacuacaggggugcaccuccaugccuggcuaauuuaaaauuuuuuuuauagagauaggguuucacuauauuuccaaggcuggucuugaacuccuggccucaaacaauacugcugccucagccucccaaagugcugggauuauaggcaugauccacuguguccagccuacucugaucuuaaaaggagaucagcaguuaauuuugucauuuguaauuaucaguauuaacaucugaaaauauuuuugcuuuaaaauuugguugauauuagacuuuauuucaguuaaguaaauaacaguguuugggugggugauuuuuuucuucuuaauauauuucuguauuuuccaauuuuugaaaauuaauauauaauuccuaugcuaaggaaaaaauagaguaaauaaaaagaauauuuaugugaucauuuauagcucauaaaauacuuuuauauuuauaaucucauagcagucuauggguagguauagugguggucuccguuuuacagaugagggaggauacuguaguucagauaaauuaaguaaccugcccacaguggcacagcugguuaaccuggacuugaacuguggucuguuguuccagauccucugcuuuuuuucacaccaccauuccacaucuacuuagagcaaaguuguuaaauaucaguggagguuucccaccuagaaucagaagcaacaggaaugcuguuagucauagagguuccauuuguccugggucuggcaacaguaucuguuuagagccuggcuuuagcauagccugcaugaauggccuauaugagaagaaugaugugaagguaagcuuguuucauagccacacccaauuucauagcauuucuuuucuuuucuuuuuuuuuuuuugagacggagucucacucucuugcccaggcuggagugcaguggugcgaucucagcucaccgcaaccuccgccuccuggguucaagcgauucuccugccucagccucccgaguagcugggauuacaggcaugcaccaccaugccuggcuaauuuuuguauuuuuaguggacacuagguuucaccauguuggccaggguggucuugauuuccugaccucaggccauccacccuccucggccucccaaagugcugcggucacagacaugagccaccacgccugauccacagcauuucuuuuuugagaaauuagaguagauacagaucagcacaaaaguaugccugcaaaacagaugaagaguuuuugugguauaugugccugcuuagcuugaagccuguuagaaugaaaucguauguaaaauaacuuuguagauuacuuggggaaucaugaaguuucauuuguaaagcuguugcuacaucaaaagagauguaagaacgagacagauaucuauaucuauagauagauauauguauuuuucuuuuuuuucuuuuuugagaugcagucucgcccuguugcccaggcuggagugcaguggugcgaucuuggcucacugcaaccucugccucccagguucaagcgauuuuccugucucagccuccugaguagcugggauuacagucgugugccaccacgccuggcuaauuuuuuguauuuuuaguagagaugggguuucaccauguuggccaggcuggucucaaacuccugaccucaugugauccacccgccuuggccucccaaagugcugggauuacaggugugagccauugcacccagccagagacagagauauauuuuguuccaaucauuuuuaacauuuacucaugugacugagagaacagaagauuuuuggagaugggcaguuauccgucgguauccaugggggauugguugcaggaaccccccucggauaccaaaaucugcagauacucaaguuacuuacauaaaguggcaugguauuugcauauaaccuaugcacauccuccuguauacuuugucaucucuagauuacuuauacuguaauaccuaauaugauguaaauguuauaaauaguuauacuguuuuuuuaauuuuuauuuuuauuguuguauuguuuuuuauuuuuauuuuuauuuauuuauuuuuuugagacagagucucgcuguuucacccaggcuggagugcaauugcacgaucucagcucacugcaaccucugccucccagauucaagagauucucccaccucagccuccugaguaguugggauuacaggcacccaccauaaugccuggcuaauuuuuguauuuuuaguagagacagcguuucaccuuguuagccaggcugcucuugaacuccugaccucaggugauccgcucgccucggccucccaaagugcugggauuacaggugugagccacugugcccggccuauuuuuauuuguauuuguauauuuuugaucuccaguugguugaauccauagauguggaacucaaggauaugcagggcuauagcuauguuuaaauuuuaauggaaccacaacuuaaauguuuguuuacauccacacaguggaaaauugggcuuuucuaaagcuguuuuauaaauagagcugguauaacucuaaauggacaaaguaagagggcaaaaguccucugguaucagcaacaguagcuuagauuggguccuccuguuacaguccuggaguaaggacaacaguaggacaaacuacuuuuauaggacucauuugaauuuuacuauuucuuagauauuuguuuaaaaacaaacuagccugguuauuucauacacagguugaguaucucuaaucugaaaaucugaaaucugaaaugcuccaaaaucugacuuuuugaguauugacgugaugccacuuguggaaaauuccacaucugaccucaugauagguagaagucaaaacuuuguuucaugcacaaauuauuacaacuauuauguaaaauuaccuucaugcuauguguauaugaaacauaaaugaauuuuguguuuaaccuuugguccuaucuccaauauagcucaugauauauaugcaaaaauucccaaauccaaaaaaaucugaaauaugagauacuucugaucugaagcauuucagauaagggauauuuaaccuguacuuauuuaauuacucaucauuuauauaguuaugaaguguuuauguuuuauauauagucauuuuauuuuuauuuauuuauuuauuuugagacaggaucuugcucugcugcucaggcuggagugcaguggcacaaucugggcucacuguagcgucgaccuacugggcauugauccucccaccgcagccucccgaguaguugggacuacaggcuuacaccaucaugcccaacuauuuuuguauuuuuaguaguauuuaaacaaauauccaaaugggguuuugccauguugcccaggcuguucuugaacuccugggcucaagugauccaccugccuuggccucccaaagugcugugauuacagaugugagccagugugccuggccaggauuguaacuuuaagagccuucugacaacuucccagucuuucacugcacccuuugaaauggguaggauaggaauauccucauuauccacagccuguaguucagcauagcauggagaugcucuguuauuacacucauacuuguucaguguuugucaucucacuaaguuguagguuccucaguggcagggacaauaugccucuccggguuauagguaugcaauauacuuuuuuuugagacggaguuucgcucuguugcucaggcugcagugcagugggacaaucuuggcuuacugcaaccucugccucccggguucaagugauucuccugccucagccuccugaguaccugggauuacaggcacgugccaccacacccagcuaauuuuuguauuuuuaguagagacaggguuuuaccauguuggucagguuggucucgaacuccugaccucaagugauccaccugccuuggccucccgaaguacugggauuacaggcaugagccgcugcgcucagccuaaauuuuuuuuuccuuuuuuuuugagauggaguuucauucuuguugcccaggcuggagcgcaguggcacaaucuccgcucacugcaaccucugccuccuggguucaagugauucuccugccucagccucccaaguagcuggaauuacaggcacccaccaccauggacggcuaauuuuugguauuuuuaguagagauggggauucaccauguuggccagucuggucucgaaguccugaccugaggugaucuacccaccuuagcuucccaaagugcugggauuauaggcaugagccaccgcgcccggccuaaauuuuuaaauuaagugaacauaugcauagcauuuauuuuuauuuauaacauauaauauuaggaauuaucguacagugaauauuucccauccccagcugucaaauaucugguauagucaaauuugagccaucucauggaauuuauaaugggcuuugacugaaacaagugaaauauauacuaagaggaaugaauggcuaacugcccauuguuugagauaacaaaaguguucaggcuauuuuggguugugguuuuucuguuucagagucauuucagcuaugcagaucacuuacuaaauucauaaugugagaguauguuaccuucuaucugaaaguggcguugggauuuugcauucucuucuugggagugccuuuuuaaaauuuaaugauuuagaccagauguugauauauuauuuggagcccugcugguuacaauguagucucauacuaugagucagaauuccucauuaaaggaucuuuauuucccugaaccauauggcaagagacaaagauaucacaaaguugaucugcugcuuuuuugcuuucuggcugauuugggcccagccuuuucauuaaaccuuuaggucaugguuccgacagcgggguguauuuuuacauaauaaaccagcauuagggcaguaucaaaagaaguagcagucuuuaaugagcaaauaucagagauuagcugcuuucuuuguagauguuucuuucuagaauaugcuguuuggucagaauucuugaugaggaagguccauucagucaguucuuguugcucucaggcaggucaacccuuaaaccuuuccauacagauaggacuagaauaaaaaacaaacuucugccuuggcauuuuuaagcuucaacaacuuucagugcuauauaauguaaauccuuaagaguuagcuuuugggggggaaaauucaagucuguaauaagacugaaagauagagaagaaauuugauauauuggaggaaggacgucccauugaaagcuuucaugugucuuucuuuucccuguaccuuggaucuguagaagucuugcaguauauguuugaauauagugggccacauaaguucaggugaaauaauuuucaaauugucuagguggcugcugcuuuccccccccccccccgagccauuuuaguauuuaauucuguuuuuuauuuuuauuuuuuuuugagacggagucucgcucuauugcccaggcuggagugcaguggcgccaucucggcucacugcaagcuccacuucccggguucacgccauucucccaccucagccucccgaguagcugggacuacaggcgccugccaccacgcccggcuaauuuuuuuguauuuuuaguagagauggaguuucaccauguuagccaggauggucucgaucugcugaccucgugaucugccugccucagccucccaaagugcugggauuacaggcaugagccaccgcgcccggcuuuaauucuguuucuauugggaauuguuauggaaaggaaagcugucuuaccuuauuuauuaauuauuauuauuauuuugagacagagucucacucuguugcccaggcuauggcaugaucuugacucacugcaaccuccaccucacggguucaagcaguucuccuguuucagccucccaaguagcugggacuacaggcaugcgucaccacaccuggcuaauuuuuguauuuuuaguagagacgggguuucaccuauuggccaggcuggucuugaacuccugaccucaaaugaaccacccccucggccucccaaaguguugggauuacaggcaugaaccacugcggccagccaccuuuuucuuuuuuuuauuuuucuuuacuuuuuugagauggagucuugcucuguugcccaggcuggagugcaguggugagaucucagcucacugcaaccucugccuccuggguucaagugauccucccucuucagccucccaaguagccgagauuacaagcaugcgccacacacccagcuaauuuuuuguauuuuuaguagagacagaguuuuaccauguuggccaagcuggucucaaacuccugacuucaagugauccauccgccucggauucccaaaguguugggauuacaggcugugagccacugcaccagccuaccuuuuucuucuuaacaaguuacaaaaagauuuauuagggaaggaaguugagaauauguaaguagggaauuuuguucuuuuguauuuuuaucaaaguauuuuaguuuucauauugcauuaaaaaauaauacuauugaacaguauacuauuaguaaucacuuuuuaucaugcugugucuucauauagucugaaagaauaauuuuucuuguuacaaaauaaugcauuuuuauuguugaaaauuuagaaaaucuaucuuuauuugcaaucuucugucaguauuucucagccuuuuucauuucugucuacuugaacuugauuugcaucauuuuuucuuguuacuccaaaccaauuuauguuucucuggguauaaauacaaauuuaacuauauauagaugcaccagcucuuauccuuuucaccguuuaaaaaaaaaaacaaacaaaaacaaaacccaucucuaguucacuuuccugcuuaugaauuuucaaagcaaggugaggaaacccacugucuuaaaauaccccaagacuuucucugccaucuggggagcugugcuguagacaggaaacugcugcuucagaaaauaugaaaugaaauaacuucaagauaaugagccucauccugaaagaacuucuggucccaacauacuuauuaagacaugggggcugggcaugguggcucaugccuguaagcccagcacucuggggugcugaggcagguggaucaccugaggucaggaguucgagaccagccuggccaacauggcgaaaccccaucucuacuaaaaauucaaaaaauuggcugggcaugguggcaggugccuguaaucccagguacaugggaggcugaggcaggagaaucguuugaacccaggaggcagagguugcaguuagcugcgccauugcacuccagcgugggcaacaagagugaaacucuaucucaaaaaaaaaaaaaaaaaaaaaaaaaagacacgggaucaaauaaccauugauuaaauuaaguaugugcauugcauguaugcaaagagguagagugggauagaguguuagguaaaaaggaacuuguauaauuagacguaggaaauggggaacucacugccuucuuucaagucccuugguaaauguagauuuuauguccucauauacuggaucaucaguccuuggaugauggauuucauaucgaauuuucuucccccucuccucccuacucuccuagggugucucccuuuagacuguugguuucugaagggcaaggaguggguuuuauucuucauauuauugguucuguguuuaccauaguccccugcucaugguaguucuucaauuaaguguguuauguucugauauuuaauauaccagcuagucauuuuagguuauuuuaugauaauaaggauagcugauuaucucuugccuccacuggaaggcaugauguuucucuuuuccugcccucaaauguugcuauguaccaaauauuuauacagucucaaagagaaacaaagauucauaaacgauauuauauuguguuggguacauauuuugaacuuuuagauuccaaaaaauuccaugucacuucuaucagaaguuagcacacuggauuggcauaagugugggguguguguauagaggagagagguggugaaucuuagaacucgaaauguuuuacaaauguuguuaagcugcagaaaauagagucuuuggcccuuagagaauuucccacugauaaaauuuccaguugaaugacuuuuaaggggaaaguggcugaauuucacugcacuucuuaccacagcuggccaccauccaagucaaagucauuccuucuuuugaaauaagcuuaaguuauucccaugaguaagcuuucugugaagaaagaaauggcacaguuguuagaguugagaguugagggaccuuuguuauauagcuuucuuguguuuccagccuucucuuuguccucucuccaucccuggagaacuggcucaucuuuuaucuaccagguggauaacauguuuuuauucuugcaauuaaaauagauaaggguauaugaauaggcuaguaaaucucauaagaaaaaauguagaucagcaacacuuaaauuucucauucuacaauucuccccaaauaguaaaguuacuugucaaacuccagcuaugcacauugcuagguguugggauauauaagauauggucucuggccucaaguugccuaaaacacagaugaaaucaauaaucuuauaaaaaagauuuauucacauccucuccaccaauauaauuguugcagaauuuauauuauucuucuuaaagaguuguguguuaacuacuacaaauacagugguuuuucuucuuuggagucauggagaagaugugaagugguagggacgugggggaagagugacacacacacaguaggccagcagcagaucgagacugguaugguaugagaggagugaggagauggugggccaccuaguuaggaagagaccuuugagcauuggccucagcugcuuucugcuuguggcugcccaaacucacuggguuuuuguuuccuccaaaguacagugcuuccuguuggccuuccuucugccugauguacucuucuguaguucuuuacuuggauaauuucuacuaauucucaguuuucauaguaaauguccauuuuucagggacacuuucccugacuaccucuaagcuagguuaggcccuucuaucauguacuuucuauauuuuuuccuuauuaugcuuaucacaauuguaauuaauuauuugugugauuauucacuguuuaacauaucuccccaccagagccucaggggcaaauauuggcucugcuguguuugucucugaauuuuuaguauccaucauagugcuuggcauauaguaggaucuugccuuguggaguaaaguauuuguucaauaaacaaauaggaaggccauuuucugcugcgaucaaaaacuguuuuaagcuucuuuggagaaauauauaucaggcugugguugaaucuuggugaaauuuaacugccaauuaggaaaguagcuguaaauaauugcuuaacacagggcauugcaugcaaaaggaccaucuaauuuguguucucugagugaaaaaaauuuaggcacagaguccuggggugcagauggggauaauccugcacagcccagcacaggauuauacagaauauguaagugugaauaaaaaaauaaacauggauguagaauucucuauuaguuuugaucuuuugcaaaugagcagaauagccaucuuuggcaaaaugugguaguaugaguuagcaaauaccaaagucacacuuuagauauagauacuagauaaaucagcauaugauaaucagcacaugauaaaaauuuugggaagcaguacaguaguauaaucguuaagcauuaaacuccuuauuuuaaaaucccauuguugacaccuucgagauagguaacauuggggaaguuauuuaaucuccauuucucuugauccuccuauguaaaacaaagguaaagauaguaccuggcugauaauguuguuguuguguggguuaaauuaguucauuaaaauguuuauaacuauuccugacacagagcuaagagcuuuaugaguguuagauuuuaucauuacuauauuuucccaugauuuuaagucauauuuuaaacguuagucuaaugaaaaggcaguguugauuuaaaaaaaaaaugucuaagcauagcuucuaacuuuuauucaacaaggcaaaaugccaaugaaagcuuucaguagaauuccauauguuguggaauauacaguuuuaccaacuguggggaaaauaucacaguuuuaggugcuugaaccuuugauugccaguuucccaugauuaaagauagacaucuaaauuuuuaauuuauauuuauuuuguuagaagcaauagugagggaaaaaguauauauauauuuuccaauuugaagcaagaauuaggguuuaggauuuaggguuuuaacucaagcauuaauugucuuuucucuuuucuuuucuuucuuuucuguucuuuuuuuggagacagggucucacucugucacccaggcuggagugcaauggcucaaucucggcucacugcagccucaaccuccugaguucaggugauucucccacaucagccuccccaguagcuaggacuacaagcauguacagccaugccuggcuaauuuuuuuuguauuuuuagcagagacgggguuuucccauguugcccaggcuggucuugaacuccuggacuuaagcaguccacccgccucagccucccaaauugcugggauuacaggcaugagccacuaugcccggccaguguccuauuuucuuaaaaaaaaaaaaaaagaaaaaaagcaaaacgaaaaucccaaagagguacccaggccauucacugaaguaauaagauagaaccagcuuuccagguagaguugagaaauauuaugcauuugugaaauacaauucaucauauucuggaacagccaauuuaguuuugagacagggucucacucuguuguucaggcugaagugcaguggugugaucucagcccacugcaaccuccaccucccaggcucaagcuugcauuagucuccugaguaguugggacuacaugcgugcacuaccauaccuggcuaauuuuuguauuuuuuguagagaugggguuucugccauguugcccaagcuggucuugaacuccugggcucaagcgauucucccacuucagccucccagagugcugggauuacaggugugucaccaugcccagcagcuuaucaaauauuuaaugaguacauucuauuccggauacuagacuaacuuaauuucucuugucugaaaaaagggauagaaucgcuuucagauuccuaccaaauauaggaguaauagaguugaaaagugagauuaggagaccuuaacuacuaguuuagagguuauacucaguauuucuagucuuucaagaaguuuuuugcuaugcauauuuaauuucaaagucuuaaauuaauuagcauuucuacuauucuccugaguaauaaaaggauauuaaaacaauuuuuggccaggcccuguggcucacgccuguaaucccagcacuuuggggggcccaggcggguggaucgcuugaggucaggaguuugagaccaaccuggccaacauggugaaaccccaucucuacuaaaaacacgaaaaauuagccgggcgugguggcuugcgccuguaaucccagcuacucgggagacugaggcaggagaaucgcuggaaugcgggagguggagguugcagugccacugcacuccagccugggugacagagggaaacucugucuccaaaaaaaaaaaguuuauauuucccacuugguaauuucuuuaguucuuccaguuugcuaauucuuguguaguaguuucuaauaugccauuuaauccauucacugcauuuuuaauuuaaaugacagucuuuuccuuuuuuucuuucuuuuucuuuuuuuuuuugagaggaagucucacucuguugcccaggcuagagugcaguggugcgaucuuggcucacugcaaccuccgccucccagguucaagcgauucuccugccucagccucccaaguaucugggauuacagucauccaccaccacaucaggcuaauuuuuguaguuuuaguagagacaggguuuuaccauguuggucaggcugaucuugaacuccugaccucaagugaccugcccaccucagcuucccaauguguugggauuauaggcaugagccacuacgcucagccuuuuuucuuuuuauuuauuugcuuuuguaaauaauggggucucccuguguuucccaggcuggucuugaacucuugagcucaagggauccuccugccugggccucccaaagucuugggauuacaggcaugagccaccacauccagccuaaaugacagucuuuuucccuucuauaauucccuuuggaucuuuuucaaaaucugcuucaguuuugauagucucuuguucuuuuauuauacuuaaaauugucauuucuuguuguucguguuguuuuccuuggaguauagaaacuauaagagcuuaauaccagagagagaauagcaaggcacuuuuaaaaucuggugaaggcuggguaagguggcucaugccuguaaucccagcacuuugggaggcugaggcaggcagauugcuugaguguagaaguccgagaccagccugggcaacaugacaaaacuccuucucuacaaaaaguauaaaaauuaacuaggcauggugguguaugccuguagucccagcuacuugggaggcugaggugggaggauugcuugagcuggagaucgugccacugcccucuagccugggcaacagagcgagacucugucucaaaaagaaaaaaaaaucuggugaaaugugaggauaaucuuauuguuuugaggcugcaagagucucucacucuuuuuuaauuuugguaaaauguacauaauauuagcuuuacaauuuuaaccauuuuuaaguguauagaucuguggcauuaaguacauucacauuguugugcaaccauuaccaucacauaccuccagaaccuuuuuauuuuccccaacuaaacucccuauuucucauuccuccuagcccagcaaccaccauucuuucugucucugugaauuugacuacucuauguaaguggaaucauacaguguuuguauauacuguauaacauauaguauaugauaugcucuauauaagugaaaucauauaguauuuguccuuuugugauuggcuuauuucacuuagaauaaugucuucaagguucauccaaguuguagcauaugucagaauuuccuuccuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuccuuccuuuuuaaggcugaauuauauuccauuguaugugcauaccacauuuguuuacccauucauccauugauggacauuuggauugcuuccaccuuuuggcuauugugaauaaugcugcuauuucaucauauguuuaauaucuuaagaggccugaacucugucucugaaggguguaagcugcugcugcugcuuuuucuuucuuucuuucuuuuuuuuuuuuugagacagggucugguuuuguugcccaggcuggagugcagugguaugaucucagcucacuacaaccucaaccucccaggcucaagccauccucccaccucagccucccaaguagcugggacuacuacaggugcaugccaccaugucuggcuaauuuuuguguguauguguauauauuauacacauacaauuuuauuauacuuaaaauugucauuucuuguuguucuuguuguuuuucuuggaguauagaaacuauaagagcuuaauaccagagcgagaauagcaaggcaccuuuaaaaucuggugaaggcuggguaagguggcucaugccuguaaucccagcacuuugggaggcugaggcaggcagauugcuugagcguagaaguccgagaccagccugggcaacaugacgaaacuccuucucuacaaaaaguauaaaaauuaacuaggcguggugguguaugccuguagucccagcuacuugggaggcugaggugggaggauugcuugagcuggagaucgugccacugcccucuagccugggcaacagagcgagacucugucucaaaaagaaaaaaaaaucugguaaaaugugaggauauauauaggauauauauauauauauauauauauaaauacauauauauauguguauuauuuuauuuuauuuuauagaaugggguuuuaccauguugcucaggcuggucuugaacuccugggcucaugugaucuaccugccuuggccucccaaagugcuaggauuacagguguaagccaccgugcccagcuggaauguaagcuucugacggacuugggcuaggacugugaacuuagccucugaugccaaggagcaaacauggaaugaaagcaggccaaaggcccuuuugcauaauauggcaguaaggcaggaagggaaguucauuccacuuuagagaggcaguguuugaagcaugaggaaguuugccagccagagaaaaugggaauaccuucugugcagagugaauacaaagauacaagggugugaaugugcaguuagggaauggggaagcuuuaguaaugagacuguuaagguggauugugucccuugugaagggacucagacgacauaaaucaguuaaaaaaaacaaaacuaacuucaguuuuugaauagguauaggauucaccugguucaaaauuuaaaagguaaagguauacagugaaaagucucccuuucccccuugaacuccagccacccaguuucccuccucauaggaaaccgaugcacuuaagaaacccaaugucuuggauaugcuucuagagauaguuugugcacaaucuggcaguaacuaguccccuuucauacaaaugaagaccuguuauacugucuuguccuguuucuugauuuuuuuuucauccuuugcauguuuuggggaacauuucuugcuuguaucuacagaacuuucucuucuuuugacaguuaaauaauagucccuugaugguuguagauaauuuauuaaacuagacccuuauggaagguuauuugugaucuguugcuguuucagacaacauggcaaagaaugacacaaauaugucaguuuacguaugugcaaguacauuuacaggauaauuucuagaagaggaacauacuaagcauuggauguuagaaaacagagaaaucuuguauuauuauuauuuuuacuuuauuuuacuuuaaguucugggauacacaugcagaacaugcagguuuguuacauagguauacaugugccauggugguuugcuacaccuaucaacucaucaucuagguuuuaagccccgcaugcauuagguauuuguccuaaugcucucccuccccuugucccccaucccccuacaggccccagugugugauguuccccucccgaaacagagguguuuaagcugauguauaaaauuuugguaaaauaauccugguaguauugaggaagauagauuggagcgcuggugagacacugggguuggagagccauccauucaagcaagagguaguaagagcugccuucaggcagugguaggagugcagauagagaaaagacacaucugcagcauguguagaguacaagagggagagggaggaaaaagaaaagauaaauucuagagauagacucauuauuacuuaauuuauauuuggauucauaguguucucgauuuugaaaaugaaucaguaaaguaaauguuuuaaaaauaacuaauuggcccggugugauggcucacgccucuaaucccugcacuuuaggagguugagauggucagaucaccugaggucaggaguuugagaccagccuggccaaaauggugaaacccuuucucuacuaaaaauacaaaaauuagccgggcgugguggcgggcgccuguaaucccagcuacucaggaggcugaggcuggagaauugcuugaacccaggacuuggagguugcagugcgccgagaucgcgacauugcacuccaaccugggcaacaagagugaaacuccgucucaaaaaaaaaaaaagaaaaaaauuacuaauuuauuuucaggggagcacuaugugguuauuaucucuauuuuacagguaaggaaacuaaggcugaaagcauuugaguaacuugucccgagccaguaauugguggugucggagugcaaauauuuuuauuaugcaaaugagcuuacuuugagaugcagggcagaaaaccuagaauucuuauuaaaucuaaaagaucucaucaaugauuuuauugaagcugaauaugaaagaagucaugccuuaaccuuuuugaucucacuuggaaaaagaaaaacuaaauacaauagcugguagcauggauccaccuagagagaugcugcaagaaaacacaaucuaguugaagugagagcucaaaggauggcgcauaaggaaagggcuugaauucaggaaugccaguguuuuuuaaugacucugauauguauuccaagcugggagggacagauaucuaugcuaguaagaaaaaacagggucaaucacuugguggcucaugccuguaaucccaacaccuugggagaccgagguggguggaccacuugagcucaggaguuugagagcagccugggcaacauggcgaaacccugucucuacaaaaaauacaaaaauuaggugggcaugguggugcacaccuguagucccagcuacucaggaggcugaggcagaagggucacuugagcccuggagguugaggcugcagugaaccaugaucgccccacugcauucuggccugggcaacagagcaagaccuugucucaaaaaaaaaaaaaaaaaaaaagagagcgagagauaaaacaguaggguaaucuguuuaugauguauguguggaagagugcauacuaaaaugguggcgggauugaaugguaggauuucagguuaaauaauuguuuuaaugaaaaacuuuuucugaccauaguuugugcuuuuacccuaacaaugaacaugugccacuuuggaaauaagagaaauaaguuccguauuuccccuccaucuuuucguuauuguuuguacucuucccacugccuggaguugcccuuccucucucauuagaaugggcccagugcagaugucacucucuucaugaagcucuucccaggcugcucagcaaagggaagcucucucccuuugcuguguuacuaaaauauuugacuaugguuguuaucaugaauuagaacuaauuguguucgugucuguuuccaccccuccuuucucugaccccccuacccagcuuccaaauuugaguccguagaaugagaguaguuacagacuucaauguugaauugguugcauuuucagcacugcaguuuuuuuuuuucccugucagaacaagaaaagauagauaaaaauucugagucauagaagaaugacuuaaaacuuccgaaggcaaugauauaucuauguaagccauaugaauacucuugccuaauuugggaacucucuggaguaaacagggccauaaauaaauaaaccaucucuggaacuaccauaccuauuacaucuguaaaaccaaaacaugauugccacauuucaacugacauauaccagaagacucugucucugaacuggaagcuccaacuugggcuguucuaaagcuucuguaaaaaggcaaauuccucaguuagucugcugaaguuauauacuauaaugauagcacuagagaaugagaaugcaaaaaucuccuuuuuucuccuucuugucuagagauugaaccuuuuacuuauucuugccagauaaauaaaccauuccucuucuuuuuuuuuccaacaaauguuccguugaucuuuccuuuuacaucuuuuuucuucuuuuuuuccucaaagcaaccagucuggauuaggcugauuguuaucuucuaaucucuccuuccuuuccauuacugccaaguaaaucuuucuuaaguauagcucugaucucaaaagguucuugcucagaaaccuaugccuuguccccagucuuccagauuaauuuaaauuccuuauucuagcucuucagggcuaucacaucccuaaccccuuucugauuguauuauuucucuauggagagcagaagucagcaaacuauagccuguguuuuuaacuguccaggagcuaagaauaguguuugcauuuaaaaauauuuugggaaaaaaacagaagaugaauauuuugagacacaagaaguuauucaaaauuaaaacuucaggccaggcacgguggcucaugccuguaaucccagcacuuugggaggcugagguggguggaucaccugaggucaggaguucaagaccagccuggucaacauggugaaaccccaucucuacuaaaaauacaaaaauuagccgggcaugauggcacgcaccuguaguuacagcuacuccggaggcuaaggcaggagaauugcuugaacccaggaggcagcaguugcagugagccaagauugcgccauugaacuccagcuugggugacagagcgagacuccgucucaagaaaaaauaaaauacaauaagaauaaagauaaauaaauaaauaaauaaauaaauaaauaaauaaguaaauaaaacuucaguguccguaaugucuuuuuuuuuuuuugagacggaguuucguucuuguugcccaggcuggagugcaaugacacgaucucggcucacugcaaccuccgccuuccagguucaagcaauucuccugccucagccucccuaguagcugggauuacaggugcgugccaccacacccggcuaaauuuuuuuuguauuuuuaguagagaagggguuucgccauguuggccaggcuggucuuaaacuccugaccccaggugauccaccugccucggccucccaaagugcugggauuacagaugugagccacugugccuggcccacauugucucuagaucuccagggacucucugcuguuauauaucucccaccuaaacucuuaguuucagaugguuuucauuuaugaaccaaauauagacuuguguuguucuuuaaugaaucauuagaagugaacuugauauuuauugaggaaugaagauaaaaggauuguagcuuaguguguacgugcuuugccugcacugucuuuaaugcaguuguggguaaugagguuucaacaaaaggcugcauaugugaugaugguaccauaagauaauaauauauuuucacuguaccuuuucuauguuuagauacaccaauacuuacaaucguguuacaguugccuacaguauucagaacaguaacaugcuauacagguuuguagccuaggagcaguggcuaugccauaaagccucggcauguaguaggcuauaccgucuagguuuguguaaguauacucuaugauguucacacaaugacaaaauugucuaaaagcacauuucucagaauauaucccugucauuaagcaauguaugacuguacuuaaaacagugacaaacuggauaaaccaaugaacucucuaguauacuguaauucucucaauucugacuaauucugauuauuccuuuugccuaacugggaauaaguuaucugagaugguauagccuaauuuacuaaugaguuugguuguccguggcaacuguucaauaucuaggcugcaguauugauguuuuauauugguaagcaagugaaacaaaaggaaaugaaguuaacauuucuauaaaagucuuuuucuuguuuuagaccaaaggcugugucuaaucuauuaauguucuaugaagagcagugaugaaauacaaucugcaaaaggcacaaacacaaauaguauugcuggagcugguuuacagcuuauuuucuaucaauacaucucagccagcaugcucuggaagugcuguagcuguucucuucuuucacuuuucagcaacuucagaacugaguccaugcccagcucauauguagucacacuaaauuguguuugcaguaguugaaaaggaaaaaacauuaagaaaaaaaagccuaaagguguaacuuuggaaguacagauaucauaaagguuacucuuuucuaugagcauuuuaauuggaggucuugccauuugacacaugaauauuauaaaacuuauaauauucugccuguggcugccugugagaaauguguuuguagcuugagcaaaggaauagagugauuuugcuuguagccuuaauuuaaugggucagaauguuuauuauggccuggagccaaauucaauuacuauauuguaaaagugacugaauaaucuccaauuagcaagcagaauggucaacguuaguaaaugcauuuaaagacuuuuugccggcugggcgcaguggcucaugccuguaaucccagcauuuugggaggccaaggugggaggaucaccugaggucggggguucgagaccagccuggccaacguggugaaacccugucucuacuaaaaauacaaaaauuagccgggcaugguggcaggcgccuguaguaccagguacucgggagacugaggcaggagaauugcuugaacucgggaggcagagguugcagugagcugagauugcaccauugcacucuaggcaacaagagcaacgugacacuccaucucaaaaaaaaaaaaaagacuuuugccauuguguuaccauuucaaguuuucaucacaccuguaauuuaaaaaauggggggucuacaguguuggucaguacugguucaauuuuaaaaguuacuuaaggccaggcugacucagcugaucaugccuaagcaaauaacaguuaaggagcugaagcccuaguuaagccuaacugaucuuggcuguggaaaccuuccagcuucugggaagaaccaggacaaugggacaucaguugguuagacugcaucuugaugguuuauaugugcccauuguguacuugaaguuuuucuuguccuucuugccaucugauagugcuguagaguuacagaaucacacaauauaacagccaaaaauauuagacauaauugaaucccacucucauuuuauuuuauuuuauuuuauuacuuuuuugagacaaagucuugcucugucacccaggcauggcacgaucucagcucacugcaaccucugccuccuggguucaagcgauucuccugucucagccucccaacuagcugggauuacaggugugcaccaccaugccuggcuaauuuuuuguauuuucaguagagacggggauucaccauguuggccuggcugguucaaacuccugaccucaggugauccacccaccucagcaucccaaaaugcugggaauacaggcguagccauggugccuggccccacucuucuuauuuuaaaaagacacaguauggcugggugugguggcucacacuuugggaggcggaggugggaggauugcuugaggccaggaguuugagaccagccuaggcaacaugaugaaaccccaccucuacugaaaauacaaaaauuagcugagugugguggugugcgucuauaguuccagcuacucgggaggcugaagugggaggauugauugagcucggaaggucaagguugcagugagcugagauugccccacugcaguccagccugggugacagagcaaaacccugucaaaaaaaagaaagggaaggggaggggagggggaaagaaagaagggagggagaaagggaggcagggagggagagagggagggagggaggaaggaagggagggagggagggaggagggagguuuaggauuagaguguaggugugcugagaucaucauuacuauuugagugauaauugaagcaaugucacuuaucuuggguaauacccgagguucauugcuggaaaucaaggaugugaacacaccagagugagguuaagaguggaaguuuaauaggcaaaagaaagagaagagcucucagcccagagagggauccuggagaaaaauggguuaccaguuccaugaugaaaugcacggaguuuuauaaaugagcuugaggaggcagugucugauuuacauagggcccaaaagauugguuggaccaggugugucauuuacauagcaugcaaagaagcuaauguuuuauuaugcagaugguucucuaccuggccugcaucauauugccuguuucuuuauuguacacaugguugaaaaagaaaagggaagauggagccuccauguugaacaugccuggcccccagguagccuuuuccuauuggcauagcugcuggcauucacccaugcaaguuuuagcaugcuuuucuaugucugcagcucgauuuuucaggguggucuuuguuagaaaagaaaugauuugggggcugcuuuuuauuaaaagggaaaccuugcugagaacucuuuuacccucaccaacugccuaaauaauuucuuucuagcuucugcaucaauauuaggcaaauugacaaacuucucugugacucuguuccucaucuguggcaugggauaguaaauggaacccaccgcaugggggaguuguaaagauuuaaugagaucauaaagagcuccugacuuacagcaugugcuaaaugaaaaauaauuuuuuuuuugaaggagaaaacugaaaucacaaacgaauauugcaauggcagagaaggaaaaagggacuaauguuuauuuagcccuuguuaucuaccaggcccuauucuaggugauuuacauauguauuacaucauuuaucucugagagagauguuacuuuuuccauuuuacugauaaggagacugaggcucaaagagauuaaguaacuugccagaggacacagaucugguaacagcacagugaggugagauucagauugcugcauuccaaagccccaguucuuuuuccacuauuccauuaccuuccaagaugaggaguaggaccucauuuuccuaacaugaaaauggguugcauuucaaaaauucguuuacaaguugguuguuuggaguuacuuuuccauggagacaauguuacaugguuacaugcccaggcuuaucugcaaaagcuauaauguaacugaaauucugcacauuugugaacugaaacuauuaaggaaaaaaaugcauuugcaguucuagcuauaagcagaaaagaaaaaauaaggaugcauuuuaaauucuguggaaugagaaaagcacguucgguuagagggcagugagggagaagauggggacuguuuuuauucugguggggcucugggauacuuucaugguauucacacauauuuccuuuuaaaaaauaauuacauaugcaagagauaggacaggugguagcguugaccuaauuucuguuggcaauauuuagcuuuccguuuuaaauauauuuacccauuuuuuuuuuuuuguaaugacaugugggagcccagcuagucacccucauauagucauagaguauuaaaguuuauagaugucaugccuguaaucccagcacuuugggaggccgagguaggugaaucauuugaggucaggaguucaagacuagccuggccaacauggugaaaccccgccucuacuaaaaauacaaaaauuagccaggugugguggcgggcaccuguagucccagcuacucaggaggcugaggcaggagaaucgcuugaacccggggggcggauguugcagccauugcgcuccagccugggugacagagcgagacugucucaaaaaaaaaaaaaaaaaaaaaaaaaugaaguuuauggauguguugaagaaagaaugaagauaaaaagaauguuuuccugagugaauuguauaagaauuugaaggaauugaggagcuaaagagcaugugcgcacagauaugaaaaugauaaaauuaaauuuucauuucaucuuaaaucuucaucauuuuacuucaguuggcauuuaauuucugagcauaugcuaugugccagucaccaugugucauggcuaugagggaaaaaaacagucacagacccuuagucacaaauuugcaaaagaauuugcuuuguacuugaagcaucuacuagagauuauauucagaucauccagugauguuuuccucuuuaucgguauuuaugaauauguaaagguuacuuaauuauaacuagugggaauaagacugaggguuuuuuuguuuguuuuuguuuuuuaagacaggaucucccccuguugcccaggccagagugcaguggugcaaucauagcuuacuacagccucgaucuucucagcucaagugauucuccuggaucacccucccaaguagcuaggacuacaggcaagagccaccacaccuaguuaauuuuuuauuuuuuuuauuuuuuguagagacagggucuugcuauguugcccaggcuggucucaaacuccuggcuucaagugaucuuccagccuuggcuucccaaaaugcuggaauuauaggugugagccacugcucccagccuuaaguaaucuuuuuuuuuuuuuuuuuuuugagacaggguuucgcucuugucacccagguuggagugcaauggcgugaucuuggcucacugcaaccucugccucccggguucaagcaauucuccugccucagccucccaaguagcugggauuacaagcauccaccaccaugcccaacuaauuuuuguauuuuuaauagagacgggguuuuaccacguuggccaggcuggucucgaacuccugaccucaggugauccacucaccuuggccucccaaagugcugggauuacaggcgugagcuauggcgccuggcaaguaaucuuuuuaauaacuaagaacacuggaaaaacuagaggagauuauuaguaaaagguguucauuuuauuuucccauaauuauugcuugauuuccugucacuagucaggacuaaaaggugggagaugugggaccuuugaguucuguuacauagcauuugcuuauguauguuugcaacuaaaauggaaacuuuaggcugggcacaguggcucaugccuguaaucccagcauuuugggaggccccuggaguaguugggacuacagcuaggugccaccaugcccagccgauuuuuguauuuugaguagagaugggguuucaccauguuggcuagguuggucucaaacucuuggccucaagugauccacccacuucggccucccaaagugcugggauuacaggcgugccuccauacagaagaauuuuuuuuuuuuuugagauggagucucgcucuaucacccaggcuggagugcaguggcgugaucucggcucacugcaagcuccgccuccuggguucaugccauucuccugccucagccucccuaguagcugggacuacaggcgcccaccaucaugcccggcuaauuuuuuguauuuuuaguagagacgggguuucacuguguuagccaggauggucucgaucuucugaccucaugaucccccugccucagccucccaaagugcugggauuacaggcgugagccacugcgccuggccagaagaaucuugaguugagggggaggaugaaguguuugcacauuagaagcuuagucaugguaucuucauaaauggggaucuggugagcaagguugcucugcuaacauuuauguagccuuaacugacagacugagucucauauuggguuagaauaaacagcugcugccaaggaagcuuaacauugguucuaaggaaacuauguggcaucagauaagcuugcuugacaucagaacuugccacugacaugguucaucugcugccuagccuaugugauuguguucucauugaugcacauuuaaauuaauauuuugggcaauugguuaaaauuuugaccuuuaggcccuagagguuucucaugacuuuauuuaugaagaauauuguugaugcauuuuagaauuuaauuuguguuuuuuucugauuaugaaggcaauacauaguugauuuaaaaaaaauacucuggaaaaaguauagaaaaggauuaagaagaaaauaaaaaucaccugaaauucuacuucccaugguauguuugcuuccaguuauuuuuucaauguggauauauauuugggagagagugggauguuuccuuauuagugaaauagcugaggcuucaguaaaauuucacuuaacacucaugauauugagauguuugccuaaugcacugugcuaauuaagguuguuuguuuaaucaggugguacaaauucugaugccuuaggagccaaauaggcaaugagugaaucaggccaguuauaagcacuggggagugauggcaacugugguuaacuggaaaaugccggcccuaacugaagaaguuacuaccaucuucaacuuacuguugucacauggaaacaggggcuaauguuaccaaaucuuccuaauugucaagaaagucccagaagucuguuucuuuuuaaugugaaauuucucauguuaaaaaauacugugcaggucaaacaaaauagucuguguguugcacuuggcccauacacuggcauuuuuugucacuccugacauaaaugcuucucaaucuuucucauagcucuuacaagaagagcacauuuauuaaagaaaauguugggagaggaguuuaugcauaaggaguuucugagaauggcuucaggaacuuuuccgucugagaggguugcuuaguauagaaaugauaaacucaguuacaggaaucagguggugacauaaaugaguaaaaugaauugggauuaagauuaugaguguggacaugguacaaaugcgcuguuugggacauuuggguuccaguaauguuuuuccuugauggaaugcagauccaaauugcugccagaccuucuaagauuuaagagaugucagaaauuuggaucuuugugaaauuucuugauuuucaacucauuuaugcauaguguuccauuauuggaacgcuaagcuugugggaguuauuuauauccuacugcucaaggucaucgccaaggucugauuuuucacacaaaaaaauugcaaccucuggcacaaauggguuaaaaauacuauguggaccaaacaaaaaccauccuugccccaaauucuacacaaaauccacuaauuugcagcucuuggccuagaucacuguuuccuacauauguccuagaaauccuaauucugucauauauuaauaggugcuaagaaauaaggaauucuuggucacaugaauuuggaaaaugauggauuaaacaaaacugaacacauuuccugacugaagguuaucauagauccucaauuaugcuaaugugccuuguaaauuccuaagaagauauagcccauuaccccacaguuacaguuaggucaccaucuccacuugcuucccccaccaccccccuugucuaggguaagaguggcuuuccuccugguaaagguuagucucuguaucucucuccagauucuuacccugucucuucagggaucugacuucagaagaaaucuauuuccugccucuuguccuguagccuaucaguaugcuugguuuucuccaguuuaaaaaaaaugacgaccuuuucuuauaccauacacaaaaauugacuccaaauggaucacagaccuaacuauaagagcuaaaacuauaaaauucuuagaauaaaacaugggaguaaaucuucaugaucucagguuagaugaagccuucuuaaguguuacaccaaaagcacaaguagcaaaagacaaaacaaaacaacaggaaaaaagcacaagcaaccaaaaucacaaacaacaaaagaagacaagcugggcugcaaucccagcacuuugggaggccccgcaggcagauuacuugagcccagaaguucgagaucagccuggucaccauggugaaacccugucucuacaaaaaauacuaaaaauuagccgaguguggcccggcacgguggcucaugccuguaaucccagcacuuugggaggccgaggcgggcggaucaccuguggucaggaguuccagaccagccugaccaacguggagaaacccagucucugcuaaaaauacaaaauuagccaggcgugguggugcgugccuguaaucccagcuacuugggaggcugaggcaggagaaucacuugaaccugggaggcagagguugcagugaaccaagaucacgccauugcacuccaaccugggcaacaagagcaaaacuccaucucaaaaaaaaaaaaaaaaaaaaaaaaaaaagccgggugugguuguauacaccuguacuuccagcuacucagggggcugaggugggaggaucaccugagccugaagagguagaggcuguggugagcugugaucaugccacugcacucuagucugggcaacagagacucuguuucagaauaaaaaaaaaaaaaaaaaaaagaaaaaggaaaagacaagcuauauuuuagucuuaaauuggccuuuaucaaaauuaaaagcuugugcugcaaaggacacuaucaagaaagggaaagacaacccacagacugggaaaaauauuugcaaaagauaaauaacucaaaauauuggcaaggggccaggcacaguggcucaugccuauaaucccagcacuuugggaggccgaagcaggcagauuaccugaggucaggaguuugagaccagccuggccaacaugaugaaacccugucucuaccaaaaaaauacaaaaauuagccaggcaugguggcucaugccuguagucccagcuacuugggaggcugaagcaggagaaucgcuugaacccgggaggcggagguugcagugagcccagauugcaccacuguacuccggccuggguaacaaaguaagucucggucucaaaaaaaaaaauauauauauauauauauauauuggcaagguaucugaauagacauuucucaaaaguagauauauaaauggucaauacacccauaaaaagaugcucagcaucauuagccaucaggucaaaaccacaaugagauaccgcuucaguaggagggcuguaauuaaaaagauaauaacaaguguugccagggauauugagaaguuggaacccucucauguagcugcugcgaauguuaaaugguuuagccucuuuggaaaauagucuggcauuuccucaaaugguuaaacauagagauaccauaugacccagcaauugaauaccuagguuuauaaccaagagaaaugaaaacauguucauacaaaaccuuguacacuaauguuuauagcagcauuauucauaauagcccaaaaaugaaaacaacucaggugcccaucaacugaugaauggacaaaaugugauguaaccauacaaugaaauaugauuuggcaauaaaaagaaaugaaguacugauacauagcacagaugaaagaagcuagucacuaaagagcacaucuuaugugauucuauuuauaucagauauuuagaauaaguaaaucuguagagagaaaguagauuaguguuuaccuaagauuaggugguggugaggaaggguuagggcuaaaugggggugguguugacugcuaauaguuacuaggucucuuucuggagugaugaaaauguucacaaaucaauugucaugguugcacaacucugugacugucuuaacgacaccauuaaccucucuguggcaguugacacuauugacuguuccugaaauucuucuggcuuuuaugacagaguucuauugaucccccugccccuaucucugauauuuucuuuccagcuuuuuucaccagcuuguucuuccaccagcuacuuaucuguuggugguguugggucgugauuucauucauuauccauggcuuuuagaacgucugaguugccuguuacuugugaaucaauuuuucuagucccgguaagugaacugaggaaccaucuuuucaguugcuuauuggacaacucccucugaauaucccagugcuaauuacuuucccucucagagcugguuuucuuccuauguuaccaauugacccagucacuugagccaggggcugggagccauccuagauuucugucucacccuccacauggagugucauguggcugccuuuuuuacaccugcccucucaucuccauucacacugcugcugcuucugcuacaguuaaucuguaguuuaucuuucacuaagacuguaagcuccaugagaucuggggccauguguguuuucuucaucacugucuguaaugcuugguacauugcauguuauguaaguaauauuuguugauugaauaaaugaauucacaaaugaacuugucuuccgaguuuucuucgcucugauccauucuugcugcugaauuuuucuguuugaaaugcagaccuaacaaugucuuuuacuuagaauaauuaaauaauuccccauugcuuagaggauaagucuauugcauugcauacaaggcccuccaugauguggccccuuucugcuuuuccaauuuccuguccucuccacaucuccucucuacccaguaccccauuuuccagcuauguuuccugagcuggccaugcuuucccauaucuugcccuauuaacuagaaagcccuccuuuuuaccuugaauuccauuacuucuggagaacucuuauucugccuuccuagaguuucucuuccucugugaaacuuccuguaccucaccuacgcagagcagaaacuugguuguaacucuacuagagcaugcauuacacugcauugccuuauuuguuuaagcauuugucaacgaacaacaaggacugagucucacuuuuguauccccaucacacagugacagacacagugccucccacaugggaaguacucauuaagugcuugauuaaaugaauaaguuggaaaucagaguagauuagagaguuuuaguuuuucuggauguggccucuuaaacacugaacucuggcuggccaucugugaaugauguacaaaggauaucagugagggguggauggaucacaaguucaucaccaccccagaaaaacaaucaaaagcauugcugaugaugggucacuuacauuauuauuauccuuguaugacugaggccugguacugggcacagcugcaaucagaaugguuguucaguauaauggauugaucaggcuaacuguuaugccaugacauugauuugagccacaguaaguacaggcaaauggguacacauucuuaagucuggucacaaucaguuggucacaaccuauugucuaaauacauuaagaacaucuuccuaccacauuuuuaauguaauguucuuuaguuacgacuuacauuguacaaauaaguaacacaagucuucucagcuuuguuuugucuuucuguuuucuuguacuuagucuagcuaagggagacaucuacauuaacauauuuuuuagucuagguagugacuugaaccagccaaccuuuuuuuucuuucuuuuuuuuuuuuugcuggaaagaaaccaaaucucucuacauuaccaaaccaaaucgaguagauugugaugaaaggaguaauaauaacaacagcagaagacaaaaggccucucacauagaauuuugaacuaaagucacauauugaacaaaggauauuuaaauuaacuacugaacaaaguaagagcucuucaaaagaaacagagcucccugccaagcccccuaaaaaugcccccaggccucuuauucauucacuaccauuauuucaguuuauaucuaaagauguuuuauuucuuaucucauucucuucccaccaccuaguggacacauaguuggcacuuacugcuuguuuauugaauugaauggaaucuagccccaagaguuaaaagcuauucucugaagaagaaaauaaaagagaaauaauuuugucagugaauagaaauaacaagucugaguuucucucggcaauggaauaaaguuaggaagggauaacacguacaguuggcucucuguaucuguggguuccacacuucugcauuuagccaacugcggauugaaaauauucagaaaacaaggauaguugcaucuguguugaacauguacagauuuuuuccuugucuuuauucccuaaacaauacaguauaacaacuauguacauagcauuuauauuauauuagguauuauaaauaauccagagauaauuuaaaguaugugggaggauguguguaaguuauauucaaauacuaugcuguuuuauauaagagacaagcaucuguggguuuugguauuugaagggggucauggaaccaauucuccauagauaccaagagacaugacuauauuuauuauaaaguuagauuacuccaaaaggguuguuuuuaaauacugacccagagaaagcuaauuagacuauaacuaagaucuguuuguucuuuucucuguuuuuguuuuuguuuuuuguuuuuuuuagacggaguuuugcuuuugucgcccaggcuggagugccauggcacgaucucggcucacugcaaccucugccucccagguucaagugauucuccugucucacccucccgaguagcugggauuacaggcgcccaccaucacgcccggccaauuuuuauauauuuaguagagacaggguuucaccauguuggccagucuggucucaaacuucugaucucaggugauccacccgccuuggccucccaaagugcuggauuacaggcgugagccaccgugcccagccacucuguuuuuuuuuaacccuuuaauccauaggacuuuuuucagaaggaauaagaucuauuuuaaggcauaaaaaaaaugaggcaucagacagaugugguggcaugcacccguauucccagcuacuugggaggcugaggugggaggauuccuugaccccagcaguuugaguccagccugggcaauauagcaagaccccaucuuaaaaaaaaaaaaguaaaaaagaagcauuuguugauucuuacugaccuguuugcaaaguuguagucuacauugggaaucauauuucuccauacuaaguugaccucgaagaauaacauuuucccaccagcuaugaagauuccuguuaguuaacaaaagacauuuugugaauuaaucccuuucuuguuuguucuacuuuuuuucuuuuucuuuuuuuuuuuucuuuugagauggagucucgcucugucacccaggcuggagugcaguggcccgaucuuggcucacugcaagcucugccucccggguucgcgccauucuccugccucagccucccgaguagcugggacuacaggcgcccgccaccacgcccggcuaauuuuuuguauuuuuagucgagacgggguuucaccguguuagccacgauggucuccaucuccugaccuugugaucuacccaccuccugaccuugugaucuacccacuuacgccugggauuacaggcguaagccaccacggcugacuguucuacucuauuuuuauuuggaaaagaugggugcuauggaaauuuucuguuuugauggugacaggagaguacaggaaaaugcauuuucugucaucaauggguuaauggcuuaaaaauuaaagauuugucuuugguucuccuagacaggcuuugccaguuguucucaaauaggacauaccuuucugcuucuguagaucuuuacaaagugguucuuuggaaguucucgacuuguuauuuuggugauagaacacuaaauuguaaagaucuagaacagaggaugacaaucuuugaauaaaugggcaggucaagguaacauaauccucucugccuucacuuagcauacaaaguccugaacuaacugaacuuuccuuucuagccucauuuccucugcugaagccacaccagcgugucuuucuaguccuggccuccuuguacucgcauaucugacugaaccuucuuugccugugcucuucucuuuguuugggcugucugauucuucucuacugggcagcuucuccuuuccaggccuggcuccuuuuuucuaaaagaccacauaggaaaggaauaaaugaagguuauaguagcugugugaagaaugaauuggaagagucuggagcaacaagaccaguuuuaggauacagugagggucucauggaucugugcugccugauaugguagccacuagccguagguggcaauuaaaaugaaauaaagguaaaaauucaguucuucaguuauacuggccacauuucuuuguuucuuuuucuuuucuuuucuuuuuuuuuuuuuuuugagacggagucucgcucugucgccuaggcuggagugcaguggugcgaucucaguucacugcaaccuccuccucccagguucaagcaauuuuccugccucagccucccaaguagcugggauuacaggugccugccacaccccuggcuaauuuuuguauuuuuaguagagacgggguuucgccauguuggccaggguggucucgaauuccugauaucagguguuccacccgccuugaccuuccaaagugcugggauuacaggcaugagcuauugcaccuggccuaugcugggaacauuccaaguggucaauacucacagguggcuaauggguacuguauugggcggcacagauuaaauagaauauuuccaucauaaaagaaaauuauuuggacagcacugccaaaaaucaauuccccaagaaaaaauggcauucauucuauauagucauguuuuauguguuguaccuuaaaaacagugccguucguugucccuaaucuaauucuagccagaguguauugagcaaucauggauacuauugcuucaaguaugaaugcagcuuagaauaacaaaaucacauuuaguguuuaucacuuaaguauucaaaaauagcauuuaaauaaaugcccuugaauauauuuuuaauuauccauuuaucuuuccuuaccuacuccuacucuuacaaagaggcaucaauuaauuacaugccauucaguuuuuaguaauuaccucuacugaggucagaauauaugcuauuuacaaaacuguuuuaauguuuuugccugguguagccaugauugcuuuaucuuuggauaauaacuguuugccauauaucagccuucuagcauugcuaccuuugaaggcuuuuuauuucauugauuuagaagugauuuuuuuuuuuauuuuuuccuuuuuuugagacgguguuuugcucuugucacccaggcuggaguacaguggcgcgaucuuggcucacugcaaccuccgccucccagguucaagcgauucucuugccucagccuccggaguagcugggauuauaggcauccgccaccacgcccagcuaauuuuuguauuuuuaguagagacaggguuucgccauguuggccaggcuggucgcgaacuccugaccucaggugaucugcucuccucggccucccaaagugcugggauuuauaggcaugagccaccacgcccggccacgugguuuuuauuucuuuaccucagucuagucuucaucccccaccccaccccacccaguccaagagcaaguccuaauaauauuucuuccguaaaaagguaacacaauucuauucuuuucuccauuucuguuuucacuacuuaaguagugaaaccuuaagucacuacuaucacucucccggcugacugcaguagccucccugcaaucaucuaggagagugauacugguuacccugcucuccccucaccaccuaaaaauaggcaaaaugaccuuuuaaaaagaaaaucaggccaggcgugguggcucaugacuguaaucccagcaguuagguaggcaaaggcaggaggaucgcuugagcaugggaguuugagaccagccugggaaacauagugagaccccaucucuacaaaauaaaaaaaaaaaauuagcuaggcguggugucucaugccuggaguccuagcugcuccggacggaggaucacuugagcccugaaucacuugagcuaugauugcaccacugcacucaagucugggauauggggccagaucaugucucuuaaaaaagaaaagaaaagaaaagaaaagaaaaagucagauuaaucucuuguuuagaacuccugccuccuauuguacugauaaacgauuccaaauauuucaagcuggccuaaaaggcucuuuaugaucuggcccuugccuucuuacccagccucauuaccacaccauacuucccucccucccugagguucagccacucuggccucuuuccaguuccuaaaauacacccaaucuuuuccugcauuagggccuuuuucuggcugcucccccuagauuguucuugccuagcucuuucaugagugacuccuucuuaguuucaaagucucagcuccaauuuugcuucuuugucuacucuuuccaaaguaagcuccuuuguuuccagcccguacucuuuauuauagcaucauucuuaccauuaucuggaaucauacuuguuuauuuacuugacucucugucucucccuacuagacuguaaguuccgugaaggcaggaaacuuuuuuuuauucucuacuccaucucuacuaccuaaacaguaccuggcucauguuguugugcuaaaagcaauguuuaauaacacugaauaacuuacuauuuucuaaaggaaauauaagaggaacucaccuaguucucccucccacgcuugcucucugugucugugucccuccuuccccccacauauauaaaaggaaucucucugugucuuaaaugugaauaucuuucuaggcccuuuauacugaaugugaacuagugacuuuguggcugaacuucaucuuuuacuucaugaaaucauggccauagcuuuuugaaugguuaguuucaguuggaaaacauagugaacaauacaucuggaaauauucugucauguuuugagcugagaaacucuagagaaccagcugcugauuuaaaagccuuuuauuaugauacagacagucuauugucuauaaaagcauuggcuauuacacagugguagauauguguugcuuuuucuagcuauuaacuugaaagaaaaaacuuguauucauaauuuaugcaugacuuauauucccugagaauaguuuauuguguuauuuucuuuagcugauuuacugagcauuuagagauuuuuugagacagggucuugcccuguuguccaggcuggagugcagugguguaaaacacugcucaccacagccuugaccuccugggcuuaagugauccuuccaccucagccucccaagcagcugggaccauaggugugagccaccacacccgacuaauuuuguguagagacaaggucucacuauguugcccaggcuggucccaaacuccugguuucaaguaauucucucaccuuggucucccaaagugcugggaaugauaagugugcaccacugugccagccaggauuuuucuuacuccauuuuuuuuuccuuuaaacucaaucaaaaguuaaaugguuaaauaguaggacugacauauuuuccauucuggguuuuuuuaauuucacagauuucuacauuaaaauaugguuuauaaauaugauuuaguacucuuagguggcuuuauauuguuaaaaugggugaauuucaccauuuacuauauuaaaguuuacucuuauauuuuauaauacaugaauauaguggaagaaaaauugacauucaagaccugcauagagauaauuuugaagaaagugaauauguguaugauuagugguauaauacacacauaauuugguagugugacauuuaauauuuugauaauuuaaaaaauuucugaccauuacuauuuggaagaucuauauaaaaugacagauaauuguguacugagauuauuagguaggaaauaauuacaacuaaauaacuuaggcugggagugguggcucaugccuguaaucccagcacuuugggaggcaagguggguggaucacuugaggucaggaguucgagaccagccuggccaacauggugaaaccccaucucuacuaaaaauccaaaaaaaaaaaaaagauuagcugggugugguggcacaugccuguagucccagcuacuugggaagcugaggcaugagaaucacuugaaccugggaggccaagguuucagugagcugagacugcgucucugcacuucagccugggcaacagagugagacucuauuucaaaaacacaaacaaaaaauaacaaaacaacuuacaguaacauuuuuguguuuuuaaauuacaaaaauuacuuuaaaauuuacauuucaggaaauuagaaaauaggaaacgcagauacaaauucauucaauuuccuaagcauuaguacaaccaguagaauauuuuaaaaauguucuuucgguguuguugcuuuauuuauacauguggauuuuuuuugguguuguacucauaauguauauuucuucuuuuaagugaaauauaaugucauaaacauuuuccuauaaugccaaguuuuuauaaccauuguuuuaauggcccacauaguacucaaccuaacgauauaucuuaauuuacuuaacuauuccucuuuguuggaggaguuauuuaugaaguguuuuagcuuuuauaacugucaucuuagugaauacuuuugugaauauuguuuuuauuaucacauuuggcauuacugcuuauaagguauauucucauaaguggaauucccagguaugacuuuuuuuauguccgcuaacaaauucuagcaagugauuuuccaaagagaauaugucaguuuauaucaccaccugcaggguguaaaacuaccuauuccauuguugcauucagcauuauauauucuuucuuuuuaacucgcacuauaauuagggaaaaauaucauauuguuuuaauuucaguuuuuuugauuacuagugaaguugcauauuuucauguuugguuucuagugucagaaucauaauagcuucaaauauuuuucccaguuccaauaacuucguuuuuuucuguauagauaguuuugucugucuaacuugauucauguacuucauguaacauuuuagagauguggccuaguuuuuuggcuuaaauacacacacuuauauucucaaugaugaauuucuccuauuaugcucaguaaugcuuucaaauuaguuauucugaagaaggaguaauacaacauuauguuuguauuccauauuguuauucuaguauauugugaaggcauauuaugugaguaauccuaaaaaauuuuuuaaauccagaaaucucccuuaaaucuagaaacuuuaaugauagauuauguuuaaguauauguuucaaauaugcuuaaguaauaguuuuuuaaagucugagaauuuauauuugaauuaugauuuuuuuuccucuuguagguuggaaaagagacuguucaaaccacugaggaucagauuuugaagagagauaugccaccagcauuuauuaagugaguaauugaaauauucuucuguugcuaagcagaauaauacucuuguuaggaagaaaaaguagcugauuucaguaacaacuuuuuuuugguauaaaacuuuuguuuacaauugaaauuucaacuuuuuugucuucuaacuuuuuuaaaaaaacuguucauuuuaguuuuugauauuaggcauuuuugacauaauaauuuuuuuuuuuugagacggaguuucacccucgucacccaguuuggagugcaauggugcgaugucagcucacugcaaccucugccucuuggguucaaaugauuugccugucucagccucuggaauagcuuggauuauaggcgcgugccaccaucccuggcuaaucuuuguauuuuuaguagagaugggguuucaccauguuggccaagcuggucuugaacuuccgaccucaggugauccacccaccuuggccucccaaagugcugggauuauaggcgugagccacuguaccuggccaauuuuugacauaauaauuuuuaauaagaccaugaguuuugaguuuuucuuuccaaaaugaaaaguauucagagacccacugugacuauagcaugcaugaaucuacauuguauacuaggcaccuuugcuuggagauaagggaauaaugguagauauaaacuuuaaaaaauuauuguuuuggccgggcgugguggcucaugccugucaucccagcacuuugggaggccaaggaggguggaucaccucaggucaggagaucgagaccauccuggcuaacauggugaaacccugucucuacuaaaaauauaaaaaaaauuagccaggcgugguggcgggugccuguagucccagcuauuugggaggcugaggcaggagaauggcgugaacucaggagguggagcuugcagugaguggagaucacgccacugcacuccagucugggugacagagcgggacucugucucaaaaaaaaaaaauuauuguuucauauuuucaguuacauuuuaaauuuaaguuauauuuauauaucuccuaguauuccuaaaaauaauuuccaggcuuuuugggcuauucugcauaaaacaagcagacauacuaauuuuugaauacuuaaaacuucuuagguucuuauauugucuuugauuagugguuuuguucuauauggcagucaaguuguaagcaaaaguaaaagcugauguguaggacaaaaaaaauagaacucauagaagucaauaagaauaacauaagacuuuccaaaaagguguuugaaggacuugaauaggcaccucaaaagaggaaauuuaaguggccaauaaauauuuuauuucagucaucagagaagugcaaauuauuuuauuauacaccccaaauuaagaacccugauaauauuaguuguugauaagauguggagcaacuggaauguucuuacacugcuguugggaauguaaauugcugcagccacuuuggaaaacaacaugacaucaguaaaguagaagauaagcaguuccacugucggguauguucccuaaagauacucguccacaugcacaccagcauccauauaaaaaacauuucuaucagcauuguucaugaugaccccacuggucuaucuagaguagaauggauaaaauaaucaugguguaaucagaaauuguaauauuaaucaguaaugaaaaggagugaggaauuuucacuuaaaaaugguuaauuuuaugcuauaugaguuucauuucaauugaaaaaaacaaugaggccaggugcaguggcucacaccuguaaucccagcacuuugggaggccgaggagggaagaucacuugagccuaggaguuugagaccagccugggcaacauggugaaaacucaucucuacaaaacauuagcuccgugugguggugugagccgauagucccagccacccaggaggcugaagugggaggaucaccugagcuggggaaguuaaggcugcagugagcugugacugcaccacugcacuccagccugggugacagggugaaacccuguaucuaaaaauaaauaaauaaauaaaaagacaaaaaaagagaaaugaaugaaucucaaaaauaauugagggaaaugaaaaacagagagacagagagacggauagauagauagauagauagauagauagauagauagauagauauguagguuccacuuauuuaaaguucaaaaauggccagguguggugacucacaccuguaaucccaguacuuugggagaccaaggcagguggaucacuugaggucaggaguucgagaucagccuggccaacauggugaaacccuaucuguacuaacaauauaaaaauuagccaggcgugguggcucacacuuguaaucccagcuacuugggaggcugaggcgggagaaucacuugaauccggguggcggagguugcagugagccaagaucaagccacuguacuccagucugggugacagagugagacucugucucaaaaaaaaaaaaaaaaaaguucaaaaacaugcagaaauaaacuauguuguuuagacaugccuauuuauaugguaaaaagaugaagaugaguaaguaauaauggucaccacagccaggguaguccuaccucugggagggaggaagaggucuauacucaggaagagguacacaggggcaucuaaaagugguaauaauguucuauuuuugauuuaagugaugaguuacaugggcgguuguuuuauauuuaugcauuauauuauacauauguuuauuuucucuauguauguuaaauaucacaacuuuaaauaaagcuaaaaguguuccuuuauuuuuauccuccuuauguucuauuauuuucauugaacagauguaaaauucucacccauauugaaaucuucuuauuucuaccugagugggugcuuuaugcaacuguguuucuguuaauuccauaaaaugucuucaugugucaggaaguaaggugcuagaagcaucuguuuuuuuguacagccuguuuugugggaguaucuuuuuuguccuaccuucauuggacuuggugaucucaagguuucuucgagcucugaucaacaugagccuauuuuguuuacaugccauccgaucagccugguaauauauauauauuuuugagacaggcucucacucugucacccagguugaagugcaguggugcgaucauggcucacugcagccucaauugcccagacuuaagugauccucuugccucaccccgagucgcugggacuacaggugugugccacuaugcccggacaauuuuuaaaucauuuguagagguaaggucucccuguugcccaggcuggucuugaauuccugggcucaagcaauccuccugcauuggccucccaaaguguugggaguaccggcaugagccacugugccccggccuuagccugguaauauuaagaggaaucuuaugcugucaacuaaacauauuauaauuaaacuugcauuuaccuuacauuaaaaacauagcucuagcuuguagcagguugccccucaccccuuggaagauacagagcacggggaaugagugaguacagguuucacuaucggguagguaguuggacuagaagaccuuacaaacaauugcuuccaacccugacauucuagucuaugaauaugauuugauugguaaguggauuuugucaggaaacuuauuuuugcuuauccccagagacauauucugaaauaugcuaugugcuuucacagacuucuuuggggacuuagaaaaauuaaaaaugagcacacccuaguugugauaaaaauuucaaaaaauuuggucacuuuaaaacaaaauaaaacuuuacugaucacccugugugguaacuagggcaucaaccccuuacucuaauaauugguaauuuaaaggaaauuaagcauuuaucuugccuuuccuguacaaaauuuuuagaguagcccaauagcccuaguuguaaggugaauucuaaccaauaaauguggaagacaugacagaauuaaaaaaucauugaucgcugggcaugguggcucacgccuguaaucccagcacuuugggaggccgaggugggaggauugcuuaagcccaggaggucgaggcugcagugagcugucauuaugccacugcacuccagccugggugacagagugagacccuguguaaaacaaaacaaaauaaaacaaaccgugauggauuuuuauguuugcuuuucuuguuuuucuauagaaugcaaaaugaagcagaaaauaguagaugccuugacuuggaaaagacagggacagagaagggggaaacagauggaagcaauuaaugacauccuuggaacuauugaguaggacauucuuuugagcugcuugguugauguuuagaaauuucuagggcaugaccgacugaaacuuccucuguagucuacuuuugcaaggacuucucaagugacugcuuaagcaacacuaaaggcuaaaauauuuaaacauuuauuguuagaucagucuguacuccuagaauguuaagaugucaaggcuagagaaaacagaagauacuuggccuguagauagauuuauaccuaagcuaucugauauauauuuaaagauuuuucagggaaagauaugauacuuuuaggauuuggggaucucaagauccuaucauaggcuauuugugugauuggcaauuagggcauauggaaaaauggguuuaauacauuuaaaaugauacaauugucgaugaggaacuuccagugcucaggcaauuccuuacuguaaaagugagagccauuuuaauauagaacaagauuugcauggucacagccuuucucuuggguggagcuaaaguuauuugaucccuggcugcacuggcagauagagcucacaauuuacuaauuuuacccaagacugcaauaauagccacaguguugcauaagagguguaggguugcauggugauugccaucgaaacugcccagauugucauaaacuucaggagugcagcagcuaugcuguauuguuaaaauguugguuagacuaaccuuauaacccuauaagaaaucauuuguuccuggcugggugcgcuagcucacgccuauaaucccagcacuuugggaggcugaggcagguggaucacuugaggucaagaguucaaaaccagccuggccaacauggugaaaccccaucucuacuaaaaauucaaaacuagccgggcgugguggcacauaccuguaaucccagcuacuugggaggcugagguaggagaaucacuugaacccaggugguggagguugcagugagccgagaucaugccaugcauuccagccugggcaagagcgaaacucugucucaaaaaaaaaaaaaaaagaaaagaaaucauuuguuccuuuugagacugucagcaggggagucagcuacuguacuccauguuuacauuuuguaucacugucaguugucauuuucuucuucgucaucaucaucaucagacugcuguggcaguaauguuuuauauauaauugauuaaugggcuagacaugcuccuugguuaauuauuuacugauugccuucuaugugccuagcaugcugagugcuguuuauagaauaguaguuccuaccaguguguaaugaauagucacuugugagauauauugcaaauaauauauuaacaguaauaaagugccagaggauacuaaugcuuugcuuuaaaagaaaaaauuaauugagaggucaggcgugguggcucaugccuguaaucccagcacuuugggaggccgaggcggggggauugugaggucaggagaucgagaccacggugaaaccccgucucuacuaaaaauacaaaaaauuagccggacgugguggcaggcaccaguagucccagcuacucaggaggcugaggcaggagaaugcgugaacccaggaggcggaguuugcagugagcugagauugcgccacugcacuccagccugggcgacagagcgagacuccaucucaaaaaaacaaacaaacaaacaaacaaacaaaaacuuaauugagcauauuuaaguucacguguauaauaauaucccucucauuccuucucauuauguuuuuuuuuaaacuuucauugaaguauaauaugcuuguuauuauguuuucuuuaaugggagauaaaauaguggaacuacagcuauuguggcugggaauuaugcauaaucccaaguagacccauggggauaugccauaaacuugaguuuuauuuuucuauauaugauggcagagcaaaaguggaaacacuacugcagagaaauuuuguaaaaaagaaauauuuuaagacguuuccaauuaaagagcuauaauacagacugacuuuaugauaggaauucagagagagagcucucucauuauaaguaggaauaguagaaagagcguuuauguaggaaguggggcuugggaggaugguuagauguagggaggaaggaaaauacucuaggugcaaugaauggcaugaccaagucaugagggccuguggggagaggggcacauggugggggugguaggaacuaagcuuagguagguagguugggcaauagugaagguccuugaaagccaggcaaaggaauuuagaauugggcaggagggaagcuuuguaguugcugagcaguaggaugacaauaugaaagcaucuuccagaagauucauaaccaaauacagaaggaauaguaggugcuaauguuguaacagagaauaagcuagaugucaaacugaccagauuuauuuucugucaguguagauuugcuucagauugauuccuuauuauaggugagaaauguuuauagcaaacuauuuuauuugccuuggaaaaauugucauugcuguauacaguggaauuucauucuuauuucugcaauggagcagaaaugaauaaggaaggcaauucuuggaccugauccaaggauguucagaacugaauggaucaaaaagcaucacuucugagguggucuugugauaugaacuugaaaagggcaugguguacauuaucuguuggcaggcaaaugacagcuuucauuucgaacuggacaguguugucacuuucugccuuagugcugcucugacagucugcuugaagucaaaacuuggauugguucaccagcuuggacuauuuuugaagcauacuguaaugucuaggcuuauugaauaaaagaauguucccaaaauaccaugugaaaggauguacuacugcuacaugauugccauuauucacauuucuugggaauucuuuguuuuaacccuuaaacuuuauuaguuaagaacaguuaugguauuuacuuauacaaauuuaccauaauuuauauucaugcacaaagaagaaauuugagaaggauuaaaauaugcuuuauacuuaauuuagaucucuuuugaccuaaaguaaugaugucacauuuuuaggucaucaggccuuguagcuuuuucuuugcuugugaucuugaacacucaaaauaauuugugaugaaauuuguauuuuuaaacacacuugugggugaaagugcccagaauaucuuuuuuuaacaauuaauuacuuaaucauaucacuuaauaccuuuuguuugccuggggcuaaugugugauuuguguguguguguguccugaguuuugugguccuuuccacugcuacaguauuagaagauuuuugucucuuaauguggaugcccaaguucugugauguaaucauugaccucugcccacugccuugcugcauuuuugaccuagagcaagcacucaaacuuuaaauaguucaccuuuggacuugccacauuaagcauaauuuaguacuacuguauuuuuuuuuuuuuuuuuuuuuuuuugagauggaaucucgcucugcuacccaggcuggagugcaauggcaccaucucagcucauugcaaccuccaccucccagguucaagagauucuccugacucagccucccgaguagcugggauuacaggcauaugccaccaugccuggucaauuuuugcauuuuuaguagagauggguuacaccauguuggccaggcuggucucgaacuccuggccucaagugauccauuugccucagccucccaaaaugcuggccuaucacuacuguuuuuuguuuguuuguuuguuuguuuuuuguuuuagacggagucuugcucugucauccaggcuggagugcaguggugugaucucggcucacugcaaccgcugccuccuggguucaagcaauucucccgccucagcuucccgaguagcugggacuacaggcacgcaccaccacgcccagcuaauuuuuguauuuuuaguagagaugggauuucagcauguuggccagccuggucuugagcucugcucaauuucuuaaauaccuuguaugagcuggguauuuuaaguuguguuauuuaguccacuucauuuuucagaugaagagaagcucaguaagguguugaaaguuacucaguucauacauggcagagguaggauucuaacccugaacuguuugauuccaaguaugcucauuccaguaugcuaagguacuuucucauucuucuuuacaauagucucuucuucuaacauaauaguuauugugagguuuaaaugagugaaaugauauaugugaaaauaccuaaaacaaacaaaaagaaacauuuggugauuauguugcaggacaggcaaaccccaaaacugagguuuaucccaagaggguucuuggcuuuuccuaggaaagaauucaagagcuagccagugguguuagcaacuuuuauugaagcagcaguguacagcagcagcagcagcagcagcagaggcauuucugcuggcggagcagggcuacccuagaggcagcgugcccagaguagcagcucagaggcaguucugcauucauauuuauacccacuuuuaauuauauucuaauuaaggggugauuugugcagaaauuucuagaaugcaagugguggcuacuagguuguucaguuguugccauggaaaggggcaguaacgucuggguguugccguggcaaugguaaggugaccuaucacccuggugggugugucuuauggggaggugcuuuuacccuggaccugcuuuagcuaguccucuaugugguccaguguccacgcccugccucuggaauugaguacugacuccuacuucaauuacauauuagcucccuucuauagcuucuuuuuuuuucuucuauagcuucuuaauuuuuguuucuuaauaauuuucuccaaauaaaugauucaauucuucaguuaguuuuuuuuuuuuuuuuuuuugagacggagucucacucuguagcacaaguuggagugcaguagcgugaucucagcucacugcaaccucccccucuagggcucaagcgauucucaugccucagccccgcaaguagcugggacuacaggugugcaccacuacucccagcugauuuuuuguauuuugguagagaggggguuucaccauuuugcccaggguggucucaaacuccugagcgcaggugaucugcucaccuuggccuaccaaagugcugaaauuacaggcgugagccaccgugcuuggcccuucaguuacuuuuuaagcuuuucucagagauauuuuuuaucuaauuuguagucuucuguaguaagacuuuuuuuuuuuugaauuggaccaugauuacuuguuuuuauuuaaugcccuuucuuucuguaucuguugaguggauuacacaauuuuuauccuuuacucuguugagauagucuaugguuuacuacaugaauauagauuugcugauaaugaaccauucuugcauuucuaggauaaacccuaccuggcugugaugaaaaaaaaaaauauauauauauauauauauagugcugaauuuaauuugcuaauauuuuaaaaggauuuugcauuuuugcucaugagggaccuuuaucuguaauuuucuuuucuuuuuauguucuuuucuaguuuggguaucaaaguuauuuuagcuucauaaaauaaggucuuuuucuaguuuuugaaacagguuauguaagauaaagauuaucugcucuugaaaguuuggcaaaacuugcaucuaaaacucccuguaucugguggugucuuugggaggaagagauaugacuaaaaagaaacucgcucaguuuuguuuuauuaucuaaaucagguucuaaauucauugugagucaacuuugguagucugauacuuuucuaagaaauuaccaauuuuauccaaccuuccaauuuauuagcauaaaauucauaauaauuauucuuuuaaaaaucucuguuguaucuaguuauaucacauuuccuauucaguauugcuuauuucugccuuuugucuuuuuuucuuaucgcucuuauuagagauuuaucugucuuaccagcuuuucccacaaagaucuauuucauuaaauucuuuucucauauuuauuauuuacuuuucucaaguuuauuauuugaauaccuuauuuuuaauauuucagucuuuauguucaaucuuucuuuucuuuuuucuuuuuugagauagcgucuugcuuugucaccugggcuguagugcaaugacaugaucucggcucacugcaaccucucccucccggguucaagcgauucuccugccucagccucccaaguggcugggauuacaggugcccgccaccaugccuggcuaauuuuuauauuuuuaguagagacaggguuucacuauguugguaagacuggucucgaacuccugaccucaggugauccacucaccuccaccucccaaagugcugggacuacaggcauguaccacuuuaauuuuuaaauuagagaauuuaaaaauucuuuaaaauuauuuuuuaaaguuuucaaaauucuuuuuaauaucuuuuguuauauuucuaauauaauuguauuguacccaaagacaugguugguaugauaucaauucuuggaaauucuuuuguuacauacagcucaguucuagugaguuuuuaugugugcuugaaaagaaaguauauucucuuuugcuuggguauagaguucuauuuauacuaauuaggucaguauauaaauauuacuaguccaauuuuuuauagccuaauuugucuguuucaacuaucagcuuaugauugauauauguuaaaaaucuccuauacuaauuguagaccugucuguuuuucuuauaauugucaguguuagcucuacauauuucaaagcaauauuguuaggugguuacaaguuugugauucuucuggguucugaauucuguuaauuauuuguugcuaauuaucuuuuuuuagaaugacuguugauagacguuagccugcuguuggcuuguuucuccagacuguguucuucuucuuuuaaucuacauccuaguuuuugccaguuuucuucauaagugaaaaauauccucuuauuguaucuaucacuucauuuuguguuuagguugccacgccuguaacucuuuuauuacauucuacuguagaacagugauugccuacuuuuuuucagcauaaggaccuuuaaguaauaauagugaaauuuuaggcugggcgugguggcucacgccuuuaauccuagcacuucgggaggccagggcaggaggauuacuugaggccaggaguucaagaccaguguagccaacauggugaaaucccgucucuaccaaaaauacaaaaauuagcugggcgugaugcugcacaccuguaggcccagcuacucgggugacugaggcaggagaacugcuugagccugggagguggagguugcagugagcugagaucacgccauugcacuucagccugggugacagagcaagacuaugucucaaaaaaaaacaaaaacagaaaaaccaacaacaaaauaauaauagugagauuuuaaauuauuucuugauuaagaaaugcauaaaaacaaaaagauacaggccgggugcgauggcucacaccuguaaucccagccuuuugggaggcuaaggugggcagaucacuugaggucaggaguucaagaccagucuggcuaacaugguggaaacccgucucuacuaaaaauacagaaauuagcugggcauggugaggagugccuguagucccagcuacuugggaggcugaggugggagaauggcuugaaccugggaggcagagauugcagugaguggagaucaugucacugcacccuagucugagugacaaagugagacucuauuucaaacaaacaaacaaaugauacagugaauuucauaauauuuuauuuuauuuuauauaauuuuuugagacaggaucuugcuaugucaccuaggcuggaauguaguugugugaucacaacucauugcagccucagccuccugggcucaggugauccucucaucucagccucccagguaccugggacuauaggcaugcaugcuaccauaccuggcuaacuaaaagaaaaaaaaaauuuuuuuuuuuuuagagaugggaucucacuauguuguccaggugggucuagaacuccuggguucagucaauccucccagaauacugggauuauaggcguuagccaccacgccuggccaauuuaguaauauuuuaagauaauuuaaaaauuuuauucaucacaacagaaucaacauacauuugaaaacugcuaguaucuguaagacacucuugcuuguauacucagucuauuucugcugcaacccuaguaugagauggaggaaggacuguggagcugauggaccaggagguagcagaguucuugauugaacucugcacacucagaaucugcacugacgcuagauuugacaagagaauaagggaagaagggagaaagaacaggacugguuauucagguuuuaaaggauuuaaagauugugacuuauacacaucuuuaaaauaaacuacuuaccaagacuugaggaacauauagcuugggcagcuguaacguuuguuccucucccauucuuucccaacaugcugcuuccccuucaguuaucaauugacuuggacagaguccuguuuuauuugaagucaaaacuggcugcauacccuccuaaucucaauaaucugaaauaagagaauuuagugagccuguggguuuugugugugugugugcucaugauggguguguguguguguuuaggcuuuguuaucuaguauacauccucuagcaaaggguuugguguuucccuugaaauguuuugaauguuuucaauaugacucauuguggguuauuuuuuaaaauucaguuuuccccuuagcuuuauugagauauaauugacaaauggaaauuguauauauuuaagcugcauccuugugguuuuauuuuuaguuuuggguguacucaugcaguguccuguacuaucacuguuuggccuugauaagaacaagaaguccacuuugcauuauguuguacuuuaagagaguugggacagggaaaggaauacuuuguggaugaggucuguaggaucuuuaaauguaggaguacaggguuggaacagcauguauuaauauuaucacacaguguacacccgugugaguuggugcugcauacuugcuacuugaauuagauuaaagcuugucauuguacucuguguuccugacucccuccuaaaaacuguaacuaugcuuguggccuucagucaggugucuaggugacuaauggcugaggauccuugaccuuucucaaaauggcaacuccaggagcaaagcauaucagcuauuacugauaugccacagaaugcguccaucucuacuguuuuaaaguacaaucugugccaaaugcuucauauuaacauagaaaagaaauuucuucaccuaucuccugagucuuuugaaaucuucacauauauuauuuucuaaauuauuauuauuuaaaauuuucuuaaagauggagucuugcucugucucccaggcuggauagaguacaguggcaugaucuuagcucacuguaaccucagacuucugggaucaaacaauucuccccucagccuccugaauagcuggggcuacagguacaugccaucaugcauggcuaauuuuuuaaaauuuuucguagagauagggucucgcuacguagucuaggcuguucucaaacuccugggcucaagcaauccucccaccucagccucccaaagcgcugggauuauaggugugagucaccaucccuggcucuauuuuuauuauuuaaaaaaaaauuauauguauauauaaauuccagugaauugauagaggcaguacuuccuauuugaagcauacuagaauggcugaacucucaguugcugaugccugaaauuuuauauuggaguucauuccuuagguuaacaauuuaaaucuuaaauaucuaaugaagggauaauuuggggggccuuagcagucauuuucacuuagaucuuugucugaagguagguucuuaauaugcgggaaggcagagagagcuugagggccugccuguaccccaaaccccugucuucucacucaggccuuauauuaugaagggucuggacuuuaauauuaucuucaaauaaggccauguauguagucacaggaaaaaaagaaguuuuaaaagauguuguucauggccaggugugguggcucacguuguaaucccagcacuuugggaggcugagguggccagauugcuugagcccaggaguucaagaccagccugggcaacauggcaaaaccccaucucuauuaaaaauacaaaaaauuaccugggcaugguggcaugcaccuguagucccaguuacucgggaggcuaagguaggaggaucacuugagcccaggaggucaaggcuguggugagccgugaucgugccacugcacuccagcccagacaaaaguugaucaugcaauuaaaauauuaaauguaagcacuuaaauagaccaccauuuuuaugaaccuguuuuggcauuucuucauuuuuaaauaugauggacuucucagacugggaagugaucuaugccuuucuugaugucugaaagacccugacaggaugggaagggaagggaagaucucaacaagggcuaagaaaagaggaagaauagcccugacaauugauuuugccugccacauaauuauacuggggccagacugguuggagaugacagugagggaggugcugggugcaguggccagguggagaaaaccucacugaccagauucucauguucucacuuccuucccuccaccuguuuccuucccaucucccaagugucgucguagccuuguuugaucagauauguuugugggcucugcaacaagcucucucucucuaauacagggaucgugguauguaaacaccuguuuccuugggugugcuccaggaacugcgaccuccaugaaauaaaauuuucaaguguucuguuccauaguacuucacucuuaggcaaacaaugcaucuuuuugacaguauuuauaaccuaaaaggcuauacugucuaagaucaguuuuaauuuuuuuguuuuuauuaaaacagugaaugugauaugaguuacuuccacuccuccccaacuuuuuuuuuuuuuuggugggagugaaaguugaacgugaauguuuucaagugcuuuccaguuuuaauuuauggaccauaugucuaaauagacuuaaucacaccauuuccuuuauauuauuuugucuaaagcucuccuuuccacggccacuaaaccagugagcugacauaggaugacugcuuuuuacagaaguagauugagauuguuuggcuuuagagugagcuaccugcacuuugugaugguagacugcccucccuaguccaacuagaccgauugcaagugcauguuauuucucacagaaagggugugugugugugugugcgugugcacgugcguaugcgugagagagagagagaaagagaucuacuggaaaaagagcucaaagagaugcugcaaagagaaucaucuuuauaaguagugcugaacuucucaaggcaggagcaguguaguuaccuucuccaucgcaacauuccuaaccucuuagguaaaaaugacuccuccaggccaggcacgguggcucacaccuguaaucccagcacuuagggaucaccugagguugggaguucgagaccagucuggccaacauggugaaaccccaucucuauuaaaaauacaaaaacuaguucggcaugguggcgcaugccuauaaucccaacuacugggaggcuaaggcuugagaaucacuugagugugggagaggcagaguuugcagugggcugagaucgcaccacugcacuccagccugggugacagagcaagacuccacuucgaaagaaaaaaaaaaaagaaaagaaaaaaucuccuccugcuuuugcacccauacuuuuuuuuuuuuugagacggagucucgcccugucacgaaggcuguagugcaguggugccaucuuggcucauugcaaccuccaccuccuggguucaagcaauuuuccugucucagcuuccugaguagcugggauuacaggcaugugccaccacgcuuggcuaauuuuuguauuuuuuaaguagagaugggguuucaccauguuggucagauuggucucgaauuccugaccuugugaucugccugccuuggccucccaaaguguugggauuacaggugugagccaccgcguccagccugcuggacauacuucuaaagacugauuuguacuugucuccuccuaccaagguuccucuuagguaaggacuuuuaaaaaauauucccauuucuaggaaucauagcauguaauaguuccucaauauauuagaugaauaaauauaugaaagaauuuaaaggaauuuaagauuagugacucugcugggcacaguggcucacgccuguaauucuggcacuuugugaggcaaggcaggaggaucacuugagcccaggaguucaagaccagucuggacaacauagggagaccuugucuguacaaaacauaaaaaauuagcugggcauggugaugugcaccuauagucucagcuacuuaagaggcugaggugggaggaucacuugagcccaggaguucaagaccagugugggcaacauagugagacccugucucuacaaaaaauauaaaaaauaaaaaauuaucugggcaugguggcaugugccuuuggucucaguuacuugauaggcugaggugggaggaugacuugagucugggagguugaggcuacagugagcugugaugguaccacugcacuccacccuggguaacagagcgagacacugucuagaaaaaaaauuuaguaacucacuuuuucuggauauagucuaaaagaacccuuaaaaaggacuugcaggcagagugugguggcucacaccuguaaucccagcauuuuggaagaccgaaguggguggaucacuugaggucaggaguuggagaccagccugggcaauaugaugaaaccucaucucuacgcaaaauacaaaaaaaauuagcugggcauaguggcgcauuccuguaguuccagcuacuugggaggcugaggcaggaggauugcuugagcccagggaacggagguugcugugagcugagaucgcgccacugcacuccagccugggcaacagaaugagacucugucucaaaaaaaaaaaaaaaaagaaaaagaaaaagaagaaaaaagacuugugguagucuuuuuauaaucucuaaauggauuuuccucuucuuuggcauacauuuaaucuucuugguuagugauaauugaaaucacauggaacugaggaauuugugcucuuuuuuucuuacaaaauaauuacucauacucaaggucuucuccuaaauugucucaaauuagaguaggugguaauucugggaagaauguauuagagggucaugagugagcauauuucgagaucccauaaggcugucauugguccauuugauauauagcauaagauuuuuuuucuagcaauuuagguugaagauucaaagggagagagaaguacuaguugauugauuuaaauuaucuaauuaaauauuauuaguauauaguuaagauauacaauuauuuaggaaacugaccuuaugccuacuuucauucuuuaaauacuuuuuaaaaauucagauuucuauuaaaaugugcaagaucacuuuaagaagcuagggagcuugaauguuuaaauaaaauccaauuuuccauacacaagacagacuucuuccuguuucugacugcugguuagucuuagugggauuuguuuggcuuuuaugaaugccauuaaauuuuaaugugcagaucagaugucuuauuguauaaaaaaaugguucagucucuguuuuggaccuaucauuuuaccacacaagggaaccauuagugauaaucaauuuuauuccuguaaaccuuuucaauuucaucuuuuucaguuuccuuucuccauaauggucauucuugucauuuuuuuuccaaauuugaaaaacuuauacaguaacuggauuucauaaauagauauaucacaagacuuguaguuggugaugcuuuuguuuguuggcuauaauuucauaaauguucaaguuuccuggaaacaauuucuuuaaauauuacccuaccacuaccuucucuccuuuggaaacuuuaauuacacauauauuagguugcuuggaguugucccacaguucacugaugccauuuguuuuucaaaaucuuuuuucacccuguuuuauuuuggauagucuuuauugcuaugacuucaauuucacuauuuuuuccccugcaauaucuaaucugcuaguaauucacaguguauuuuuauaucucagacauaucuuucguaucuaguuguucuauuugggucuuuuucucuaucuuccauuuaucuaacuaggguaaccaaucuacuuuuuuuuuuuuuuuugagacaggaucuugcugggucacucaggauggagugcaaucacggcccacugcagccucaaccuccugggcccaagugauccucccaccucagccucaagaguagcuggggcuacaggcgcacaacaccaugccauuacauuuuuuauuuuuauuuuuugagauggggucuuacucuguugcccaggcuggagugcaguggcacaaucacggcucacugcauccucaacuucccuggguuuaggugauccagccaccucagccuccugaguagcugggacuauaggagugcaccaccacacauggcuaauuuuuuauuuuuuguaaaaaugggguuuugccaugcugcccaggcuggucuugaacuccugagcucaagagauccuccugccucagccucccaaagugcuaggauuacaggugugagccaccaugccuggccugauuuuuuuuuuuuuuuuuuuguagagauggagucuugcuauauugcccaggcuggccuugaacuccuggccucaagcaauccuucugccucagccucccagaccaugguauuaggcacugugcccagcucaaucuuuacuuuuguuuuuugaacauguggaguacaguuaugaccauuuuaauguucuuauauacugauucugucaucuuugucauuucuaggucgguuuuguuuugaaauagggucuuauucugucacccaguaugggaugugguagugcgauaauggcucacugcagccuuggccucuugggcucaagugauucucccacuuuagccuccugaguagcugggaccacagguacuuaccacuguuccuggcuaauuuuuaaauuuuuuguagagacaaggucuuccuuggccgggugcaguggcuuacaccuauaaucccaacacuuugggaggcugaggcggguggaucacuugaggccaggaguucgagaccagccuggccaucaugauaccccgucgcuacuaaaaauauaaaaauuagccagcuguggugugguagcacacacuuguaaucccggcuaccugggaggcugaggcacaagaauccuuugaacccaagagguggagguugcuuugagccgagaucgcaccacugcacuccagccugggcgacacagccagacuuugucuaaaaaaaagaagacagggucucccugaguugcccaggcuggucuugaacuccuggccucaagcaguccuccucucauccucagccuccuaaaguguugggauuacaggcaugagccaugacaccaggcccgagguugguuuugaaugauugacuuuucucuucauuauuggcgguauuuucaugccuucuuguauaccugauaauuuuugacuggaugagaguuuccucuuauugcugugacaagucaccagaaacuuugugguuuaaaacaacacaaauuuauuaucuuacaguucuggaagccagaaguccaaagugagucagcagggccacauucuuucuggaaacucuagaaaagacucuguuucuucaccuuuuccagcuucuagaggcugccugcuuuccuuggcuuguagccccacauuacuccagucucugcuuucauuaucauaccuccuucucuccugcuuccauugccaugucagugaaauaaugcccucaguuugcuaauaaaauaacugucaacuuagaauucuguacugcuauaauagucuuugaagaaugaggacaaaacagacauuaucaaacaaaaacugauacauuuugucaccagcagacuuuuacuagaggaaauccuaaagaauguacuucagacaaguccgcugaucccagauguaagccugaaauacaagagggaaugaugagccaagauacuggacaguuuguugguaaauguagauaaguguugauguauauaauaaugggauguuuuuacucaacgcuucugauaccagauguauggcuuuuuuuuuccacaccaacaaccagucuuccaacucuucagacaccaacuugguauucagcagcgcaauucaauucugacacuaacuauccagaguuagugucagacuccacagguuuaagugcuuagucccauaaaacuauccucacuucagauaccagucacaaguauugggugccugguauacccacacuucugucugacuuuacuacaaaguugggaguuccuacaacuccccgcuuucggguuuguuaauucgcuagaauggcucacauaacucacagaaauacuuuacucaaauaguuaccaguuuauuauaaaggauacaacccaggaacagccaaauggaagagaugcauagggcaagauaugaugaggaagauuucaugcugccugggugcaccaccucccagcacccagauguguucaccaacucagaaacucucugaccaugccuugauguuucuggaaccagcucccguuuugaagcuaucuagggucccccagccacuagucaucuuauuagcauacaaaagacacuuuuuuuuuuuugagacaggauccagcucugucacccacacuggagugcaguggcaugaucauagcucacuacagccuugauauccuggacucaagcacuccuccugccucagccuccugaguagcuaggacuacaggugugagccaccgugccugccuaucuuuuuaaaauuuuuaguagagaugagaucuugcucuguuacccaggcucgucuggaacuccuaagcucaagugauccuccugccuugggcuuccaaaguacugggauuacaggcaugagccacugugccuguccacaaagacacuuuuaagugucaaaagacacuuuuaggaaaaauauuuuuccuaaaauuuggaucacucauucuuuuuaauaacacauagaaaauuuauaaaaauaaaucauauguuaagccaugaagcuagccuaaauauauuuuagugccuuaagaccacauuuucuacacaacucauuugaaugauaaaucaaugaucagaagauaagaggaagaguccuuuauacguagaaguauauuuuaaaauucccaaacaauucauuguuaaauaaaucacagugacaauuaaaaaugaaugacaaaaacacuaccuaucaaaacccauggggccaguaaacagugaaacaaacaaacaaacaauccucaguuuuauuaauaaaagaaaaaugcagggcugggcacaguggcucaaauguauaaucccagcacuuuuuuuuuuuuuuuuucagacugagucucacucugucgcuuaggcugaagugcaguggcgugaucuuggcucaaugcaaccuccgccucccagguucaagcaauucuccugccucagccucccaaguagcugggauuacaggcgcuugucaccaugccuggcuaauuuuuguauucuuaguagagacaguguuucaccaugauggccaggcuggucuccaacuccugaccucuagugauccacuuaccucggccucccagagugcuggguuuacaggugugagccacugugccuggcccccagcacuuuaggagucugacauggaugaauugcuugagcccagaaguucacgaccagccugugcaacauggcaacacuccaucgcuacaaaaaauaaacauaauuagcuggguaugauggucugugccuguagucccagcuacuugagaggcugaggugggaggugaccaggaggucgaggcugcagugagccaugauuauaccacugcaccugccgccugggcaacagaccgagacccugucucaaaaaaaaaaaagaaaaaaaaagcaaguuaaauucacaauaguuuaucguuucacauugaccagauuggcauauuaaaaguucagacgaugaggaucaagucuguauacugcugguagaaguauucaauugauaaaaccauuuuggaaagcaguuugucauucccugguaaaguugaauauauuuauuuucuguaauuuaguauuuccauuacuagauauauaaucuaaacucuguucauguguaccaggagccagaauaaaaauuuucacagcacuauuauucauauuaacacuaauaacagaaacaagaaccuagaacaccucuaacauccagcagagguagaauggguaaaucaauuuugguauauauauauauauuuuuuuuuuuuuuugagauggaguuucgcuuuuguugcccaggcuggagugcaauggcacgaucucagcucaccgcaaccuccgccucccggguucaaguaauucuccugccucagccucccgaguagcugggauuacaggcaugugccaccacgcccagcaaauuuuguauuuuuaauacagacaggguuucuccauguuggucaggcaggucuugaacucccgaccucaggugaucugcccgccucagccucccaaagugcugagauuacaggcgugagccaccacgccuggccaauuuugguauauucucacaggggaauacaacauaguagcuacaguuguuaacaugauggacugaacauuauaauguugaacaaaaagaacagucacagaagcaugcauaacgguaugauuccgcuuaaguuccaauauaggcagaacucaacaaaaaauugcuuagguauguauacauauauaggugguaaaaguauaaagaaaaucaagaaaauaauuaacaacauucagaguaauaauuaucucuggagaauaggaaggaggauuugguuaaggugggguucuaaaguaccugguacuauuuuauaaaaugauuuuuuuuuuuuuuuugagacuaaaucucacucuauugccuaggcuggagugcaguggcaugaucuuggcucacuguaaccucugccuccuggguucuacugauucuccucccucagccuccuguguagcugggauuacaggugcccgccaccaugcccagcuaauuuuuguauuuuuaguagagacgggguuucaccauguuggccaggcugguuucgaacuccugaccucaguccgcccaccuuggccucccaaagugcugggauuacaggcaugagccacugcaccuggcauaaaaugauuauugacuuuuagguagaugguguuuguuugaauuaaaauuuauacaaucuuuuacauguguuauuuuauuuuguaacuuaaaaacuaugaaaauccucaaccucaauggaaauuaacacuauauugaauaaagauaaccuacagacugggaaaaaaacauuugcaaauuguauuucugaugagaguuuaauaacuagcuuaucuaagaaacucuuacaacucagccccaaaagacaaccuaauugaaaaaugggccuaauugaauagacauuucuccauaaaagauguagaaauggacaacaagcacaugaaaagauguucaccaucauugaucauuaaggaauugcaaaucaaagccauaaugagauaccacuucacaccugcuaggguggcuuuuauuuaaaaaaaaaaaaagauaagcauuggugaggauauggagaauuaggagcccuuaugugaaauggcacagugcuggaaaauaguuuugugguuucucaaaaaaucaaacauggaauuacuauauaaacuagcaauuccuccccuagguauauaacuaagagaaaugagaacauuauagcagcauuauucauaauugcuaaaagguguagacagcucaaauguucauaaguagauuaauggguaaacaaacuguggcauauccauacaauggaauauuauuauucagccauaaaaaaagaaugaaguauugauacaggcuacaacuuggaugaaccucaaaaacaugcuaaaugaaaggagccagacguaguguaugaauucuuuuguaugauguuuccacaauaggcaaauccagugagacagaaagcagauuagcgguuaucaggggacgggggaaggagaaaauagggaguuauuacuuaaugaguauugcguguuuuacugagauaaugaagaguuuuggcacuagagagaggcagugguugcacaacacugugaauacacuaaaugcuacugaauuguacacuuugaaaugguuauuuguauguuacaugaauuucaccucaauugaaaagaaacuauguuuggauccaauuuugguuuauuauuggugaagauccaaaauuugaauuggugagaagguaagaacuguuuaguauaacuucugcagauugcaauauggcaacauuuguuaaaaauuauacauaugcauaccuuugacucagcaauuuuauaucuagaauguauccuacagacauacaggguaaaauuacauguauucaaggugauucaucacagcaggcuaauaacuauuagccugggcuauuauguagcuuuauaaaaguaggaggaggcucuuuauguacuuuucuuucuuuuuuucuucuucuucuuuucuuuuuucuuuuuuuggagucuugcucuguugcccaggcuggagugcaguggcaugaucucggcucacugcaaccuccgcuuccuggguucaagugauucuccugccucagccuccccaguagcugggauuacaggccccugccaccaugccuggcuaauuuuuguacuuuugguagagauagaguuucaccauguuggccaggcugaucucgaaauccugaccuaaaguaauccaccugccuuggccucccaaagugcugggauuacacgugugagccaccaugcgcggcccucuuuauguacuuuuaauagaacaacacauaaauguaaaaagcagaaugcagcgagugaccauauaugauccuauuuguguaaaaaaguggggaaauguacauuuuugcuucuuugaggccugaaauguuuuaugaagacauuuacauacagaggaaauacaacauuggaggaaacucaguauugguugcaagugggauggaaugagugcauggaagauagugaagggaaagagauuucucauuguaugcccuuuugguuuuaaauauguguauaugcuuguguaauauguaugaauauauauuauauauuuaaaauaaaauuaaaaagaacaaaauauccaguccuuuaagccugaucaaaagccacaucaaacaggucuugcccuucacugauauuuauuauauacugccuuauguuuuuuuuuuuguuuguuuguucguuuguuuuggagacagagucuaacucugucacccaggcuggagugcaguggcaugaucucggcucacugcaaccuccaccucugauucuccugccucugaguagcugggauuacagauguccaccacuaugccuggcuaauuuuuguauuuuuaguagagacgggcuuucacuauguuggccaggcuggucucgaacucccaaccucaagugaucugcccaccuuggccucucaaagugcugggauuacaggcaugagccaacugcgcccggccauguauuggcuuauucugccaauguuugugucuugccuuaguaaaguaugcuccucgagaguuagaauagugcuuuuuacaucuuuauauacauaccuacaguguccacagcccagugcuuuuuauguaguugaaauucauaaguugguuuaauucuacuuguuaacaauguaauacugcuuuaaacuuguggaguuucuguauuacuucauuuauccucaaaagaaccuggugagauaggcuuuuauuugcaggugacauuuucuauguuuucaaaugagacuguauaauucuggcuaagcauuuuaacuuuaagcaguuuguuccuuaucuuuguaaguuagucagucacaacauaauggcuauauugaauaugagacuagaggagaugaucuauuagguuauuuucaacucuguggggaugaguaauugaaugaaugaaugaauacauuuuauuaguacaaggaaggcaaacugaauacuugguguaugcauuuuggguuccucuuuuaaaugaaucccccgcccagcuccccuuccaccacucaaccuuuggcugaucugguuacuuauauuaauauuaaacuauuaauaacuggcuuaguuacuaauaauagugaccuuuaauuaacaauauauuuucauuuuaauuuuuaaauuuuuguuuuuauuuucuuuuaacaauauauuuucaaaugguccaauggauuuaucaaacaaauuuauuuagcuagaugaaugagugagaaauuuaugcauugccucauacuuuuucuuuguguuucuuccuauuccuuugcuuuguuuaguuauuaaauuucacuuaacaccaugcuuuggcauuuuauuuccagauguuagaucugaaaaugaucuaacauuucagcaaagaacugaaggauuucaguucuuugugcagugucuuuuaauagcaguguguauaggguggggaggaauaaggaaacaaaggcauugcagagauagagcaaccugaagucaaagagcccagauguuuucucgucauuuuuuguugucaggaaauaaagaauaagggcagugcacugaaugaaugugcugcuuuuaccuguaauuuuguaauuuucuuuuugaaacagggucucucaaaaugcugggauuacaggcaugagccacuguguccugccuaaauuguaaaaucuaaaaacguagguucuauuaucaauuggucuuggcuauuuuucauguagggaaaaaaacugugaauuuacaugcauauucucucuuuguauuugcauaugguauucuucugugugguucugccgguguguuaaccuguguucuucccuauaggguugagaaugcuugcaccaagcuuguccaggcagcucagaugcuucagucagacccuuacucagugccugcucgagauuaucuaauugaugggucaaggggcauccucucuggaacaucagaccugcuccuuaccuucgaugaggcugagguaggcaaucugagacaaaaagccuacucuugaagauaauaauggaagauugaugauuguuuagaaugaaaauauguugaaugcugcacaucuguguuaccguguuugcuaguuguccacccaugugauugaauacucugaaauauuuuuucagguccguaaaauuauuagaguuugcaaaggaauuuuggaauaucuuacaguggcagaggugguggagacuauggaagauuuggucacuuacacaaagaaucuugggccagguuaguuuuauccaauuucuauaacauuuuuuaaggauuguccauguuggagccaaaggaaaggguacccucuuccuacuuuuugcagaagauaggugaagaugcauugggcuuucaggugucugcucuguugauggagaugaugcugugcuuugaggugaugucauuaucucugguaucugaaucugcuuucuauauauugccuugucaaaugaauuaaaccaaacauugcaaauacugcuauuggagaauguaggaaauacuuuucuguuacuguaaugcugaaggccauccugcauccugaccucuccauuccacauuacacagcauuccuucacugucugccagcuggccuguaguucuuuaugaccucuuagcuugcuaauuagccugccuacuauuauggauucaugcccucacccaaggcugcauaauauaaucagaccuaggagagaagagcuauugugguuaaaucuuauuuugaaaugauuauucaggcaucugagcauuaaauauucaaaauauauaaacggauaccagcuuuugauguuacagacauauaacaugaacuugagggucuuuaaaguaugaaugagaccaaugacaagauauguuagauguuuaaccugcuuaacuugauuguuaucacuuuauaaaauucauuuguuuuaugugaaauguugauuuuuaauuaacagcauuuuuaugagguuccaguguagguguucuguaaaacuuaauggcaguuaagaauuugagccaucacugaagaucaccuggaaauagguuucucugguggcuuuagaguaguccucuuaaaauuucucauaauacuggcgaaaauuauauuuccccaaauggaaucuuaugcagaauccccaaacaaaaaaagacaaaauggagcuacuuuaggugaagcaggagcagccccaccucugcuucucuuuggucuugauggucugugagacaacuugagaaauccuaggaguaauuugaaaaucaaagcuuuagagaaucacauagcgccuuugaauaacaaccaacauaaacaaaaagugcuagcagagugauuccaaaacaccagaugcuuucaaacacugucaucccuauaauuauuuuuauaauauuucuauuuguuucuaauuauaaaacuaguacaugcuuauuuuggacaaauuggaaaguacagacaaauagaaauaugaaaacaaaacauaucauuguuauucuuagaacuuuuuucagccacuagauucaguacuaggcucaugugagauuuuuagcacagaguucagagacauggcaugaaaccuguaugcauagaagccuggcaaaauguuuuucccuuaccugugaauuucuuuuuaauaaauauauauuuauucauuuagauguuuaauauuugugaauauauuuauaucaaaauaugaaaauguuuaucacauuuaguguuuacauuuaauacauuacuuucauugaaaagaguaauguugcauaaauuagaguucagugauggugucuguuguuuaaauaagugagcaaucgguuugaacuuucauaguauuucauaauggauuuagacugagaaagccagacccgggauuguuucacuacucacccugcacaauuucuucuuugugccccaggaaugacuaagauggccaagaugauugacgagagacagcaggagcucacucaccaggagcaccgagugauguuggugaacucgaugaacaccgugaaagaguugcugccaguucucauuucagguacuuccugccuguacuuuauuuuauaggggggaaaaauguuagcauguucuaaacucugagguucauuuuguuuucuuuuguuuucuuuucuuuuuuuuuuuuuugagaugaagucucacucuguugccaggcuggagugcaguggugcgaucucggcucacugcaaccucugccuccuggguucaagcgauucuccugccucagccuucugaguagcaggcacuacaggugcgcacugccaugcccagcuaauuuuuguauuuucaguagagacgggguuucaccaugugggccaggauggucuugaucucuugaccucgugaucugccugccucagccucccagagugcugggauuacaugcgugagccauggcuccuggccugagguucauuuucuuuuguggcuucacugcauguccuucagccuagguaaaaaugagacccgauugauugguuaucacaugauggcuguagcugauuggcugagaaccagucuucuucucuaaugcuguccuucuccuguucuuuguuugaaauugccuuucuguggccuaauucuguucuccuaaagcucuaacaagccccuuugcugggagguggacucuccucuauaaacucuagccuaggauauuaaauuuucacaccuuuguguuauagaaaaauaauuaggagcuggaauggauauuauagagcaucauaugauaaagacaugaacucagagcccuuuuuaguguguauuaauccaauuuuuccuaaaagauauuuaacuguuguuuacaucaugaguagaucaguucuuuagucaccagcugggacuaccuucccauugaguagugcucugaaaugcaaacaugguagcugcucucucgacuagcaaaagggaguagcacuuauugagugucuaguauaugccagacagcucaugguuuauaugaauuaucuuagucaaguuguggguuaauuaguuauuucucagaaggcaacuuuauuauaaaaaucuggugacucaugucauugugacuuccagcuaccugcuuugguguuucaaguaguagcuaaaaaaggacauaugaguauaagaguucaggaggcugggcacaguggcucacuccuguaaucccagcacuuugggaggccgagguggguggaucaccugaggucaggaguucgagaccagccuggccaacauggcaaaaccccgucucuacuaaaaacaaaacaaaacaaaaauuagccaggauugguggcagacggcuauaaucccagcuacucaggagguugaggcaggagaauugcucaaacccaggaggcggagguugcagugagccgagaucacgccgaaaguguugggauuacaggcgugagccaccaugcccagacauuauuuuuuucuucuuuauguuuggggguuggcaaauccaagcuacauguugagagaaaucucggaugauaaacuugacaucuugggaucuucugcugggaucaggggcagcaggauacgccauucagaguauuacugacaguuuucauauugucccauuagguuuguaguagauggagccagggugagggccaggaugauaacugauuuagaaggauauuagauauuuugugauugcaggucaucagcauaugcagguuaaauuaguuacuuaaucauguugugauggugucuuuguaccuugaguuuucuuuuucuuuuuuuauuuuuacaauaaagguuguuaauguuggaacuuuauugucaaacuuguaguguuuguuuuguauacucauuuuaggaucuuaaaagcccaaaacaucuaaaguguagaacaucuuuugugaauauuguuauacaacaagauuaaauuccaagcuuacuuucugaucuuuuauuuuuacagcuaugaagauuuuuguaacaacuaaaaacucaaaaaaccaaggcauagaggaagcuuuaaaaaaucgcaauuuuacuguagaaaaaaugagugcugaaauuaaugagauaauucguguguuacaacucaccucuugggaugaagaugccugggccagcaagguacguguucuuaguggagaaauaagcaaaauccccaacucucccuggcuggggguuuugauuggcaccugucucauacuuuaucuuguaauuuuuguagcauaagaguacucagauauugugaaaguaauuucuucuucauuucuguuucauagguuacuugcuaucuuugcuaauuuccuuuguucuaagguagaacaaguaaauaggcaugugggguagauacugguuuaaggcugagauuuauagcuuuuccaucaggcuggagucuuauugguuggacugguggaagaguauauucccguggaugggagcucugccuuguauaugggugguucuucccagcugacuaaguaagauacagauaugccuguaauucugaacuuuauggaaaacuuuucuuuaaccaaucuuugauccagagaaaucuacagaggaaacucuuggcauuucuagaugugucccuugaucauuccauuuuccccaaggaagguuuaauuaaaauauuagucuucacauuggucaguuaguuugagggaucccuucacccuuuuucuggaaucucuuuuaggaccccagaggggcuggcagauuccuucuagagccuguuagcagugguuuuguguugcugcugcucuggucugcugcucccuguuuaaugacugugaaccaagcuuucaggucugggggaacagagauacuuggguucauacuuuccuuguaggagcccaagauguaggcaguggggggaacacacuguccccaagaucuagcuuucccaugugugaccccaaugucuccagggccagccagaaggcugguagucaacuaaagaagggauuuuguuguaugacuuccauugggugcucaguagaacgguauguucuccgggaucuguaagguaauguaaaagcuggggccugaaaucaccagcccucucucuuguugcccugaaagcuaauuuaauuauauagaguaaguuagcuuauuuuaacuauggauuuauuuacagagacauuuucucauugaugugaaguucuugaauagauucuaagacuguauuuuaaaucuauaugguaaaaucuuuuuaacucugauauuuuauuuaauuuugcuuuugcauaguugacaacuuucacuucccuguuaugacuucuuuaugcaucuuuuuuuguucuuuuguuuuauucuuuuucucacguuuagaagguaagcuuucucuugcccucuaguuucuuuuucgcuuaaaaagagaaaagcaugucugugagguuuuuuugugcugugugccgugccuuauucuguguauaacacugugcuugaaugugcgucagaaugugauuuaauacgggacucuaggcagugcuggggagacugacuguggcucauauugagugauuucuuugggaaaagcuaaaggaaagacauuacugugggcuaucaggcugccuauauuuggugggugccuucaguucuuuggguaggcuccugggaucuuuuuuggccuggucuuucccauugacuucauuugaggagcaggauuccccagguagcugggagaccccugaguuaccuguggacccugcuguugggaaaggagacuuccagcugaugcuaucucuguaccugccucucccaccagucuucuuugcgggcucugaaauuuugcuuuuggagaugcaucauugagguuuuaagccauaaugaaagaggguaggcuagagagcuuagaugaggcaccuguccuucauaauaauccuagccuucaaaauccaaaggaaaacagaagugaagugugucuaaaggucuuccuaacuucauucuguggcucacugcauguuuugcuguccaaacugaauuagcuguaguucuccaugaccucauguuccccuaacccaagcucuucgcuuauucucuuucuuuugcuucuagcagaugacaaaaaguaauaaggaggaacaggcauuuuaaccuuaauguuucucuauuuucagaagggaaaagcuauccaucauuuagugaauaaauguuauugaacuuuauuuugugcaagugccaucaagagcugcuucucucauuaaaaaaauguagucaguugaguuuucagggcuaggauuaggcacuuggggauacaagugaaauagaccugguacucaccguguacagucuuguagcugcucccaguuuuaugcugaggaaaaccaauuuguuaggaugcuacaaaacuaacuucaucugaaaugaaagaagguaaauuaaauuagcucaacucaaguacacgaugacaucagaaugaacaagagauguuuauguuuuaaucuacugaccauaagaaugaaaaagagaugcuuauuuuuuaaccuaaugacaucagaauaaaaaaagagguuuauuuuuaaccuaauuuugcuuuuguuuuacauuuaugugguucaaauaucaaagugcugcaaaaagauauaccugauaagucuuccuccuaaccugguucccauccacucuaccgcuccucacccucuaagaguaaucauuucuauugguuaucaaaauagaaaaaaauuuuacccugaaaauagaaauugguagcuaggauuuuggcucuuuuucaguuuuguagcauuacgcaucuuucauugcuccacuguaagcagugaauuaaucagaccuuuugucugacugugacugcuggguucccauucuguuuaaugcauacagugucuuucaccucuucucgccccuaccaauaaauaauuaacuuugucuuaccauacuuguuucaugccuccccauuggugcaguauucuucuggaaagugaugauuccucuagaaaagugggggaagaaaguaaguggaaaaaauucuugguaaaagugcgucuugccgaauaaguuaagauuuuaaagaggcaaugcaauaacugauuauuuuaccuuuuauaccuauauucaaauugcacauuuacaaauuuaaaaguaacuuugacuuuaaacacuucacuuauuuuaaaaguaaaaaguuuccuuuucuuaaaucaacaaucauuuuauagugaucauuaaaaauuagguuagcauuuuuuucugaaaauacauuauuuauuaaaagaauuugaguuaaacacaauucuaauucuacccuuuguaaauuuagugcucuacauuuaauuuuuuugguauuuauauuacuuguaucuugaugcaugcugagaauuaagaggaagugagauaaaaaauuaaaaaaaaauuucacugcuaagacuuugaacccuacauaggcacuccugcagcuuugcaccgugaaucauuaaauucuauuauucagaauuaguuccuguggugggucucuccccacugugguccugggcuggugguggguaaaaguaguaagugacucagaugccuuauacagaagauuagcaaacuuaacuaaggcaggaaauguugguuagaacuugugaguguguaauacuacccccuuacuugcagaccacugggauuuaagaguugauuuguuaaauuaaaaaaaggucauuugugggcuuucuaugagcaaguguucuaguguuuuguuuuuagcagcuaauagaaugaaagaucucuaagagcuugagagaaauaguuaauucaggcauuuaugauauuuuaucucccugcuccccaugaggagaaaaucccaaaauaaauugauguuucccuucugaucuaaguuaucuuuggcuaguacaucugaucaugcacucauagguagcauagauuuuuagagccaggaagguauucuuagagaugaggaauugagacccagagaagguaacuugcaugaagucucaggacuagacaacuuucucuuguuuaaauguaguuuguaagauuuuguucuacugcccaaucuauacuuuccagaaacaucuuaaaccagaaacaucugguuuaaaacauugacuugcagguggaaaugagguuagaaaggggauggagugggaagacagguguugguggagggagaagggagaguauggugggcagucauggagagagguucuuauuccccauauuuaaaauuuucaagagccuaggauugcaggacuuuacuuuuuuaaccgaaguuccucuugauuguccauagaaggaggucauuauuauucacagguguucugaggccuaaaucuauguuuaauuuaaggaguguuucaguuccuaggaaagcacguacaaaugguuuagcuugucguuccaucuuuugguaugcagggaagagugccaaggcacuguauuuuuuucauuuaaaacaugaauucauaagaauuuuauguuaagaaggagcauaacauggugggggaggacccagauagauucaggccagcuguccccaaagccacaugacuagaccuggucuuuuuauacuucacucuuucaacacccacaaacccccugaaaaacaaaccaaaaacagauaagaaauugguagagacuuuucuuuuucccaaaguugagcuuuuacagagaagaauacucaaaugaaggugcaguuuuucucucuucuauuucauaucugaauuauacugaccugaaauauacagaccuacaugacaagguuuagcaaaaugguuugugguacaaagcauggcugaccacaaggguuacgauuauuuucacccuuuauaaauauauccccaaauugacuucuguccuaguuguccagugaauuuguuuaugucauauucauuguuuguauacuuacaugcuuaugacagaauucugucaauucuauaauaaauauugccuuucaaaagaaauauauaugaaagucuuaggagaaaaaaauucccuuagacauguuuguuuuuacuagauaugacuaacauaaaaugguuacuuauaaccuacuguuuuccagaaagaauuuaagauggcucuuucaguuauuguuuuaaaucucugaaauugucuaaaauuaaugcuguuaaaaauuuugguaacuuauugaaagucgcaguuauuaaaugcagcuucauucaaaauuggcuauugguuccuuuuaggggaaaaugaacaucucuuaauuuuaacuucuugacggugucacaccucccacugagcaguaaauuacucacuuccugagaauuacauucuuuccuugcaguacuggccauuagagcuuuauuaaggagaaaaaaagaaaugauuuuugaggaugcugaauagacaaaaacuauuuuuuccauuguguuucaaaucauuuuugggcauuggagaauaaaagcagucauuuuuguuaguguagauuaugaauuugauuucuggagcuuauuuucucugcaguauuaaccaaagucaaaacugacaaggcagagauuugcugacuauuguuggagauuaguagaaucuuuagcaacucuccuugguaaaagaaaaaaaaaucuuguuucauuugauaagcaaugagguuuggagucaacaaaccugagaucaaauuagguuuguaggagucaguuccuguuucuuaauuuguaguauuauuuaaaugacauuuaaauuugagauucaaugagguaaggagggggaaaguagcuaaaacagaaccuaacaugcagggaaugcauauuaaauucaaugcaugucaguugaauuuaguuuccuaacuaguagccuuuaauguuagaguagacauaaaaauuucugaccuucguuucccuuugaauuuagauuuuugaaauguaauaaauaccuauugcuuuucucacugaaaauaaaaguguguuaggaaaaugguuuaacagguuuuaagugaaauauuuuuacauugacauaauuauucuccaggauguccacacacuuccuaaguaagaguuugugauuaaaagaaaaccuaugccuagauaacuuguguuagauccugaaggcuacccaguucucugagguuaggaguugccuggccucaagucuuuuaaaaaguuauugauucaggccuugcuaauuuggaauuaagcuaaaguugaccuuugcauuaauuuugaaggcaacguuuucugcacaaauuaauuuaagacaugauaggagagauuugcugauauucaaaccauuugagaaucaaagcacuuaaaaauaccacauaucuucuucuaauuacaaguggauuuugaaauagauccucuuaugauucugccuuuuauugacagcuaccaugguuacauauaacuugauaauaaaaauauuuuguuuucaauuuuuuugguaauuuaguucacuucuuuuucauugcuauagcugagaauuugcuauuuagagccuuagauagccaaggauucaacaggagaaucaucugugucuguuuagaaggggaaggagggauuccgacaguugagagaucugucuuuugaauagggggcuuuggaacaguuguggaccuugagccuaacuaugggugcugccaaugcuuauuugugauagugcuguaucuuuuuuugaauuggaaguggggaugcuccuggugcccccguguggaaaacuaguggugcaacaccuuuaagaaccccaguugugcaggauuggaaacugaaggaagcuaggacauugccuagaauuuuagagguuaacuuugugcuuugauggcuuaacucuguaagagucaguuuccuacagcaaaaaggaggauagauggucuuugaagaugcuaaauagagacuuaagagauggcugguguuauauuguucucuguguuuuuauguguuuaaaaaaauuuacggaaauacuuaaauacauuuaaagugauuagucuguuguuucagcuucuccugguguauccugggagauuuuaugcuaguuuccugauaguccucgugaauccugguuguaaaaaauaagcugagacccauuuauucuauccugcaucuucuuccaggugagggauaguaagggaacuaagaaggaggaauagcagggaaggucagaaaacacuucuaaauuauauuacuuugagggguuuauuuguagaauuaaaauuaaacugcuagauuaacauuuucaauuguuucuuccaaccaguaauuccaaguuuuucagguuaauugaauauagugaaauaucauccagugugugcauuucaaaacaagauguaaaagaacugugauuuguggcaccacauacuaacgaggcuucccugaggugggaagggcuuuggcaaggcugcaguagaugaauguugacuaguggaaaggcugacaaugaggcaugugacaacagggcuuuuuccugcugaagacauuaaacauauucuggcuugagcaauuuuaccaguuuucacaguuuuagcaauagggaacccaauuccacucuguuuagcaacagaguagaauuaacugaauauuugcaugcaagaugcugcauuuugacagaaaugagaauugugguguggugacaauauuuuuaaggccuucguaggacugacuaccuuagcuauguauguuaaugcuguaacuucuucucugucuuacguucuaucaugguaucucaacuuuugcaaagaaaauaauggugggauuucuucccaaaaggacacugaagccaugaagagagcauuggccuccauagacuccaaacugaaccaggccaaagguuggcuccgugacccuagugccuccccagguaacccucuaguucugcuuuucugaucaauacaacgagaagcuaaaaaccaagcaaaugaaagaaagaaauuuucccauaaucucaucaucugagagaacuacuguaacauuauggggcauaccccauuaucugauaguucugaguaacugaagcaaguaguaggccuuacaaggaugaagggaauagauucgaucaccucuaaucacggaggaguaagucauacugagcugggcauucuuugcaaaauuuuugguucuccccuucccugaauccaaaagguaauuauuuugaaugaaaguucuucucuuccaguucccauugagcagacuuccauuuaugucaacagaguucuuaauuaagcagauuaaaucaugaugccaaugagaauuggaaaguugacuguauaaagauaagacccaaauagguuauugaacuaggcuuuauugauuuucuaaucuaauauuuauucuguuuuagauuaauauuugaaugaaugugaaaaaccuaaaguagguuggaggugcuaaauacuauuaaauuguuagagucuguuuucaucauccauauucuuaccacaagcuacuuaguaucuccaaauagauacaguuccaaguaucuuuuuuugcgugucuguuguugaaaccucacccuaugguuuaagggcacugcuuggcuguuagcuaucagauauguugccuucuauucacucgucuuguuuaaaaucauccauuccuuggugaaugaaaugacuuguaaaguauccucucuaaauaaugaaugugucaacaauguaguuauugaauaucucuuuauuuuaggggaugcuggugagcaggccaucagacagaucuuagaugaagcuggaaaaguuggugaacucugugcaggcaaagaacgcagggagauucugggaacuugcaaaaugcuagggcagaugacugaucaaguggcugaccuccgugccagguaaaaguuccucuguccuuacagagcaguaguggguaacucacuccuaacagggugauucagaaaacaagccucugccaguuuugaguuaucucuuuggcuaguagauaacagagauauuauagucuauuaaauucuuuugagauggaggugaacuuucccuuugcugacuuuauuuauuuauuuauuauuuuuugagacagagucucacucuguuacccagacuggagugcgguggugcgaucuuggcucacugcaaccuccaccucccagguucaagagauucuccugccucagccucccggguagcugggauuauaggcgcccgccaucacaccuggcuaauuuuguuuguuuguuuguuuguuuguuugagauggagucuuacucuguugccaggcuggagugcaguggcgcgaucuugggucacugcaaccuccagcuccgugguucaagcaguucucugccucaaccucccgaguagcugggauuauaggcgcccgccaccacgaccagcuaauuuuuguauuuuuaguacagacgggguuucaccaucuuggccaggcuggucuugaacuccugaccucgugauccacccuccuuggccucccaaagugcugggauuacaggagugagccacugugcccggccacaccuggcuaauuuuuguauuuuuaguagagaugggguuuugccagguuggccagguugggcugggauuacaggugugagccaccaugccuggccugacuuuauuuaaaacauguuuuuauuuauuuauuuauuuauuuauuuagagacggagucucgcucugucacccgggcuggcaugcaguggugcaaucucggcucacugcaaccccugccucccaggcucaagcaauucuccugccuuaaccucccaaguagcugggauuacaggcaugggcugccacaccuggcuaauuuuuuauaauuuuaguagagacaggguuuuaccuuguuggccaggcuggucucaaacucucaggugauccaccugccuuggcuuccaaaagugcugggauuacaggcgugagccaccaugaccugccaaauuuuuucuuuuucuuuuucuuuuucuuuuuuauuuuuuugagaugggagauucgcucuuguugcccaggcuggagugcaauggcgcgaucucggcucacugcaaccuucgccuccuggguucaagugauucuccugccucagccuccugaguagcuaggauuacaggaaugcgccaccaugcccggcuaaguuuguauuuuuaguagagacgggguuucuccauguuggucaggcuggucucaaacuuccggccucaggugauccaccugccuuggccucccaaagugcugggauuauaggugugagccaccaugcccggccaaauuuuuuauuuuuaaugacauggccuugcucugucacccaggcucaagugcagugguaugaucauaguucacuguaacuuugaacuccugggcucaagcaauguuccuucuucagccuccugaguagauagaacuauaggcaugugccacuaugcuuggcuaguuuuucaauauuuuguagagauaaggucuugcuauguuuuguggucucaaacuccuggccucaagugauccucucaaaaguguugagauuaaaggcgugagccaccacuccuggcuugaacuuuuaaaauacacaaaugccuaauaguaaaguugaaacuuguuccguaauugaaacugaaacacaaaucuaguuucuaauuuacuagccauaggcuuaugaaaaauaaaggggcaguggugaagucuggcauggguaaauacauuuuacggaggauggggagaaagaaacauagcgugaaaacauuggaauuauuucaccucauaaaaaaaucauuuaacuagguuauccucuaaguugguaauuucugggcuuuuuugaguuuccuuuucaugauuauuuauucggauucauaauuauuuaccuuccuuuuacccuccuaaagccuuggccuuuagagcuuuucuccccauaaacuaaauaaacauaguuugcuauugagaaaacucaauauaauauaaauuuguuuggaauucauacagaugaacucauccauagugauaaugaaguucuaaaagauuuuuauagaauuuuaugguauggacauuacgaaaacuuggaauaggaugagacacucaugaaacaucaugagauaauuaggauacacagggucuacauacaaacagggcucagaaacacuccucuacaugcagugcaccauuauaccuggucuccaauauuagugcaauagacauaagaaugcagaucuuauuuauuuauuuuuauuuuauuuuauuuuauuuuuuugagacaagaguuuugcucuuauugcccaggcuggagugcaauagcaugaucuuggcucacuguaacuuccgccuccuggguucaaggcauucuccugccucagccucuugaguaccugggauuacaggcaugcgccaccaugccuggcuaauuuuuguauuuuaauagagacgggguuucaccauguugaucaggcuggucuugaacuccugaccucaggugauccgccugcugcggccucccaaagugcugggauuacgggugugagccacugugccuggccaagaaugcggaucuuaaaggcgugguucuuaaccuuuuguggaccaagaucacuucuaucaucugaugaaaacauucauccuuaccuaaaaagaugcauauaaacaugcccauacaauauuauguauaauuucuagagguuccuggauucccugcagcccuggaagcuccaggacuuucagguugcgucucuauguugaaggggaaagaaacagcuuaaauaaaugugaucccauugaguucagugaaucuuuucuccugcugagaagcagucuccucugucaugagcaugguaagaacuuugcaaaaaggacaaaaagaaguuuuguucucauucggagaaaugccagugcaguuugauaggauucuuggcucuucugauuucucacuuuugugucuuuugucugcaaccuuuucccagugugguagccaguuuucacuuggaauucucaaauacacaguuguauguguuuagagaaagaugaguaugagcaagagaaugagguaguuauuguagggguuccaccauuaaucuguaaagagaaaaggcuagaacagugaaggguaacuaugguccugcuucacaguggagccugcaauauccuuuccugaugaaagauuagaaaguuaucucccuguaguccuuucuuaaguguacccagcuguuuaauauuuuaguggcugaaaugcgguaacaauuucuucuugauauucuguucagucacacaggguuucuagguugcuaguauauauuuuuacccccaugagacucaauaaaaucuuucuguuuugaaugaaaaaacuguguagcccauaaauaguuuuacuuuuucacaguuggacucuuuuuuaaaaaaaaaauuucuaaauuuccagccucagagaaguuauuauuuuguaauauacaguuggacucuuuuaacaaaaagaucucucaucaugaaguaguagauuugaagaaaaaaagcacauuaaauccuaaagacuauguuuccuaaaagucuuccccucuucugccacauaaaaggaaggccucaacuucaaggaaaaaguguauauauaccuuuuauauacccggcaauaaaugaaugauucauuaccucaaguuuugguauagaugaaaaacagaauaauuuuauuuauuuauuuauuuauuuuuuuuuuuagguuuuucuuuuuuuuuuuuuuuucuuuuuuugagacggagucucgcucugucgcccaggcuggagugcaguggcgugaucucggcucacugcaagcucugccucccggguucacaccauucuccugccucagccuaccgaguagcugggacuacuaggcgccugccaccacgccuggcuaauuuuuuuuuuuuuuuuuuuuggauuuuuaguagagacgggguuucagcguguuagccaggauggucucgaucucgugaccucgugauccgcccaccuuggccucccaaagugcugggauuacaggcgugagccaccgcgccuggccgaaaaccagaagaauuuuaaaaagaggcuagauaggcugggugugguggcucacaccuguaaucccagcacuuugggaggcugaggcugguggaucucuugaggucggaaguucaagaccagccuggccaacagugugaaaccccgucucuacuaaaaauacaaaaauuagccaggcaugguggcacaugccuguaaucucagcuacucgggaggccgaggcaggagaauugcuugaacuacuugagaggcugagguaggagaauuuuggcucauugcaaccacugccucccaagaucgcgccacuucauuccagccuggaaaacagugagacuccgucucaaaaaaaauaaaaaaacccacagaggcuagauagaugaaugacagaucaauacuauuaugaagggaagcaaagguguuuuggaguuuauccuaaaaauagaaguucugauuaggauaaucagccaugccauucuaccaaaugguaaaguuacugccccuaucauugaguuuaccagccugcuuggauuaaaacaaucuggauuguaaaaugagggcaaaucauacuuugugacuuggaaaguaaauaaggaaaacaaguaaauagggaaaguaaauagagaaacaaguuuccaugaacucauaucauuuuuaguaguaauagcauaucauuucugagagaggaaaauagugaaaucaguucuuuaggaacuugaugggaaacagugguuuccuaucaccaugugcucaguauuagcuaguuucgauuauuuauauauuuauagguugccuaggaggaagguaggcauuuaagauuaucauuagguucauuauaaaaaugaugauaauucaguaauaaugauagauuuuuauugccaguguuuucaaguauauuauuuugaugcuugaagccacuccauaagauaaguggggaaaauguauuaccuaccuucauuauauguuaccuucacuauauaaguuagaaaauggaaacccagggagguuaaacaucauaaacaagguuccacagguaccaagagucaagauuugaacacagaucugcuuguucccagucugguacacuuucauuaacacuaugcgugcuuccuccugaaacauuuucaauguauacuugcccauaagaagacaauuuaauggacuauuuauuucagaagcacacauuacuaugguaacaaagcccucccuagcaauaagaucaccagcacauuuucccacugaaguuuagauuggauuauguaaucacuaccaagaggagaauaauuaucaaaauuugcuggccuggucuucaaagugguuaugcaguuccgugaagcuaaugugcauuuuuaaaagaaaaaguacuugauuugggcgucuugcuuuguuuaugucuguuuucuugugcugucccagauuuacugggaaaaaggaaaaagccaagcauguucaugaaaaccacauguacugugcuauugggaauauuuugucauuaaguauuugaggguguacaaugacagcaugugucuguuuugagcagaggacaaggauccucaccgguggccaugcagaaagcucagcagguaucucagggucuggaugugcucacagcaaaaguggaaaaugcagcucgcaagcuggaagccaugaccaacucaaagcagagcauugcaaagaagaucgaugcugcucagguagucacagugauuuucaggaggggugggaaauauuucauaaauauccuaagucauaaauauccuaucuuucuucucugucucuuaucauuuacugugguuggauaaugguuucuaagugaugagugacuuccagcacuuaccaauguuaacaccuccuuuaccaccacagguuuagacaaauguuuaucuauauuuugaaauaaagaucuuaauuuacagcacuucaguuagguaaaaguaagcucucagaguaccaagggaagauugcaguacauuggaacuauuccuugucccagaauucacaacucuugggucauuguaauguuuagggguuaaaguuuuccgauacugcucuacuguaaaaugauuuucaagcauuucacaaacacacauguuugaggaacugaggaacuaauaaggugugguuaauucagagaugagauaaagcuugggaaaauauuuuaugcuaauggguguaaaaaaauugauuuuaaaaagaugagagauugaguuucuuaucuaagaaccuccauacaauaauaaagaucagaauuauaaaaaugauuacugguauauuacuuuugaaauccuucuucuggccuuguuaaguuuaguagaaaggagugugugaguagaucacagcgugcugcuucuccguuucuauguguagaacuggcuugcagauccaaaugguggaccggaaggagaagagcagauucgaggugcuuuggcugaagcucggaaaauagcagaauuaugugaugauccuaaagaaagagaugacauucuacguucccuuggggaaauaucugcucugacuucuaaauuagcagaucuacgaagacaguauguauuuaacccuuacauugccuuuucauaucuuuucuucucuuucucucucccuucccucucccuuucuuucuuucuucccccaagaacauacauauuucaauuccccuagguuaaaugcacuuaugaugcucuuccacuauauucucauuaauucuaggucagauguuaauuugcuguaucagugauguaacugagguuuaaugauuuauugcuggucacauaguuauaaauugauaaauuuaggaugcuaagaacuccuuuuuugagaugcuuuuuaaauuucuaagcuagggcuuucuuugauacaucauguuuaugaccuaucuguuucccauacauaagaggaaaauaauuuuuguggcuagcuaugaaaagacuccuauguguauauggaggggaagaagcguaagaauguacuuuccuccuuccccagcaaugauauuuuguaaguagcaaguauaggagauacuuaaauuacauuuccuggaugauuuuucuuguaacaacagccuccccacagccuccucuccuaaagucucucauggcaccuacuuugaugauauggaaaagggguauuuccucuuuuuuuuuuuauuuuuuauuuuuauuuuuuugagauagggucucacucuaccacccacgcuggagugcagcggcaugacuaugccucacugcagcuuugaacucccaggcucaagccauccuuccaccucagccuccggaguagcugggacuacaggcacgugccaccaugccuggcuaauuuuuuuauuuuuuguagagacgggguguugcuauguugucagggcuggucucaaacucaagggcucaagcuauccucccacuucagcuuuccaaaguuuugggauuacaggcaugagccacugcaccuaacugcuuucuucuuucaauagauauuuuucacuuuuaagaaaaaaaccccugcagcacaugcuaaaauaacacuaaggaaggguuuaaugucaaauguaaaaguugcucucuauacucuuaggaccuaauggaaguccauauacauacuagguacucuuuaauguuucuuaaugaugaagagguaaugaaugguaauggugcuaacagcagaccuucauguguggucauucaugccaucauuacuuaauacuauagcacacacauaaacauacaucuauguaaccucuugccaggaguagccacgaucagaaucauguuaaagacccucuuuguucaccuuuauaaaggagaauguuauaaaaauuuagaaucauaaaggaacucuuaagagaguaucuaagcugggcaugguagcucaggccuguaaucccaacacuuggugaggcugagggcguguggaucacuugaggucaggaauucaagaccagccugccagccuggccaacauggugaaacccugucucuacuaaaaaaaauacaaaaauuagccaggccuggugguggguguguaauccuagcuacucagaggcugaggcaagagaauagcuugaacccaggaaguggagguugcauugagcugagauugugccgcugcacuccagccugggugacagagugagacucugucucagcaaaaaaaaaaaaaaaaaaaaaaagaaaagaaaagaaaaaaaagagagagacagaguaucuaaauuagcuguucuggcgcggaugggcuauuauuuuuauuuauguauguauuuuauuuauuuauuuauuuauuuuugagacggagucuugcucugcugccaggcuggagugcaguggcgugaucuuggcucacugcauccuccgcuugccaaguucaagugauucuccugccucagccucccgaguagcugggacuacaggcgcacaccaccacgcccagcuaaauuuuuguauuuuuaguagagaugggguuucaccauguuguccaggauggucuugaucucuugaccucgugauccacccaccucagccucccaaguccugggauuacaggugugagccaccacaccuggccuauuauuuuuauuuuuacagaugagacagauaaaguuagccugaaaguuaccuuucuauggcugagaggaccugagauggaaaaugagucagauucuuuguauuuuuauaaugguuagaauuugaagucuuuggaauaagguguugggggcaguuuuuuucuuugugauauaauugugguugucuuuuuauuucuguguugauacuugguugagguucuuugguuggaaggaccuggucaaguaaaaaguagaggauuauugaaaauagaggcaccucaucaaacccaauagcuugaauguggccagaucuugggcaacuggaagccccucccuccaccucuuagucgcugugugggauccucuaugucuguuucacccuguguguugacuuaguuuauuuaucuggggguuuugucucuggcugugagcuaccacggcccaggcuuaaucacuuuccagcuccagauaccaucacugguugacuaugcaguguuuuugaaauauggacccaggauuaucugccuaagaaucaucugagaaggucguuaaaaaugcagaccccuugaccccaccgcagacauacuuaauuggaaucgcuuuugaugguggguuuaacaaucuguauuuaaaaauaagaucuccagugacuuuuauccacacuggacuuugagaacccccagaaucuaauugagugccuugccugacuguggguauguuguccuugagguagauaaccacccaguuuaaucaguuauggcaaggacuggggauuaugugauaccaaauguauaguaguuuaugaaugaaggcugggcacgguggcucacgccuguaauccuagcacuuugggaggcugacgugggcacaucacccgaggucaggaguucgagaccagcccggucaacauggugaaaacccguuucuacuaaaaauagagaaauuagcugggugugguggugggcaucuauaauccuagcuacucaggaggcugagacaagagaauggcuugaacccgagaggcagagguugcagugagccgagaucgugccacugcacuccagccugggcaacacagcgagacuccaucucaaaacaaaacaaacaaaaaaaaguguggcgacucugaagucacggugcuggguuugaauccugacucuaucaaaguaaauaaugggacauugggcaaguuauccaaccucauaccuccauuuuguuucuuuaauaaugaggauaauacuguuauuuacaucauaggguuguuguaaggauuaaauaauauaaggcaacugcuuauggcugggugugguaggucaugccuauaaucccagcacaggacucugggaggcccaggugguaggaucacuuaaacccaggaguuaaggaccagcuugggaaacaucgggagaauguuuccuaucuccacgaaauauuuuuuuuuuuaauuagccaggugugguggugcauaccuauagucccagcuaccugaaaggcugaggcaggaggauugcugcagugagcccugggaggucaagccugcugugagccaugaucucaccacugcauuccagccagggugauggagcaaaaccccucucaaaacaaaaaacaaacaacaacaaaaaauugcuuguaacaguaccuggcagaauuaggacucaaaagauaguauuacuacuaguuugacuauaacuguuucagcugcuccuacaacaaacauggcugccugggcccacccaguuccagaggaaacugguguuuucagagguggcaggcagagggugccgcuaaccuagugaugauugauugagcuccgcuaaccaaaugauugaucugagcuuuacugaugcaaacucauauuuaaugucuuaacuaggacaaaauaaucugaauguaaauuauuaauuucuuauguaagggccaaauaaauaaaccacuccuuucaaaccaaauuaauaguaaucaggagcaauuugucauccuauuagcauuugucauuagcagcuaagugaucucaauguaaauaguguuuaugugugacaggauggcugucuuuuucucuguagggggaaaggagauucuccagaggcucgagccuuggccaaacagguggccacggcccugcagaaccugcagaccaaaaccaaccgggcuguggccaacagcagaccggccaaagcagcuguacaccuugagggcaagauugagcaagcacagcgguggauugauaaucccacaguggaugaccguggagucgguaagggcagcagugcacuauaaccucauuaaauuggucucagugcaaauaagcaaguuguugauagggguccuguaacaucuguaauuagguaaggguucuuuagcugcugauaaguaacugugauuccauuuccaaaugcagccaguaaaauuccugugauguaaucaagaagcagaccaggcaugguggcucauguuuguaauccaagugcuuugggaggcuaaggugggaggaucacuugcgcccaggaguuugagaccagccaagcaacauagcaagacccucucuguacaaaaauaaaagaguaaagaauuggcugggcauagugaugcucaccuguagucacaccuuuccagcuacuugggaggcugaggugggaggaucgcuugagaccaggaguuccagucuguagugagcuaugaucacaccacugcauucuaaccucagugacagagagagaccaugucucuuuaaaaacaaaacaaaaaagaacaaaauucuaaguuaguuaugcccaguguugugaggaguuggagaauugggcacauauauaauuuacuggagaaauaaauuaguacaaacuuucuaaauuugguauuagaugucaagagcuuuaaacaaaguucauacccauugacucaggaaauuaaggguuucuucccuaagaaauaauuagagaucuuucuaagaaguugcauacaggaauauaugcauacagcauaaauguuuaauaauaacugacuugugaaauaauuauuguuaauaugauaaaauauuacauagauuuuagaucaugauuuuaaaagauagugaaauaaaaauaaaguguuaaauaaaaagaacuggcugggugcgguggcucaucccuguaaucccagcacuuugggaggccgagguggguggaucgccugaacucagggguuugagaccagccugggcaacauagugagacccugucucucuaaaaaaaaccaauuagccagguaugguggugcacacuuguaguuccagcuacuugagaggcuguggugggagggauugcuugagccggcaggucaaggcugcaaugagcuguuguuccacugcacuccagcuugggugauagagcaagacgccacaucgcaccacagaauggcauugcaauugucuccucugggucuuguaaguuucauuguuuuucucuugguccaggucaggcugccauccgggggcuuguggccgaagggcaucgucuggcuaauguuaugauggggccuuaucggcaagaucuucucgccaagugugaccgaguggaccagcugacagcccagcuggcugaccuggcugccagaggggaaggggagaguccucaggcacgagcacuugcaucucagcuccaagacuccuuaaagguagaagucaggagcacauaucauuuuacuuuuuaugcuuccuauuauugaaagacgagggaaggaagagagaguuuugaaaaauacauaauuucuggggucuagggaaaaugaaaagagugugaccaaagauauaaggaaaucuagagcuuauuaggaaaaagcuugcugguauauaguagcaacuaaauuuguguuuuccaaauuccacucagucaagagcccuuucgugauuuuugcucuauccacauaucaucuguacuuuuauuuagccaauauuuuucuuaaaauggacuuuuuuuuuuuuuuuaaauggacuucuuuuuaaaacuuaaauuuauuuaagagaaaacucugugggccgggcauggugguacaugccuguaaucucagcuacuugggaggcugaggugggagaaucaccugaaccugggaggcagagguugaagaucacgucacugcacuccagccugggugacagagcgagacuccauuucaaauaaauaaauaaauaaauaaaugaaagaaaacuuuguaauccugaaaucuuggguuugauaagcuaguuguauuuuuucuauuauccuuuaaaagaaacacauaauuauuaaaauaaaaacauuugcccauguaacaccuaaaauuaucucagguaucaccagcuaguuuaugcugcccaccuugcaaaacaaugagggugauggagacuucuuuguauauauccagaaaacuuaaauuggauuaaaugugaugacuaugaaaaagagcuuguucauggcuucuaagaauacucuuauuuagacccauguugagaaauugauacagauauuuguuauugaguuuuucuagaaaacuuaauugaaagaaccuggauuaaaaaauucccauucuugauuucuuuccucuuaagacaauaaauugcuuagaauuuggcacuacauccaccaaacaauccuuacaguuacugugaucguuaucaggccccgccagcacuggcaaugguguggaacucuagcccaucucugggccuucuuugggcucaaccucaugauucucaguaucauuucauggaggccaccaaaaaaggaaguaggguuccuugauugaguggaacagucucuagggacaugugggucaugucuuauuucuacuacaccacuaaugucuuacagggcaggauucauaaauuacaccuguucugugcuagcucagugcuuuguacacaguuaacaaauauuuauugaaugaaagacugaauagaugaaugaaugucagugaaguaagggcauuaguagauaugcuuugaggauguaucuggacauuuucauauguaaacaauguuuuuaaggaucuaaaagcucggaugcaggaggccaugacucaggaagugucagauguuuucagcgauaccacaacucccaucaagcuguuggcaguggcagccacggcgccuccugaugcgccuaacagggaagagguggguaucugaggucuuccauuuuucugucagccugugcuauagguauauguaaaggugaaaugugauuacaguggacaucaggaucagugguugggaaacuguagaugaaggguggaagagcagaacagggaaagcccuaccaccucuacuuuuagucuccacguauaucagugaggaauaucuuuaguugcaagcaauagaagaccugaccaucagagaugaaaacaaccggguuuguuuucaucacaaaccaagaaacauggaaguagguggcuuuggcauugguucagcagcuaaauaucaugaaagcuggcauuucuaugauuuucuaggucauuuucucagggugugggauggcaucauguuaaaugcaggaagaaaugaagaauggggguacuccagucacaacugugccuuucgagucaggaugaucuuuuuaaaucaaucgaugucauucuuauacucagacccuuccaaugacuccccgcuaucccagaguaaaaccagagugcuaacaaugaagaaaauugccagcgaugugcugguaagccaacucuccaggaaaacgaaaaaccuugauuuguaauguuuguugauuuccauuauguaaauacucccacgguggcuguuucaacaugaagucacugaaaccugaguugggaagagauggacauguuucgcuccugugagcuggcacgagucgguacagguggcuuuagcacaccacuggaucugguccccauccauuucuuugcucucgugugguaccacucuucccccucaugcuacaucuguauguaccuccuugaauuguauuccuaguguguauuuauauguucuaaucuuggggccuuugcacucguuuguuccagucuucuccagauaaccauaucuauuaguuacugucuuucuucagcuuucuacugaaaugucacuuucgggugaccacuaagauaacaccaccaccccaacuacuauccccauggauuucuucaucuccauauccuacuuuuucacuuagcauuuaucaacauuuaauguauuuacccauuuuucauuuuugguuugucugucucccucccacuaccaugaaagcuccaugcagggagggacuuuauucugucauugccuuauucccccuucuuggaacagugccugccacauuguuggugcugaaugagugaaaauagaggcuuucuuagaaauuguccaggagagcuuugcuaugccucauuggcuugaacucugucucauggccacccuagcugcaaaggaguuuaggaaagcaaguauuugguuuuccagccuuuauaguauuggcagcgaaugagaagggguuugggucagguacccaagacaguguagaacugguagguggagguuuuuguuauuaugugcugauuaccccaguuuucuuucuguaaccugaguuacuaggcaguucagcugauuguucccuuaggcugagaugauuugcuauuuuuuuaauuccagacuucucuuucaggcuaguagauacaucuaggugggccucuccaccuacagucuuccuaguuaccucagcauauguuguccuucuguucucucucagaaauuugugaguugucauugacuuuucccuuccccacacccguucauacaaauaaacaacuaaggcacacucauuuaaucucacauccauuuucuguucauauugccagagcucuaauuauuuuccuaguccccuagucccccuagagcuaugacugcauagcucuaacuggucuucuuugacucuuucacuaggccaucaaucaaauaaaaauacaaccugacucugacauucuccugcuuaaacccuucaguggggccuguacuuucacagaggauaaggccagggcucugugaucuagcucugacacuucccauaccuguuuccuacaaaccccucccucucauuucuggcccuagcuauaccuaguugcuugugguuuccugcacagucugucuuuuccaugucuuuguuuuuucuguguaauuaucuuccccuucuuuuuuggugaauuacuauuuauccuucauccuauuauccuuuguuuccuagagagguuaagugcuuuuucuuuugcuccuaccuauaguaucagugcuuagcucuauuauuguacauagcacacuguauuguaaaucuguuuucgagugcuuuuuucucacugggcugugaguuccuugagaugaggauauuguguuuuacucauuuuuguguccucagcaccugucucagggucuggcacauaguaggugcucaguaaauuuugguugagugacgagaaaagcaaguuaagcaguuaguuaaaucagaaggagcagcagucauggucuggcauugagauggucaaccaaggauauuagguagguaaaagcccaggagauccagagugugggagaccagcuaggguaaaagaacugaggccacgggaaggaggcuaggagaucagggauuuuaggcagagauucucagcauuaaauggcaggaacccauguaguuaaauccaaacaagaggcuggcguggggaagagacuugagaagauagacacagaacacuggcaaugauuuggaaccugcuauugaaccaagagaccuuuagagauugucuagagccagaacugaucuccaaguuaggcagaaguugacaaaaaagaggacgcauuccacuaggcagcuccagacauguucguguaguguauaaaccugacccagugcuguugggaagcaucaguucuaauaaugcaguaaguaaguaacugaaugugaagacuaaauaaaccccauucuccaaagcuuaucuucuaguuugaagaagauaagcuuuugcaagaaucuauucuaacaaaugaccaaagaucucuugcuacuuuaaguuuaauaguccccuccacaguaugcaaccuugcacaguaucccuguuaaaggaaacauuaacuuuuuuagaauuugagagcugaaugaacaauuaaguagaugauuuugcauuugggguuaauaaaagucagucauccuugcccugaggccugagugugagcaccagcuaucauuuuucccuuggaggucaauggcagaguuuuuacaacauuaaugguaaugggauauaugaaggaugcugcucuggggagccuggagcucaauuuaggacuguguggauguucugggcuuuuaauguacccagcugccuacaauagagccuggagugggcuugacugucuucuucaaacuagaagauaagcuuuugagaauggggguuguuuagucuucacauucagcaaauuacugcagaguauauaaugcuccugcuuguaccugguaagcacugguugaacuggaaaugaagguuaugugcgugugugugugaguguguuugugugcauuugcacaugauggugauggcuaaacgucugaggagauccaucaaggccaggauuuggaguuugacuguuguuuuauuaacuaggguuugaugucaucucuaaagucuuugagcaguugcugcccuucuuaaaggaugaaacuuuuucuuaggcugccugacccauuuuauugaaauaaauguucuuaauaucuguuuuuuccucaagguauuugaugagagggcagcuaacuuugaaaaccauucaggaaagcuuggugcuacggccgagaaggcggcugcgguugguacugcuaauaaaucaacaguggaaggcauucaggccucagugaagacggcccgagaacucacaccccagguuggguuuugcucauuccucauacaguguucaguaaagaaaguuaauuacagaacaguuucuauacauuuuugaauacuuaccguaagauggcauaaaaaaacauauacaggccagcacgguagcaccuauaauuccggcacuuugggagggugaggcgggaggacugcuugagccugggaguuugagaccagccugggcaauacagcaagaccccgacucuaccaaaaaaaaaaaaauuagcugggugugguggcgcaugccugugaacacagcuauuugugaggcugaggugggaggauuauuugagcccagaagguugaggcugcaguaagcuuugauugccccacugcccuccagccuggggugacagagcaagacccugucaccgucuuuauacauuuucauaacauuugaauuuuuuuuuacaaggacuauuuauuaguuuuuuuuuuuuuuuuuuuuuuuugagacggagucucgcucugucgcccaggccggacuguggacugcaguggcgcaaucucggcucacugcaagcuccgcuucccggguucacgccauucuccugccucagccucccgaguagcugggacuacaggcgcccgccaccgcgcccggcuaauuuuuuuuguauuuuuaguagagacgggguuucaccuuguuagccaggauggucucgaucuuaguuuugaaaguagaaaaaauuaguaaagcaauccccuugccacauacacacauaacuaggaaaauauuuggauaaucuuuuuuuuuuuuuuuuuugagggacagaguuucgcucuugucacccaggcuggaguccaaugguguaaucucagcucacugcagccuccacuuccuggguucaagugguucuccugacucugccuccugaguagcugggauuacaggcacccgccaccaugcccggcuaauuuuucuauuuuuuaguagagacaggguuucuccauguuggccaggcuggucuugaacuccugaccucaugauccgcccaccucggccucccaaagugcugagauuacaggcaugagcuacugcggccggcuuggauaaucuuaagaggcuacuuuguuuugauuuuggaguuuauaucuuuucuccacaucuuugugagaguuuuuuuuuuuuuuuuaaauugaucuguuucuauaacuuucuuuuuucuacuuauuguguaacaaggcauggcuaguaaguuugggagcaaaggaagauugggaaaaaaaaccaaacuguacaguuauuaaaaguuuacuaugugauagguuuucuuaaaaauauuagcucaacauuauuuagugugauguuugugcaauuuuucuucuauucaaauuauagaaaauucauuauuuuuucauuuauuuauucagacauuuacugagugccuaugauacauucgaaacuaugcuaggcuuuauaaauuugugauacuggcuuaugugugaacuugugaggagauaugggggaaauaaacaugucucugaaucauuaaacuuuugccuguguggcguguuaauaaauuagauccucuuguccaacuuuuuaacuuguccaacuuuuacacaauuuuucauaagcuacaaacaugucuaacacucuuuaaaagcucccauaaaacauggaacauaaaauacaauuucaauaugaaacugagauuccuaaaaaggaggaacaggaaucuaggcuuauaacaccaauuauagauaaaaugaggacucuggagacagauuuggacuugagaccucugugaguuuuuuuuuuuuuccgagacggagucuugcucuguugcccaggcuggagugcaguggcaugaucuuggcucacugcaaccuccgccuccgggguucaagcgauucucuugccucagccuccccaguagcuaagauuacaggcguccaccaccauacccggcuaguuuuuuguauuuuuauuagagaugggguuucaccauauuggccaggcuggucucaaacuccugaccucaagugauccacccgccucggucucccaaagugcugggauuauggguaugagccacugcacccggccgacuccucugugcucuugaugcuuagucucucaucuguaaaauggagcuaacuccuuccuaauggacucuauuuggauuaagaauaugcauguacagccuguaucuuaccagauacguggcaaauguuaauccuuuuuuccccaaaugcuguaacugacuggccaggaccucuugagcagucacuuaaauuuucugagacuugguuuuugcaucucuaaaguagagauauuaacuguccugucucaugggguuguugugaggauuuuuucuucauauuauucauaaaucaguuuugaguacuuuucgguauccuucuuaauggugauuuuuaagauggaagaguugacaucaaguguuuaaacauaugccaguuuuguguauguucuucugaaguaucaaguggacacucauuuacuuugucacuuuauuaccuucuuaaaaucaggcugugaugguaaaaccuuccugugaagggcccauucuggggagcuguuuauugagaccaaaccucauguauucagccugaaaagagacuugccacuuucuggcuuuacagugccaucuguagguaaagaggagaaagcuuggcugaagguuuguaucuggagagcaagggugcucugguguuuaaagguguuuugucauugucagguggucucggcugcucguaucuuacuuaggaacccuggaaaucaagcugcuuaugaacauuuugagaccaugaagaaccaguggaucgauaauguugaaaaaaugacagguagaguuuucuauacaaaucuuguugucuaauccaugaagaaugaguucugagaaauuggagcgggacugguucuguuacucagcuguaauuggauaaagggccggucacgugcugagcaguguacuuggcucugcuuaaggcugcugagcaguggcggcuucucauucaagccuugcaacuuugucagaagagagacucuuugagucucuuuuauuuuaaugcugcccuccuggcgugauguuuauugucaccacuccuaucuucucuuugaauagugucuuugcccaguccgagcccgaguuugguuucagaggcugggaggcgguguuuguggauacaguaagugucccugucauuuucaguggguucacauuucaaggaaccacaauagcuaccauuuaauacaacuugucucaaaguuuccuccaacuuaucaacuacguaguuuuuuuaaaaaggagaaaccaaccaccagcaaaccugugucugugcaauugaaguggcaccucugaaucgucuucauucucuguaaagggagagauaggaaagaaggaaugaggaauguaggcuuuuugcugucccugcagaaccugcugugacugggguccauggcagcccgagaugaaaguggaacuccugaggugucugaagagagguaacaggaauaagaaauaggcuguuaggguuauuggaauccuccgcauggcucaucuugagcacuacaagcugccaacaagcaacagauggcuggggagugagagggacagggagaaaauauuauucacagauaacgugguggugaugcagugaugguuucagacauauuccuuguuuccucccgauguugcauuucugguugucugggguggauacaagaaggcuggcaaccacgguugguauaaaugcugcaaauccagaugggcuuuugggcuauguccucacuguuuuuuuuaacugugguguuuaccuggaagcuuuugauuauguaggaagaguuugagcugaagaagagaauucuggauguuauacuuucucaugagaaguuugaguggauaacaguguuuuggaguuucuguucuucuaaauugaaacuaaauuccauuucuguuuuccuaacagggcugguggacgaagccauugauaccaaaucucuguuggaugcuucagaagaagcaauuaaaaaagaccuggacaagugcaagguagcuauggccaacauucagccucagaugcugguugcuggggcaaccaguauugcucgucgggccaaccggauccugcugguggcuaagagggagguggagaauuccgaggaucccaaguuccgugaggcugugaaagcugccucugaugaauugagcaaaaccaucuccccgauggugauggaugcaaaagcuguggcuggaaacauuuccgacccugguaagcaaugcauggcacuaugucucaccuccacugagagguuaacucaggaaaggucgugagggaauauguaccccacaaccaccacauacaaagucugggggcaaaaacuauagacacuuaguuugagaaugcuagauuaaucuuuuuccauccaagucucugcaguuaucagcaggcuuguuguauguuaguuuuucuggaccaacuucucugugcuuucuuuuuuuuuugagacucucacccaggccagagggcaguggcaugaucucagcucacugaaaccuccaccuucuggguucuagcgauucuccuaccucagccucccgaguagcugggauuacaggugugugccaccaugccuggcuaauuuuuauguuuuuaguagacaggguuuugccauguuggccaggcuggucuugaauuccugaccucaggugauccacccgccuuggccugucaaagugcugggauuacaggugugagccaccgugcccaaccucugcgcuuuuuuagugcugggauuacaggugugagccaccgugcccaaccucugcgcuuuuuuuuuuuuuuuuuuuuuugagacggaguuuugcucuuguugcccaggcuggaguacaauggcacaaucuuggcucacugcaaccuccgcccccgccuggauucaagugauucuccugccccagccuccugaguagcugggauuacaggcucccaccaccacacccagcuaauuuuuuguaguuuuaguagaggcagaguuucaccauguuggccaggcuggucucaaacuccagaccucaguugauccacccgccuuggccucccaaagugcugggauuacaggcauccagccugugcuuucuuaauauggucuggcuaaauagcuccucgccuuguucagucauuauuuuggaaaauuuucaaaagaugcaugauaaccaauuuaccauccauuuaguuuauguaacugguguuaacuucucuugggcuuuucuuaaaaugcuuuuuuuucuuuguaaagcauucucaguuucuaucaaaucuggagggcuuaaguugaucugugggucuccuaggcccuacaccuaaagaaaaucuggguuuucuuuaggugaauuuugaucauauuuuugguacuaccauggcagaucauaauuggagccgcuccuuugguugaaaucaucugaauuccuuccuguuuugaacaucugauguuuucagucuugucuaugaguagaaugcagucaaugcaagagaguaggaaggaggggcuccccuauucaucucugguucaggcagaaucuuucuaauauccaaaacccauuaucacuaaggacaugcuugguuuccuaauuggaguuucuaauaguagaguagauuccugaauuccaggcaacugaacagaguagcgcagcucagcauaaggguuaacauacugaaugccaaggacagcaaaggaguagagagaaaggugagaaguacuucagggaauguauguccaaucugaaacugacaucucccauguucugaguugggcaggcuuaucucuugacugccucaucauaagagaggugauggaugccaccugagcccaaaguguucaugcccagggaucuccuggguacuuuuuaguuguacagccaagaaggcacccugaacacuaaaagaacagcugguuugugaugcuuccaaugcucugcaggccucagggcaucugccuuguccugccuccccccuucuucaaucacugcccgugauauuuacuggcagcuucacauccagcuuuuguucauggaaccaguucugcugcugcacagacagugcuuuggggcacugacccacccagcugaaagugaggaugucuuguguuuaggacugcaaaagagcuuccuggacucaggauaucggauccugggagcuguggccaaggucagagaagccuuccaaccucaggagccugacuucccgccgccuccaccagaccuugaacaacuccgaguaaguaaauucagauaugcagagaauugagcaggaagguguugagacuucagcaagagagagguagauuguguuuuagagccuccaucacuagguggcuucguuuagcuuucauuugaagcuuagugggaggcagaucucgauuuucauuccuaaauccaguggaguuauaaccuagugcuuauaugcauggguuguguguguguguguaguacuggugugugugguaguggcuugcugugauggggagcggcuggagcagaggagcuggcuuugguaaguguggaugugaugagugaugagguagugcauugugguaaaauaaucugcacagcuuggaguaaggagauuugguguguucuuaguugauaaugguagaaccgaggugguugaaaucuuguguugguucuuuccuuuauuugacuuuuuuuuaaguaacaagauacaugcuuuuaaaaaauuuuucccuaacuauaauuuaagaucuuuagauaccuuccccacuaccccccgcaaguacugugaauauauuuuuacaugguguaggaagaagcuagcuaggcaguauguugcagacacaaauuccagaaacagaaauagugauuauuucuagacacuuauuccaacuaacaguauuagaaauaccuugacuuuguaaauaacuuaucaaggcaauaaucugauuuacuuucccauauuuaaugucaguaaaagauguuaaguuuuuaaguugguugaguacaaaauugugucaucgcacacacagcuaaggaacaguguuucccagccuucaacgcaucuuagauucuucccagcugggugcuugguggguguuuagagcugggagagagggcuauuccugggaauggcuucuuaugugagcaacagaguuaugucauuuagaaucuggaucuuagaggucauuuggucuagcuaccccucagugacagaugaggaaccucaggccaaggggagaaguuacuugccuauguagcugcuuucugguagaaccaggaccacaacuuacaucuucuguagggacuuuuugagaauccuucaucugguagcacuguguauacuucccugggaugcaaccaaaacaguagcugcaagccuuuuuuuuuuuucuuuuuuucuuguuuugagauggagucuugcucugucgcccaggcuggagcgcaguggcaugaucucagcucacggcaaccucugccucccggguucaagcaauucuccugccucagcuucuugaguaguugggauuauaggcacaugccaccaugcccggcuaauuuuuguguuuuuaguagagaugggguuucaccauuuugggcaggcuggucucgaacuccugaccucaggugacccaccugccuuggccucccaaagugcugggauuauaggcgugagccacugcgcccggccacugcuagcuuuuuguagagaaaccugcuucuguugagauugaagcaggugguccuuguggcucaguguggguggucuuauguggagucaauauggguggguuuucuagggaugcuuuuuagaagaaaggaaagaauuccaggggggaguaguuuuaggacuuuacuuacaacuuguuuucucuuuuuuagcuaacagaugagcuugcuccucccaaaccaccucugccugaaggugaggucccuccaccuaggccuccaccaccagaggaaaaggaugaagaguucccugagcagaaggccggggaggugauuaaccagccaaugaugauggcugccagacagcuccaugaugaagcucgcaaaugguccagcaagguaaguagugaagcuuuucuuguugagaaaggaugucuucucggaaaggaugaaggaccaugaaagacccagaaagaagagucuauuuggagucacccucucucucuccuuugguuccuguguugccaauagcauauuccucuucuuaccugugcuuuagugagauguuucugacaccugaugguuucuccuucaagcuugcaaaagccagagucagggugccugugauuugagaagaggauuccuguccuuuguccauuagagugccaggugccuugaccuuagcauuuggggucuuuuagaaauugcuuaucuuucuuggaacugcaaauguuuuuagaugcuacauugcuaaugaucagagcuccaaauaugaauugugugggcugugcuaaagcuagaugaaauguuugcauuuucuuuuuuuuuccacagaagcaaguagauugguaucuuagaagccaugugcuuuuguccuuucucagaaucauuucaccugucaacucaagacagcuccaggcugucucuuacucagcaaaucugaagguguaaauauuaaugugguugguaaaaauauggaugcuacagcagucuugcccuaugaauaacuuuugccuauuuuccccuaaaugaugaaaagugagcaguagcuuuucuagauaagaggaauauuauugcuaacccugcagugaaagguagcucuuaguucuaaacuguuucuaauaugacccuagaucuuuuuuuuaauguuuuuaugacccuagaucuuuauucccaccaccuauuugccuuuauucuuuacacauccucaaagcuuucaagcucuugugucgauuguauuuccucagggaccuccugcaccugcagcugaucuuggauuuuuuucaggcugggaaauucacauugguuuuuaacucuguauuuugcugaacuguuagcugugagcccagguucuaagaaggaagggagacuuugcugguguuggaccugaccuguagaauuauuuauaaugguaucucuccaacugcauguggcagagccccacugugcauggggagugggggagggugacagugaagauuuuaaaggaaauuuaaauuucauuacaaugaaccaaaauacacuaugcagaacaaaaaauauacaugaauuauuuaaaaaaacaaacaaacuuaaaagcagacagcauuggcccacauuacuugccccacucugccauuuguggccagaaguccugaggucuaucuccugaagugugcaagaucaggaguuugcugacuuugaguugugugaagucagaagcuacuugaaccauguguguacugggcuggggaggaauaucuguucgugugucugucaaccuaucugucuuuguacacugugggacucugagccuuagcagcagugagcuggcuuuucuucugagcagcagagaugggucuugguugaguuuaggcaaaagaguuuagaugguaucugaaccccuuguuggcccugaauccuccaacaucgucacccuuuggagucagguuucaugugcagguuaagacuuuuaggagugguaacaaccucaaagaaaauuccauauaaacuacuuccucuugaguacagauguuugauguaaagaaccuguauucaucauucuuuguauaaaugguuuggcuucauuguggcaguuuuuaauuuucuuuccauguuagucuauuuucagcaucuggcuuuuauaaucuccaucccugguucuaaauucauguucucuccaucaugauucucauucuuaaaugagcaccauucuucugagcuucugugagcucagcugcagucacuugccaaguucacauauuauucuaucugugaacuagauaagcagaguuuggggugagugagaaccuauuuugcaagcaauuuagguuguacccaaggagaagcuuucugaggugguacuagcaauggaugcaaaaagagaugguagaagcuuugccucagaagaccuugaggggauagagagcuggucugauguguggguguucccugagaugggcggcugacgagguggcuucuugaggcuccuuacagcugggugacagugggguacuuaaguucucuucagucaccauuguguuuguuuuuccugccucuuuccuaguuugguauucguuaccucugauguaucauuuuuaauucugggacuuuuaacucaugaaggaaauaaucuaugucuggcagcugcagagcugacccaaauugccuccugugucccaggaaaauguagaacagugaccauaugauccagcaguguucacuuuguucuguacaaaguaacuuguguggcugcauuuacuuuuucucuccggauuccuuuuaaagguaauuugcuacuaucguuugguuguuuggcuccucagaaauauucucaugugagaaucacucuugucaaguuugacuuuaguaucaaguauauuaaagaaauggaugccacuugcuuucuugguguaaagauuucucuagaagcccuuugccauuggagugagucccuuuucuucucucaccacacaguggcuugggcugaguggcgcuggaggcugagaauucccccuucugugaagcuugguacacaaggcuccuagagaacauguuucuuucucauccuaggcaggcuuugguuacuaaaccagcugaagcccaguuucccaagucguauugcucuuacuaacacuaucccuauuucucauccuucccgccaucgacaaagccgggcaucccagccgcugagguggguauagguguuguagcugaggcagaugcggccgaugcugcuggcuucccuguccccccugacauggaagacgauuacgaaccugagcugcuguuaaugccauccaaucagccggucaaccagcccauucuggccgcggcucaguccuugcaucgggaagcuaccaaguggucuaguaagguacugauaagcacccccaguugggggcugcuccauaugcauccggccaugugcagccuugacacauugcaucacucaugaucugugcugguccugugagucugagcagggcgggcaucugucugucugcaccauguuguuaggacuggcuucacaaguuugauaggucugcuaacgccagauuaauuggacugcauuuauguuuaggggaugaagagagauggggggggucacuuuuggaaaggauuccuuuucuuacugauuuuguggccaucgcuggaaaccccuugggaagccgugaaugcaucucucaaugacuuccaggucaggaaccaugguagaccauuacgaggucaccuggccugaccauugagcuuugccugcucccaacugaccccucacugauggcucagggagaguugaugagggggagaggcagcuuuauagggcagggucucugggggaggacugcuugcugcccugcacuuggcuauguggcagaugcuggccuugaugggaguccacagaaaauggggccucacugacugcuuguccagguaucucagugggagggaaugggagugggaaauggaguacucaaggccacaagacaggccgccauagaacuuuggccuuggggaaugaaccaaagcuaguuuggagaguagggugauuggggugaucacuuuucccuuuaaagguggcaugcugcaagaagaaaggcuuugaagagugauggguagucacuaaccauggcacuaugcuaucuucuaaccaacgugaugggguccuggaaugauccuaggucugcacuagaagagguagacccagaggaccuugucuaacauaccccuugcuucuugacuucuucccauaccugcguucucuccggccucaauuacugccugagauguuacacccuuccagcauaaaugaugaaccgcuucauggugccuguagaggccucuugcagagcacccugcagugguaugguuuguguaugccucacugcacuguagagaaaugaagagcaugaggggaaaaaugaguagggccuggacuuuuagcuaguuuugaacacugcaguugcuaugacuugggguuguuagcagccaaaagaggagcuuucaugagagggcacagaauacauaacuugucuguuucuuuacuaugacccaugaggguuuuaguaaaccaaaaugccaagucuaagauaaacugccauuccuuggagugaggguuccauuuacagccugaaucacgacuuuuauuuuccuaaugccuucucuugcauccucuuagcugaagguuccuuuaacuggagucuucacuuagcugaggggacugaagaauugauucuuuacccuuuuacgugggaaaaauuaaagcaacauguucguucaggcugacaggacaaauaagaggcaguagagggauagccagagcaggcuagaucagaaaauaucuuuuuuuuuuuuuucccucacccagcugagaauaguuacuuggguuugaaauucuaguuaaguagcaagaacgcuuggcugcuauuugcaacaaggguaagcaugaagagggugauuucagcaucuggaaaggcuccucuguauuuuuccccucaggccagcucuacugcuuucucccuauagaaaugaaagugccuguuuaaccagcuccuuggcccuguccccaguuuauugauaugauuaaccuggagaugccaaagugcuuguucagugcugugccuggggugcacaucuugcccuuucagacuaauaucugggucuuccuuuuuuuuagucaggaaaugucucucucccucuccuuucccccuccucucuccucucucuuuguuucucacacugagugcuugggcgagugcccugucucauucuuuuuuuuucuuccagugcuauccguaucacucaagaacggcccuuuucuccucuucucacccuuccggagggaugcuaagguggcaagcucccuccucuucucugugcuucuccuuccuuccuuaacauggccagagcgugggcagagcucacacuguaucuuugcuucccucuagggcaaugacaucauugcagcagccaagcgcauggcucugcugauggcugagaugucucggcugguaagagggggcagugguaccaagcgggcacucauucagugugccaaggacaucgccaaggccucagaugaggugacucgguuggccaaggagguugccaagcagugcacagauaaacggauuagaaccaaccucuuacagguacucggggaaagaggcugcgugugugugugugugugugugugugugugcguguguguguguguuggaggggaggguaugagagggagaaaagcaggagagaaaaacuagguaagggagaaagaggcacuucaccggggacagaaauagcagaaagggaaaaaaacaaauguacugggaaagacagauucaggaaagguuacuuccuaaucaaaugaaugcuuccauuucuggagaaauggauuguacugacccuaggggaaaaaacaaguggaauucugcugcuuauuuaucgagugccuuuucugugccagccacugggaauacagagguagguaagucuugccuucaaggagcuugugggcaaggcaaacagagaaacauaccaaauuaaacuuucucuuuagguaugugagcgaaucccaaccauaagcacccagcucaaaauccuguccacagugaaggccaccaugcugggccggaccaacaucagugaugaggagucugagcagguauguggcagcuguuuuugguuucuggcuggcagcuucugugccguuuugcaguaauuuaacucugcuuuggggaaauuuuaccccuuaauugaguaucgaguauucaguaugugggaugcacucagacugucucaggaggggaaagucuguguuggauagauacaucagaaauuuggaauuggggccaggugcaguggcacaugcagguaaucccagcacuuugggaggcugaggcgggagaauugcuuaagcccagaaggucaaggcaguaagcugugauugcaccacugcacugcagccugggugacagagugagacucuugucuugaaaaaacaaaacaaaacaccaggaauugggagccaggugugguggugugcaccuguagucccagcuacucaggaggcugaggcaguaggaucauuugaaaccaggaguugaagacuagcuugggcaaaauagcaagaccccaucucaaaauaaauagauaaauaaauaaauaaauaaauaaauaaauaaguaaauaaaaggaaucuggaauugcucuugggcaacuuuugucauuuuacagauaggaaacugaggucuagagagguuaagugucugaaauaacacuauggaucaguggcaguuaggacucuacucaguuccuuacccuuggaauaaguuuggcucuuuugaggccuccagugccuguucauuucaacucacuguauguuucuggcuggagagaagguccgcuuuccagcucucuguguguuagugccucagggaggaugaauagugcaggcuuuuccggggcaugagguaguuaggccugugcugaaacugaaaugacagcucaaaggaggugcuucucuuauauucucuuuagguuucucugauagagauagaaauaaggaugcugagaagguucucuuaaccacugcuuccugcauauaccuuggcagucacccaaguuuguccuccuucccaaaaucuuggcccaggucuuucaggaaacccucauuugagcaccccuuacucuccuuauuuccccuccgggaggcccugcucuaagcaagauucccacauggacugcccacacagggcuccucacacaugggguacauaguuuuguuggacuagccacacgaggcucaucacacaugggcuaaggugaagcacuguauuagguguuaagggaguuuaaaaaauuaagagacacaauuccccccacccaacguggggaacucaaaaauagucugaaagaacaacuguuucugaucucuaggccaggagauagggcacuggggcacuuuagaggaaauaaggcggccauucuucuuggugccauuauuguugcuucugcuaccauauucuaauccaacaacucucacccuaauccucucuucucccaaaccaugggaacuguaucuucacaccuaacuuccacauauucuaugaaggguuugcacacuucgcuguuucuaugucaugugaucucuucuguccaaagaaagguggaaaaaaauggggaaggaaggguaagacugagauucaggccuaaucagagacuuaaucaauuaaccacuaaaaauaugccuugagaauaucuauuauguuccauuaaauauuccaguuuuaaaaaggguagaaauugacaguaugguagaauggaaaaaacacaggacuguuugggaggcugaggcaggagaaucgcuugaaccugggaggcggaaauugcagugagccgagaucgugccauugcacuccagccuaguuaacaagagugaaacuccgucucaaaaaaaaaaaauaauaauaaaauaaaauaaaauaaacaacaacaaaaaacaaaacccauaggacuauaagucagaaauccugaguccuaauucucacucuaugaaugucucugggccugagucccuuugcugaccaagugaaaagaacaacugaugaggaauuccagcccacaguuacacuuaucagagccugugaaacugaguguacaaauuuuaugcaggugugcauuuuuucugggggagaauucaccgccuucauuaaauccucaaaugauguaugacuuaaaaauagccaagaauuacugagcugaugaauugccaagauccuuccuugacuuucuaugguagaguaccaaugugauuucagucuuauaaguuugugcguuuguuugaaagauuaacguauuuagauuuucauggguuuaaagugguugguugcuugguuuguucauuugguuguuuuuaaaauucauuaauuaaauauuuaugaaauaccuccugugugccaggcaccauccuaaauacuggggguaugacagugcacaaaauugacaaaaaucuacucuguauaacuuaaauguuaguaugaagacagaaaaaacccucaaaacucccaaacaaccuagguaaaauacguaguguaucaguucgugaugauagguucaauggaaaaaauaaggccaagcgcgguggcucacgccuacuguauguagucuuagcacuuugggaggcugaggugggcagaucacuugagcccaggaguacgaguccaaccugggcaacauggcggaaccccaucuguacaaaaaauuaaaaaauuacccagauguggcagcauguaccuauugucccagcugcucaaaggcugaggcaggaggauccuugagcccagggggcagaggcugcaguggccgagaucacaccacugcacuccagccuggaugaaagagaaagaccccaucucaaaaaaagaaugagcagggaaauccucaccaaggugacaagugagcaaagaucugaaggugaggggaucccugggaucccuggggaaagagcaguccagguacaggaaacagcaaguccugagggagaagcauguuugaagaccaagaaagaggacaugcuguaagcuaucugaagccacaguauacaaucagcgauggccaguuuuggguucuuuuuggugaucugggaaaaccccuagugaugcaagcaaauaugggggaugccagguaccagugggguuagcugcaucccacuccuggcugaaaccuauuuuagagacaggccugcaucagggacccuggguaacggaaaguaccuuuuuccuugcaggccacagagaugcugguucacaaugcccagaaccucaugcagucugugaaggagacugugcgggaagcugaagcugcuucaaucaaaauucgaacagaugcuggauuuacacugcgcuggguuagaaagacucccugguaccaguaggcaccuggcugagccuggcuggcacagaaaccucuacuaaaaagaaggaaaaugaucugagucccaggagcugcccagaguugcugggagcugaaaaaucacauccuggccuggcacaucagaaaggaaugggggccucuucaaauuagaagacauuuauacucuuuuuucauggacacuuugaaauguguuucuguauaaagccuguauucucaaacacaguuacacuugugcacccucuaucccaauaggcagacuggguuucuagcccauggacuucacauaagcucagaauccaagugaacacuagccagacacucugcucugcccuuguucccuaggggacacuucccucuguuucucuuuccuuggcucccauucacucuuccagaaucccaagacccagggcccaggcaaaucaguuacuaagaagaaaauugcugugccucccaaaauuguuuugagcuuuccauguugcugccaaccauaccuuccuucccugggcugugcuaccuggguccuuuucagaagugagcuuugcugcuacaggggaagguggccucuguggagccccagcauaugggggccuggauucauuuccugcccuuccucaguuuaauccuucuaguuucccacaauauaaaacuguacuucacugucaggaagaaaucacagaaucauaugauucugcuuuuaccaugccccugagcaaugucugugcuagggaaacuucccgucccauauccugccucagcccgccaagguagccaucccaugaacacacuguguccuggugcucucugccacuggaagggcagaguagccaggguguggcccugccaucuucccagcagggccacucccggcacuccaugcuuagucacugccugcagaggucugugcugaggccuuaucauucauucuuagcucuuaauuguucauuuugagcugaaaugcugcauuuuaauuuuaaccaaaacaugucuccuauccugguuuuuguagccuuccuccacauccuuucuaaacaagauuuuaaagacauguagguguuuguucaucuguaacucuaaaagauccuuuuuaaauucaguccuaagaaagaggagugcuuguccccuaagaguguuuaauggcaaggcagcccugucugaaggacacuuccugccuaagggagagugguauuugcagacuagaauucuagugcugcugaagaugaaucaaugggaaauacuacuccuguaauuccuaccucccugcaaccaacuacaaccaagcucucugcaucuacucccaaguaugggguucaagagaguaauggguuucauauuucuuaucaccacaguaaguuccuacuaggcaaaaugagagggcaguguuuccuuuuugguacuuauuacugcuaaguauuucccagcacaugaaaccuuauuuuuucccaaagccagaaccagaugaguaaaggaguaagaaccuugccugaacauccuuccuucccacccaucgcuguguguuaguucccaacaucgaauguguacaacuuaaguugguccuuuacacucaggcuuucacuauuuccuuuauaaugaggaugauuauuuucaaggcccucagcauauuuguauaguugcuugccugauauaaaugcaauauuaaugccuuuaaaguaugaaucuaugccaaagaucacuuguuguuuuacuaaagaaagauuacuuagaggaaauaagaaaaaucauguuugcucucccgguucuuccagugguuugagacacugguuuacacuuuaugccggaugugcuuuucuccaauaucagugcucgagacacagugaagcaaauuaaaaaaaaaaaaaaaaaaaaucccugaaugaugauuagagacaucaccgcuaaaaaacuacauuuauaagcuaggauuuguuauaugcaaauauuuucugccucuucuuuuguucuguuuaaaacaauaaaaugcauuuguauaa

SEQ ID NO: 192471 - RNA, 122043 nt, Homo sapiens
uuauacaaaugcauuuuauuguuuuaaacagaacaaaagaagaggcagaaaauauuugcauauaacaaauccuagcuuauaaauguaguuuuuuagcggugaugucucuaaucaucauucagggauuuuuuuuuuuuuuuuuuuuaauuugcuucacugugucucgagcacugauauuggagaaaagcacauccggcauaaaguguaaaccagugucucaaaccacuggaagaaccgggagagcaaacaugauuuuucuuauuuccucuaaguaaucuuucuuuaguaaaacaacaagugaucuuuggcauagauucauacuuuaaaggcauuaauauugcauuuauaucaggcaagcaacuauacaaauaugcugagggccuugaaaauaaucauccucauuauaaaggaaauagugaaagccugaguguaaaggaccaacuuaaguuguacacauucgauguugggaacuaacacacagcgaugggugggaaggaaggauguucaggcaagguucuuacuccuuuacucaucugguucuggcuuugggaaaaaauaagguuucaugugcugggaaauacuuagcaguaauaaguaccaaaaaggaaacacugcccucucauuuugccuaguaggaacuuacuguggugauaagaaauaugaaacccauuacucucuugaaccccauacuugggaguagaugcagagagcuugguuguaguugguugcagggagguaggaauuacaggaguaguauuucccauugauucaucuucagcagcacuagaauucuagucugcaaauaccacucucccuuaggcaggaaguguccuucagacagggcugccuugccauuaaacacucuuaggggacaagcacuccucuuucuuaggacugaauuuaaaaaggaucuuuuagaguuacagaugaacaaacaccuacaugucuuuaaaaucuuguuuagaaaggauguggaggaaggcuacaaaaaccaggauaggagacauguuuugguuaaaauuaaaaugcagcauuucagcucaaaaugaacaauuaagagcuaagaaugaaugauaaggccucagcacagaccucugcaggcagugacuaagcauggagugccgggaguggcccugcugggaagauggcagggccacacccuggcuacucugcccuuccaguggcagagagcaccaggacacaguguguucaugggauggcuaccuuggcgggcugaggcaggauaugggacgggaaguuucccuagcacagacauugcucaggggcaugguaaaagcagaaucauaugauucugugauuucuuccugacagugaaguacaguuuuauauugugggaaacuagaaggauuaaacugaggaagggcaggaaaugaauccaggcccccauaugcuggggcuccacagaggccaccuuccccuguagcagcaaagcucacuucugaaaaggacccagguagcacagcccagggaaggaagguaugguuggcagcaacauggaaagcucaaaacaauuuugggaggcacagcaauuuucuucuuaguaacugauuugccugggcccugggucuugggauucuggaagagugaaugggagccaaggaaagagaaacagagggaaguguccccuagggaacaagggcagagcagagugucuggcuaguguucacuuggauucugagcuuaugugaaguccaugggcuagaaacccagucugccuauugggauagagggugcacaaguguaacuguguuugagaauacaggcuuuauacagaaacacauuucaaaguguccaugaaaaaagaguauaaaugucuucuaauuugaagaggcccccauuccuuucugaugugccaggccaggaugugauuuuucagcucccagcaacucugggcagcuccugggacucagaucauuuuccuucuuuuuaguagagguuucugugccagccaggcucagccaggugccuacugguaccagggagucuuucuaacccagcgcaguguaaauccagcaucuguucgaauuuugauugaagcagcuucagcuucccgcacagucuccuucacagacugcaugagguucugggcauugugaaccagcaucucuguggccugcaaggaaaaagguacuuuccguuacccagggucccugaugcaggccugucucuaaaauagguuucagccaggagugggaugcagcuaaccccacugguaccuggcaucccccauauuugcuugcaucacuagggguuuucccagaucaccaaaaagaacccaaaacuggccaucgcugauuguauacuguggcuucagauagcuuacagcauguccucuuucuuggucuucaaacaugcuucucccucaggacuugcuguuuccuguaccuggacugcucuuuccccagggaucccagggauccccucaccuucagaucuuugcucacuugucaccuuggugaggauuucccugcucauucuuuuuuugagauggggucuuucucuuucauccaggcuggagugcaguggugugaucucggccacugcagccucugcccccugggcucaaggauccuccugccucagccuuugagcagcugggacaauagguacaugcugccacaucuggguaauuuuuuaauuuuuuguacagaugggguuccgccauguugcccagguuggacucguacuccugggcucaagugaucugcccaccucagccucccaaagugcuaagacuacauacaguaggcgugagccaccgcgcuuggccuuauuuuuuccauugaaccuaucaucacgaacugauacacuacguauuuuaccuagguuguuugggaguuuugaggguuuuuucugucuucauacuaacauuuaaguuauacagaguagauuuuugucaauuuugugcacugucauacccccaguauuuaggauggugccuggcacacaggagguauuucauaaauauuuaauuaaugaauuuuaaaaacaaccaaaugaacaaaccaagcaaccaaccacuuuaaacccaugaaaaucuaaauacguuaaucuuucaaacaaacgcacaaacuuauaagacugaaaucacauugguacucuaccauagaaagucaaggaaggaucuuggcaauucaucagcucaguaauucuuggcuauuuuuaagucauacaucauuugaggauuuaaugaaggcggugaauucucccccagaaaaaaugcacaccugcauaaaauuuguacacucaguuucacaggcucugauaaguguaacugugggcuggaauuccucaucaguuguucuuuucacuuggucagcaaagggacucaggcccagagacauucauagagugagaauuaggacucaggauuucugacuuauaguccuauggguuuuguuuuuuguuguuguuuauuuuauuuuauuuuauuauuauuuuuuuuuuuugagacggaguuucacucuuguuaacuaggcuggagugcaauggcacgaucucggcucacugcaauuuccgccucccagguucaagcgauucuccugccucagccucccaaacaguccuguguuuuuuccauucuaccauacugucaauuucuacccuuuuuaaaacuggaauauuuaauggaacauaauagauauucucaaggcauauuuuuagugguuaauugauuaagucucugauuaggccugaaucucagucuuacccuuccuuccccauuuuuuuccaccuuucuuuggacagaagagaucacaugacauagaaacagcgaagugugcaaacccuucauagaauauguggaaguuaggugugaagauacaguucccaugguuugggagaagagaggauuagggugagaguuguuggauuagaauaugguagcagaagcaacaauaauggcaccaagaagaauggccgccuuauuuccucuaaagugccccagugcccuaucuccuggccuagagaucagaaacaguuguucuuucagacuauuuuugaguuccccacguuggguggggggaauugugucucuuaauuuuuuaaacucccuuaacaccuaauacagugcuucaccuuagcccaugugugaugagccucguguggcuaguccaacaaaacuauguaccccaugugugaggagcccugugugggcaguccaugugggaaucuugcuuagagcagggccucccggaggggaaauaaggagaguaaggggugcucaaaugaggguuuccugaaagaccugggccaagauuuugggaaggaggacaaacuugggugacugccaagguauaugcaggaagcagugguuaagagaaccuucucagcauccuuauuucuaucucuaucagagaaaccuaaagagaauauaagagaagcaccuccuuugagcugucauuucaguuucagcacaggccuaacuaccucaugccccggaaaagccugcacuauucauccucccugaggcacuaacacacagagagcuggaaagcggaccuucucuccagccagaaacauacagugaguugaaaugaacaggcacuggaggccucaaaagagccaaacuuauuccaaggguaaggaacugaguagaguccuaacugccacugauccauaguguuauuucagacacuuaaccucucuagaccucaguuuccuaucuguaaaaugacaaaaguugcccaagagcaauuccagauuccuuuuauuuacuuauuuauuuauuuauuuauuuauuuauuuaucuauuuauuuugagauggggucuugcuauuuugcccaagcuagucuucaacuccugguuucaaaugauccuacugccucagccuccugaguagcugggacuacaggugcacaccaccacaccuggcucccaauuccugguguuuuguuuuguuuuuucaagacaagagucucacucugucacccaggcugcagugcaguggugcaaucacagcuuacugccuugaccuucugggcuuaagcaauucucccgccucagccucccaaagugcugggauuaccugcaugugccacugcaccuggccccaauuccaaauuucugauguaucuauccaacacagacuuuccccuccugagacagucugagugcaucccacauacugaauacucgauacucaauuaagggguaaaauuuccccaaagcagaguuaaauuacugcaaaacggcacagaagcugccagccagaaaccaaaaacagcugccacauaccugcucagacuccucaucacugauguugguccggcccagcaugguggccuucacuguggacaggauuuugagcugggugcuuaugguugggauucgcucacauaccuaaagagaaaguuuaauuugguauguuucucuguuugccuugcccacaagcuccuugaaggcaagacuuaccuaccucuguauucccaguggcuggcacagaaaaggcacucgauaaauaagcagcagaauuccacuuguuuuuuccccuagggucaguacaauccauuucuccagaaauggaagcauucauuugauuaggaaguaaccuuuccugaaucugucuuucccaguacauuuguuuuuuucccuuucugcuauuucuguccccggugaagugccucuuucucccuuaccuaguuuuucucuccugcuuuucucccucucauacccuccccuccaacacacacacacacgcacacacacacacacacacacacacacacgcagccucuuuccccgaguaccuguaagagguugguucuaauccguuuaucugugcacugcuuggcaaccuccuuggccaaccgagucaccucaucugaggccuuggcgauguccuuggcacacugaaugagugcccgcuugguaccacugcccccucuuaccagccgagacaucucagccaucagcagagccaugcgcuuggcugcugcaaugaugucauugcccuagagggaagcaaagauacagugugagcucugcccacgcucuggccauguuaaggaaggaaggagaagcacagagaagaggagggagcuugccaccuuagcaucccuccggaagggugagaagaggagaaaagggccguucuugagugauacggauagcacuggaagaaaaaaaaagaaugagacagggcacucgcccaagcacucagugugagaaacaaagagagaggagagaggagggggaaaggagagggagagagacauuuccugacuaaaaaaaaggaagacccagauauuagucugaaagggcaagaugugcaccccaggcacagcacugaacaagcacuuuggcaucuccagguuaaucauaucaauaaacuggggacagggccaaggagcugguuaaacaggcacuuucauuucuauagggagaaagcaguagagcuggccugaggggaaaaauacagaggagccuuuccagaugcugaaaucacccucuucaugcuuacccuuguugcaaauagcagccaagcguucuugcuacuuaacuagaauuucaaacccaaguaacuauucucagcugggugagggaaaaaaaaaaaaaagauauuuucugaucuagccugcucuggcuaucccucuacugccucuuauuuguccugucagccugaacgaacauguugcuuuaauuuuucccacguaaaaggguaaagaaucaauucuucaguccccucagcuaagugaagacuccaguuaaaggaaccuucagcuaagaggaugcaagagaaggcauuaggaaaauaaaagucgugauucaggcuguaaauggaacccucacuccaaggaauggcaguuuaucuuagacuuggcauuuugguuuacuaaaacccucaugggucauaguaaagaaacagacaaguuauguauucugugcccucucaugaaagcuccucuuuuggcugcuaacaaccccaagucauagcaacugcaguguucaaaacuagcuaaaaguccaggcccuacucauuuuuccccucaugcucuucauuucucuacagugcagugaggcauacacaaaccauaccacugcagggugcucugcaagaggccucuacaggcaccaugaagcgguucaucauuuaugcuggaaggguguaacaucucaggcaguaauugaggccggagagaacgcagguaugggaagaagucaagaagcaagggguauguuagacaagguccucugggucuaccucuucuagugcagaccuaggaucauuccaggaccccaucacguugguuagaagauagcauagugccaugguuagugacuacccaucacucuucaaagccuuucuucuugcagcaugccaccuuuaaagggaaaagugaucaccccaaucacccuacucuccaaacuagcuuugguucauuccccaaggccaaaguucuauggcggccugucuuguggccuugaguacuccauuucccacucccauucccucccacugagauaccuggacaagcagucagugaggccccauuuucuguggacucccaucaaggccagcaucugccacauagccaagugcagggcagcaagcaguccucccccagagacccugcccuauaaagcugccucucccccucaucaacucucccugagccaucagugaggggucaguugggagcaggcaaagcucaauggucaggccaggugaccucguaauggucuaccaugguuccugaccuggaagucauugagagaugcauucacggcuucccaagggguuuccagcgauggccacaaaaucaguaagaaaaggaauccuuuccaaaagugaccccccccaucucucuucauccccuaaacauaaaugcaguccaauuaaucuggcguuagcagaccuaucaaacuugugaagccaguccuaacaacauggugcagacagacagaugcccgcccugcucagacucacaggaccagcacagaucaugagugaugcaaugugucaaggcugcacauggccggaugcauauggagcagcccccaacugggggugcuuaucaguaccuuacuagaccacuugguagcuucccgaugcaaggacugagccgcggccagaaugggcugguugaccggcugauuggauggcauuaacagcagcucagguucguaaucgucuuccaugucaggggggacagggaagccagcagcaucggccgcaucugccucagcuacaacaccuauacccaccucagcggcugggaugcccggcuuugucgauggcgggaaggaugagaaauagggauaguguuaguaagagcaauacgacuugggaaacugggcuucagcugguuuaguaaccaaagccugccuaggaugagaaagaaacauguucucuaggagccuuguguaccaagcuucacagaagggggaauucucagccuccagcgccacucagcccaagccacuguguggugagagaagaaaagggacucacuccaauggcaaagggcuucuagagaaaucuuuacaccaagaaagcaaguggcauccauuucuuuaauauacuugauacuaaagucaaacuugacaagagugauucucacaugagaauauuucugaggagccaaacaaccaaacgauaguagcaaauuaccuuuaaaaggaauccggagagaaaaaguaaaugcagccacacaaguuacuuuguacagaacaaagugaacacugcuggaucauauggucacuguucuacauuuuccugggacacaggaggcaauuugggucagcucugcagcugccagacauagauuauuuccuucaugaguuaaaagucccagaauuaaaaaugauacaucagagguaacgaauaccaaacuaggaaagaggcaggaaaaacaaacacaauggugacugaagagaacuuaaguaccccacugucacccagcuguaaggagccucaagaagccaccucgucagccgcccaucucagggaacacccacacaucagaccagcucucuauccccucaaggucuucugaggcaaagcuucuaccaucucuuuuugcauccauugcuaguaccaccucagaaagcuucuccuuggguacaaccuaaauugcuugcaaaauagguucucacucaccccaaacucugcuuaucuaguucacagauagaauaauaugugaacuuggcaagugacugcagcugagcucacagaagcucagaagaauggugcucauuuaagaaugagaaucaugauggagagaacaugaauuuagaaccagggauggagauuauaaaagccagaugcugaaaauagacuaacauggaaagaaaauuaaaaacugccacaaugaagccaaaccauuuauacaaagaaugaugaauacagguucuuuacaucaaacaucuguacucaagaggaaguaguuuauauggaauuuucuuugagguuguuaccacuccuaaaagucuuaaccugcacaugaaaccugacuccaaagggugacgauguuggaggauucagggccaacaagggguucagauaccaucuaaacucuuuugccuaaacucaaccaagacccaucucugcugcucagaagaaaagccagcucacugcugcuaaggcucagagucccacaguguacaaagacagauagguugacagacacacgaacagauauuccuccccagcccaguacacacaugguucaaguagcuucugacuucacacaacucaaagucagcaaacuccugaucuugcacacuucaggagauagaccucaggacuucuggccacaaauggcagaguggggcaaguaaugugggccaaugcugucugcuuuuaaguuuguuuguuuuuuuaaauaauucauguauauuuuuuguucugcauaguguauuuugguucauuguaaugaaauuuaaauuuccuuuaaaaucuucacugucacccucccccacuccccaugcacaguggggcucugccacaugcaguuggagagauaccauuauaaauaauucuacaggucagguccaacaccagcaaagucucccuuccuucuuagaaccugggcucacagcuaacaguucagcaaaauacagaguuaaaaaccaaugugaauuucccagccugaaaaaaauccaagaucagcugcaggugcaggaggucccugaggaaauacaaucgacacaagagcuugaaagcuuugaggauguguaaagaauaaaggcaaauagguggugggaauaaagaucuagggucauaaaaacauuaaaaaaaagaucuagggucauauuagaaacaguuuagaacuaagagcuaccuuucacugcaggguuagcaauaauauuccucuuaucuagaaaagcuacugcucacuuuucaucauuuaggggaaaauaggcaaaaguuauucauagggcaagacugcuguagcauccauauuuuuaccaaccacauuaauauuuacaccuucagauuugcugaguaagagacagccuggagcugucuugaguugacaggugaaaugauucugagaaaggacaaaagcacauggcuucuaagauaccaaucuacuugcuucuguggaaaaaaaaagaaaaugcaaacauuucaucuagcuuuagcacagcccacacaauucauauuuggagcucugaucauuagcaauguagcaucuaaaaacauuugcaguuccaagaaagauaagcaauuucuaaaagaccccaaaugcuaaggucaaggcaccuggcacucuaauggacaaaggacaggaauccucuucucaaaucacaggcacccugacucuggcuuuugcaagcuugaaggagaaaccaucaggugucagaaacaucucacuaaagcacagguaagaagaggaauaugcuauuggcaacacaggaaccaaaggagagagagagggugacuccaaauagacucuucuuucugggucuuucaugguccuucauccuuuccgagaagacauccuuucucaacaagaaaagcuucacuacuuaccuugcuggaccauuugcgagcuucaucauggagcugucuggcagccaucaucauuggcugguuaaucaccuccccggccuucugcucagggaacucuucauccuuuuccucuggugguggaggccuagguggagggaccucaccuucaggcagaggugguuugggaggagcaagcucaucuguuagcuaaaaaagagaaaacaaguuguaaguaaaguccuaaaacuacuccccccuggaauucuuuccuuucuucuaaaaagcaucccuagaaaacccacccauauugacuccacauaagaccacccacacugagccacaaggaccaccugcuucaaucucaacagaagcagguuucucuacaaaaagcuagcaguggccgggcgcaguggcucacgccuauaaucccagcacuuugggaggccaaggcaggugggucaccugaggucaggaguucgagaccagccugcccaaaauggugaaaccccaucucuacuaaaaacacaaaaauuagccgggcaugguggcaugugccuauaaucccaacuacucaagaagcugaggcaggagaauugcuugaacccgggaggcagagguugccgugagcugagaucaugccacugcgcuccagccugggcgacagagcaagacuccaucucaaaacaagaaaaaaagaaaaaaaaaaaaggcuugcagcuacuguuuugguugcaucccagggaaguauacacagugcuaccagaugaaggauucucaaaaagucccuacagaagauguaaguugugguccugguucuaccagaaagcagcuacauaggcaaguaacuucuccccuuggccugagguuccucaucugucacugagggguagcuagaccaaaugaccucuaagauccagauucuaaaugacauaacucuguugcucacauaagaagccauucccaggaauagcccucucucccagcucuaaacacccaccaagcacccagcugggaagaaucuaagaugcguugaaggcugggaaacacuguuccuuagcugugugugcgaugacacaauuuuguacucaaccaacuuaaaaacuuaacaucuuuuacugacauuaaauaugggaaaguaaaucagauuauugccuugauaaguuauuuacaaagucaagguauuucuaauacuguuaguuggaauaagugucuagaaauaaucacuauuucuguuucuggaauuugugucugcaacauacugccuagcuagcuucuuccuacaccauguaaaaauauauucacaguacuugcgggggguaguggggaagguaucuaaagaucuuaaauuauaguuagggaaaaauuuuuuaaaagcauguaucuuguuacuuaaaaaaaagucaaauaaaggaaagaaccaacacaagauuucaaccaccucgguucuaccauuaucaacuaagaacacaccaaaucuccuuacuccaagcugugcagauuauuuuaccacaaugcacuaccucaucacucaucacauccacacuuaccaaagccagcuccucugcuccagccgcuccccaucacagcaagccacuaccacacacaccaguacuacacacacacacacaacccaugcauauaagcacuagguuauaacuccacuggauuuaggaaugaaaaucgagaucugccucccacuaagcuucaaaugaaagcuaaacgaagccaccuagugauggaggcucuaaaacacaaucuaccucucucuugcugaagucucaacaccuuccugcucaauucucugcauaucugaauuuacuuacucggaguuguucaaggucugguggaggcggcgggaagucaggcuccugagguuggaaggcuucucugaccuuggccacagcucccaggauccgauauccugaguccaggaagcucuuuugcaguccuaaacacaagacauccucacuuucagcugggugggucagugccccaaagcacugucugugcagcagcagaacugguuccaugaacaaaagcuggaugugaagcugccaguaaauaucacgggcagugauugaagaaggggggaggcaggacaaggcagaugcccugaggccugcagagcauuggaagcaucacaaaccagcuguucuuuuaguguucagggugccuucuuggcuguacaacuaaaaaguacccaggagaucccugggcaugaacacuuugggcucagguggcauccaucaccucucuuaugaugaggcagucaagagauaagccugcccaacucagaacaugggagaugucaguuucagauuggacauacauucccugaaguacuucucaccuuucucucuacuccuuugcuguccuuggcauucaguauguuaacccuuaugcugagcugcgcuacucuguucaguugccuggaauucaggaaucuacucuacuauuagaaacuccaauuaggaaaccaagcauguccuuagugauaauggguuuuggauauuagaaagauucugccugaaccagagaugaauaggggagccccuccuuccuacucucuugcauugacugcauucuacucauagacaagacugaaaacaucagauguucaaaacaggaaggaauucagaugauuucaaccaaaggagcggcuccaauuaugaucugccaugguaguaccaaaaauaugaucaaaauucaccuaaagaaaacccagauuuucuuuagguguagggccuaggagacccacagaucaacuuaagcccuccagauuugauagaaacugagaaugcuuuacaaagaaaaaaaagcauuuuaagaaaagcccaagagaaguuaacaccaguuacauaaacuaaauggaugguaaauugguuaucaugcaucuuuugaaaauuuuccaaaauaaugacugaacaaggcgaggagcuauuuagccagaccauauuaagaaagcacaggcuggaugccuguaaucccagcacuuugggaggccaaggcggguggaucaacugaggucuggaguuugagaccagccuggccaacauggugaaacucugccucuacuaaaacuacaaaaaauuagcugggugugguggugggagccuguaaucccagcuacucaggaggcuggggcaggagaaucacuugaauccaggcgggggcggagguugcagugagccaagauugugccauuguacuccagccugggcaacaagagcaaaacuccgucucaaaaaaaaaaaaaaaaaaaaaagcgcagagguugggcacgguggcucacaccuguaaucccagcacuaaaaaagcgcagagguugggcacgguggcucacaccuguaaucccagcacuuugacaggccaaggcggguggaucaccugaggucaggaauucaagaccagccuggccaacauggcaaaacccugucuacuaaaaacauaaaaauuagccaggcaugguggcacacaccuguaaucccagcuacucgggaggcugagguaggagaaucgcuagaacccagaagguggagguuucagugagcugagaucaugccacugcccucuggccugggugagagucucaaaaaaaaaagaaagcacagagaaguugguccagaaaaacuaacauacaacaagccugcugauaacugcagagacuuggauggaaaaagauuaaucuagcauucucaaacuaagugucuauaguuuuugcccccagacuuuguauguggugguugugggguacauauucccucacgaccuuuccugaguuaaccucucaguggaggugagacauagugccaugcauugcuuaccagggucggaaauguuuccagccacagcuuuugcauccaucaccaucggggagaugguuuugcucaauucaucagaggcagcuuucacagccucacggaacuugggauccucggaauucuccaccucccucuuagccaccagcaggauccgguuggcccgacgagcaauacugguugccccagcaaccagcaucugaggcugaauguuggccauagcuaccuugcacuuguccaggucuuuuuuaauugcuucuucugaagcauccaacagagauuugguaucaauggcuucguccaccagcccuguuaggaaaacagaaauggaauuuaguuucaauuuagaagaacagaaacuccaaaacacuguuauccacucaaacuucucaugagaaaguauaacauccagaauucucuucuucagcucaaacucuuccuacauaaucaaaagcuuccagguaaacaccacaguuaaaaaaaacagugaggacauagcccaaaagcccaucuggauuugcagcauuuauaccaaccgugguugccagccuucuuguauccaccccagacaaccagaaaugcaacaucgggaggaaacaaggaauaugucugaaaccaucacugcaucaccaccacguuaucugugaauaauauuuucucccugucccucucacuccccagccaucuguugcuuguuggcagcuuguagugcucaagaugagccaugcggaggauuccaauaacccuaacagccuauuucuuauuccuguuaccucucuucagacaccucaggaguuccacuuucaucucgggcugccauggaccccagucacagcagguucugcagggacagcaaaaagccuacauuccucauuccuucuuuccuaucucucccuuuacagagaaugaagacgauucagaggugccacuucaauugcacagacacagguuugcuggugguugguuucuccuuuuuaaaaaaacuacguaguugauaaguuggaggaaacuuugagacaaguuguauuaaaugguagcuauugugguuccuugaaaugugaacccacugaaaaugacagggacacuuacuguauccacaaacaccgccucccagccucugaaaccaaacucgggcucggacugggcaaagacacuauucaaagagaagauaggaguggugacaauaaacaucacgccaggagggcagcauuaaaauaaaagagacucaaagagucucucuucugacaaaguugcaaggcuugaaugagaagccgccacugcucagcagccuuaagcagagccaaguacacugcucagcacgugaccggcccuuuauccaauuacagcugaguaacagaaccagucccgcuccaauuucucagaacucauucuucauggauuagacaacaagauuuguauagaaaacucuaccugucauuuuuucaacauuaucgauccacugguucuucauggucucaaaauguucauaagcagcuugauuuccaggguuccuaaguaagauacgagcagccgagaccaccugacaaugacaaaacaccuuuaaacaccagagcacccuugcucuccagauacaaaccuucagccaagcuuucuccucuuuaccuacagauggcacuguaaagccagaaaguggcaagucucuuuucaggcugaauacaugagguuuggucucaauaaacagcuccccagaaugggcccuucacaggaagguuuuaccaucacagccugauuuuaagaagguaauaaagugacaaaguaaaugaguguccacuugauacuucagaagaacauacacaaaacuggcauauguuuaaacacuugaugucaacucuuccaucuuaaaaaucaccauuaagaaggauaccgaaaaguacucaaaacugauuuaugaauaauaugaagaaaaaauccucacaacaaccccaugagacaggacaguuaauaucucuacuuuagagaugcaaaaaccaagucucagaaaauuuaagugacugcucaagagguccuggccagucaguuacagcauuuggggaaaaaaggauuaacauuugccacguaucugguaagauacaggcuguacaugcauauucuuaauccaaauagaguccauuaggaaggaguuagcuccauuuuacagaugagagacuaagcaucaagagcacagaggagucggccgggugcaguggcucauacccauaaucccagcacuuugggagaccgaggcggguggaucacuugaggucaggaguuugagaccagccuggccaauauggugaaaccccaucucuaauaaaaauacaaaaaacuagccggguauggugguggacgccuguaaucuuagcuacuggggaggcugaggcaagagaaucgcuugaaccccggaggcggagguugcagugagccaagaucaugccacugcacuccagccugggcaacagagcaagacuccgucucggaaaaaaaaaaaaacucacagaggucucaaguccaaaucugucuccagaguccucauuuuaucuauaauugguguuauaagccuagauuccuguuccuccuuuuuaggaaucucaguuucauauugaaauuguauuuuauguuccauguuuuaugggagcuuuuaaagaguguuagacauguuuguagcuuaugaaaaauuguguaaaaguuggacaaguuaaaaaguuggacaagaggaucuaauuuauuaacacgccacacaggcaaaaguuuaaugauucagagacauguuuauuucccccauaucuccucacaaguucacacauaagccaguaucacaaauuuauaaagccuagcauaguuucgaauguaucauaggcacucaguaaaugucugaauaaauaaaugaaaaaauaaugaauuuucuauaauuugaauagaagaaaaauugcacaaacaucacacuaaauaauguugagcuaauauuuuuaagaaaaccuaucacauaguaaacuuuuaauaacuguacaguuugguuuuuuuucccaaucuuccuuugcucccaaacuuacuagccaugccuuguuacacaauaaguagaaaaaagaaaguuauagaaacagaucaauuuaaaaaaaaaaaaaaaacucucacaaagauguggagaaaagauauaaacuccaaaaucaaaacaaaguagccucuuaagauuauccaagccggccgcaguagcucaugccuguaaucucagcacuuugggaggccgaggugggcggaucaugaggucaggaguucaagaccagccuggccaacauggagaaacccugucucuacuaaaaaauagaaaaauuagccgggcaugguggcgggugccuguaaucccagcuacucaggaggcagagucaggagaaccacuugaacccaggaaguggaggcugcagugagcugagauuacaccauuggacuccagccugggugacaagagcgaaacucugucccucaaaaaaaaaaaaaaaaaagauuauccaaauauuuuccuaguuauguguguauguggcaaggggauugcuuuacuaauuuuuucuacuuucaaaacuaagaucgagaccauccuggcuaacaaggugaaaccccgucucuacuaaaaauacaaaaaaaauuagccgggcgcgguggcgggcgccuguagucccagcuacucgggaggcugaggcaggagaauggcgugaacccgggaagcggagcuugcagugagccgagauugcgccacugcaguccacaguccggccugggcgacagagcgagacuccgucucaaaaaaaaaaaaaaaaaaaaaaaacuaauaaauaguccuuguaaaaaaaaauucaaauguuaugaaaauguauaaagacggugacagggucuugcucugucaccccaggcuggagggcaguggggcaaucaaagcuuacugcagccucaaccuucugggcucaaauaauccucccaccucagccucacaaauagcuguguucacaggcaugcgccaccacacccagcuaauuuuuuuuuuuuugguagagucggggucuugcuguauugcccaggcuggucucaaacucccaggcucaagcaguccucccgccucacccucccaaagugccggaauuauaggugcuaccgugcuggccuguauauguuuuuuuaugccaucuuacgguaaguauucaaaaauguauagaaacuguucuguaauuaacuuucuuuacugaacacuguaugaggaaugagcaaaacccaaccuggggugugaguucucgggccgucuucacugaggccugaaugccuuccacuguugauuuauuagcaguaccaaccgcagccgccuucucggccguagcaccaagcuuuccugaaugguuuucaaaguuagcugcccucucaucaaauaccuugaggaaaaaacagauauuaagaacauuuauuucaauaaaaugggucaggcagccuaagaaaaaguuucauccuuuaagaagggcagcaacugcucaaagacuuuagagaugacaucaaacccuaguuaauaaaacaacagucaaacuccaaauccuggccuugauggaucuccucagacguuuagccaucaccaucaugugcaaaugcacacaaacacacucacacacacacgcacauaaccuucauuuccaguucaaccagugcuuaccagguacaagcaggagcauuauauacucugcaguaauuugcugaaugugaagacuaaacaacccccauucucaaaagcuuaucuucuaguuugaagaagacagucaagcccacuccaggcucuauuguaggcagcuggguacauuaaaagcccagaacauccacacaguccuaaauugagcuccaggcuccccagagcagcauccuucauauaucccauuaccauuaauguuguaaaaacucugccauugaccuccaagggaaaaaugauagcuggugcucacacucaggccucagggcaaggaugacugacuuuuauuaaccccaaaugcaaaaucaucuacuuaauuguucauucagcucucaaauucuaaaaaaguuaauguuuccuuuaacagggauacugugcaagguugcauacuguggaggggacuauuaaacuuaaaguagcaagagaucuuuggucauuuguuagaauagauucuugcaaaagcuuaucuucuucaaacuagaagauaagcuuuggagaaugggguuuauuuagucuucacauucaguuacuuacuuacugcauuauuagaacugaugcuucccaacagcacugggucagguuuauacacuacacgaacaugucuggagcugccuaguggaaugcguccucuuuuuugucaacuucugccuaacuuggagaucaguucuggcucuagacaaucucuaaaggucucuugguucaauagcagguuccaaaucauugccaguguucugugucuaucuucucaagucucuuccccacgccagccucuuguuuggauuuaacuacauggguuccugccauuuaaugcugagaaucucugccuaaaaucccugaucuccuagccuccuucccguggccucaguucuuuuacccuagcuggucucccacacucuggaucuccugggcuuuuaccuaccuaauauccuugguugaccaucucaaugccagaccaugacugcugcuccuucugauuuaacuaacugcuuaacuugcuuuucucgucacucaaccaaaauuuacugagcaccuacuaugugccagacccugagacaggugcugaggacacaaaaaugaguaaaacacaauauccucaucucaaggaacucacagcccagugagaaaaaagcacucgaaaacagauuuacaauacagugugcuauguacaauaauagagcuaagcacugauacuauagguaggagcaaaagaaaaagcacuuaaccucucuaggaaacaaaggauaauaggaugaaggauaaauaguaauucaccaaaaaagaaggggaagauaauuacacagaaaaaacaaagacauggaaaagacagacugugcaggaaaccacaagcaacuagguauagcuagggccagaaaugagagggagggguuuguaggaaacagguaugggaagugucagagcuagaucacagagcccuggccuuauccucugugaaaguacaggccccacugaaggguuuaagcaggagaaugucagagucagguuguauuuuuauuugauugauggccuagugaaagagucaaagaagaccaguuagagcuaugcagucauagcucuagggggacuaggggacuaggaaaauaauuagagcucuggcaauaugaacagaaaauggaugugagauuaaaugagugugccuuaguuguuuauuuguaugaacggguguggggaagggaaaagucaaugacaacucacaaauuucugagagagaacagaaggacaacauaugcugagguaacuaggaagacuguagguggagaggcccaccuagauguaucuacuagccugaaagagaagucuggaauuaaaaaaauagcaaaucaucucagccuaagggaacaaucagcugaacugccuaguaacucagguuacagaaagaaaacugggguaaucagcacauaauaacaaaaaccuccaccuaccaguucuacacugucuuggguaccugacccaaaccccuucucauucgcugccaauacuauaaaggcuggaaaaccaaauacuugcuuuccuaaacuccuuugcagcuaggguggccaugagacagaguucaagccaaugaggcauagcaaagcucuccuggacaauuucuaagaaagccucuauuuucacucauucagcaccaacaauguggcaggcacuguuccaagaagggggaauaaggcaaugacagaauaaagucccucccugcauggagcuuucaugguagugggagggagacagacaaaccaaaaaugaaaaauggguaaauacauuaaauguugauaaaugcuaagugaaaaaguaggauauggagaugaagaaauccauggggauaguaguugggguggugguguuaucuuaguggucacccgaaagugacauuucaguagaaagcugaagaaagacaguaacuaauagauaugguuaucuggagaagacuggaacaaacgagugcaaaggccccaagauuagaacauauaaauacacacuaggaauacaauucaaggagguacauacagauguagcaugagggggaagagugguaccacacgagagcaaagaaauggauggggaccagauccaguggugugcuaaagccaccuguaccgacucgugccagcucacaggagcgaaacauguccaucucuucccaacucagguuucagugacuucauguugaaacagccaccgugggaguauuuacauaauggaaaucaacaaacauuacaaaucaagguuuuucguuuuccuggagaguuggcuuaccagcacaucgcuggcaauuuucuucauuguuagcacucugguuuuacucugggauagcggggagucauuggaagggucugaguauaagaaugacaucgauugauuuaaaaagaucauccugacucgaaaggcacaguugugacuggaguacccccauucuucauuucuuccugcauuuaacaugaugccaucccacacccugagaaaaugaccuagaaaaucauagaaaugccagcuuucaugauauuuagcugcugaaccaaugccaaagccaccuacuuccauguuucuugguuugugaugaaaacaaacccgguuguuuucaucucugauggucaggucuucuauugcuugcaacuaaagauauuccucacugauauacguggagacuaaaaguagaggugguagggcuuucccuguucugcucuuccacccuucaucuacaguuucccaaccacugauccugauguccacuguaaucacauuucaccuuuacauauaccuauagcacaggcugacagaaaaauggaagaccucagauacccaccucuucccuguuaggcgcaucaggaggcgccguggcugccacugccaacagcuugaugggaguugugguaucgcugaaaacaucugacacuuccugagucauggccuccugcauccgagcuuuuagauccuuaaaaacauuguuuacauaugaaaauguccagauacauccucaaagcauaucuacuaaugcccuuacuucacugacauucauucaucuauucagucuuucauucaauaaauauuuguuaacuguguacaaagcacugagcuagcacagaacagguguaauuuaugaauccugcccuguaagacauuagugguguaguagaaauaagacaugacccacaugucccuagagacuguuccacucaaucaaggaacccuacuuccuuuuuugguggccuccaugaaaugauacugagaaucaugagguugagcccaaagaaggcccagagaugggcuagaguuccacaccauugccagugcuggcggggccugauaacgaucacaguaacuguaaggauuguuugguggauguagugccaaauucuaagcaauuuauugucuuaagaggaaagaaaucaagaaugggaauuuuuuaauccagguucuuucaauuaaguuuucuagaaaaacucaauaacaaauaucuguaucaauuucucaacaugggucuaaauaagaguauucuuagaagccaugaacaagcucuuuuucauagucaucacauuuaauccaauuuaaguuuucuggauauauacaaagaagucuccaucacccucauuguuuugcaaggugggcagcauaaacuagcuggugauaccugagauaauuuuagguguuacaugggcaaauguuuuuauuuuaauaauuauguguuucuuuuaaaggauaauagaaaaaauacaacuagcuuaucaaacccaagauuucaggauuacaaaguuuucuuucauuuauuuauuuauuuauuuauuugaaauggagucucgcucugucacccaggcuggagugcagugacgugaucuucaaccucugccucccagguucaggugauucucccaccucagccucccaaguagcugagauuacaggcauguaccaccaugcccggcccacagaguuuucucuuaaauaaauuuaaguuuuaaaaagaaguccauuuaaaaaaaaaaaaaaaguccauuuuaagaaaaauauuggcuaaauaaaaguacagaugauauguggauagagcaaaaaucacgaaagggcucuugacugaguggaauuuggaaaacacaaauuuaguugcuacuauauaccagcaagcuuuuuccuaauaagcucuagauuuccuuauaucuuuggucacacucuuuucauuuucccuagaccccagaaauuauguauuuuucaaaacucucucuuccuucccucgucuuucaauaauaggaagcauaaaaaguaaaaugauaugugcuccugacuucuaccuuuaaggagucuuggagcugagaugcaagugcucgugccugaggacucuccccuuccccucuggcagccaggucagccagcugggcugucagcugguccacucggucacacuuggcgagaagaucuugccgauaaggccccaucauaacauuagccagacgaugcccuucggccacaagcccccggauggcagccugaccuggaccaagagaaaaacaaugaaacuuacaagacccagaggagacaauugcaaugccauucuguggugcgauguggcgucuugcucuaucacccaagcuggagugcaguggaacaacagcucauugcagccuugaccugccggcucaagcaaucccucccaccacagccucucaaguagcuggaacuacaagugugcaccaccauaccuggcuaauugguuuuuuuuagagagacagggucucacuauguugcccaggcuggucucaaaccccugaguucaggcgauccacccaccucggccucccaaagugcugggauuacagggaugagccaccgcacccagccaguucuuuuuauuuaacacuuuauuuuuauuucacuaucuuuuaaaaucaugaucuaaaaucuauguaauauuuuaucauauuaacaauaauuauuucacaagucaguuauuauuaaacauuuaugcuguaugcauauauuccuguaugcaacuucuuagaaagaucucuaauuauuucuuagggaagaaacccuuaauuuccugagucaauggguaugaacuuuguuuaaagcucuugacaucuaauaccaaauuuagaaaguuuguacuaauuuauuucuccaguaaauuauauaugugcccaauucuccaacuccucacaacacugggcauaacuaacuuagaauuuuguucuuuuuuguuuuguuuuuaaagagacauggucucucucugucacugagguuagaaugcaguggugugaucauagcucacuacagacuggaacuccuggucucaagcgauccucccaccucagccucccaaguagcuggaaaggugugacuacaggugagcaucacuaugcccagccaauucuuuacucuuuuauuuuuguacagagagggucuugcuauguugcuuggcuggucucaaacuccugggcgcaagugauccucccaccuuagccucccaaagcacuuggauuacaaacaugagccaccaugccuggucugcuucuugauuacaucacaggaauuuuacuggcugcauuuggaaauggaaucacaguuacuuaucagcagcuaaagaacccuuaccuaauuacagauguuacaggaccccuaucaacaacuugcuuauuugcacugagaccaauuuaaugagguuauagugcacugcugcccuuaccgacuccacggucauccacugugggauuaucaauccaccgcugugcuugcucaaucuugcccucaagguguacagcugcuuuggccggucugcuguuggccacagcccgguugguuuuggucugcagguucugcagggccguggccaccuguuuggccaaggcucgagccucuggagaaucuccuuucccccuacagagaaaaagacagccauccugucacacauaaacacuauuuacauugagaucacuuagcugcuaaugacaaaugcuaauaggaugacaaauugcuccugauuacuauuaauuugguuugaaaggagugguuuauuuauuuggcccuuacauaagaaauuaauaauuuacauucagauuauuuuguccuaguuaagacauuaaauaugaguuugcaucaguaaagcucagaucaaucauuugguuagcggagcucaaucaaucaucacuagguuagcggcacccucugccugccaccucugaaaacaccaguuuccucuggaacugggugggcccaggcagccauguuuguuguaggagcagcugaaacaguuauagucaaacuaguaguaauacuaucuuuugaguccuaauucugccagguacuguuacaagcaauuuuuuguuguuguuuguuuuuuguuuugagagggguuuugcuccaucacccuggcuggaaugcaguggugagaucauggcucacagcaggcuugaccucccagggcucacugcagcaauccuccugccucagccuuucagguagcugggacuauagguaugcaccaccacaccuggcuaauuaaaaaaaaaaauauuucguggagauaggaaacauucucccgauguuucccaagcugguccuuaacuccuggguuuaagugauccuaccaccugggccucccagaguccugugcugggauuauaggcaugaccuaccacacccagccauaagcaguugccuuauauuauuuaauccuuacaacaacccuaugauguaaauaacaguauuauccucauuauuaaagaaacaaaauggagguaugagguuggauaacuugcccaaugucccauuauuuacuuugauagagucaggauucaaacccagcaccgugacuucagagucgccacacuuuuuuuuguuuguuuuguuuugagauggagucucgcuguguugcccaggcuggagugcaguggcacgaucucggcucacugcaaccucugccucucggguucaagccauucucuugucucagccuccugaguagcuaggauuauagaugcccaccaccacacccagcuaauuucucuauuuuuaguagaaacggguuuucaccauguugaccgggcuggucucgaacuccugaccucgggugaugugcccacgucagccucccaaagugcuaggauuacaggcgugagccaccgugcccagccuucauucauaaacuacuauacauuugguaucacauaauccccaguccuugccauaacugauuaaacugggugguuaucuaccucaaggacaacauacccacagucaggcaaggcacucaauuagauucuggggguucucaaaguccaguguggauaaaagucacuggagaucuuauuuuuaaauacagauuguuaaacccaccaucaaaagcgauuccaauuaaguaugucugcgguggggucaaggggucugcauuuuuaacgaccuucucagaugauucuuaggcagauaauccuggguccauauuucaaaaacacugcauagucaaccagugaugguaucuggagcuggaaagugauuaagccugggccgugguagcucacagccagagacaaaacccccagauaaauaaacuaagucaacacacagggugaaacagacauagaggaucccacacagcgacuaagagguggagggaggggcuuccaguugcccaagaucuggccacauucaagcuauuggguuugaugaggugccucuauuuucaauaauccucuacuuuuuacuugaccagguccuuccaaccaaagaaccucaaccaaguaucaacacagaaauaaaaagacaaccacaauuauaucacaaagaaaaaaacugcccccaacaccuuauuccaaagacuucaaauucuaaccauuauaaaaauacaaagaaucugacucauuuuccaucucagguccucucagccauagaaagguaacuuucaggcuaacuuuaucugucucaucuguaaaaauaaaaauaauaggccaggugugguggcucacaccuguaaucccaggacuugggaggcugagguggguggaucacgaggucaagagaucaagaccauccuggacaacauggugaaaccccaucucuacuaaaaauacaaaaauuuagcugggcgugguggugugcgccuguagucccagcuacucgggaggcugaggcaggagaaucacuugaacuuggcaagcggaggaugcagugagccaagaucacgccacugcacuccagccuggcagcagagcaagacuccgucucaaaaauaaauaaauaaauaaauaaaauacauacauaaauaaaaauaauagcccauccgcgccagaacagcuaauuuagauacucugucucucucuuuuuuuucuuuucuuuucuuuuuuuuuuuuuuuuuuuuuuugcugagacagagucucacucugucacccaggcuggagugcagcggcacaaucucagcucaaugcaaccuccacuuccuggguucaagcuauucucuugccucagccucugaguagcuaggauuacacacccaccaccaggccuggcuaauuuuuguauuuuuuuuaguagagacaggguuucaccauguuggccaggcuggcaggcuggucuugaauuccugaccucaagugauccacacgcccucagccucaccaaguguugggauuacaggccugagcuaccaugcccagcuuagauacucucuuaagaguuccuuuaugauucuaaauuuuuauaacauucuccuuuauaaaggugaacaaagagggucuuuaacaugauucugaucguggcuacuccuggcaagagguuacauagauguauguuuaugugugugcuauaguauuaaguaaugauggcaugaaugaccacacaugaaggucugcuguuagcaccauuaccauucauuaccucuucaucauuaagaaacauuaaagaguaccuaguauguauauggacuuccauuagguccuaagaguauagagagcaacuuuuacauuugacauuaaacccuuccuuaguguuauuuuagcaugugcugcagggguuuuuuucuuaaaagugaaaaauaucuauugaaagaagaaagcaguuaggugcaguggcucaugccuguaaucccaaaacuuuggaaagcugaagugggaggauagcuugagcccuugaguuugagaccagcccugacaacauagcaacaccccgucucuacaaaaaauaaaaaaauuagccaggcaugguggcacgugccuguagucccagcuacuccggaggcugagguggaaggauggcuugagccugggaguucaaagcugcagugaggcauagucaugccgcugcacuccagcgugggugguagagugagacccuaucucaaaaaaauaaaaauaaaaaauaaaaaaaaaaagaggaaauaccccuuuuccauaucaucaaaguaggugccaugagagacuuuaggagaggaggcuguggggaggcuguuguuacaagaaaaaucauccaggaaauguaauuuaaguaucuccuauacuugcuacuuacaaaauaucauugcuggggaaggaggaaaguacauucuuacgcuucuuccccuccauauacacauaggagucuuuucauagcuagccacaaaaauuauuuuccucuuauguaugggaaacagauaggucauaaacaugauguaucaaagaaagcccuagcuuagaaauuuaaaaagcaucucaaaaaaggaguucuuagcauccuaaauuuaucaauuuauaacuaugugaccagcaauaaaucauuaaaccucaguuacaucacugauacagcaaauuaacaucugaccuagaauuaaugagaauauaguggaagagcaucauaagugcauuuaaccuaggggaauugaaauauguauguucuugggggaagaaagaaagaaagggagagggaagggagagagaaagagaagaaaagauaugaaaaggcaauguaaggguuaaauacauacugucuucguagaucugcuaauuuagaagucagagcagauauuuccccaagggaacguagaaugucaucucuuucuuuaggaucaucacauaauucugcuauuuuccgagcuucagccaaagcaccucgaaucugcucuucuccuuccgguccaccauuuggaucugcaagccaguucuacacauagaaacggagaagcagcacgcugugaucuacucacacacuccuuucuacuaaacuuaacaaggccagaagaaggauuucaaaaguaauauaccaguaaucauuuuuauaauucugaucuuuauuauuguauggagguucuuagauaagaaacucaaucucucaucuuuuuaaaaucaauuuuuuuacacccauuagcauaaaauauuuucccaagcuuuaucucaucucugaauuaaccacaccuuauuaguuccucaguuccucaaacauguguguuugugaaaugcuugaaaaucauuuuacaguagagcaguaucggaaaacuuuaaccccuaaacauuacaaugacccaagaguugugaauucugggacaaggaauaguuccaauguacugcaaucuucccuugguacucugagagcuuacuuuuaccuaacugaagugcuguaaauuaagaucuuuauuucaaaauauagauaaacauuugucuaaaccuguggugguaaaggagguguuaacauugguaagugcuggaagucacucaucacuuagaaaccauuauccaaccacaguaaaugauaagagacagagaagaaagauaggauauuuaugacuuaggauauuuaugaaauauuucccaccccuccugaaaaucacugugacuaccugagcagcaucgaucuucuuugcaaugcucugcuuugaguuggucauggcuuccagcuugcgagcugcauuuuccacuuuugcugugagcacauccagacccugagauaccugcugagcuuucugcauggccaccggugaggauccuuguccucugcucaaaacagacacaugcugucauuguacacccucaaauacuuaaugacaaaauauucccaauagcacaguacaugugguuuucaugaacaugcuuggcuuuuuccuuuuucccaguaaaucugggacagcacaagaaaacagacauaaacaaagcaagacgcccaaaucaaguacuuuuucuuuuaaaaaugcacauuagcuucacggaacugcauaaccacuuugaagaccaggccagcaaauuuugauaauuauucuccucuugguagugauuacauaauccaaucuaaacuucagugggaaaaugugcuggugaucuuauugcuagggagggcuuuguuaccauaguaaugugugcuucugaaauaaauaguccauuaaauugucuucuuaugggcaaguauacauugaaaauguuucaggaggaagcacgcauaguguuaaugaaaguguaccagacugggaacaagcagaucuguguucaaaucuugacucuugguaccuguggaaccuuguuuaugauguuuaaccucccuggguuuccauuuucuaacuuauauagugaagguaacauauaaugaagguagguaauacauuuuccccacuuaucuuauggaguggcuucaagcaucaaaauaauauacuugaaaacacuggcaauaaaaaucuaucauuauuacugaauuaucaucauuuuuauaaugaaccuaaugauaaucuuaaaugccuaccuuccuccuaggcaaccuauaaauauauaaauaaucgaaacuagcuaauacugagcacauggugauaggaaaccacuguuucccaucaaguuccuaaagaacugauuucacuauuuuccucucucagaaaugauaugcuauuacuacuaaaaaugauaugaguucauggaaacuuguuucucuauuuacuuucccuauuuacuuguuuuccuuauuuacuuuccaagucacaaaguaugauuugcccucauuuuacaauccagauuguuuuaauccaagcaggcugguaaacucaaugauaggggcaguaacuuuaccauuugguagaauggcauggcugauuauccuaaucagaacuucuauuuuuaggauaaacuccaaaacaccuuugcuucccuucauaauaguauugaucugucauucaucuaucuagccucuguggguuuuuuuauuuuuuuugagacggagucucacuguuuuccaggcuggaaugaaguggcgcgaucuugggaggcagugguugcaaugagccaaaauucuccuaccucagccucucaaguaguucaagcaauucuccugccucggccucccgaguagcugagauuacaggcaugugccaccaugccuggcuaauuuuuguauuuuuaguagagacgggguuucacacuguuggccaggcuggucuugaacuuccgaccucaagagauccaccagccucagccucccaaagugcugggauuacaggugugagccaccacacccagccuaucuagccucuuuuuaaaauucuucugguuuucggccaggcgcgguggcucacgccuguaaucccagcacuuugggaggccaaggugggcggaucacgaggucacgagaucgagaccauccuggcuaacacgcugaaaccccgucucuacuaaaaauccaaaaaaaaaaaaaaaaaaaauuagccaggcgugguggcaggcgccuaguagucccagcuacucgguaggcugaggcaggagaauggugugaacccgggaggcagagcuugcagugagccgagaucacgccacugcacuccagccugggcgacagagcgagacuccgucucaaaaaaagaaaaaaaaaaaaaaaagaaaaaccuaaaaaaaaaaauaaauaaauaaauaaauaaaauuauucuguuuuucaucuauaccaaaacuugagguaaugaaucauucauuuauugccggguauauaaaagguauauauacacuuuuuccuugaaguugaggccuuccuuuuauguggcagaagaggggaagacuuuuaggaaacauagucuuuaggauuuaaugugcuuuuuuucuucaaaucuacuacuucaugaugagagaucuuuuuguuaaaagaguccaacuguauauuacaaaauaauaacuucucugaggcuggaaauuuagaaauuuuuuuuuuaaaaaagaguccaacugugaaaaaguaaaacuauuuaugggcuacacaguuuuuucauucaaaacagaaagauuuuauugagucucauggggguaaaaauauauacuagcaaccuagaaacccugugugacugaacagaauaucaagaagaaauuguuaccgcauuucagccacuaaaauauuaaacagcuggguacacuuaagaaaggacuacagggagauaacuuucuaaucuuucaucaggaaaggauauugcaggcuccacugugaagcaggaccauaguuacccuucacuguucuagccuuuucucuuuacagauuaaugguggaaccccuacaauaacuaccucauucucuugcucauacucaucuuucucuaaacacauacaacuguguauuugagaauuccaagugaaaacuggcuaccacacugggaaaagguugcagacaaaagacacaaaagugagaaaucagaagagccaagaauccuaucaaacugcacuggcauuucuccgaaugagaacaaaacuucuuuuuguccuuuuugcaaaguucuuaccaugcucaugacagaggagacugcuucucagcaggagaaaagauucacugaacucaaugggaucacauuuauuuaagcuguuucuuuccccuucaacauagagacgcaaccugaaaguccuggagcuuccagggcugcagggaauccaggaaccucuagaaauuauacauaauauuguaugggcauguuuauaugcaucuuuuuagguaaggaugaauguuuucaucagaugauagaagugaucuugguccacaaaagguuaagaaccacgccuuuaagauccgcauucuuggccaggcacaguggcucacacccguaaucccagcacuuugggaggccgcagcaggcggaucaccugaggucaggaguucaagaccagccugaucaacauggugaaaccccgucucuauuaaaauacaaaaauuagccaggcaugguggcgcaugccuguaaucccagguacucaagaggcugaggcaggagaaugccuugaacccaggaggcggaaguuacagugagccaagaucaugcuauugcacuccagccugggcaauaagagcaaaacucuugucucaaaaaaauaaaauaaaauaaaauaaaaauaaauaaauaagaucugcauucuuaugucuauugcacuaauauuggagaccagguauaauggugcacugcauguagaggaguguuucugagcccuguuuguauguagacccuguguauccuaauuaucucaugauguuucaugagugucucauccuauuccaaguuuucguaauguccauaccauaaaauucuauaaaaaucuuuuagaacuucauuaucacuauggaugaguucaucuguaugaauuccaaacaaauuuauauuauauugaguuuucucaauagcaaacuauguuuauuuaguuuauggggagaaaagcucuaaaggccaaggcuuuaggaggguaaaaggaagguaaauaauuaugaauccgaauaaauaaucaugaaaaggaaacucaaaaaagcccagaaauuaccaacuuagaggauaaccuaguuaaaugauuuuuuuaugaggugaaauaauuccaauguuuucacgcuauguuucuuucuccccauccuccguaaaauguauuuacccaugccagacuucaccacugccccuuuauuuuucauaagccuauggcuaguaaauuagaaacuagauuuguguuucaguuucaauuacggaacaaguuucaacuuuacuauuaggcauuuguguauuuuaaaaguucaagccaggagugguggcucacgccuuuaaucucaacacuuuugagaggaucacuugaggccaggaguuugagaccacaaaacauagcaagaccuuaucucuacaaaauauugaaaaacuagccaagcauaguggcacaugccuauaguucuaucuacucaggaggcugaagaaggaacauugcuugagcccaggaguucaaaguuacagugaacuaugaucauaccacugcacuugagccugggugacagagcaaggccaugucauuaaaaauaaaaaauuuggccgggcaugguggcucacaccuauaaucccagcacuuugggaggccaaggcagguggaucaccugaggccggaaguuugagaccagccugaccaacauggagaaaccccgucucuacuaaaaauacaaacuuagccgggcaugguggcgcauuccuguaauccuagcuacucaggaggcugaggcaggagaaucacuugaacccaggaggcgaagguugcagugagccgagaucgcgccauugcacuccagccugggcaacaagagcgaaucucccaucucaaaaaaauaaaaaagaaaaagaaaaagaaaaagaaaaaauuuggcaggucaugguggcucacgccuguaaucccagcacuuuuggaagccaaggcagguggaucaccugagaguuugagaccagccuggccaacaagguaaaacccugucucuacuaaaauuauaaaaaauuagccagguguggcagcccaugccuguaaucccagcuacuugggagguuaaggcaggagaauugcuugagccugggaggcagggguugcagugagccgagauugcaccacugcaugccagcccgggugacagagcgagacuccgucucuaaauaaauaaauaaauaaauaaauaaaaacauguuuuaaauaaagucaggccaggcaugguggcucacaccuguaaucccagcccaaccuggccaaccuggcaaaaccccaucucuacuaaaaauacaaaaauuagccagguguggccgggcacaguggcucacuccuguaaucccagcacuuugggaggccaaggaggguggaucacgaggucaggaguucaagaccagccuggccaagauggugaaaccccgucuguacuaaaaauacaaaaauuagcuggucgugguggcgggcgccuauaaucccagcuacucgggagguugaggcagagaacugcuugaaccacggagcuggagguugcagugacccaagaucgcgccacugcacuccagccuggcaacagaguaagacuccaucucaaacaaacaaacaaacaaacaaacaaaauuagccaggugugauggcgggcgccuauaaucccagcuacccgggaggcugaggcaggagaaucucuugaaccugggagguggagguugcagugagccaagaucgcaccaccgcacuccagucuggguaacagagugagacucugucucaaaaaauaauaaauaaauaaauaaagucagcaaagggaaaguucaccuccaucucaaaagaauuuaauagacuauaauaucucuguuaucuacuagccaaagagauaacucaaaacuggcagaggcuuguuuucugaaucacccuguuaggagugaguuacccacuacugcucuguaaggacagaggaacuuuuaccuggcacggaggucagccacuugaucagucaucugcccuagcauuuugcaaguucccagaaucucccugcguucuuugccugcacagaguucaccaacuuuuccagcuucaucuaagaucugucugauggccugcucaccagcauccccuaaaauaaagagauauucaauaacuacauuguugacacauucauuauuuagagaggauacuuuacaagucauuucauucaccaaggaauggaugauuuuaaacaagacgagugaauagaaggcaacauaucugauagcuaacagccaagcagugcccuuaaaccauagggugagguuucaacaacagacacgcaaaaaaagauacuuggaacuguaucuauuuggagauacuaaguagcuugugguaagaauauggaugaugaaaacagacucuaacaauuuaauaguauuuagcaccuccaaccuacuuuagguuuuucacauucauucaaauauuaaucuaaaacagaauaaauauuagauuagaaaaucaauaaagccuaguucaauaaccuauuugggucuuaucuuuauacagucaacuuuccaauucucauuggcaucaugauuuaaucugcuuaauuaagaacucuguugacauaaauggaagucugcucaaugggaacuggaagagaagaacuuucauucaaaauaauuaccuuuuggauucagggaaggggagaaccaaaaauuuugcaaagaaugcccagcucaguaugacuuacuccuccgugauuagaggugaucgaaucuauucccuucauccuuguaaggccuacuacuugcuucaguuacucagaacuaucagauaaugggguaugccccauaauguuacaguaguucucucagaugaugagauuaugggaaaauuucuuucuuucauuugcuugguuuuuagcuucucguuguauugaucagaaaagcagaacuagaggguuaccuggggaggcacuagggucacggagccaaccuuuggccugguucaguuuggagucuauggaggccaaugcucucuucauggcuucaguguccuuuugggaagaaaucccaccauuauuuucuuugcaaaaguugagauaccaugauagaacguaagacagagaagaaguuacagcauuaacauacauagcuaagguagucaguccuacgaaggccuuaaaaauauugucaccacaccacaauucucauuucugucaaaaugcagcaucuugcaugcaaauauucaguuaauucuacucuguugcuaaacagaguggaauuggguucccuauugcuaaaacugugaaaacugguaaaauugcucaagccagaauauguuuaaugucuucagcaggaaaaagcccuguugucacaugccucauugucagccuuuccacuagucaacauucaucuacugcagccuugccaaagcccuucccaccucagggaagccucguuaguauguggugccacaaaucacaguucuuuuacaucuuguuuugaaaugcacacacuggaugauauuucacuauauucaauuaaccugaaaaacuuggaauuacugguuggaagaaacaauugaaaauguuaaucuagcaguuuaauuuuaauucuacaaauaaaccccucaaaguaauauaauuuagaaguguuuucugaccuucccugcuauuccuccuucuuaguucccuuacuaucccucaccuggaagaagaugcaggauagaauaaaugggucucagcuuauuuuuuacaaccaggauucacgaggacuaucaggaaacuagcauaaaaucucccaggauacaccaggagaagcugaaacaacagacuaaucacuuuaaauguauuuaaguauuuccguaaauuuuuuuaaacacauaaaaacacagagaacaauauaacaccagccaucucuuaagucucuauuuagcaucuucaaagaccaucuauccuccuuuuugcuguaggaaacugacucuuacagaguuaagccaucaaagcacaaaguuaaccucuaaaauucuaggcaauguccuagcuuccuucaguuuccaauccugcacaacugggguucuuaaagguguugcaccacuaguuuuccacacgggggcaccaggagcauccccacuuccaauucaaaaaaagauacagcacuaucacaaauaagcauuggcagcacccauaguuaggcucaagguccacaacuguuccaaagcccccuauucaaaagacagaucucucaacugucggaaucccuccuuccccuucuaaacagacacagaugauucuccuguugaauccuuggcuaucuaaggcucuaaauagcaaauucucagcuauagcaaugaaaaagaagugaacuaaauuaccaaaaaaauugaaaacaaaauauuuuuauuaucaaguuauauguaaccaugguagcugucaauaaaaggcagaaucauaagaggaucuauuucaaaauccacuuguaauuagaagaagauaugugguauuuuuaagugcuuugauucucaaaugguuugaauaucagcaaaucucuccuaucaugucuuaaauuaauuugugcagaaaacguugccuucaaaauuaaugcaaaggucaacuuuagcuuaauuccaaauuagcaaggccugaaucaauaacuuuuuaaaagacuugaggccaggcaacuccuaaccucagagaacuggguagccuucaggaucuaacacaaguuaucuaggcauagguuuucuuuuaaucacaaacucuuacuuaggaaguguguggacauccuggagaauaauuaugucaauguaaaaauauuucacuuaaaaccuguuaaaccauuuuccuaacacacuuuuauuuucagugagaaaagcaauagguauuuauuacauuucaaaaaucuaaauucaaagggaaacgaaggucagaaauuuuuaugucuacucuaacauuaaaggcuacuaguuaggaaacuaaauucaacugacaugcauugaauuuaauaugcauucccugcauguuagguucuguuuuagcuacuuucccccuccuuaccucauugaaucucaaauuuaaaugucauuuaaauaauacuacaaauuaagaaacaggaacugacuccuacaaaccuaauuugaucucagguuuguugacuccaaaccucauugcuuaucaaaugaaacaagauuuuuuuuucuuuuaccaaggagaguugcuaaagauucuacuaaucuccaacaauagucagcaaaucucugccuugucaguuuugacuuugguuaauacugcagagaaaauaagcuccagaaaucaaauucauaaucuacacuaacaaaaaugacugcuuuuauucuccaaugcccaaaaaugauuugaaacacaauggaaaaaauaguuuuugucuauucagcauccucaaaaaucauuucuuuuuuucuccuuaauaaagcucuaauggccaguacugcaaggaaagaauguaauucucaggaagugaguaauuuacugcucagugggaggugugacaccgucaagaaguuaaaauuaagagauguucauuuuccccuaaaaggaaccaauagccaauuuugaaugaagcugcauuuaauaacugcgacuuucaauaaguuaccaaaauuuuuaacagcauuaauuuuagacaauuucagagauuuaaaacaauaacugaaagagccaucuuaaauucuuucuggaaaacaguagguuauaaguaaccauuuuauguuagucauaucuaguaaaaacaaacaugucuaagggaauuuuuuucuccuaagacuuucauauauauuucuuuugaaaggcaauauuuauuauagaauugacagaauucugucauaagcauguaaguauacaaacaaugaauaugacauaaacaaauucacuggacaacuaggacagaagucaauuuggggauauauuuauaaagggugaaaauaaucguaacccuuguggucagccaugcuuuguaccacaaaccauuuugcuaaaccuugucauguaggucuguauauuucaggucaguauaauucagauaugaaauagaagagagaaaaacugcaccuucauuugaguauucuucucuguaaaagcucaacuuugggaaaaagaaaagucucuaccaauuucuuaucuguuuuugguuuguuuuucaggggguuuguggguguugaaagagugaaguauaaaaagaccaggucuagucauguggcuuuggggacagcuggccugaaucuaucuggguccucccccaccauguuaugcuccuucuuaacauaaaauucuuaugaauucauguuuuaaaugaaaaaaauacagugccuuggcacucuucccugcauaccaaaagauggaacgacaagcuaaaccauuuguacgugcuuuccuaggaacugaaacacuccuuaaauuaaacauagauuuaggccucagaacaccugugaauaauaaugaccuccuucuauggacaaucaagaggaacuucgguuaaaaaaguaaaguccugcaauccuaggcucuugaaaauuuuaaauauggggaauaagaaccucucuccaugacugcccaccauacucucccuucucccuccaccaacaccugucuucccacuccauccccuuucuaaccucauuuccaccugcaagucaauguuuuaaaccagauguuucugguuuaagauguuucuggaaaguauagauugggcaguagaacaaaaucuuacaaacuacauuuaaacaagagaaaguugucuaguccugagacuucaugcaaguuaccuucucugggucucaauuccucaucucuaagaauaccuuccuggcucuaaaaaucuaugcuaccuaugagugcaugaucagauguacuagccaaagauaacuuagaucagaagggaaacaucaauuuauuuugggauuuucuccucauggggagcagggagauaaaauaucauaaaugccugaauuaacuauuucucucaagcucuuagagaucuuucauucuauuagcugcuaaaaacaaaacacuagaacacuugcucauagaaagcccacaaaugaccuuuuuuuaauuuaacaaaucaacucuuaaaucccaguggucugcaaguaaggggguaguauuacacacucacaaguucuaaccaacauuuccugccuuaguuaaguuugcuaaucuucuguauaaggcaucugagucacuuacuacuuuuacccaccaccagcccaggaccacaguggggagagacccaccacaggaacuaauucugaauaauagaauuuaaugauucacggugcaaagcugcaggagugccuauguaggguucaaagucuuagcagugaaauuuuuuuuuaauuuuuuaucucacuuccucuuaauucucagcaugcaucaagauacaaguaauauaaauaccaaaaaaauuaaauguagagcacuaaauuuacaaaggguagaauuagaauuguguuuaacucaaauucuuuuaauaaauaauguauuuucagaaaaaaaugcuaaccuaauuuuuaaugaucacuauaaaaugauuguugauuuaagaaaaggaaacuuuuuacuuuuaaaauaagugaaguguuuaaagucaaaguuacuuuuaaauuuguaaaugugcaauuugaauauagguauaaaagguaaaauaaucaguuauugcauugccucuuuaaaaucuuaacuuauucggcaagacgcacuuuuaccaagaauuuuuuccacuuacuuucuucccccacuuuucuagaggaaucaucacuuuccagaagaauacugcaccaauggggaggcaugaaacaaguaugguaagacaaaguuaauuauuuauugguaggggcgagaagaggugaaagacacuguaugcauuaaacagaaugggaacccagcagucacagucagacaaaaggucugauuaauucacugcuuacaguggagcaaugaaagaugcguaaugcuacaaaacugaaaaagagccaaaauccuagcuaccaauuucuauuuucaggguaaaauuuuuuucuauuuugauaaccaauagaaaugauuacucuuagagggugaggagcgguagaguggaugggaaccagguuaggaggaagacuuaucagguauaucuuuuugcagcacuuugauauuugaaccacauaaauguaaaacaaaagcaaaauuagguuaaaaauaaaccucuuuuuuuauucugaugucauuagguuaaaaaauaagcaucucuuuuucauucuuauggucaguagauuaaaacauaaacaucucuuguucauucugaugucaucguguacuugaguugagcuaauuuaauuuaccuucuuucauuucagaugaaguuaguuuuguagcauccuaacaaauugguuuuccucagcauaaaacugggagcagcuacaagacuguacacggugaguaccaggucuauuucacuuguauccccaagugccuaauccuagcccugaaaacucaacugacuacauuuuuuuaaugagagaagcagcucuugauggcacuugcacaaaauaaaguucaauaacauuuauucacuaaaugauggauagcuuuucccuucugaaaauagagaaacauuaagguuaaaaugccuguuccuccuuauuacuuuuugucaucugcuagaagcaaaagaaagagaauaagcgaagagcuuggguuaggggaacaugaggucauggagaacuacagcuaauucaguuuggacagcaaaacaugcagugagccacagaaugaaguuaggaagaccuuuagacacacuucacuucuguuuuccuuuggauuuugaaggcuaggauuauuaugaaggacaggugccucaucuaagcucucuagccuacccucuuucauuauggcuuaaaaccucaaugaugcaucuccaaaagcaaaauuucagagcccgcaaagaagacuggugggagaggcagguacagagauagcaucagcuggaagucuccuuucccaacagcaggguccacagguaacucaggggucucccagcuaccuggggaauccugcuccucaaaugaagucaaugggaaagaccaggccaaaaaagaucccaggagccuacccaaagaacugaaggcacccaccaaauauaggcagccugauagcccacaguaaugucuuuccuuuagcuuuucccaaagaaaucacucaauaugagccacagucagucuccccagcacugccuagagucccguauuaaaucacauucugacgcacauucaagcacaguguuauacacagaauaaggcacggcacacagcacaaaaaaaccucacagacaugcuuuucucuuuuuaagcgaaaaagaaacuagagggcaagagaaagcuuaccuucuaaacgugagaaaaagaauaaaacaaaagaacaaaaaaagaugcauaaagaagucauaacagggaagugaaaguugucaacuaugcaaaagcaaaauuaaauaaaauaucagaguuaaaaagauuuuaccauauagauuuaaaauacagucuuagaaucuauucaagaacuucacaucaaugagaaaaugucucuguaaauaaauccauaguuaaaauaagcuaacuuacucuauauaauuaaauuagcuuucagggcaacaagagagagggcuggugauuucaggccccagcuuuuacauuaccuuacagaucccggagaacauaccguucuacugagcacccaauggaagucauacaacaaaaucccuucuuuaguugacuaccagccuucuggcuggcccuggagacauuggggucacacaugggaaagcuagaucuuggggacaguguguuccccccacugccuacaucuugggcuccuacaaggaaaguaugaacccaaguaucucuguucccccagaccugaaagcuugguucacagucauuaaacagggagcagcagaccagagcagcagcaacacaaaaccacugcuaacaggcucuagaaggaaucugccagccccucugggguccuaaaagagauuccagaaaaagggugaagggaucccucaaacuaacugaccaaugugaagacuaauauuuuaauuaaaccuuccuuggggaaaauggaaugaucaagggacacaucuagaaaugccaagaguuuccucuguagauuucucuggaucaaagauugguuaaagaaaaguuuuccauaaaguucagaauuacaggcauaucuguaucuuacuuagucagcugggaagaaccacccauauacaaggcagagcucccauccacgggaauauacucuuccaccaguccaaccaauaagacuccagccugauggaaaagcuauaaaucucagccuuaaaccaguaucuaccccacaugccuauuuacuuguucuaccuuagaacaaaggaaauuagcaaagauagcaaguaaccuaugaaacagaaaugaagaagaaauuacuuucacaauaucugaguacucuuaugcuacaaaaauuacaagauaaaguaugagacaggugccaaucaaaacccccagccagggagaguuggggauuuugcuuauuucuccacuaagaacacguaccuugcuggcccaggcaucuucaucccaagaggugaguuguaacacacgaauuaucucauuaauuucagcacucauuuuuucuacaguaaaauugcgauuuuuuaaagcuuccucuaugccuugguuuuuugaguuuuuaguuguuacaaaaaucuucauagcuguaaaaauaaaagaucagaaaguaagcuuggaauuuaaucuuguuguauaacaauauucacaaaagauguucuacacuuuagauguuuugggcuuuuaagauccuaaaaugaguauacaaaacaaacacuacaaguuugacaauaaaguuccaacauuaacaaccuuuauuguaaaaauaaaaaaagaaaaagaaaacucaagguacaaagacaccaucacaacaugauuaaguaacuaauuuaaccugcauaugcugaugaccugcaaucacaaaauaucuaauauccuucuaaaucaguuaucauccuggcccucacccuggcuccaucuacuacaaaccuaaugggacaauaugaaaacugucaguaauacucugaauggcguauccugcugccccugaucccagcagaagaucccaagaugucaaguuuaucauccgagauuucucucaacauguagcuuggauuugccaacccccaaacauaaagaagaaaaaaauaaugucugggcaugguggcucacgccuguaaucccaacacuuucggcgugaucucggcucacugcaaccuccgccuccuggguuugagcaauucuccugccucaaccuccugaguagcugggauuauagccgucugccaccaauccuggcuaauuuuuguuuuguuuuguuuuuaguagagacgggguuuugccauguuggccaggcuggucucgaacuccugaccucaggugauccacccaccucggccucccaaagugcugggauuacaggagugagccacugugcccagccuccugaacucuuauacucauauguccuuuuuuagcuacuacuugaaacaccaaagcagguagcuggaagucacaaugacaugagucaccagauuuuuauaauaaaguugccuucugagaaauaacuaauuaacccacaacuugacuaagauaauucauauaaaccaugagcugucuggcauauacuagacacucaauaagugcuacucccuuuugcuagucgagagagcagcuaccauguuugcauuucagagcacuacucaaugggaagguagucccagcuggugacuaaagaacugaucuacucaugauguaaacaacaguuaaauaucuuuuaggaaaaauuggauuaauacacacuaaaaagggcucugaguucaugucuuuaucauaugaugcucuauaauauccauuccagcuccuaauuauuuuucuauaacacaaaggugugaaaauuuaauauccuaggcuagaguuuauagaggagaguccaccucccagcaaaggggcuuguuagagcuuuaggagaacagaauuaggccacagaaaggcaauuucaaacaaagaacaggagaaggacagcauuagagaagaagacugguucucagccaaucagcuacagccaucaugugauaaccaaucaaucgggucucauuuuuaccuaggcugaaggacaugcagugaagccacaaaagaaaaugaaccucaggccaggagccauggcucacgcauguaaucccagcacucugggaggcugaggcaggcagaucacgaggucaagagaucaagaccauccuggcccacauggugaaaccccgucucuacugaaaauacaaaaauuagcugggcauggcagugcgcaccuguagugccugcuacucagaaggcugaggcaggagaaucgcuugaacccaggaggcagagguugcagugagccgagaucgcaccacugcacuccagccuggcaacagagugagacuucaucucaaaaaaaaaaaaaagaaaagaaaacaaaagaaaacaaaaugaaccucagaguuuagaacaugcuaacauuuuuccccccuauaaaauaaaguacaggcaggaaguaccugaaaugagaacuggcagcaacucuuucacgguguucaucgaguucaccaacaucacucggugcuccuggugagugagcuccugcugucucucgucaaucaucuuggccaucuuagucauuccuggggcacaaagaagaaauugugcagggugaguagugaaacaaucccgggucuggcuuucucagucuaaauccauuaugaaauacuaugaaaguucaaaccgauugcucacuuauuuaaacaacagacaccaucacugaacucuaauuuaugcaacauuacucuuuucaaugaaaguaauguauuaaauguaaacacuaaaugugauaaacauuuucauauuuugauauaaauauauucacaaauauuaaacaucuaaaugaauaaauauauauuuauuaaaaagaaauucacagguaagggaaaaacauuuugccaggcuucuaugcauacagguuucaugccaugucucugaacucugugcuaaaaaucucacaugagccuaguacugaaucuaguggcugaaaaaaguucuaagaauaacaaugauauguuuuguuuucauauuucuauuugucuguacuuuccaauuuguccaaaauaagcauguacuaguuuuauaauuagaaacaaauagaaauauuauaaaaauaauuauagggaugacaguguuugaaagcaucugguguuuuggaaucacucugcuagcacuuuuuguuuauguugguuguuauucaaaggcgcuaugugauucucuaaagcuuugauuuucaaauuacuccuaggauuucucaaguugucucacagaccaucaagaccaaagagaagcagagguggggcugcuccugcuucaccuaaaguagcuccauuuugucuuuuuuuguuuggggauucugcauaagauuccauuuggggaaauauaauuuucgccaguauuaugagaaauuuuaagaggacuacucuaaagccaccagagaaaccuauuuccaggugaucuucagugauggcucaaauucuuaacugccauuaaguuuuacagaacaccuacacuggaaccucauaaaaaugcuguuaauuaaaaaucaacauuucacauaaaacaaaugaauuuuauaaagugauaacaaucaaguuaagcagguuaaacaucuaacauaucuugucauuggucucauucauacuuuaaagacccucaaguucauguuauaugucuguaacaucaaaagcugguauccguuuauauauuuugaauauuuaaugcucagaugccugaauaaucauuucaaaauaagauuuaaccacaauagcucuucucuccuaggucugauuauauuaugcagccuugggugagggcaugaauccauaauaguaggcaggcuaauuagcaagcuaagaggucauaaagaacuacaggccagcuggcagacagugaaggaaugcuguguaauguggaauggagaggucaggaugcaggauggccuucagcauuacaguaacagaaaaguauuuccuacauucuccaauagcaguauuugcaauguuugguuuaauucauuugacaaggcaauauauagaaagcagauucagauaccagagauaaugacaucaccucaaagcacagcaucaucuccaucaacagagcagacaccugaaagcccaaugcaucuucaccuaucuucugcaaaaaguaggaagaggguacccuuuccuuuggcuccaacauggacaauccuuaaaaaauguuauagaaauuggauaaaacuaaccuggcccaagauucuuuguguaagugaccaaaucuuccauagucuccaccaccucugccacuguaagauauuccaaaauuccuuugcaaacucuaauaauuuuacggaccugaaaaaauauuucagaguauucaaucacauggguggacaacuagcaaacacgguaacacagaugugcagcauucaacauauuuucauucuaaacaaucaucaaucuuccauuauuaucuucaagaguaggcuuuuugucucagauugccuaccucagccucaucgaagguaaggagcaggucugauguuccagagaggaugccccuugacccaucaauuagauaaucucgagcaggcacugaguaagggucugacugaagcaucugagcugccuggacaagcuuggugcaagcauucucaacccuauagggaagaacacagguuaacacaccggcagaaccacacagaagaauaccauaugcaaauacaaagagagaauaugcauguaaauucacaguuuuuuucccuacaugaaaaauagccaagaccaauugauaauagaaccuacguuuuuagauuuuacaauuuaggcaggacacaguggcucaugccuguaaucccagcauuuugagagacccuguuucaaaaagaaaauuacaaaauuacagguaaaagcagcacauucauucagugcacugcccuuauucuuuauuuccugacaacaaaaaaugacgagaaaacaucugggcucuuugacuucagguugcucuaucucugcaaugccuuuguuuccuuauuccuccccacccuauacacacugcuauuaaaagacacugcacaaagaacugaaauccuucaguucuuugcugaaauguuagaucauuuucagaucuaacaucuggaaauaaaaugccaaagcaugguguuaagugaaauuuaauaacuaaacaaagcaaaggaauaggaagaaacacaaagaaaaaguaugaggcaaugcauaaauuucucacucauucaucuagcuaaauaaauuuguuugauaaauccauuggaccauuugaaaauauauuguuaaaagaaaauaaaaacaaaaauuuaaaaauuaaaaugaaaauauauuguuaauuaaaggucacuauuauuaguaacuaagccaguuauuaauaguuuaauauuaauauaaguaaccagaucagccaaagguugagugguggaaggggagcugggcgggggauucauuuaaaagaggaacccaaaaugcauacaccaaguauucaguuugccuuccuuguacuaauaaaauguauucauucauucauucaauuacucauccccacagaguugaaaauaaccuaauagaucaucuccucuagucucauauucaauauagccauuauguugugacugacuaacuuacaaagauaaggaacaaacugcuuaaaguuaaaaugcuuagccagaauuauacagucucauuugaaaacauagaaaaugucaccugcaaauaaaagccuaucucaccagguucuuuugaggauaaaugaaguaauacagaaacuccacaaguuuaaagcaguauuacauuguuaacaaguagaauuaaaccaacuuaugaauuucaacuacauaaaaagcacugggcuguggacacuguagguauguauauaaagauguaaaaagcacuauucuaacucucgaggagcauacuuuacuaaggcaagacacaaacauuggcagaauaagccaauacauggccgggcgcaguuggcucaugccuguaaucccagcacuuugagaggccaaggugggcagaucacuugagguugggaguucgagaccagccuggccaacauagugaaagcccgucucuacuaaaaauacaaaaauuagccaggcauagugguggacaucuguaaucccagcuacucagaggcaggagaaucagagguggagguugcagugagccgagaucaugccacugcacuccagccugggugacagaguuagacucugucuccaaaacaaacgaacaaacaaacaaaaaaaaaaacauaaggcaguauauaauaaauaucagugaagggcaagaccuguuugauguggcuuuugaucaggcuuaaaggacuggauauuuuguucuuuuuaauuuuauuuuaaauauauaauauauauucauacauauuacacaagcauauacacauauuuaaaaccaaaagggcauacaaugagaaaucucuuucccuucacuaucuuccaugcacucauuccaucccacuugcaaccaauacugaguuuccuccaauguuguauuuccucuguauguaaaugucuucauaaaacauuucaggccucaaagaagcaaaaauguacauuuccccacuuuuuuacacaaauaggaucauauauggucacucgcugcauucugcuuuuuacauuuauguguuguucuauuaaaaguacauaaagagggccgcgcaugguggcucacacguguaaucccagcacuuugggaggccaaggcagguggauuacuuuaggucaggauuucgagaucagccuggccaacauggugaaacucuaucucuaccaaaaguacaaaaauuagccaggcaugguggcaggggccuguaaucccagcuacuggggaggcugaggcaggagaaucacuugaacccaggaagcggagguugcagugagccgagaucaugccacugcacuccagccugggcaacagagcaagacuccaaaaaaagaaaaaagaaaagaagaagaagaaaaaaagaaagaaaaguacauaaagagccuccuccuacuuuuauaaagcuacauaauagcccaggcuaauaguuauuagccugcugugaugaaucaccuugaauacauguaauuuuacccuguaugucuguaggauacauucuagauauaaaauugcugagucaaagguaugcauauguauaauuuuuaacaaauguugccauauugcaaucugcagaaguuauacuaaacaguucuuaccuucucaccaauucaaauuuuggaucuucaccaauaauaaaccaaaauuggauccaaacauaguuucuuuucaauugaggugaaauucauguaacauacaaauaaccauuucaaaguguacaauucaguagcauuuaguguauucacaguguugugcaaccacugccucucucuagugccaaaacucuucauuaucucaguaaaacacgcaauacucauuaaguaauaacucccuauuuucuccuucccccguccccugauaaccgcuaaucugcuuucugucucacuggauuugccuauuguggaaacaucauacaaaagaauucauacacuacgucuggcuccuuucauuuagcauguuuuugagguucauccaaguuguagccuguaucaauacuucauucuuuuuuuauggcugaauaauaauauuccauuguauggauaugccacaguuuguuuacccauuaaucuacuuaugaacauuugagcugucuacaccuuuuagcaauuaugaauaaugcugcuauaauguucucauuucucuuaguuauauaccuaggggaggaauugcuaguuuauauaguaauuccauguuugauuuuuugagaaaccacaaaacuauuuuccagcacugugccauuucacauaagggcuccuaauucuccauauccucaccaaugcuuaucuuuuuuuuuuuuuaaauaaaagccacccuagcaggugugaagugguaucucauuauggcuuugauuugcaauuccuuaaugaucaaugauggugaacaucuuuucaugugcuuguuguccauuucuacaucuuuuauggagaaaugucuauucaauuaggcccauuuuucaauuagguugucuuuuggggcugaguuguaagaguuucuuagauaagcuaguuauuaaacucucaucagaaauacaauuugcaaauguuuuuuucccagucuguagguuaucuuuauucaauauaguguuaauuuccauugagguugaggauuuucauaguuuuuaaguuacaaaauaaaauaacacauguaaaagauuguauaaauuuuaauucaaacaaacaccaucuaccuaaaagucaauaaucauuuuaugccaggugcaguggcucaugccuguaaucccagcacuuugggaggccaaggugggcggacugaggucaggaguucgaaaccagccuggccaacauggugaaaccccgucucuacuaaaaauacaaaaauuagcugggcaugguggcgggcaccuguaaucccagcuacacaggaggcugagggaggagaaucaguagaacccaggaggcagagguuacagugagccaagaucaugccacugcacuccagccuaggcaauagagugagauuuagucucaaaaaaaaaaaaaaaaucauuuuauaaaauaguaccagguacuuuagaaccccaccuuaaccaaauccuccuuccuauucuccagagauaauuauuacucugaauguuguuaauuauuuucuugauuuucuuuauacuuuuaccaccuauauauguauacauaccuaagcaauuuuuuguugaguucugccuauauuggaacuuaagcggaaucauaccguuaugcaugcuucugugacuguucuuuuuguucaacauuauaauguucaguccaucauguuaacaacuguagcuacuauguuguauuccccugugagaauauaccaaaauuggccaggcgugguggcucacgccuguaaucucagcacuuugggaggcugaggcgggcagaucaccugaggucgggaguucaagaccugccugaccaacauggagaaacccugucuguauuaaaaauacaaaauuugcugggcgugguggcacaugccuguaaucccagcuacucgggaggcugaggcaggagaauuacuugaacccgggaggcggagguugcggugagcugagaucgugccauugcacuccagccugggcaacaaaagcgaaacuccaucucaaaaaaaaaaaaaaauauauauauauauaccaaaauugauuuacccauucuaccucugcuggauguuagagguguucuagguucuuguuucuguuauuaguguuaauaugaauaauagugcugugaaaauuuuuauucuggcuccugguacacaugaacagaguuuagauuauauaucuaguaauggaaauacuaaauuacagaaaauaaauauauucaacuuuaccagggaaugacaaacugcuuuccaaaaugguuuuaucaauugaauacuucuaccagcaguauacagacuugauccucaucgucugaacuuuuaauaugccaaucuggucaaugugaaacgauaaacuauugugaauuuaacuugcuuuuuuuuucuuuuuuuuuuuugagacagggucucggucuguugcccaggcggcaggugcagugguauaaucauggcucacugcagccucgaccuccuggucaccucccaccucagccucucaaguagcugggacuacaggcacagaccaucauacccagcuaauuauguuuauuuuuuguagcgauggaguguugccauguugcacaggcuggucgugaacuucugggcucaagcaauucauccaugucagacuccuaaagugcugggggccaggcacaguggcucacaccuguaaacccagcacucugggaggccgagguaaguggaucacuagaggucaggaguuggagaccagccuggccaucauggugaaacacugucucuacuaagaauacaaaaauuagccaggcauggugacaagcgccuguaaucccagcuacuugggaggcugaggcaggagaauugcuugaaccugggaggcggagguugcauugagccaagaucacgccacugcacuucagccuaagcgacagagugagacucagucugaaaaaaaaaaaaaaaaagugcugggauuauacauuugagccacugugcccagcccugcauuuuucuuuuauuaauaaaacugaggauuguuuguuuguuuguuucacuguuuacuggccccauggguuuugauagguaguguuuuugucauucauuuuuaauugucacugugauuuauuuaacaaugaauuguuugggaauuuuaaaauauacuucuacguauaaaggacucuuccucuuaucuucugaucauugauuuaucauucaaaugaguuguguagaaaauguggucuuaaggcacuaaaauauauuuaggcuagcuucauggcuuaacauaugauuuauuuuuauaaauuuucuauguguuauuaaaaagaaugagugauccaaauuuuaggaaaaauauuuuuccuaaaagugucuuuugacacuuaaaagugucuuuguggacaggcacaguggcucaugccuguaaucccaguacuuuggaagcccaaggcaggaggaucacuugagcuuaggaguuccagacgagccuggguaacagagcaagaucucaucucuacuaaaaauuuuaaaaagauaggcaggcacgguggcucacaccuguaguccuagcuacucaggaggcugaggcaggaggagugcuugaguccaggauaucaaggcuguagugagcuaugaucaugccacugcacuccagugugggugacagagcuggauccugucucaaaaaaaaaaaagugucuuuuguaugcuaauaagaugacuaguggcugggggacccuagauagcuucaaaacgggagcugguuccagaaacaucaaggcauggucagagaguuucugaguuggugaacacaucugggugcugggagguggugcacccaggcagcaugaaaucuuccucaucauaucuugcccuaugcaucucuuccauuuggcuguuccuggguuguauccuuuauaauaaacugguaacuauuugaguaaaguauuucugugaguuaugugagccauucuagcgaauuaacaaacccgaaagcggggaguuguaggaacucccaacuuuguaguaaagucagacagaaguguggguauaccaggcacccaauacuugugacugguaucugaagugaggauaguuuuaugggacuaagcacuuaaaccuguggagucugacacuaacucuggauaguuagugucagaauugaauugcgcugcugaauaccaaguuggugucugaagaguuggaagacugguuguugguguggaaaaaaaaagccauacaucugguaucagaagcguugaguaaaaacaucccauuauuauauacaucaacacuuaucuacauuuaccaacaaacuguccaguaucuuggcucaucauucccucuuguauuucaggcuuacaucugggaucagcggacuugucugaaguacauucuuuaggauuuccucuaguaaaagucugcuggugacaaaauguaucaguuuuuguuugauaaugucuguuuuguccucauucuucaaagacuauuauagcaguacagaauucuaaguugacaguuauuuuauuagcaaacugagggcauuauuucacugacauggcaauggaagcaggagagaaggagguaugauaaugaaagcagagacuggaguaauguggggcuacaagccaaggaaagcaggcagccucuagaagcuggaaaaggugaagaaacagagucuuuucuagaguuuccagaaagaauguggcccugcugacucacuuuggacuucuggcuuccagaacuguaagauaauaaauuuguguuguuuuaaaccacaaaguuucuggugacuugucacagcaauaagaggaaacucucauccagucaaaaauuaucagguauacaagaaggcaugaaaauaccgccaauaaugaagagaaaagucaaucauucaaaaccaaccucgggccuggugucauggcucaugccuguaaucccaacacuuuaggaggcugaggaugagaggaggacugcuugaggccaggaguucaagaccagccugggcaacucagggagacccugucuucuuuuuuuuagacaaagucuggcugugucgcccaggcuggagugcaguggugcgaucucggcucaaagcaaccuccaccucuuggguucaaaggauucuugugccucagccucccagguagccgggauuacaagugugugcuaccacaccacagcuggcuaauuuuuauauuuuuaguagcgacgggguaucaugauggccaggcuggucucgaacuccuggccucaagugauccacccgccucagccucccaaaguguugggauuauagguguaagccacugcacccggccaaggaagaccuugucucuacaaaaaauuuaaaaauuagccaggaacagugguaaguaccuguggucccagcuacucaggaggcuaaagugggagaaucacuugagcccaagaggccaaggcugcagugagccauuaucgcacuaccacaucccauacugggugacagaauaagacccuauuucaaaacaaaaccgaccuagaaaugacaaagaugacagaaucaguauauaagaacauuaaaauggucauaacuguacuccacauguucaaaaaacaaaaguaaagauugagcugggcacagugccuaauaccauggucugggaggcugaggcagaaggauugcuugaggccaggaguucaaggccagccugggcaauauagcaagacuccaucucuacaaaaaaaaaaaaaaaaaaaucaggccaggcaugguggcucacaccuguaauccuagcacuuugggaggcugaggcaggaggaucucuugagcucaggaguucaagaccagccugggcagcauggcaaaaccccauuuuuacaaaaaauaaaaaauuagccaugugugguggugcacuccuauagucccagcuacucaggaggcugagguggcuggaucaccuaaacccagggaaguugaggaugcagugagccgugauugugccacugcacuccagccugggcaacagaguaagaccccaucucaaaaaauaaaaauaaaaaauguaauggcaugguguugugcgccuguagccccagcuacucuugaggcugaggugggaggaucacuugggcccaggagguugaggcugcagugggccgugauugcacuccauccugagugacccagcaagauccugucucaaaaaaaaaaaaaaaaguagauugguuacccuaguuagauaaauggaagauagagaaaaagacccaaauagaacaacuagauacgaaagauaugucugagauauaaaaauacacugugaauuacuagcagauuagauauugcaggggaaaaaauagugaaauugaagucauagcaauaaagacuauccaaaauaaaacagggugaaaaaagauuuugaaaaacaaauggcaucagugaacugugggacaacuccaagcaaccuaauauauguguaauuaaaguuuccaaaggagagaagguagugguaggguaauauuuaaagaaauuguuuccaggaaacuugaacauuuaugaaauuauagccaacaaacaaaagcaucaccaacuacaagucuugugauauaucuauuuaugaaauccaguuacuguauaaguuuuucaaauuuggaaaaaaaaugacaagaaugaccauuauggagaaaggaaacugaaaaagaugaaauugaaaagguuuacaggaauaaaauugauuaucacuaaugguucccuugugugguaaaaugauagguccaaaacagagacugaaccauuuuuuuauacaauaagacaucugaucugcacauuaaaauuuaauggcauucauaaaagccaaacaaaucccacuaagacuaaccagcagucagaaacaggaagaagucugucuuguguauggaaaauuggauuuuauuuaaacauucaagcucccuagcuucuuaaagugaucuugcacauuuuaauagaaaucugaauuuuuaaaaaguauuuaaagaaugaaaguaggcauaaggucaguuuccuaaauaauuguauaucuuaacuauauacuaauaauauuuaauuagauaauuuaaaucaaucaacuaguacuucucucucccuuugaaucuucaaccuaaauugcuagaaaaaaaaucuuaugcuauauaucaaauggaccaaugacagccuuaugggaucucgaaauaugcucacucaugacccucuaauacauucuucccagaauuaccaccuacucuaauuugagacaauuuaggagaagaccuugaguaugaguaauuauuuuguaagaaaaaaagagcacaaauuccucaguuccaugugauuucaauuaucacuaaccaagaagauuaaauguaugccaaagaagaggaaaauccauuuagagauuauaaaaagacuaccacaagucuuuuuucuucuuuuucuuuuucuuuuuuuuuuuuuuuuugagacagagucucauucuguugcccaggcuggagugcaguggcgcgaucucagcucacagcaaccuccguucccugggcucaagcaauccuccugccucagccucccaaguagcuggaacuacaggaaugcgccacuaugcccagcuaauuuuuuuuguauuuugcguagagaugagguuucaucauauugcccaggcuggucuccaacuccugaccucaagugauccacccacuucggucuuccaaaaugcugggauuacaggugugagccaccacacucugccugcaaguccuuuuuaaggguucuuuuagacuauauccagaaaaagugaguuacuaaauuuuuuuucuagacagugucucgcucuguuacccaggguggagugcagugguaccaucacagcucacuguagccucaaccucccagacucaagucauccucccaccucagccuaucaaguaacugagaccaaaggcacaugccaccaugcccagauaauuuuuuauuuuuuauauuuuuuguagagacagggucucacuauguugcccacacuggucuugaacuccugggcucaagugauccucccaccucagccucuuaaguagcugagacuauaggugcacaucaccaugcccagcuaauuuuuuauguuuuguacagacaaggucucccuauguuguccagacuggucuugaacuccugggcucaagugauccuccugccuugccucacaaagugccagaauuacaggcgugagccacugugcccagcagagucacuaaucuuaaauuccuuuaaauucuuucauauauuuauucaucuaauauauugaggaacuauuacaugcuaugauuccuagaaaugggaauauuuuuuaaaaguccuuaccuaagaggaaccuugguaggaggagacaaguacaaaucagucuuuagaaguauguccagcaggcuggacgcgguggcucacaccuguaaucccaacacuuugggaggccaaggcaggcagaucacaaggucaggaauucgagaccaaucugaccaacauggugaaaccccaucucuacuuaaaaaauacaaaaauuagccaagcgugguggcacaugccuguaaucccagcuacucaggaagcugagacaggaaaauugcuugaacccaggagguggagguugcaaugagccaagauggcaccacugcacuacagccuucgugacagggcgagacuccgucucaaaaaaaaaaaaaguaugggugcaaaagcaggaggagauuuuuucuuuucuuuuuuuuuuuucuuucgaaguggagucuugcucugucacccaggcuggagugcaguggugcgaucucagcccacugcaaacucugccucucccacacucaagugauucucaagccuuagccucccaguaguugggauuauaggcaugcgccaccaugccgaacuaguuuuuguauuuuuaauagagaugggguuucaccauguuggccagacuggucucgaacucccaaccucaggugaucccuaagugcugggauuacaggugugagccaccgugccuggccuggaggagucauuuuuaccuaagagguuaggaauguugcgauggagaagguaacuacacugcuccugccuugagaaguucagcacuacuuauaaagaugauucucuuugcagcaucucuuugagcucuuuuuccaguagaucucuuucucucucucucucacgcauacgcacgugcacacgcacacacacacacacacccuuucugugagaaauaacaugcacuugcaaucggucuaguuggacuagggagggcagucuaccaucacaaagugcagguagcucacucuaaagccaaacaaucucaaucuacuucuguaaaaagcagucauccuaugucagcucacugguuuaguggccguggaaaggagagcuuuagacaaaauaauauaaaggaaauggugugauuaagucuauuuagacauaugguccauaaauuaaaacuggaaagcacuugaaaacauucacguucaacuuucacucccaccaaaaaaaaaaaaaaguuggggaggaguggaaguaacucauaucacauucacuguuuuaauaaaaacaaaaaaauuaaaacugaucuuagacaguauagccuuuuagguuauaaauacugucaaaaagaugcauuguuugccuaagagugaaguacuauggaacagaacacuugaaaauuuuauuucauggaggucgcaguuccuggagcacacccaaggaaacagguguuuacauaccacgaucccuguauuagagagagagagcuuguugcagagcccacaaacauaucugaucaaacaaggcuacgacgacacuugggagaugggaaggaaacagguggagggaaggaagugagaacaugagaaucuggucagugagguuuucuccaccuggccacugcacccagcaccucccucacugucaucuccaaccagucuggccccaguauaauuauguggcaggcaaaaucaauugucagggcuauucuuccucuuuucuuagcccuuguugagaucuucccuucccuucccauccugucagggucuuucagacaucaagaaaggcauagaucacuucccagucugagaaguccaucauauuuaaaaaugaagaaaugccaaaacagguucauaaaaaugguggucuauuuaagugcuuacauuuaauauuuuaauugcaugaucaacuuuugucugggcuggagugcaguggcacgaucacggcucaccacagccuugaccuccugggcucaagugauccuccuaccuuagccucccgaguaacugggacuacaggugcaugccaccaugcccagguaauuuuuuguauuuuuaauagagaugggguuuugccauguugcccaggcuggucuugaacuccugggcucaagcaaucuggccaccucagccucccaaagugcugggauuacaacgugagccaccacaccuggccaugaacaacaucuuuuaaaacuucuuuuuuuccugugacuacauacauggccuuauuugaagauaauauuaaaguccagacccuucauaauauaaggccugagugagaagacagggguuugggguacaggcaggcccucaagcucucucugccuucccgcauauuaagaaccuaccuucagacaaagaucuaagugaaaaugacugcuaaggccccccaaauuaucccuucauuagauauuuaagauuuaaauuguuaaccuaaggaaugaacuccaauauaaaauuucaggcaucagcaacugagaguucagccauucuaguaugcuucaaauaggaaguacugccucuaucaauucacuggaauuuauauauacauauaauuuuuuuuuaaauaauaaaaauagagccagggauggugacucacaccuauaaucccagcgcuuugggaggcugaggugggaggauugcuugagcccaggaguuugagaacagccuagacuacguagcgagacccuaucucuacgaaaaauuuuaaaaaauuagccaugcaugauggcauguaccuguagccccagcuauucaggaggcugaggggagaauuguuugaucccagaagucugagguuacagugagcuaagaucaugccacuguacucuauccagccugggagacagagcaagacuccaucuuuaagaaaauuuuaaauaauaauaauuuagaaaauaauauaugugaagauuucaaaagacucaggagauaggugaagaaauuucuuuucuauguuaauaugaagcauuuggcacagauuguacuuuaaaacaguagagauggacgcauucuguggcauaucaguaauagcugauaugcuuugcuccuggaguugccauuuugagaaaggucaaggauccucagccauuagucaccuagacaccugacugaaggccacaagcauaguuacaguuuuuaggagggagucaggaacacagaguacaaugacaagcuuuaaucuaauucaaguagcaaguaugcagcaccaacucacacggguguacacugugugauaauauuaauacaugcuguuccaacccuguacuccuacauuuaaagauccuacagaccucauccacaaaguauuccuuucccugucccaacucucuuaaaguacaacauaaugcaaaguggacuucuuguucuuaucaaggccaaacagugauaguacaggacacugcaugaguacacccaaaacuaaaaauaaaaccacaaggaugcagcuuaaauauauacaauuuccauuugucaauuauaucucaauaaagcuaaggggaaaacugaauuuuaaaaaauaacccacaaugagucauauugaaaacauucaaaacauuucaagggaaacaccaaacccuuugcuagaggauguauacuagauaacaaagccuaaacacacacacacacccaucaugagcacacacacacacaaaacccacaggcucacuaaauucucuuauuucagauuauugagauuaggaggguaugcagccaguuuugacuucaaauaaaacaggacucuguccaagucaauugauaacugaaggggaagcagcauguugggaaagaaugggagaggaacaaacguuacagcugcccaagcuauauguuccucaagucuugguaaguaguuuauuuuaaagauguguauaagucacaaucuuuaaauccuuuaaaaccugaauaaccaguccuguucuuucucccuucuucccuuauucucuugucaaaucuagcgucagugcagauucugagugugcagaguucaaucaagaacucugcuaccuccugguccaucagcuccacaguccuuccuccaucucauacuaggguugcagcagaaauagacugaguauacaagcaagagugucuuacagauacuagcaguuuucaaauguauguugauucuguugugaugaauaaaauuuuuaaauuaucuuaaaauauuacuaaauuggccaggcgugguggcuaacgccuauaaucccaguauucugggaggauugacugaacccaggaguucuagacccaccuggacaacauagugagaucccaucucuaaaaaaaaaaaaauuuuuuuuuucuuuuaguuagccagguaugguagcaugcaugccuauagucccagguaccugggaggcugagaugagaggaucaccugagcccaggaggcugaggcugcaaugaguugugaucacacaacuacauuccagccuaggugacauagcaagauccugucucaaaaaauuauauaaaauaaaauaaaauauuaugaaauucacuguaucauuuguuuguuuguuugaaauagagucucacuuugucacucagacuagggugcagugacaugaucuccacucacugcaaucucugccucccagguucaagccauucucccaccucagccucccaaguagcugggacuacaggcacuccucaccaugcccagcuaauuucuguauuuuuaguagagacggguuuccaccauguuagccagacuggucuugaacuccugaccucaagugaucugcccaccuuagccucccaaaaggcugggauuacaggugugagccaucgcacccggccuguaucuuuuuguuuuuaugcauuucuuaaucaagaaauaauuuaaaaucucacuauuauuauuuuguuguugguuuuucuguuuuuguuuuuuuuugagacauagucuugcucugucacccaggcugaagugcaauggcgugaucucagcucacugcaaccuccaccucccaggcucaagcaguucuccugccucagucacccgaguagcugggccuacaggugugcagcaucacgcccagcuaauuuuuguauuuuugguagagacgggauuucaccauguuggcuacacuggucuugaacuccuggccucaaguaauccuccugcccuggccucccgaagugcuaggauuaaaggcgugagccaccacgcccagccuaaaauuucacuauuauuacuuaaagguccuuaugcugaaaaaaaguaggcaaucacuguucuacaguagaauguaauaaaagaguuacaggcguggcaaccuaaacacaaaaugaagugauagauacaauaagaggauauuuuucacuuaugaagaaaacuggcaaaaacuaggauguagauuaaaagaagaagaacacagucuggagaaacaagccaacagcaggcuaacgucuaucaacagucauucuaaaaaaagauaauuagcaacaaauaauuaacagaauucagaacccagaagaaucacaaacuuguaaccaccuaacaauauugcuuugaaauauguagagcuaacacugacaauuauaagaaaaacagacaggucuacaauuaguauaggagauuuuuaacauauaucaaucauaagcugauaguugaaacagacaaauuaggcuauaaaaaauuggacuaguaauauuuauauacugaccuaauuaguauaaauagaacucuauacccaagcaaaagagaauauacuuucuuuucaagcacacauaaaaacucacuagaacugagcuguauguaacaaaagaauuuccaagaauugauaucauaccaaccaugucuuuggguacaauacaauuauauuagaaauauaacaaaagauauuaaaaagaauuuugaaaacuuuaaaaaauaauuuuaaagaauuuuuaaauucucuaauuuaaaaauuaaagugguacaugccuguagucccagcacuuugggagguggaggugaguggaucaccugaggucaggaguucgagaccagucuuaccaacauagugaaacccugucucuacuaaaaauauaaaaauuagccaggcaugguggcgggcaccuguaaucccagccacuugggaggcugaggcaggagaaucgcuugaacccgggagggagagguugcagugagccgagaucaugucauugcacuacagcccaggugacaaagcaagacgcuaucucaaaaaagaaaaaagaaaagaaagauugaacauaaagacugaaauauuaaaaauaagguauucaaauaauaaacuugagaaaaguaaauaauaaauaugagaaaagaauuuaaugaaauagaucuuugugggaaaagcugguaagacagauaaaucucuaauaagagcgauaagaaaaaaagacaaaaggcagaaauaagcaauacugaauaggaaaugugauauaacuagauacaacagagauuuuuaaaagaauaauuauuaugaauuuuaugcuaauaaauuggaagguuggauaaaauugguaauuucuuagaaaaguaucagacuaccaaaguugacucacaaugaauuuagaaccugauuuagauaauaaaacaaaacugagcgaguuucuuuuuagucauaucucuuccucccaaagacaccaccagauacagggaguuuuagaugcaaguuuugccaaacuuucaagagcagauaaucuuuaucuuacauaaccuguuucaaaaacuagaaaaagaccuuauuuuaugaagcuaaaauaacuuugauacccaaacuagaaaagaacauaaaaagaaaagaaaauuacagauaaaggucccucaugagcaaaaaugcaaaauccuuuuaaaauauuagcaaauuaaauucagcacuauauauauauauauauauauuuuuuuuuuucaucacagccagguaggguuuauccuagaaaugcaagaaugguucauuaucagcaaaucuauauucauguaguaaaccauagacuaucucaacagaguaaaggauaaaaauuguguaauccacucaacagauacagaaagaaagggcauuaaauaaaaacaaguaaucaugguccaauucaaaaaaaaaaaagucuuacuacagaagacuacaaauuagauaaaaaauaucucugagaaaagcuuaaaaaguaacugaagggccaagcacgguggcucacgccuguaauuucagcacuuugguaggccaaggugagcagaucaccugcgcucaggaguuugagaccacccugggcaaaauggugaaacccccucucuaccaaaauacaaaaaaucagcugggaguaguggugcacaccuguagucccagcuacuugcggggcugaggcaugagaaucgcuugagcccuagagggggagguugcagugagcugagaucacgcuacugcacuccaacuugugcuacagagugagacuccgucucaaaaaaaaaaaaaaaaaaaacuaacugaagaauugaaucauuuauuuggagaaaauuauuaagaaacaaaaauuaagaagcuauagaagaaaaaaaaagaagcuauagaagggagcuaauauguaauugaaguaggagucaguacucaauuccagaggcagggcguggacacuggaccacauagaggacuagcuaaagcagguccaggguaaaagcaccuccccauaagacacacccaccagggugauaggucaccuuaccauugccacggcaacacccagacguuacugccccuuuccauggcaacaacugaacaaccuaguagccaccacuugcauucuagaaauuucugcacaaaucaccccuuaauuagaauauaauuaaaaguggguauaaauaugaaugcagaacugccucugagcugcuacucugggcacgcugccucuaggguagcccugcuccgccagcagaaaugccucugcugcugcugcugcugcugcuguacacugcugcuucaauaaaaguugcuaacaccacuggcuagcucuugaauucuuuccuaggaaaagccaagaacccucuugggauaaaccucaguuuugggguuugccuguccugcaacauaaucaccaaauguuucuuuuuguuuguuuuagguauuuucacauauaucauuucacucauuuaaaccucacaauaacuauuauguuagaagaagagacuauuguaaagaagaaugagaaaguaccuuagcauacuggaaugagcauacuuggaaucaaacaguucaggguuagaauccuaccucugccauguaugaacugaguaacuuucaacaccuuacugagcuucucuucaucugaaaaaugaaguggacuaaauaacacaacuuaaaauacccagcucauacaagguauuuaagaaauugagcagagcucaagaccaggcuggccaacaugcugaaaucccaucucuacuaaaaauacaaaaauuagcugggcgugguggugcgugccuguagucccagcuacucgggaagcugaggcgggagaauugcuugaacccaggaggcagcgguugcagugagccgagaucacaccacugcacuccagccuggaugacagagcaagacuccgucuaaaacaaaaaacaaacaaacaaacaaacaaaaaacaguagugauaggccagcauuuugggaggcugaggcaaauggaucacuugaggccaggaguucgagaccagccuggccaacaugguguaacccaucucuacuaaaaaugcaaaaauugaccaggcaugguggcauaugccuguaaucccagcuacucgggaggcugagucaggagaaucucuugaaccugggagguggagguugcaaugagcugagauggugccauugcacuccagccuggguagcagagcgagauuccaucucaaaaaaaaaaaaaaaaaaaaaaaaauacaguaguacuaaauuaugcuuaauguggcaaguccaaaggugaacuauuuaaaguuugagugcuugcucuaggucaaaaaugcagcaaggcagugggcagaggucaaugauuacaucacagaacuugggcauccacauuaagagacaaaaaucuucuaauacuguagcaguggaaaggaccacaaaacucaggacacacacacacacaaaucacacauuagccccaggcaaacaaaagguauuaagugauaugauuaaguaauuaauuguuaaaaaaagauauucugggcacuuucacccacaaguguguuuaaaaauacaaauuucaucacaaauuauuuugaguguucaagaucacaagcaaagaaaaagcuacaaggccugaugaccuaaaaaugugacaucauuacuuuaggucaaaagagaucuaaauuaaguauaaagcauauuuuaauccuucucaaauuucuucuuugugcaugaauauaaauuaugguaaauuuguauaaguaaauaccauaacuguucuuaacuaauaaaguuuaaggguuaaaacaaagaauucccaagaaaugugaauaauggcaaucauguagcaguaguacauccuuucacaugguauuuugggaacauucuuuuauucaauaagccuagacauuacaguaugcuucaaaaauaguccaagcuggugaaccaauccaaguuuugacuucaagcagacugucagagcagcacuaaggcagaaagugacaacacuguccaguucgaaaugaaagcugucauuugccugccaacagauaauguacaccaugcccuuuucaaguucauaucacaagaccaccucagaagugaugcuuuuugauccauucaguucugaacauccuuggaucagguccaagaauugccuuccuuauucauuucugcuccauugcagaaauaagaaugaaauuccacuguauacagcaaugacaauuuuuccaaggcaaauaaaauaguuugcuauaaacauuucucaccuauaauaaggaaucaaucugaagcaaaucuacacugacagaaaauaaaucuggucaguuugacaucuagcuuauucucuguuacaacauuagcaccuacuauuccuucuguauuugguuaugaaucuucuggaagaugcuuucauauugucauccuacugcucagcaacuacaaagcuucccuccugcccaauucuaaauuccuuugccuggcuuucaaggaccuucacuauugcccaaccuaccuaccuaagcuuaguuccuaccacccccaccaugugccccucuccccacaggcccucaugacuuggucaugccauucauugcaccuagaguauuuuccuuccucccuacaucuaaccauccucccaagccccacuuccuacauaaacgcucuuucuacuauuccuacuuauaaugagagagcucucucucugaauuccuaucauaaagucagucuguauuauagcucuuuaauuggaaacgucuuaaaauauuucuuuuuuacaaaauuucucugcaguaguguuuccacuuuugcucugccaucauauauagaaaaauaaaacucaaguuuauggcauauccccaugggucuacuugggauuaugcauaauucccagccacaauagcuguaguuccacuauuuuaucucccauuaaagaaaacauaauaacaagcauauuauacuucaaugaaaguuuaaaaaaaaacauaaugagaaggaaugagagggauauuauuauacacgugaacuuaaauaugcucaauuaaguuuuuguuuguuuguuuguuuguuuguuuuuuugagauggagucucgcucugucgcccaggcuggagugcaguggcgcaaucucagcucacugcaaacuccgccuccuggguucacgcauucuccugccucagccuccugaguagcugggacuacuggugccugccaccacguccggcuaauuuuuuguauuuuuaguagagacgggguuucaccguggucucgaucuccugaccucacaauccccccgccucggccucccaaagugcugggauuacaggcaugagccaccacgccugaccucucaauuaauuuuuucuuuuaaagcaaagcauuaguauccucuggcacuuuauuacuguuaauauauuauuugcaauauaucucacaagugacuauucauuacacacugguaggaacuacuauucuauaaacagcacucagcaugcuaggcacauagaaggcaaucaguaaauaauuaaccaaggagcaugucuagcccauuaaucaauuauauauaaaacauuacugccacagcagucugaugaugaugaugacgaagaagaaaaugacaacugacagugauacaaaauguaaacauggaguacaguagcugacuccccugcugacagucucaaaaggaacaaaugauuucuuuucuuuuuuuuuuuuuuuugagacagaguuucgcucuugcccaggcuggaaugcauggcaugaucucggcucacugcaaccuccaccaccuggguucaagugauucuccuaccucagccucccaaguagcugggauuacagguaugugccaccacgcccggcuaguuuugaauuuuuaguagagaugggguuucaccauguuggccaggcugguuuugaacucuugaccucaagugauccaccugccucagccucccaaagugcugggauuauaggcgugagcuagcgcacccagccaggaacaaaugauuucuuauaggguuauaagguuagucuaaccaacauuuuaacaauacagcauagcugcugcacuccugaaguuuaugacaaucugggcaguuucgauggcaaucaccaugcaacccuacaccucuuaugcaacacuguggcuauuauugcagucuuggguaaaauuaguaaauugugagcucuaucugccagugcagccagggaucaaauaacuuuagcuccacccaagagaaaggcugugaccaugcaaaucuuguucuauauuaaaauggcucucacuuuuacaguaaggaauugccugagcacuggaaguuccucaucgacaauuguaucauuuuaaauguauuaaacccauuuuuccauaugcccuaauugccaaucacacaaauagccuaugauaggaucuugagauccccaaauccuaaaaguaucauaucuuucccugaaaaaucuuuaaauauauaucagauagcuuagguauaaaucuaucuacaggccaaguaucuucuguuuucucuagccuugacaucuuaacauucuaggaguacagacugaucuaacaauaaauguuuaaauauuuuagccuuuaguguugcuuaagcagucacuugagaaguccuugcaaaaguagacuacagaggaaguuucagucggucaugcccuagaaauuucuaaacaucaaccaagcagcucaaaagaauguccuacucaauaguuccaaggaugucauuaauugcuuccaucuguuucccccuucucugucccugucuuuuccaagucaaggcaucuacuauuuucugcuucauuuugcauucuauagaaaaacaagaaaagcaaacauaaaaauccaucacgguuuguuuuauuuuguuuuguuuuacacagggucucacucugucacccaggcuggagugcaguggcauaaugacagcucacugcagccucgaccuccugggcuuaagcaauccucccaccucggccucccaaagugcugggauuacaggcgugagccaccaugcccagcgaucaaugauuuuuuaauucugucaugucuuccacauuuauugguuagaauucaccuuacaacuagggcuauugggcuacucuaaaaauuuuguacaggaaaggcaagauaaaugcuuaauuuccuuuaaauuaccaauuauuagaguaagggguugaugcccuaguuaccacacagggugaucaguaaaguuuuauuuuguuuuaaagugaccaaauuuuuugaaauuuuuaucacaacuagggugugcucauuuuuaauuuuucuaaguccccaaagaagucugugaaagcacauagcauauuucagaauaugucucuggggauaagcaaaaauaaguuuccugacaaaauccacuuaccaaucaaaucauauucauagacuagaaugucaggguuggaagcaauuguuuguaaggucuucuaguccaacuaccuacccgauagugaaaccuguacucacucauuccccgugcucuguaucuuccaaggggugaggggcaaccugcuacaagcuagagcuauguuuuuaauguaagguaaaugcaaguuuaauuauaauauguuuaguugacagcauaagauuccucuuaauauuaccaggcuaaggccggggcacaguggcucaugccgguacucccaacacuuugggaggccaaugcaggaggauugcuugagcccaggaauucaagaccagccugggcaacagggagaccuuaccucuacaaaugauuuaaaaauuguccgggcauaguggcacacaccuguagucccagcgacucggggugaggcaagaggaucacuuaagucugggcaauugaggcugcagugagccaugaucgcaccacugcacuucaaccugggugacagagugagagccugucucaaaaauauauauauauuaccaggcugaucggauggcauguaaacaaaauaggcucauguugaucagagcucgaagaaaccuugagaucaccaaguccaaugaagguaggacaaaaaagauacucccacaaaacaggcuguacaaaaaaacagaugcuucuagcaccuuacuuccugacacaugaagacauuuuauggaauuaacagaaacacaguugcauaaagcacccacucagguagaaauaagaagauuucaauaugggugagaauuuuacaucuguucaaugaaaauaauagaacauaaggaggauaaaaauaaaggaacacuuuuagcuuuauuuaaaguugugauauuuaacauacauagagaaaauaaacauauguauaauauaaugcauaaauauaaaacaaccgcccauguaacucaucacuuaaaucaaaaauagaacauuauuaccacuuuuagaugccccuguguaccucuuccugaguauagaccucuuccucccucccagagguaggacuacccuggcuguggugaccauuauuacuuacucaucuucaucuuuuuaccauauaaauaggcaugucuaaacaacauaguuuauuucugcauguuuuugaacuuuuuuuuuuuuuuuuuugagacagagucucacucugucacccagacuggaguacaguggcuugaucuuggcucacugcaaccuccgccacccggauucaagugauucucccgccucagccucccaaguagcugggauuacaagugugagccaccacgccuggcuaauuuuuauauuguuaguacagauaggguuucaccauguuggccaggcugaucucgaacuccugaccucaagugauccaccugccuuggucucccaaaguacugggauuacaggugugagucaccacaccuggccauuuuugaacuuuaaauaaguggaaccuacauaucuaucuaucuaucuaucuaucuaucuaucuaucuaucuauccgucucucugucucucuguuuuucauuucccucaauuauuuuugagauucauucauuucucuuuuuuugucuuuuuauuuauuuauuuauuuuuagauacaggguuucacccugucacccaggcuggagugcaguggugcagucacagcucacugcagccuuaacuuccccagcucaggugauccucccacuucagccuccuggguggcugggacuaucggcucacaccaccacacggagcuaauguuuuguagagaugaguuuucaccauguugcccaggcuggucucaaacuccuaggcucaagugaucuucccuccucggccucccaaagugcugggauuacaggugugagccacugcaccuggccucauuguuuuuuucaauugaaaugaaacucauauagcauaaaauuaaccauuuuuaagugaaaauuccucacuccuuuucauuacugauuaauauuacaauuucugauuacaccaugauuauuuuauccauucuacucuagauagaccaguggggucaucaugaacaaugcugauagaaauguuuuuuauauggaugcuggugugcauguggacgaguaucuuuagggaacauacccgacaguggaacugcuuaucuucuacuuuacugaugucauguuguuuuccaaaguggcugcagcaauuuacauucccaacagcaguguaagaacauuccaguugcuccacaucuuaucaacaacuaauauuaucaggguucuuaauuugggguguauaauaaaauaauuugcacuucucugaugacugaaauaaaauauuuauuggccacuuaaauuuccucuuuugaggugccuauucaaguccuucaaacaccuuuuuggaaagucuuauguuauucuuauugacuucuaugaguucuauuuuuuuuguccuacacaucagcuuuuacuuuugcuuacaacuugacugccauauagaacaaaaccacuaaucaaagacaauauaagaaccuaagaaguuuuaaguauucaaaaauuaguaugucugcuuguuuuaugcagaauagcccaaaaagccuggaaauuauuuuuaggaauacuaggagauauauaaauauaacuuaaauuuaaaauguaacugaaaauaugaaacaauaauuuuuuuuuuuugagacagagucccgcucugucacccagacuggagugcaguggcgugaucuccacucacugcaagcuccaccuccugaguucacgccauucuccugccucagccucccaaauagcugggacuacaggcacccgccaccacgccuggcuaauuuuuuuuauauuuuuaguagagacaggguuucaccauguuagccaggauggucucgaucuccugaccugaggugauccacccuccuuggccucccaaagugcugggaugacaggcaugagccaccacgcccggccaaaacaauaauuuuuuaaaguuuauaucuaccauuauucccuuaucuccaagcaaaggugccuaguauacaauguagauucaugcaugcuauagucacagugggucucugaauacuuuucauuuuggaaagaaaaacucaaaacucauggucuuauuaaaaauuauuaugucaaaaauuggccagguacaguggcucacgccuauaaucccagcacuuugggaggccaagguggguggaucaccugaggucggaaguucaagaccagcuuggccaacauggugaaaccccaucucuacuaaaaauacaaagauuagccagggaugguggcacgcgccuauaauccaagcuauuccagaggcugagacaggcaaaucauuugaacccaagaggcagagguugcagugagcugacaucgcaccauugcacuccaaacugggugacgagggugaaacuccgucucaaaaaaaaaaaauuauuaugucaaaaaugccuaauaucaaaaacuaaaaugaacaguuuuuuuaaaaaaguuagaagacaaaaaaguugaaauuucaauuguaaacaaaaguuuuauaccaaaaaaaaguuguuacugaaaucagcuacuuuuucuuccuaacaagaguauuauucugcuuagcaacagaagaauauuucaauuacucacuuaauaaaugcugguggcauaucucucuucaaaaucugauccucagugguuugaacagucucuuuuccaaccuacaagaggaaaaaaaaucauaauucaaauauaaauucucagacuuuaaaaaacuauuacuuaagcauauuugaaacauauacuuaaacauaaucuaucauuaaaguuucuagauuuaagggagauuucuggauuuaaaaaauuuuuuaggauuacucacauaauaugccuucacaauauacuagaauaacaauauggaauacaaacauaauguuguauuacuccuucuucagaauaacuaauuugaaagcauuacugagcauaauaggagaaauucaucauugagaauauaaguguguguauuuaagccaaaaaacuaggccacaucucuaaaauguuacaugaaguacaugaaucaaguuagacagacaaaacuaucuauacagaaaaaaacgaaguuauuggaacugggaaaaauauuugaagcuauuaugauucugacacuagaaaccaaacaugaaaauaugcaacuucacuaguaaucaaaaaaacugaaauuaaaacaauaugauauuuuucccuaauuauagugcgaguuaaaaagaaagaauauauaaugcugaaugcaacaauggaauagguaguuuuacacccugcagguggugauauaaacugacauauucucuuuggaaaaucacuugcuagaauuuguuagcggacauaaaaaaagucauaccugggaauuccacuuaugagaauauaccuuauaagcaguaaugccaaaugugauaauaaaaacaauauucacaaaaguauucacuaagaugacaguuauaaaagcuaaaacacuucauaaauaacuccuccaacaaagaggaauaguuaaguaaauuaagauauaucguuagguugaguacuaugugggccauuaaaacaaugguuauaaaaacuuggcauuauaggaaaauguuuaugacauuauauuucacuuaaaagaagaaauauacauuaugaguacaacaccaaaaaaaauccacauguauaaauaaagcaacaacaccgaaagaacauuuuuaaaauauucuacugguuguacuaaugcuuaggaaauugaaugaauuuguaucugcguuuccuauuuucuaauuuccugaaauguaaauuuuaaaguaauuuuuguaauuuaaaaacacaaaaauguuacuguaaguuguuuuguuauuuuuuguuuguguuuuugaaauagagucucacucuguugcccaggcugaagugcagagacgcagucucagcucacugaaaccuuggccucccagguucaagugauucucaugccucagcuucccaaguagcugggacuacaggcaugugccaccacacccagcuaaucuuuuuuuuuuuuuuggauuuuuaguagagaugggguuucaccauguuggccaggcuggucucgaacuccugaccucaagugauccacccaccuugccucccaaagugcugggauuacaggcaugagccaccacucccagccuaaguuauuuaguuguaauuauuuccuaccuaauaaucucaguacacaauuaucugucauuuuauauagaucuuccaaauaguaauggucagaaauuuuuuaaauuaucaaaauauuaaaugucacacuaccaaauuauguguguauuauaccacuaaucauacacauauucacuuucuucaaaauuaucucuaugcaggucuugaaugucaauuuuucuuccacuauauucauguauuauaaaauauaagaguaaacuuuaauauaguaaauggugaaauucacccauuuuaacaauauaaagccaccuaagaguacuaaaucauauuuauaaaccauauuuuaauguagaaaucugugaaauuaaaaaaacccagaauggaaaauaugucaguccuacuauuuaaccauuuaacuuuugauugaguuuaaaggaaaaaaaaauggaguaagaaaaauccuggcuggcacaguggugcacacuuaucauucccagcacuuugggagaccaaggugagagaauuacuugaaaccaggaguuugggaccagccugggcaacauagugagaccuugucucuacacaaaauuagucgggugugguggcucacaccuauggucccagcugcuugggaggcugagguggaaggaucacuuaagcccaggaggucaaggcuguggugagcaguguuuuacaccacugcacuccagccuggacaacagggcaagacccugucucaaaaaaucucuaaaugcucaguaaaucagcuaaagaaaauaacacaauaaacuauucucagggaauauaagucaugcauaaauuaugaauacaaguuuuuucuuucaaguuaauagcuagaaaaagcaacacauaucuaccacuguguaauagccaaugcuuuuauagacaauagacugucuguaucauaauaaaaggcuuuuaaaucagcagcugguucucuagaguuucucagcucaaaacaugacagaauauuuccagauguauuguucacuauguuuuccaacugaaacuaaccauucaaaaagcuauggccaugauuucaugaaguaaaagaugaaguucagccacaaagucacuaguucacauucaguauaaagggccuagaaagauauucacauuuaagacacagagagauuccuuuuauauauguggggggaaggagggacacagacacagagagcaagcgugggagggagaacuaggugaguuccucuuauauuuccuuuagaaaauaguaaguuauucaguguuauuaaacauugcuuuuagcacaacaacaugagccagguacuguuuagguaguagagauggaguagagaauaaaaaaaaguuuccugccuucacggaacuuacagucuaguagggagagacagagagucaaguaaauaaacaaguaugauuccagauaaugguaagaaugaugcuauaauaaagaguacgggcuggaaacaaaggagcuuacuuuggaaagaguagacaaagaagcaaaauuggagcugagacuuugaaacuaagaaggagucacucaugaaagagcuaggcaagaacaaucuagggggagcagccagaaaaaggcccuaaugcaggaaaagauuggguguauuuuaggaacuggaaagaggccagaguggcugaaccucagggagggagggaaguauggugugguaaugaggcuggguaagaaggcaagggccagaucauaaagagccuuuuaggccagcuugaaauauuuggaaucguuuaucaguacaauaggaggcaggaguucuaaacaagagauuaaucugacuuuuucuuuucuuuucuuuucuuuucuuuuuuaagagacaugaucuggccccauaucccagacuugagugcaguggugcaaucauagcucaagugauucagggcucaagugauccuccguccggagcagcuaggacuccaggcaugagacaccacgccuagcuaauuuuuuuuuuuuauuuuguagagauggggucucacuauguuucccaggcuggucucaaacucccaugcucaagcgauccuccugccuuugccuaccuaacugcugggauuacagucaugagccaccacgccuggccugauuuucuuuuuaaaaggucauuuugccuauuuuuagguggugaggggagagcaggguaaccaguaucacucuccuagaugauugcagggaggcuacugcagucagccgggagagugauaguagugacuuaagguuucacuacuuaaguagugaaaacagaaauggagaaaagaauagaauuguguuaccuuuuuacggaagaaauauuauuaggacuugcucuuggacugggugggguggggugggggaugaagacuagacugagguaaagaaauaaaaaccacguggccgggcgugguggcucaugccuauaaaucccagcacuuugggaggccgaggagagcagaucaccugaggucaggaguucgcgaccagccuggccaacauggcgaaacccugucucuacuaaaaauacaaaaauuagcugggcgugguggcggaugccuauaaucccagcuacuccggaggcugaggcaagagaaucgcuugaaccugggaggcggagguugcagugagccaagaucgcgccacuguacuccagccugggugacaagagcaaaacaccgucucaaaaaaaggaaaaaauaaaaaaaaaaaucacuucuaaaucaaugaaauaaaaagccuucaaagguagcaaugcuagaaggcugauauauggcaaacaguuauuauccaaagauaaagcaaucauggcuacaccaggcaaaaacauuaaaacaguuuuguaaauagcauauauucugaccucaguagagguaauuacuaaaaacugaauggcauguaauuaauugaugccucuuuguaagaguaggaguagguaaggaaagauaaauggauaauuaaaaauauauucaagggcauuuauuuaaaugcuauuuuugaauacuuaagugauaaacacuaaaugugauuuuguuauucuaagcugcauucauacuugaagcaauaguauccaugauugcucaauacacucuggcuagaauuagauuagggacaacgaacggcacuguuuuuaagguacaacacauaaaacaugacuauauagaaugaaugccauuuuuucuuggggaauugauuuuuggcagugcuguccaaauaauuuucuuuuaugauggaaauauucuauuuaaucugugccgcccaauacaguacccauuagccaccugugaguauugaccacuuggaauguucccagcauaggccaggugcaauagcucaugccuguaaucccagcacuuuggaaggucaaggcggguggaacaccugauaucaggaauucgagaccacccuggccaacauggcgaaaccccgucucuacuaaaaauacaaaaauuagccagggguguggcaggcaccuguaaucccagcuacuugggaggcugaggcaggaaaauugcuugaaccugggaggaggagguugcagugaacugagaucgcaccacugcacuccagccuaggcgacagagcgagacuccgucucaaaaaaaaaaaaaaaagaaaagaaaagaaaaagaaacaaagaaauguggccaguauaacugaagaacugaauuuuuaccuuuauuucauuuuaauugccaccuacggcuaguggcuaccauaucaggcagcacagauccaugagacccucacuguauccuaaaacuggucuuguugcuccagacucuuccaauucauucuucacacagcuacuauaaccuucauuuauuccuuuccuauguggucuuuuagaaaaaaggagccaggccuggaaaggagaagcugcccaguagagaagaaucagacagcccaaacaaagagaagagcacaggcaaagaagguucagucagauaugcgaguacaaggaggccaggacuagaaagacacgcugguguggcuucagcagaggaaaugaggcuagaaaggaaaguucaguuaguucaggacuuuguaugcuaagugaaggcagagaggauuauguuaccuugaccugcccauuuauucaaagauugucauccucuguucuagaucuuuacaauuuaguguucuaucaccaaaauaacaagucgagaacuuccaaagaaccacuuuguaaagaucuacagaagcagaaagguauguccuauuugagaacaacuggcaaagccugucuaggagaaccaaagacaaaucuuuaauuuuuaagccauuaacccauugaugacagaaaaugcauuuuccuguacucuccugucaccaucaaaacagaaaauuuccauagcacccaucuuuuccaaauaaaaauagaguagaacagucagccgugguggcuuacgccuguaaucccaggcguaaguggguagaucacaaggucaggagguggguagaucacaaggucaggagauggagaccaucguggcuaacacggugaaaccccgucucgacuaaaaauacaaaaaauuagccgggcgugguggcgggcgccuguagucccagcuacucgggaggcugaggcaggagaauggcgcgaacccgggaggcagagcuugcagugagccaagaucgggccacugcacuccagccugggugacagagcgagacuccaucucaaaagaaaaaaaaaaaagaaaaagaaaaaaaguagaacaaacaagaaagggauuaauucacaaaaugucuuuuguuaacuaacaggaaucuucauagcuggugggaaaauguuauucuucgaggucaacuuaguauggagaaauaugauucccaauguagacuacaacuuugcaaacaggucaguaagaaucaacaaaugcuucuuuuuuacuuuuuuuuuuuuaagauggggucuugcuauauugcccaggcuggacucaaacugcuggggucaaggaauccucccaccucagccucccaaguagcugggaauacgggugcaugccaccacaucugucugaugccucauuuuuuuuaugccuuaaaauagaucuuauuccuucugaaaaaaguccuauggauuaaaggguuaaaaaaaaacagaguggcugggcacgguggcucacgccuguaauccagcacuuugggaggccaaggcggguggaucaccugagaucagaaguuugagaccagacuggccaacauggugaaacccugucucuacuaaauauauaaaaauuggccgggcgugauggugggcgccuguaaucccagcuacucgggagggugagacaggagaaucacuugaaccugggaggcagagguugcagugagccgagaucgugccauggcacuccagccugggcgacaaaagcaaaacuccgucuaaaaaaaacaaaaaacaaaaacaaaaacagagaaaagaacaaacagaucuuaguuauagucuaauuagcuuucucugggucaguauuuaaaaacaacccuuuuggaguaaucuaacuuuauaauaaauauagucaugucucuugguaucuauggagaauugguuccaugacccccuucaaauaccaaaacccacagaugcuugucucuuauauaaaacagcauaguauuugaauauaacuuacacacauccucccacauacuuuaaauuaucucuggauuauuuauaauaccuaauauaauauaaaugcuauguacauaguuguuauacuguauuguuuagggaauaaagacaaggaaaaaaucuguacauguucaacacagaugcaacuauccuuguuuucugaauauuuucaauccgcaguuggcuaaaugcagaaguguggaacccacagauacagagagccaacuguacguguuaucccuuccuaacuuuauuccauugccgagagaaacucagacuuguuauuucuauucacugacaaaauuauuucucuuuuauuuucuucuucagagaauagcuuuuaacucuuggggcuagauuccauucaauucaauaaacaagcaguaagugccaacuauguguccacuagguggugggaagagaaugagauaagaaauaaaacaucuuuagauauaaacugaaauaaugguagugaaugaauaagaggccugggggcauuuuuagggggcuuggcagggagcucuguuucuuuugaagagcucuuacuuuguucaguaguuaauuuaaauauccuuuguucaauaugugacuuuaguucaaaauucuaugugagaggccuuuugucuucugcuguuguuauuauuacuccuuucaucacaaucuacucgauuugguuugguaauguagagagauuugguuucuuuccagcaaaaaaaaaaaaagaaagaaaaaaaagguuggcugguucaagucacuaccuagacuaaaaaauauguuaauguagaugucucccuuagcuagacuaaguacaagaaaacagaaagacaaaacaaagcugagaagacuuguguuacuuauuuguacaauguaagucguaacuaaagaacauuacauuaaaaaugugguaggaagauguucuuaauguauuuagacaauagguugugaccaacugauugugaccagacuuaagaauguguacccauuugccuguacuuacuguggcucaaaucaaugucauggcauaacaguuagccugaucaauccauuauacugaacaaccauucugauugcagcugugcccaguaccaggccucagucauacaaggauaauaauaauguaagugacccaucaucagcaaugcuuuugauuguuuuucugggguggugaugaacuugugauccauccaccccucacugauauccuuuguacaucauucacagauggccagccagaguucaguguuuaagaggccacauccagaaaaacuaaaacucucuaaucuacucugauuuccaacuuauucauuuaaucaagcacuuaaugaguacuucccaugugggaggcacugugucugucacugugugauggggauacaaaagugagacucaguccuuguuguucguugacaaaugcuuaaacaaauaaggcaaugcaguguaaugcaugcucuaguagaguuacaaccaaguuucugcucugcguaggugagguacaggaaguuucacagaggaagagaaacucuaggaaggcagaauaagaguucuccagaaguaauggaauucaagguaaaaaggagggcuuucuaguuaauagggcaagauaugggaaagcauggccagcucaggaaacauagcuggaaaaugggguacuggguagagaggagauguggagaggacaggaaauuggaaaagcagaaaggggccacaucauggagggccuuguaugcaaugcaauagacuuauccucuaagcaauggggaauuauuuaauuauucuaaguaaaagacauuguuaggucugcauuucaaacagaaaaauucagcagcaagaauggaucagagcgaagaaaacucggaagacaaguucauuugugaauucauuuauucaaucaacaaauauuacuuacauaacaugcaauguaccaagcauuacagacagugaugaagaaaacacacauggccccagaucucauggagcuuacagucuuagugaaagauaaacuacagauuaacuguagcagaagcagcagcagugugaauggagaugagagggcagguguaaaaaaggcagccacaugacacuccauguggagggugagacagaaaucuaggauggcucccagccccuggcucaagugacugggucaauugguaacauaggaagaaaaccagcucugagagggaaaguaauuagcacugggauauucagagggaguuguccaauaagcaacugaaaagaugguuccucaguucacuuaccgggacuagaaaaauugauucacaaguaacaggcaacucagacguucuaaaagccauggauaaugaaugaaaucacgacccaacaccaccaacagauaaguagcugguggaagaacaagcuggugaaaaaagcuggaaagaaaauaucagagauaggggcagggggaucaauagaacucugucauaaaagccagaagaauuucaggaacagucaauagugucaacugccacagagagguuaauggugucguuaagacagucacagaguugugcaaccaugacaauugauuugugaacauuuucaucacuccagaaagagaccuaguaacuauuagcagucaacaccacccccauuuagcccuaacccuuccucaccaccaccuaaucuuagguaaacacuaaucuacuuucucucuacagauuuacuuauucuaaauaucugauauaaauagaaucacauaagaugugcucuuuagugacuagcuucuuucaucugugcuauguaucaguacuucauuucuuuuuauugccaaaucauauuucauuguaugguuacaucacauuuuguccauucaucaguugaugggcaccugaguuguuuucauuuuugggcuauuaugaauaaugcugcuauaaacauuaguguacaagguuuuguaugaacauguuuucauuucucuugguuauaaaccuagguauucaauugcugggucauaugguaucucuauguuuaaccauuugaggaaaugccagacuauuuuccaaagaggcuaaaccauuuaacauucgcagcagcuacaugagaggguuccaacuucucaauaucccuggcaacacuuguuauuaucuuuuuaauuacagcccuccuacugaagcgguaucucauugugguuuugaccugauggcuaaugaugcugagcaucuuuuuauggguguauugaccauuuauauaucuacuuuugagaaaugucuauucagauaccuugccaauauauauauauauauauauauuuuuuuuuuugagaccgagacuuacuuuguuacccaggccggaguacaguggugcaaucugggcucacugcaaccuccgccucccggguucaagcgauucuccugcuucagccucccaaguagcugggacuacaggcaugagccaccaugccuggcuaauuuuuguauuuuuuugguagagacaggguuucaucauguuggccaggcuggucucaaacuccugaccucagguaaucugccugcuucggccucccaaagugcugggauuauaggcaugagccacugugccuggccccuugccaauauuuugaguuauuuaucuuuugcaaauauuuuucccagucuguggguugucuuucccuuucuugauaguguccuuugcagcacaagcuuuuaauuuugauaaaggccaauuuaagacuaaaauauagcuugucuuuuccuuuuucuuuuuuuuuuuuuuuuuuuuauucugaaacagagucucuguugcccagacuagagugcaguggcaugaucacagcucaccacagccucuaccucuucaggcucaggugauccucccaccucagcccccugaguagcuggaaguacagguguauacaaccacacccggcuuuuuuuuuuuuuuuuuuuuuuuuuuuugagauggaguuuugcucuuguugcccagguuggagugcaauggcgugaucuugguucacugcaaccucugccucccagguucaagugauucuccugccucagccucccaaguagcugggauuacaggcacgcaccaccacgccuggcuaauuuuguauuuuuagcagagacuggguuucuccacguuggucaggcuggucuggaacuccugaccacaggugauccgcccgccucggccucccaaagugcugggauuacaggcaugagccaccgugccgggccacacucggcuaauuuuuaguauuuuuuguagagacaggguuucaccauggugaccaggcugaucucgaacuucugggcucaaguaaucugccugcggggccucccaaagugcugggauugcagcccagcuugucuucuuuuguuguuugugauuuugguugcuugugcuuuuuuccuguuguuuuguuuugucuuuugcuacuugugcuuuugguguaacacuuaagaaggcuucaucuaaccugagaucaugaagauuuacucccauguuuuauucuaagaauuuuauaguuuuagcucuuauaguuaggucugugauccauuuggagucaauuuuuguguaugguauaagaaaaggucgucauuuuuuuuaaacuggagaaaaccaagcauacugauaggcuacaggacaagaggcaggaaauagauuucuucugaagucagaucccugaagagacaggguaagaaucuggagagagauacagagacuaaccuuuaccaggaggaaagccacucuuacccuagacaagggggguggugggggaagcaaguggagauggugaccuaacuguaacugugggguaaugggcuauaucuucuuaggaauuuacaaggcacauuagcauaauugaggaucuaugauaaccuucagucaggaaauguguucaguuuuguuuaauccaucauuuuccaaauucaugugaccaagaauuccuuauuucuuagcaccuauuaauauaugacagaauuaggauuucuaggacauauguaggaaacagugaucuaggccaagagcugcaaauuaguggauuuuguguagaauuuggggcaaggaugguuuuuguuugguccacauaguauuuuuaacccauuugugccagagguugcaauuuuuuugugugaaaaaucagaccuuggcgaugaccuugagcaguaggauauaaauaacucccacaagcuuagcguuccaauaauggaacacuaugcauaaaugaguugaaaaucaagaaauuucacaaagauccaaauuucugacaucucuuaaaucuuagaaggucuggcagcaauuuggaucugcauuccaucaaggaaaaacauuacuggaacccaaaugucccaaacagcgcauuuguaccauguccacacucauaaucuuaaucccaauucauuuuacucauuuaugucaccaccugauuccuguaacugaguuuaucauuucuauacuaagcaacccucucagacggaaaaguuccugaagccauucucagaaacuccuuaugcauaaacuccucucccaacauuuucuuuaauaaaugugcucuucuuguaagagcuaugagaaagauugagaagcauuuaugucaggagugacaaaaaaugccaguguaugggccaagugcaacacacagacuauuuuguuugaccugcacaguauuuuuuaacaugagaaauuucacauuaaaaagaaacagacuucugggacuuucuugacaauuaggaagauuugguaacauuagccccuguuuccaugugacaacaguaaguugaagaugguaguaacuucuucaguuagggccggcauuuuccaguuaaccacaguugccaucacuccccagugcuuauaacuggccugauucacucauugccuauuuggcuccuaaggcaucagaauuuguaccaccugauuaaacaaacaaccuuaauuagcacagugcauuaggcaaacaucucaauaucaugaguguuaagugaaauuuuacugaagccucagcuauuucacuaauaaggaaacaucccacucucucccaaauauauauccacauugaaaaaauaacuggaagcaaacauaccaugggaaguagaauuucaggugauuuuuauuuucuucuuaauccuuuucuauacuuuuuccagaguauuuuuuuuaaaucaacuauguauugccuucauaaucagaaaaaaacacaaauuaaauucuaaaaugcaucaacaauauucuucauaaauaaagucaugagaaaccucuagggccuaaaggucaaaauuuuaaccaauugcccaaaauauuaauuuaaaugugcaucaaugagaacacaaucacauaggcuaggcagcagaugaaccaugucaguggcaaguucugaugucaagcaagcuuaucugaugccacauaguuuccuuagaaccaauguuaagcuuccuuggcagcagcuguuuauucuaacccaauaugagacucagucugucaguuaaggcuacauaaauguuagcagagcaaccuugcucaccagauccccauuuaugaagauaccaugacuaagcuucuaaugugcaaacacuucauccucccccucaacucaagauucuucuggccaggcgcaguggcucacgccuguaaucccagcacuuugggaggcugaggcagggggaucaugaggucagaagaucgagaccauccuggcuaacacagugaaaccccgucucuacuaaaaauacaaaaaauuagccgggcaugauggugggcgccuguagucccagcuacuagggaggcugaggcaggagaauggcaugaacccaggaggcggagcuugcagugagccgagaucacgccacugcacuccagccugggugauagagcgagacuccaucucaaaaaaaaaaaaaauucuucuguauggaggcacgccuguaaucccagcacuuugggaggccgaaguggguggaucacuugaggccaagaguuugagaccaaccuagccaacauggugaaaccccaucucuacucaaaauacaaaaaucggcugggcaugguggcaccuagcuguagucccaacuacuccaggggccucccaaaaugcugggauuacaggcaugagccacugugcccagccuaaaguuuccauuuuaguugcaaacauacauaagcaaaugcuauguaacagaacucaaaggucccacaucucccaccuuuuaguccugacuagugacaggaaaucaagcaauaauuaugggaaaauaaaaugaacaccuuuuacuaauaaucuccucuaguuuuuccaguguucuuaguuauuaaaaagauuacuugccaggcgccauagcucacgccuguaaucccagcacuuugggaggccaaggugaguggaucaccugaggucaggaguucgagaccagccuggccaacgugguaaaaccccgucucuauuaaaaauacaaaaauuaguugggcauggugguggaugcuuguaaucccagcuacuugggaggcugaggcaggagaauugcuugaacccgggaggcagagguugcagugagccaagaucacgccauugcacuccaaccugggugacaagagcgaaacccugucucaaaaaaaaaaaaaaaaaaaagauuacuuaaggcugggagcaguggcucacaccuauaauuccagcauuuugggaagccaaggcuggaagaucacuugaagccaggaguuugagaccagccugggcaacauagcaagacccugucucuacaaaaaauaaaaaaaauaaaaaauuaacuaggugugguggcucuugccuguaguccuagcuacuugggagggugauccaggagaaucacuugagcugagaagaucgaggcuguaguaagcuaugauugcaccacugcacucuggccugggcaacagggggagauccugucuuaaaaaacaaaaacaaacaaaaaaacccucagucuuauucccacuaguuauaauuaaguaaccuuuacauauucauaaauaccgauaaagaggaaaacaucacuggaugaucugaauauaaucucuaguagaugcuucaaguacaaagcaaauucuuuugcaaauuugugacuaagggucugugacuguuuuuuucccucauagccaugacacauggugacuggcacauagcauaugcucagaaauuaaaugccaacugaaguaaaaugaugaagauuuaagaugaaaugaaaauuuaauuuuaucauuuucauaucugugcgcacaugcucuuuagcuccucaauuccuucaaauucuuauacaauucacucaggaaaacauucuuuuuaucuucauucuuucuucaacacauccauaaacuucauuuuuuuuuuuuuuuuuuuuuuuuugagacagucucgcucugucacccaggcuggagcgcaauggcugcaacauccgccccccggguucaagcgauucuccugccucagccuccugaguagcugggacuacaggugcccgccaccacaccuggcuaauuuuuguauuuuuaguagaggcgggguuucaccauguuggccaggcuagucuugaacuccugaccucaaaugauucaccuaccucggccucccaaagugcugggauuacaggcaugacaucuauaaacuuuaauacucuaugacuauaugagggugacuagcugggcucccacaugucauuacaaaaaaaaaaaaauggguaaauauauuuaaaacggaaagcuaaauauugccaacagaaauuaggucaacgcuaccaccuguccuaucucuugcauauguaauuauuuuuuaaaaggaaauaugugugaauaccaugaaaguaucccagagccccaccagaauaaaaacaguccccaucuucucccucacugcccucuaaccgaacgugcuuuucucauuccacagaauuuaaaaugcauccuuauuuuuucuuuucugcuuauagcuagaacugcaaaugcauuuuuuuccuuaauaguuucaguucacaaaugugcagaauuucaguuacauuauagcuuuugcagauaagccugggcauguaaccauguaacauugucuccauggaaaaguaacuccaaacaaccaacuuguaaacgaauuuuugaaaugcaacccauuuucauguuaggaaaaugagguccuacuccucaucuuggaagguaauggaauaguggaaaaagaacuggggcuuuggaaugcagcaaucugaaucucaccucacugugcuguuaccagaucuguguccucuggcaaguuacuuaaucucuuugagccucagucuccuuaucaguaaaauggaaaaaguaacaucucucucagagauaaaugauguaauacauauguaaaucaccuagaauagggccugguagauaacaagggcuaaauaaacauuagucccuuuuuccuucucugccauugcaauauucguuugugauuucaguuuucuccuucaaaaaaaaaauuauuuuucauuuagcacaugcuguaagucaggagcucuuuaugaucucauuaaaucuuuacaacucccccaugcgguggguuccauuuacuaucccaugccacagaugaggaacagagucacagagaaguuugucaauuugccuaauauugaugcagaagcuagaaagaaauuauuuaggcaguuggugaggguaaaagaguucucagcaagguuucccuuuuaauaaaaagcagcccccaaaucauuucuuuucuaacaaagaccacccugaaaaaucgagcugcagacauagaaaagcaugcuaaaacuugcaugggugaaugccagcagcuaugccaauaggaaaaggcuaccugggggccaggcauguucaacauggaggcuccaucuucccuuuucuuuuucaaccauguguacaauaaagaaacaggcaauaugaugcaggccagguagagaaccaucugcauaauaaaacauuagcuucuuugcaugcuauguaaaugacacaccugguccaaccaaucuuuugggcccuauguaaaucagacacugccuccucaagcucauuuauaaaacuccgugcauuucaucauggaacugguaacccauuuuucuccaggaucccucucugggcugagagcucuucucuuucuuuugccuauuaaacuuccacucuuaaccucacucugguguguucacauccuugauuuccagcaaugaaccucggguauuacccaagauaagugacauugcuucaauuaucacucaaauaguaaugaugaucucagcacaccuacacucuaauccuaaaccucccuccucccucccucccucccuuccuuccucccucccucccucucucccucccugccucccuuucucccucccuucuuucuuucccccuccccuccccuucccuuucuuuuuuuugacaggguuuugcucugucacccaggcuggacugcaguggggcaaucucagcucacugcaaccuugaccuuccgagcucaaucaauccucccacuucagccucccgaguagcuggaacuauagacgcacaccaccacacucagcuaauuuuuguauuuucaguagaggugggguuucaucauguugccuaggcuggucucaaacuccuggccucaagcaauccucccaccuccgccucccaaagugugagccaccacacccagccauacugugucuuuuuaaaauaagaagaguggggccaggcaccauggcuacgccuguauucccagcauuuugggaugcugagguggguggaucaccugaggucaggaguuugaaccagccaggccaacauggugaauccccgucucuacugaaaauacaaaaaauuagccaggcaugguggugcacaccuguaaucccagcuaguugggaggcugagacaggagaaucgcuugaacccaggaggcagagguugcagugagcugagaucgugccaugccugggugacagagcaagacuuugucucaaaaaaguaauaaaauaaaauaaaauaaaaugagagugggauucaauuaugucuaauauuuuuggcuguuauauugugugauucuguaacucuacagcacuaucagauggcaagaaggacaagaaaaacuucaaguacacaaugggcacauauaaaccaucaagaugcagucuaaccaacugaugucccauuguccugguucuucccagaagcuggaagguuuccacagccaagaucaguuaggcuuaacuagggcuucagcuccuuaacuguuauuugcuuaggcaugaucagcugagucagccuggccuuaaguaacuuuuaaaauugaaccaguacugaccaacacuguagaccccccauuuuuuaaauuacaggugugaugaaaacuugaaaugguaacacaauggcaaaagucuuuuuuuuuuuuuugagauggagugucacguugcucuuguugccuagagugcaauggugcaaucucagcucacugcaaccucugccucccgaguucaagcaauucuccugccucagucucccgaguaccugguacuacaggcgccugccaccaugcccggcuaauuuuuguauuuuuaguagagacaggguuucaccacguuggccaggcuggucucgaacccccgaccucaggugauccucccaccuuggccucccaaaaugcugggauuacaggcaugagccacugcgcccagccggcaaaaagucuuuaaaugcauuuacuaacguugaccauucugcuugcuaauuggagauuauucagucacuuuuacaauauaguaauugaauuuggcuccaggccauaauaaacauucugacccauuaaauuaaggcuacaagcaaaaucacucuauuccuuugcucaagcuacaaacacauuucucacaggcagccacaggcagaauauuauaaguuuuauaauauucaugugucaaauggcaagaccuccaauuaaaaugcucauagaaaagaguaaccuuuaugauaucuguacuuccaaaguuacaccuuuaggcuuuuuuuucuuaauguuuuuuccuuuucaacuacugcaaacacaauuuagugugacuacauaugagcugggcauggacucaguucugaaguugcugaaaagugaaagaagagaacagcuacagcacuuccagagcaugcuggcugagauguauugauagaaaauaagcuguaaaccagcuccagcaauacuauuuguguuugugccuuuugcagauuguauuucaucacugcucuucauagaacauuaauagauuagacacagccuuuggucuaaaacaagaaaaagacuuuuauagaaauguuaacuucauuuccuuuuguuucacuugcuuaccaauauaaaacaucaauacugcagccuagauauugaacaguugccacggacaaccaaacucauuaguaaauuaggcuauaccaucucagauaacuuauucccaguuaggcaaaaggaauaaucagaauuagucagaauugagagaauuacaguauacuagagaguucauugguuuauccaguuugucacuguuuuaaguacagucauacauugcuuaaugacagggauauauucugagaaaugugcuuuuagacaauuuugucauugugugaacaucauagaguauacuuacacaaaccuagacgguauagccuacuacaugccgaggcuuuauggcauagccacugcuccuaggcuacaaaccuguauagcauguuacuguucugaauacuguaggcaacuguaacacgauuguaaguauugguguaucuaaacauagaaaagguacagugaaaauauauuauuaucuuaugguaccaucaucacauaugcagccuuuuguugaaaccucauuacccacaacugcauuaaagacagugcaggcaaagcacguacacacuaagcuacaauccuuuuaucuucauuccucaauaaauaucaaguucacuucuaaugauucauuaaagaacaacacaagucuauauuugguucauaaaugaaaaccaucugaaacuaagaguuuaggugggagauauauaacagcagagagucccuggagaucuagagacaaugugggccaggcacaguggcucacaucuguaaucccagcacuuugggaggccgaggcagguggaucaccuggggucaggaguuuaagaccagccuggccaacauggcgaaaccccuucucuacuaaaaauacaaaaaaaauuuagccgggugugguggcacgcaccuguaaucccagcuacuagggaggcugaggcaggagaauugcuugaaccuggaaggcggagguugcagugagccgagaucgugucauugcacuccagccugggcaacaagaacgaaacuccgucucaaaaaaaaaaaaagacauuacggacacugaaguuuuauuuacuuauuuauuuauuuauuuauuuauuuauuuauuuaucuuuauucuuauuguauuuuauuuuuucuugagacggagucucgcucugucacccaagcuggaguucaauggcgcaaucuuggcucacugcaacugcugccuccuggguucaagcaauucuccugccuuagccuccggaguagcuguaacuacaggugcgugccaucaugcccggcuaauuuuuguauuuuuaguagagaugggguuucaccauguugaccaggcuggucuugaacuccugaccucaggugauccacccaccucagccucccaaagugcugggauuacaggcaugagccaccgugccuggccugaaguuuuaauuuugaauaacuucuugugucucaaaauauucaucuucuguuuuuuucccaaaauauuuuuaaaugcaaacacuauucuuagcuccuggacaguuaaaaacacaggcuauaguuugcugacuucugcucuccauagagaaauaauacaaucagaaagggguuagggaugugauagcccugaagagcuagaauaaggaauuuaaauuaaucuggaagacuggggacaaggcauagguuucugagcaagaaccuuuugagaucagagcuauacuuaagaaagauuuacuuggcaguaauggaaaggaaggagagauuagaagauaacaaucagccuaauccagacugguugcuuugaggaaaaaaagaagaaaaaagauguaaaaggaaagaucaacggaacauuuguuggaaaaaaaaagaagaggaaugguuuauuuaucuggcaagaauaaguaaaagguucaaucucuagacaagaaggagaaaaaaggagauuuuugcauucucauucucuagugcuaucauuauaguauauaacuucagcagacuaacugaggaauuugccuuuuuacagaagcuuuagaacagcccaaguuggagcuuccaguucagagacagagucuucugguauaugucaguugaaauguggcaaucauguuuugguuuuacagauguaauagguaugguaguuccagagaugguuuauuuauuuauggcccuguuuacuccagagaguucccaaauuaggcaagaguauucauauggcuuacauagauauaucauugccuucggaaguuuuaagucauucuucuaugacucagaauuuuuaucuaucuuuucuuguucugacagggaaaaaaaaaaacugcagugcugaaaaugcaaccaauucaacauugaagucuguaacuacucucauucuacggacucaaauuuggaagcuggguaggggggucagagaaaggagggguggaaacagacacgaacacaauuaguucuaauucaugauaacaaccauagucaaauauuuuaguaacacagcaaagggagagagcuucccuuugcugagcagccugggaagagcuucaugaagagagugacaucugcacugggcccauucuaaugagagaggaagggcaacuccaggcagugggaagaguacaaacaauaacgaaaagauggaggggaaauacggaacuuauuucucuuauuuccaaaguggcacauguucauuguuaggguaaaagcacaaacuauggucagaaaaaguuuuucauuaaaacaauuauuuaaccugaaauccuaccauucaaucccgccaccauuuuaguaugcacucuuccacacauacaucauaaacagauuacccuacuguuuuaucucucgcucucuuuuuuuuuuuuuuuuuuuuugagacaaggucuugcucuguugcccaggccagaaugcaguggggcgaucaugguucacugcagccucaaccuccagggcucaagugacccuucugccucagccuccugaguagcugggacuacaggugugcaccaccaugcccaccuaauuuuuguauuuuuuguagagacaggguuucgccauguugcccaggcugcucucaaacuccugagcucaagugguccacccaccucggucucccaagguguugggauuacaggcaugagccaccaagugauugacccuguuuuuucuuacuagcauagauaucugucccucccagcuuggaauacauaucagagucauuaaaaaacacuggcauuccugaauucaagcccuuuccuuaugcgccauccuuugagcucucacuucaacuagauuguguuuucuugcagcaucucucuagguggauccaugcuaccagcuauuguauuuaguuuuucuuuuuccaagugagaucaaaaagguuaaggcaugacuucuuucauauucagcuucaauaaaaucauugaugagaucuuuuagauuuaauaagaauucuagguuuucugcccugcaucucaaaguaagcucauuugcauaauaaaaauauuugcacuccgacaccaccaauuacuggcucgggacaaguuacucaaaugcuuucagccuuaguuuccuuaccuguaaaauagagauaauaaccacauagugcuccccugaaaauaaauuaguaauuuuuuucuuuuuuuuuuuuugagacggaguuucacucuuguugcccagguuggagugcaaugucgcgaucucggcgcacugcaaccuccaaguccuggguucaagcaauucuccagccucagccuccugaguagcugggauuacaggcgcccgccaccacgcccggcuaauuuuuguauuuuuaguagagaaaggguuucaccauuuuggccaggcuggucucaaacuccugaccucaggugaucugaccaucucaaccuccuaaagugcagggauuagaggcgugagccaucacaccgggccaauuaguuauuuuuaaaacauuuacuuuacugauucauuuucaaaaucgagaacacuaugaauccaaauauaaauuaaguaauaaugagucuaucucuagaauuuaucuuuucuuuuuccucccucucccucuuguacucuacacaugcugcagaugugucuuuucucuaucugcacuccuaccacugccugaaggcagcucuuacuaccucuugcuugaauggauggcucuccaaccccagugucucaccagcgcuccaaucuaucuuccucaauacuaccaggauuauuuuaccaaaauuuuauacaucagcuuaaacaccucuguuucgggaggggaacaucacacacuggggccuguagggggaugggggacaaggggagggagagcauuaggacaaauaccuaaugcaugcggggcuuaaaaccuagaugaugaguugauagguguagcaaaccaccauggcacauguauaccuauguaacaaaccugcauguucugcauguguaucccagaacuuaaaguaaaauaaaguaaaaauaauaauaauacaagauuucucuguuuucuaacauccaaugcuuaguauguuccucuucuagaaauuauccuguaaauguacuugcacauacguaaacugacauauuugugucauucuuugccauguugucugaaacagcaacagaucacaaauaaccuuccauaagggucuaguuuaauaaauuaucuacaaccaucaagggacuauuauuuaacugucaaaagaagagaaaguucuguagauacaagcaagaaauguuccccaaaacaugcaaaggaugaaaaaaaaaucaagaaacaggacaagacaguauaacaggucuucauuuguaugaaaggggacuaguuacugccagauugugcacaaacuaucucuagaagcauauccaagacauuggguuucuuaagugcaucgguuuccuaugaggagggaaacuggguggcuggaguucaagggggaaagggagacuuuucacuguauaccuuuaccuuuuaaauuuugaaccaggugaauccuauaccuauucaaaaacugaaguuaguuuuguuuuuuuuaacugauuuaugucgucugagucccuucacaagggacacaauccaccuuaacagucucauuacuaaagcuuccccauucccuaacugcacauucacacccuuguaucuuuguauucacucugcacagaagguauucccauuuucucuggcuggcaaacuuccucaugcuucaaacacugccucucuaaaguggaaugaacuucccuuccugccuuacugccauauuaugcaaaagggccuuuggccugcuuucauuccauguuugcuccuuggcaucagaggcuaaguucacaguccuagcccaaguccgucagaagcuuacauuccagcugggcacgguggcuuacaccuguaauccuagcacuuugggaggccaaggcagguagaucacaugagcccaggaguucaagaccagccugagcaacaugguaaaaccccauucuauaaaauaaaauaaaauaauacacauauauauauguauuuauauauauauauauauauauauauccuauauauauccucacauuuuaccagauuuuuuuuucuuuuugagacagagucucgcucuguugcccaggcuagagggcaguggcacgaucuccagcucaagcaauccucccaccucagccucccaaguagcugggacuacaggcauacaccaccacgccuaguuaauuuuuauacuuuuuguagagaaggaguuucgucauguugcccaggcuggucucggacuucuacgcucaagcaaucugccugccucagccucccaaagugcugggauuacaggcaugagccaccuuacccagccuucaccagauuuuaaaggugccuugcuauucucgcucugguauuaagcucuuauaguuucuauacuccaagaaaaacaacaagaacaacaagaaaugacaauuuuaaguauaauaaaauuguauguguauaauauauacacauacacacaaaaauuagccagacaugguggcaugcaccuguaguagucccagcuacuugggaggcugaggugggaggauggcuugagccugggagguugagguuguagugagcugagaucauaccacugcacuccagccugggcaacaaaaccagacccugucucaaaaaaaaaaaaagaaagaaagaaagaaaaagcagcagcagcagcuuacacccuucagagacagaguucaggccucuuaagauauuaaacauaugaugaaauagcagcauuauucacaauagccaaaagguggaagcaauccaaauguccaucaauggaugaauggguaaacaaaugugguaugcacauacaauggaauauaauucagccuuaaaaaggaaggaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaggaaggaaauucugacauaugcuacaacuuggaugaaccuugaagacauuauucuaagugaaauaagccaaucacaaaaggacaaauacuauaugauuucacuuauauagagcauaucauauacuauauguuauacaguauauacaaacacuguaugauuccacuuacauagaguagucaaauucacagagacagaaagaauggugguugcugggcuaggaggaaugagaaauagggaguuuaguuggggaaaauaaaaagguucuggagguaugugaugguaaugguugcacaacaaugugaauguacuuaaugccacagaucuauacacuuaaaaaugguuaaaauuguaaagcuaauauuauguacauuuuaccaaaauuaaaaaagagugagagacucuugcagccucaaaacaauaagauuauccucacauuucaccagauuuuuuuuucuuuuugagacagagucucgcucuguugcccaggcuagagggcaguggcacgaucuccagcucaagcaauccucccaccucagccucccaaguagcugggacuacaggcauacaccaccaugccuaguuaauuuuuauacuuuuuguagagaaggaguuuugucauguugcccaggcuggucucggacuucuacacucaagcaaucugccugccucagccucccaaagugcugggauuacaggcaugagccaccuuacccagccuucaccagauuuuaaaagugccuugcuauucucucucugguauuaagcucuuauaguuucuauacuccaaggaaaacaacacgaacaacaagaaaugacaauuuuaaguauaauaaaagaacaagagacuaucaaaacugaagcagauuuugaaaaagauccaaagggaauuauagaagggaaaaagacugucauuuaggcuggaugugguggcucaugccuguaaucccaagacuuugggaggcccaggcaggaggaucccuugagcucaagaguucaagaccagccugggaaacacagggagaccccauuauuuacaaaagcaaauaaauaaaaagaaaaaaggcugagcguaguggcucaugccuauaaucccaacacauugggaagcugaggugggcaggucacuugaggucaggaguucaagaucagccugaccaacaugguaaaacccugucucuacuaaaacuacaaaaauuagccugauguggugguggaugacuguaaucccagauacuugggaggcugaggcaggagaaucgcuugaaccugggaggcggagguugcagugagccaagaucgcaccacugcacucuagccugggcaacagagugagacuuccucucaaaaaaaaaaagaaaaagaaagaaaaaaaggaaaagacugucauuuaaauuaaaaaugcagugaauggauuaaauggcauauuagaaacuacuacacaagaauuagcaaacuggaagaacuaaagaaauuaccaagugggaaauauaaacuuuuuuuuuuuggagacagaguuucccucugucacccaggcuggagugcaguggcacugcaaccuccaccucccgcauuccagcgauucuccugccucagucucccgaguagcugggauuacaggcgcaagccaccacgcccggcuaauuuuucguguuuuuaguagagaugggguuucaccauguuggccagguuggucucaaacuccugaccucaagcgauccacccgccugggccccccaaagugcugggauuacaggcgugagccacagggccuggccaaaaauuguuuuaauauccuuuuauuacucaggagaauaguagaaaugcuaauuaauuuaagacuuugaaauuaaauaugcauagcaaaaaacuucuugaaagacuagaaauacugaguauaaccucuaaacuaguaguuaaggucuccuaaucucacuuuucaacucuauuacuccuauauuugguaggaaucugaaagcgauucuaucccuuuuuucagacaagagaaauuaaguuagucuaguauccggaauagaauguacucauuaaauauuugauaagcugcugggcauggugacacaccuguaaucccagcacucugggaggcugaagugggagaaucgcuugagcccaggaguucaagaccagcuugggcaacauggcagaaaccccaucucuacaaaaaauacaaaaauuagccagguaugguagugcacgcauguagucccaacuacucaggagacuaaugcaagcuugagccugggagguggagguugcagugggcugagaucacaccacugcacuucagccugaacaacagagugagacccugucucaaaacuaaauuggcuguuccagaauaugaugaauuguauuucacaaaugcauaauauuucucaacucuaccuggaaagcugguucuaucuuauuacuucagugaauggccuggguaccucuuugggauuuucguuuugcuuuuuuucuuuuuuuuuuuuuuuaagaaaauaggacacuggccgggcauaguggcucaugccuguaaucccagcaauuugggaggcugaggcggguggacugcuuaaguccaggaguucaagaccagccugggcaacaugggaaaaccccgucucugcuaaaaauacaaaaaaaauuagccaggcauggcuguacaugcuuguaguccuagcuacuggggaggcugaugugggagaaucaccugaacucaggagguugaggcugcagugagccgagauugagccauugcacuccagccugggugacagagugagacccugucuccaaaaaaagaacagaaaagaaagaaaagaaaagagaaaagacaauuaaugcuugaguuaaaacccuaaauccuaaacccuaauucuugcuucaaauuggaaaauauauauauacuuuuucccucacuauugcuucuaacaaaauaaauauaaauuaaaaauuuagaugucuaucuuuaaucaugggaaacuggcaaucaaagguucaagcaccuaaaacugugauauuuuccccacaguugguaaaacuguauauuccacaacauauggaauucuacugaaagcuuucauuggcauuuugccuuguugaauaaaaguuagaagcuaugcuuagacauuuuuuuuuuaaaucaacacugccuuuucauuagacuaacguuuaaaauaugacuuaaaaucaugggaaaauauaguaaugauaaaaucuaacacucauaaagcucuuagcucugugucaggaauaguuauaaacauuuuaaugaacuaauuuaacccacacaacaacaacauuaucagccagguacuaucuuuaccuuuguuuuacauaggaggaucaagagaaauggagauuaaauaacuuccccaauguuaccuaucucgaaggugucaacaaugggauuuuaaaauaaggaguuuaaugcuuaacgauuauacuacuguacugcuucccaaaauuuuuaucaugugcugauuaucauaugcugauuuaucuaguaucuauaucuaaagugugacuuugguauuugcuaacucauacuaccacauuuugccaaagauggcuauucugcucauuugcaaaagaucaaaacuaauagagaauucuacauccauguuuauuuuuuuauucacacuuacauauucuguauaauccugugcugggcugugcaggauuauccccaucugcaccccaggacucugugccuaaauuuuuuucacucagagaacacaaauuagaugguccuuuugcaugcaaugcccuguguuaagcaauuauuuacagcuacuuuccuaauuggcaguuaaauuucaccaagauucaaccacagccugauauauauuucuccaaagaagcuuaaaacaguuuuugaucgcagcagaaaauggccuuccuauuuguuuauugaacaaauacuuuacuccacaaggcaagauccuacuauaugccaagcacuaugauggauacuaaaaauucagagacaaacacagcagagccaauauuugccccugaggcucugguggggagauauguuaaacagugaauaaucacacaaauaauuaauuacaauugugauaagcauaauaaggaaaaaauauagaaaguacaugauagaagggccuaaccuagcuuagagguagucagggaaagugucccugaaaaauggacauuuacuaugaaaacugagaauuaguagaaauuauccaaguaaagaacuacagaagaguacaucaggcagaaggaaggccaacaggaagcacuguacuuuggaggaaacaaaaacccagugaguuugggcagccacaagcagaaagcagcugaggccaaugcucaaaggucucuuccuaacuagguggcccaccaucuccucacuccucucauaccauaccagucucgaucugcugcuggccuacugugugugugucacucuucccccacgucccuaccacuucacaucuucuccaugacuccaaagaagaaaaaccacuguauuuguaguaguuaacacacaacucuuuaagaagaauaauauaaauucugcaacaauuauauugguggagaggaugugaauaaaucuuuuuuauaagauuauugauuucaucuguguuuuaggcaacuugaggccagagaccauaucuuauauaucccaacaccuagcaaugugcauagcuggaguuugacaaguaacuuuacuauuuggggagaauuguagaaugagaaauuuaaguguugcugaucuacauuuuuucuuaugagauuuacuagccuauucauauacccuuaucuauuuuaauugcaagaauaaaaacauguuauccaccugguagauaaaagaugagccaguucuccagggauggagagaggacaaagagaaggcuggaaacacaagaaagcuauauaacaaaggucccucaacucucaacucuaacaacugugccauuucuuucuucacagaaagcuuacucaugggaauaacuuaagcuuauuucaaaagaaggaaugacuuugacuuggaugguggccagcugugguaagaagugcagugaaauucagccacuuuccccuuaaaagucauucaacuggaaauuuuaucagugggaaauucucuaagggccaaagacucuauuuucugcagcuuaacaacauuuguaaaacauuucgaguucuaagauucaccaccucucuccucuauacacacaccccacacuuaugccaauccagugugcuaacuucugauagaagugacauggaauuuuuuggaaucuaaaaguucaaaauauguacccaacacaauauaauaucguuuaugaaucuuuguuucucuuugagacuguauaaauauuugguacauagcaacauuugagggcaggaaaagagaaacaucaugccuuccaguggaggcaagagauaaucagcuauccuuauuaucauaaaauaaccuaaaaugacuagcugguauauuaaauaucagaacauaacacacuuaauugaagaacuaccaugagcaggggacuaugguaaacacagaaccaauaauaugaagaauaaaacccacuccuugcccuucagaaaccaacagucuaaagggagacacccuaggagaguagggaggagagggggaagaaaauucgauaugaaauccaucauccaaggacugaugauccaguauaugaggacauaaaaucuacauuuaccaagggacuugaaagaaggcagugaguuccccauuuccuacgucuaauuauacaaguuccuuuuuaccuaacacucuaucccacucuaccucuuugcauacaugcaaugcacauacuuaauuuaaucaaugguuauuugaucccgugucuuuuuuuuuuuuuuuuuuuuuuuuuugagauagaguuucacucuuguugcccacgcuggagugcaauggcgcagcuaacugcaaccucugccuccuggguucaaacgauucuccugccucagccucccauguaccugggauuacaggcaccugccaccaugcccagccaauuuuuugaauuuuuaguagagaugggguuucgccauguuggccaggcuggucucgaacuccugaccucaggugauccaccugccucagcaccccagagugcugggcuuacaggcaugagccaccaugcccagcccccaugucuuaauaaguauguugggaccagaaguucuuucaggaugaggcucauuaucuugaaguuauuucauuucauauuuucugaagcagcaguuuccugucuacagcacagcuccccagauggcagagaaagucuugggguauuuuaagacaguggguuuccucaccuugcuuugaaaauucauaagcaggaaagugaacuagagauggguuuuguuuuuguuuguuuuuuuuuuuaaacggugaaaaggauaagagcuggugcaucuauauauaguuaaauuuguauuuauacccagagaaacauaaauugguuuggaguaacaagaaaaaaugaugcaaaucaaguucaaguagacagaaaugaaaaaggcugagaaauacugacagaagauugcaaauaaagauagauuuucuaaauuuucaacaauaaaaaugcauuauuuuguaacaagaaaaauuauucuuucagacuauaugaagacacagcaugauaaaaagugauuacuaauaguauacuguucaauaguauuauuuuuuaaugcaauaugaaaacuaaaauacuuugauaaaaauacaaaagaacaaaauucccuacuuacauauucucaacuuccuucccuaauaaaucuuuuuguaacuuguuaagaagaaaaagguaggcuggugcaguggcucacagccuguaaucccaacacuuugggaauccgaggcggauggaucacuugaagucaggaguuugagaccagcuuggccaacaugguaaaacucugucucuacuaaaaauacaaaaaauuagcuggguguguggcgcaugcuuguaaucucggcuacuugggaggcugaagagggaggaucacuugaacccaggaggcagagguugcagugagcugagaucucaccacugcacuccagccugggcaacagagcaagacuccaucucaaaaaaguaaagaaaaauaaaaaaaagaaaaagguggcuggccgcagugguucaugccuguaaucccaacacuuugggaggccgagggggugguucauuugaggucaggaguucaagaccagccuggccaauaggugaaaccccgucucuacuaaaaauacaaaaauuagccagguguggugacgcaugccuguagucccagcuacuugggaggcugaaacaggagaacugcuugaacccgugagguggagguugcagugagucaagaucaugccauagccugggcaacagagugagacucugucucaaaauaauaauaauaauuaauaaauaagguaagacagcuuuccuuuccauaacaauucccaauagaaacagaauuaaagccgggcgcgguggcucaugccuguaaucccagcacuuugggaggcugaggcaggcagaucacgaggucagcagaucgagaccauccuggcuaacauggugaaacuccaucucuacuaaaaauacaaaaaaauuagccgggcgugguggcaggcgccuguagucccagcuacucgggaggcugaggugggagaauggcgugaacccgggaaguggagcuugcagugagccgagauggcgccacugcacuccagccugggcaauagagcgagacuccgucucaaaaaaaaauaaaaauaaaaaacagaauuaaauacuaaaauggcucggggggggggggggaaagcagcagccaccuagacaauuugaaaauuauuucaccugaacuuauguggcccacuauauucaaacauauacugcaagacuucuacagauccaagguacagggaaaagaaagacacaugaaagcuuucaaugggacguccuuccuccaauauaucaaauuucuucucuaucuuucagucuuauuacagacuugaauuuucccccccaaaagcuaacucuuaaggauuuacauuauauagcacugaaaguuguugaagcuuaaaaaugccaaggcagaaguuuguuuuuuauucuaguccuaucuguauggaaagguuuaaggguugaccugccugagagcaacaagaacugacugaauggaccuuccucaucaagaauucugaccaaacagcauauucuagaaagaaacaucuacaaagaaagcagcuaaucucugauauuugcucauuaaagacugcuacuucuuuugauacugcccuaaugcugguuuauuauguaaaaauacaccccgcugucggaaccaugaccuaaagguuuaaugaaaaggcugggcccaaaucagccagaaagcaaaaaagcagcagaucaacuuugugauaucuuugucucuugccauaugguucagggaaauaaagauccuuuaaugaggaauucugacucauaguaugagacuacauuguaaccagcagggcuccaaauaauauaucaacaucuggucuaaaucauuaaauuuuaaaaaggcacucccaagaagagaaugcaaaaucccaacgccacuuucagauagaagguaacauacucucacauuaugaauuuaguaagugaucugcauagcugaaaugacucugaaacagaaaaaccacaacccaaaauagccugaacacuuuuguuaucucaaacaaugggcaguuagccauucauuccucuuaguauauauuucacuuguuucagucaaagcccauuauaaauuccaugagauggcucaaauuugacuauaccagauauuugacagcuggggaugggaaauauucacuguacgauaauuccuaauauuauauguuauaaauaaaaauaaaugcuaugcauauguucacuuaauuuaaaaauuuaggccgggcgcgguggcucaugccuauaaucccagcacuuugggaagcuaagguggguagaucaccucaggucaggacuucgagaccagacuggccaacauggugaauccccaucucuacuaaaaauaccaaaaauuagccguccaugguggugggugccuguaauuccagcuacuugggaggcugaggcaggagaaucacuugaacccaggaggcagagguugcagugagcggagauugugccacugcgcuccagccugggcaacaagaaugaaacuccaucucaaaaaaaaaggaaaaaaaaauuuaggcugagcgcagcggcucaugccuguaaucccaguacuucgggaggccaaggcagguggaucacuugaggucaggaguucgagaccaaccugaccaacaugguaaaacccugucucuacuaaaaauacaaaaauuagcugggugugguggcacgugccuguaaucccagguacucaggaggcugaggcaggagaaucacuugaacccgggaggcagagguugcaguaagccaagauugucccacugcacugcagccugagcaacagagcgaaacuccgucucaaaaaaaaguauauugcauaccuauaacccggagaggcauauugucccugccacugaggaaccuacaacuuagugagaugacaaacacugaacaaguaugaguguaauaacagagcaucuccaugcuaugcugaacuacaggcuguggauaaugaggauauuccuauccuacccauuucaaagggugcagugaaagacugggaaguugucagaaggcucuuaaaguuacaauccuggccaggcacacuggcucacaucuguaaucacagcacuuugggaggccaaggcagguggaucacuugagcccaggaguucaagaacagccugggcaacauggcaaaaccccauuuggauauuuguuuaaauacuacuaaaaauacaaaaauaguugggcaugaugguguaagccuguagucccaacuacucgggaggcugcggugggaggaucaaugcccaguaggucgacgcuacagugagcccagauugugccacugcacuccagccugagcagcagagcaagauccugucucaaaauaaauaaauaaauaaaaauaaaaugacuauauauaaaacauaaacacuucauaacuauauaaaugaugaguaauuaaauaaguacagguuaaauaucccuuaucugaaaugcuucagaucagaaguaucucauauuucagauuuuuuuggauuugggaauuuuugcauauauaucaugagcuauauuggagauaggaccaaagguuaaacacaaaauucauuuauguuucauauacacauagcaugaagguaauuuuacauaauaguuguaauaauuugugcaugaaacaaaguuuugacuucuaccuaucaugaggucagauguggaauuuuccacaaguggcaucacgucaauacucaaaaagucagauuuuggagcauuucagauuucagauuuucagauuagagauacucaaccuguguaugaaauaaccaggcuaguuuguuuuuaaacaaauaucuaagaaauaguaaaauucaaaugaguccuauaaaaguaguuuguccuacuguuguccuuacuccaggacuguaacaggaggacccaaucuaagcuacuguugcugauaccagaggacuuuugcccucuuacuuuguccauuuagaguuauaccagcucuauuuauaaaacagcuuuagaaaagcccaauuuuccacuguguggauguaaacaaacauuuaaguugugguuccauuaaaauuuaaacauagcuauagcccugcauauccuugaguuccacaucuauggauucaaccaacuggagaucaaaaauauacaaauacaaauaaaaauaggccgggcacaguggcucacaccuguaaucccagcacuuugggaggccgaggcgagcggaucaccugaggucaggaguucaagagcagccuggcuaacaaggugaaacgcugucucuacuaaaaauacaaaaauuagccaggcauuauggugggugccuguaaucccaacuacucaggaggcugaggugggagaaucucuugaaucugggaggcagagguugcagugagcugagaucgugcaauugcacuccagccugggugaaacagcgagacucugucucaaaaaaauaaauaaauaaaaauaaaaauaaaaaacaauacaacaauaaaaauaaaaauuaaaaaaacaguauaacuauuuauaacauuuacaucauauuagguauuacaguauaaguaaucuagagaugacaaaguauacaggaggaugugcauagguuauaugcaaauaccaugccacuuuauguaaguaacuugaguaucugcagauuuugguauccgagggggguuccugcaaccaaucccccauggauaccgacggauaacugcccaucuccaaaaaucuucuguucucucagucacaugaguaaauguuaaaaaugauuggaacaaaauauaucucugucucuggcugggugcaauggcucacaccuguaaucccagcacuuugggaggccaaggcggguggaucacaugaggucaggaguuugagaccagccuggccaacauggugaaaccccaucucuacuaaaaauacaaaaaauuagccaggcgugguggcacacgacuguaaucccagcuacucaggaggcugagacaggaaaaucgcuugaaccugggaggcagagguugcagugagccaagaucgcaccacugcacuccagccugggcaacagggcgagacugcaucucaaaaaagaaaaaaaagaaaaauacauauaucuaucuauagauauagauaucugucucguucuuacaucucuuuugauguagcaacagcuuuacaaaugaaacuucaugauuccccaaguaaucuacaaaguuauuuuacauacgauuucauucuaacaggcuucaagcuaagcaggcacauauaccacaaaaacucuucaucuguuuugcaggcauacuuuugugcugaucuguaucuacucuaauuucucaaaaaagaaaugcuguggaucaggcgugguggcucaugucugugaccgcagcacuuugggaggccgaggaggguggauggccugaggucaggaaaucaagaccacccuggccaacauggugaaaccuaguguccacuaaaaauacaaaaauuagccaggcaugguggugcaugccuguaaucccagcuacucgggaggcugaggcaggagaaucgcuugaacccaggaggcggagguugcggugagcugagaucgcaccacugcacuccagccugggcaagagagugagacuccgucucaaaaaaaaaaaaagaaaagaaaagaaaugcuaugaaauuggguguggcuaugaaacaagcuuaccuucacaucauucuucucauauaggccauucaugcaggcuaugcuaaagccaggcucuaaacagauacuguugccagacccaggacaaauggaaccucuaugacuaacagcauuccuguugcuucugauucuaggugggaaaccuccacugauauuuaacaacuuugcucuaaguagauguggaaugguggugugaaaaaaagcagaggaucuggaacaacagaccacaguucaaguccagguuaaccagcugugccacugugggcagguuacuuaauuuaucugaacuacaguauccucccucaucuguaaaacggagaccaccacuauaccuacccauagacugcuaugagauuauaaauauaaaaguauuuuaugagcuauaaaugaucacauaaauauucuuuuuauuuacucuauuuuuuccuuagcauaggaauuauauauuaauuuucaaaaauuggaaaauacagaaauauauuaagaagaaaaaaaucacccacccaaacacuguuauuuacuuaacugaaauaaagucuaauaucaaccaaauuuuaaagcaaaaauauuuucagauguuaauacugauaauuacaaaugacaaaauuaacugcugaucuccuuuuaagaucagaguaggcuggacacaguggaucaugccuauaaucccagcacuuugggaggcugaggcagcaguauuguuugaggccaggaguucaagaccagccuuggaaauauagugaaacccuaucucuauaaaaaaaauuuuaaauuagccaggcauggaggugcaccccuguagucccagcuacuaaggaggcugaggugggaggaucuguugggcccaggaguucgaggcugcagugagcuaugaucacaccacugcacuccagccugggcgacagagcgacuccaucucuaaacaacaacaaaacaagagcagagcagucuuucccauuuaucaguguaaagugaagauaauacugcuauuugucccagagcuggucccaagaacauaugauauacaagugaggcccauaaaagucaaggccacaaaaaacucccaaaauaaauauuucaugagcccaaggaguacuuacaacacaugcucucagaugcacuggagaaagcaaaguaucugaagccccauuaacaaaacuggcaugacuauaaugucacaucacagacugacacauuucuaugggccauuuuaaugaaaaaaagaaaaauuuauauaccaugcuacaaaguacucagucuaagacuugugacuuuuucacacugccugcugaauccaagccuucuuagaauuucuugugcccuucuccuauuuuuccuuucccacccuucccuugacuaccuccucuuccuuguuucauuauugaauuggacucacucucuguguuuaaaacugccuuaaauagaguuuuaagugguacaugccuguaaucccugcuaccugggaggcugaggcaggagaaucacuugaacccgggaggcagaaguugcagugagcugaggucacgccacugcacuccagcuuggacuacacagugagacucuaucucaagauaaauaaauaaauaaauacucccacccuacccccucccuaauuguggaguaaaagugaugacccaguugcaaauuuuauauauauauuuauauauauauaucagugaccagacuacuuugcuuagcaaauauacaugaaauuacaaauccuaaugaguucugcccccauaaaaguaaguaaugucuuucuuuuuuuuuuuuuuuuugagacagagucuuccuuugucaccaggcuggaaugcaguggcaagaucucagcucagugcaaccuccaccucccggauucaagcgauucucccgccucagccucccgaguagcugggacuacaggcgcgugccaccaugcccaguuaauuuuuguauuuuuaguagagacgggguuucacccuguuggccaggauggucuccaucucuugaccucgugaucagcccgccucggccucccaaagugcugggauuacaggcaugagccaccauacuuggccaaguaauaccuuucuuaccacaucucuaaauauucaaauccuaucugucuuuaagacccaacucaauguuauauccucugugaagccuucccugauucuccaaucaaaaguaaucucgucuuccucugacuuuccaucauacucuguuuccucagugccacuuaagauuuccaauucagccgggcgugguggcucacgccuguaaucccagcacuuugggaggccgaggcgggcggauaaccugaggucaggaguucaagaccagccuaaccaacauggagaaaccccgucucuacuaaaaauccaaaauuagccgggcgugguggcacaugccuguaaucccagcuacuagggaggcugaggcaggagaaucacuugaaccugggagacagagguugcggugagccaagaucaugccacugcacuccaaccugggcaauaagagcguaacuccaucucagaaaaaaaagacuuccaauucaguaucauacugauugugacaggcaucacacuuauugcuuugacauuggaaggggucucaauaaacaccugcuugauaagugaaugacuauuacaacaauugaaaauuucaucuucaucuaguaaauuuuaauuauggaaauauccaaaagucauuuaggcucaagaacaguaaaugaaguaguugagcucaagaaugccuacuucagucaaaauguacacuuucuugaccaaaauaagacuaauuuggcauacguauguaaauaaucugaaagaaauucccaaagaaaagcacuagaauaaggauauaaccucccaaaguaacucccaagaaauacucacccagauuacauaaauuccagaagauuuguucuaaaaucaguuucauuauuuuaccguaauacuauguuucuuuucuagcaaauucagaguucaauuauccaguucuauuauuucuucuucuaauauauuucugauuaauuccuucuccauuuucccugccacucgcaaguccaggccuucauuuucuucauaaccaaccaauuuuaaaagcuucccaauuugucucccuucccauaguuccuucaacaauauuuauugagugauccuaugugccaauuuugagggcaggaacugaggaccauauaaagaaauaucagaccaggcacaguagcucacaacuguaauccagcacuuugagaggccaaggcgggaggauugcuugagcccagggauucgagaccagccugggcaacauaacaagacccugucucuauuuaaaaccaaaauaaaauuuuuuaaaaagagaggaauaucagacaaggcuugaccuccaggaacaaucuugaagcauguacagaauccacauauuuaacggucacaguuggcaccaagaaugugaagcaauggguagguccucuggccuccccaaaacacacuauacuauucucacacgccauucucacgcagucuuucucacacacuauucucauccuccuuccccuccugcucucuuuguucauccuuuuggauaaggccuauguuacacugcccauaugucacgcacuaacuucaucuccaauuucucuccaacuugucuccugagcugcaaucaagauaaucuacuugcuguaaccuggaagugacuuacucacaaguaccuuuguucaugauuaacuauuuaucagcacaauccucccuacuuugucucugcuaacccauagcuaccaccaaucucaaguccccucuuuuguauguguuggaaaguauauaacuuaacuacauaucauuguuuucaucuuauaaccuuauuucuuuuguauuugucucacaguguguauuacaguguuuccuaacuaaggccguauaucacaaucaccuauggagcuuccuaaaaaauacgaaggccuggccgggcacaguggcacaugccuguaaucucagcacuuugggaggccgaggcgggcaaaucacaaggucaagagauggagaucauccuggccaacauggugaaaccccgccucuacuaaaaauacaaaaauuagcuggccacgguggugcgaaccuguagucccagcuacucgggaggcuaaggcaggagaaucacuugaaccugggaggaggacguugcagugggcccagaucgugucacugcacuccagccucgugacagaggaagacuccaucucaaaaacaaacaaacaaacaaacaaacaaaggccuucagcuacuugggaggcugaggugggaggauuuuucucaguccaggagauggaggcugcagugagcuaugaucacgccauugcacuccagcgccugcgugacagagcgagacccugucucaaaaaaaaaaaaaaaaaaaagcaaaauacaaaggccuugacccgugggagcuggacaucuuaauuucuaaaaagccucacugaugauuuucaugaacacucuuaagcugagaagcacugauuuauugcaguguuuuccauauagcagacauucaaugcuuauuaauucauggcauggaagcccauaaauaacuuuucucuaaauagccuaaccagauaucaaccccuagacuacacuagcucuguuccaagugcaacaugugguuuuaagauuucauuuccugaaguacuacauggagagacacuauuaccuugucucuuuacauuguuuccuauuuguugaaaaauggaggccuggaaugcagccauguuagacaacacuacauaagaauguacucuggaguguucuguucaaauuaguuauaaaaagaagaacaauguacaaguagacauugugaaugaauacagcauucuuacugaaugaauagauucuuacuaaagcuauagagaagaaagaucaggaauuuggucgguggugucacccugucuuccuagcuaccagucuccuaaauugcuugagacaguccagggaccccugaagacugaggaagacuuucagcugcuaaagagccucuaagugcacuaaagugcucaaaucagaaaaguaacccaagccccacccagacagacccacaguugccgcccaacugcccugacacacacuauuuacacagcucagugggggagcaguaugaacuuuuuccaaaauuguuccucacaagcaggaccagucugagucacccacccagggugggaaagaaaagugugacauuagccaggggagucuugggagacuggucucagcaccucuuuuuucccauuucagacgugggcuccaccuccuccaggaaucaccucgguuaugagucacagcuguggguuacaggggucugcagagccaccaggaaaguuguggauggggagcggaugccccagccuucucuccggcaggggcggcagaucccagauuccacaggccucucccaacagcuccaucuugcuuccugccaggaggaggggccaaggagggcccccgagucuagaaaggccccagugggaggaggccguuugacagcagguaacgccaggugaaaauguccacaggagggaaugaaaggaagggcagcagggcugagcggaaggaaaaaccgggcuuguggucacgaaugacugcauaaaggugugagagugccagaggagugagcauaaguaaaaugcccaggagggaggaggaggcgacagagagugaggcaagugaauaaaagggcggaauacagggagcucuggggagcgggggugggcgaggcgggucucagggugaggggcagaaguauuagaaaggaggacaacguggcucaaauaaggaucccuagaagagaaggcaagggauccgugggaaggcccgcucucccucccccgcacagccagaucgaggaggccuaaaaggcgcugagagcgaggaagucaacgugggggcgaagccugcgcggggcagggacccucggacaucccagcaacucucauuuauugggugucugcugugggccacacgccgcgcgaggcacuccacgaauaauaccucgccauaucuucacgacaagcccgcaaggcagccuuuuucaugacugcucccauuuuauagaugaggacacugaggcccggagaggcucaggacucgcucaaggucacagggcggagaagaggccauucgaacccucggcgccuggcuccggaacccacgcggaaagccacggccagcgagccggccacaggcagccgcgacgcgggccggggccccggggauaccucccgcgcccgcucccgcgccaggcccugcgcgcucacccggacgagguugcugacggccgccugcacggcggccacgggcgcggugaggucaggaauggcuuugccguccaccucgcccuccucgugcauuaucaccaggugggagaucugcugugccaccggcuccaggaugcucucgaucgugcgcguaugaaacacuggcaucgcggcggcgagcggggcggcgaaccgcgggcgacagagaaguaggauccacggggccgggaaccggcgaagagacagacugugcagcgacuac

SEQ ID NO: 192472 - RNA, 70489 nt, Homo sapiens
cggcgaggcggggagggccccggacuccgacggcggcucggacgccgacucggagguggguccggggagcccgacucggaccgcggaggugagcgggagcugaggcugaggagaggggagcuuggggggcgccugcugccaagggugaguggggagucugggauggagccgggggcugccgagggaccgcgaccuggaggggccccggggagacgguugagggaaccgggauagucagcucuggaauggaaucugaagcaaauggagguugucgaacugagggccugaaggcugagggauaaguggaggccgaggaacgagagggagagagcgagagggggaggcuugaagagcccagagcuugggggcuuuugaaagcugcgcagugggggaaaaagaucgaagguccugcgggaauguggacccggaagaagagaugcucuggguuuggcagcggggaugaggagucagaggagcaagaccugggccgguguucccuucccagggcgagggagggcgaucggggcugggacuggagcccucucaugggguucuccucuuacggagcccucuuauccgccucccaccccggguggggcugguggugauggagggcaggauuuagguuugacuagaaggaggagggcuguuggaugggaaaucgucuggccucaaggggugagggaggcacugaaaaagagaaguguggucaagaaagaaaaggagcccuuggggaucuaauuuugggcuuuggcauuuuuacaggugccuuuuaaaacaucaaagaucacuagggcaauguacuuggaucguggggcuuucucguucgugcacaguggaucauuuuaagaaucuuggguggaaggggcggugugaaucacugauuugccuaaaggacugggggaaguaguggagaggaagugauguuugaagaagguaguggaagacgugauucugaaaaugaagauaucauuuggauuuauugacaguaaugguguccuuuuuuucauuguaauuuuuucguagcuaaguuuaaauaccagacauguuaagauccuaaaaauuuacuauauuaccuuuaaguuuuaaaaacuugaaacaagacuuuggauacucagauuuuaaaaauuaaacuugaaacaagaauuuggacacuuggauuuuacagauacucaacauggacugguuccacuuucaaaguuuuaaguugacacauguauuugccacauaguaaauguauggucaaugcaaguuucugggugaagggggcacagugaacuugccacagucuaggcgcaauaccaaaucuuccucucacugauaaccccaggauuggacuuaucucuugaaaauuggagagguaccuuugacugauuggcaaaaccaauauugaaauacuauuuugcagguauugugugaauaguauuuuuaguagagugauuuggaaaaauaaggacagaggaugcuuguaguuggcagccaacacaacugggacagguggguauacagaugcuuuuuauagaagacauaguuccaaaacauaauuaugccagaaaaagaaugauugcaauauuuauauucacuuuaguagagauaaauugacuuccuuuugugauuguuaagucauaacaugguuccaugaagucuuugacuuuagccacaugucucauauguuuuacaacuuuuuaugugauuauagguuuguaaaguuguuggccauuucuuuucucuuccuucuuuucuuuucuuuccuuucuuuuuuuuuuuugagacagagauucgcuguguugcccaggcuuaagugauccucccaccucagccucccaaguagcugggaguagcugggacugcaggugggcgccaccauggcuggcuaauuuuuguuagcaucaagcguuuucuaaaugcuugauuaaaucuaaauggauaucuacuguuuaaucuucaugagaugauaauuugauuugcaacagcuuuuaaauuaguuuauguguaugggcuaugugacauacccucagaugcacaguggaauaguaauuguuucuucaaaggauaugugaauucuuagcuaaaaaugcugagauuguuaaaguauuaauucccuuuucuuuaacuuaauacaaauuaucuucaguugaaguuuauguaauauuacuguuuguugguuuuaucuuuagagugagauccucuggagaccuuaucuucauacuuaguugugaauaaaagucauggcauguaaaaauuugcugaacugcaauauaagaacucuauuaagauuacagcuuaauguuauugcaaaauuaaagagaaacuguuagauggaguuguacaauuaacauauuagcaugucuaauaguuuuuuaauuuuuguuucccuuugucaguucucacacccauugaauaaagaaaaucaguuuuuggcuaggugugguggcuuacuccuguaaucccaccacuuuaggaggccgaagcaggcagaucacuugaggucaggaguucaagaccagcuuggccaacauggcaaaaccccaucucuacuaauacuauaaaaagaauuaaucaggugugguggcucacaccuguaaucccagcuacucaggaggcugaggcaggagaaucucuugaacccgggaagcagagguugugagcugagaucacaccacugcacuccagccugggcaacagagugauaugucucaaaaaaaaaaaaaaaaucgguuucucuaaggcagaagaagccaucaugacugcgauggcagaauaugcagacauauuuagguaaaucaguuuugauuucaguaccauaaccccccuucugcaaaagcuuauucacauugcacaguugcuuauaaacauuuuuuuauuuuguuaaucauuagauccucaauacuucuucaaaacuuugcuguuacugauuaagacauuuucauggcuuuucuaagaauugaaauuugaacacuuuuuuugagaaacuuaaaucacagauguuuccaugaauaguauuauuauuguuuuauaagaaugccauguuaacaagcuauucuuucaagauuuuuacuuccaggccugauguaauauaugguguuaauuguuggguguaccuagcaugcccguuaauuuauggauggaaaucuuuccugucuucagauucuacccccuucauuuuucauaugccaguggauuguuaaugaacuaagauugaauucacuuuuuaauuuuaaagcuucuguagcuuugauucucuuuggacaucaaacugauuuauacgagauaugaauacaauugcauauucugcuaaauuaccuaugaagcucuuuugaaugauugugguauuuggugaaaaaauacaguaugagcuaaucaaaauucuuuuaagggauuuagguuauagaggaggacuauacuauuucauucccagauuagauuaaauguuuuacuuauuugcagagaugacaggggagagccuugauuauuuucacgucucauguauuuauauuuguuuacaaauaaagaguuacuuauuugcaaaaugccguaucuuuaauacuugcuuacaugugauuuugggaauucuuuuggaaccaguuuuuguucuuguuuuuguuuugcucuaaggguaugauguaacacauugagggguuaauaguagggcaagaacagagaaagccauuugacaacagauaucaucaggacagugaugcuuacuuuaggucuugugguuuucuuggccuugagaaaucaagauguuaacuaaaaauaggagagcaugggccaggcacacugggaaaacagauugguguuuacaugcuaccgcuguugcuuccugguaauuugccauaugaauguguggguauggauuuguaacagaccugugaugugaauauuccugaacccccuccucccauacacacaguaccaucaucacagaucugaagccuaaccuuuagcugaguucagugacuucauguuuccguauugaaauguucuguuauuggguccucacaauacuauagaauguaacauacugcgggcacgguggcucacgccuguaaucucagcacuuugggaggccgaggcgggcggaucacgaggccaggagaucgagaccauccuggcgaacacggugaaaccccgucucuacuaaaaauacaaaaaaauuagccgggccucguggcaggcgccuguagucccagcuacucaggaggcugaggcaggagaauggcaugaacccgagaggcggagcuugcagugagcggagaucacaccacugcacuccagccugggcaacagagcgagacuccgucucaaaaaaaaaaaaaaaaaaagacuauuaacuaagaaaaacuugguuauaauaguuucaccacaguguuucaccauaaaacaauguuuuaugauauguaccucagaaaagaguguuguggggcagggcagugaauuauauuuauauuugucuaaguauuuuuugguaguuuuuuuuuuuuaaagauagggucucacugucucccaggcuggaauacaguggcgcgaucauggcuuaugcagccuugaacuccugggcucaagcaguccuccugccucagcuuucugaguagcugggacuauaggcgugugccaccacaccuggcuaauuuuuuuaaauuuuucuuuuguagagaugggguaucagcuauguugaccaggcugguuuagagcuccuggccucgagcaguccucccaccucagccucccaaagugcuaggauuacaggugugagugucuuaaauuuuugaagugcauuuaguuaagcuuaugaguuguggcagaggacaagagguaguaacaugaguaucuguuaucuugauacuuguucuguugucuugaaauuuuugacagauaaauucuaguuggaggugagaaccauggauucugcuaauuuagggccuuccuauagguuaacuggugucacugaguuuuuggaaauacuugcaaaucuguuuuaguuuggaacuuugagauuaaauggaauugaugucaguuccaucaauauaauauuagcaugaaagccagagauuuccaaaaccauacauuaaaauuuggcugcaaauccaauccauuuucacaauauuuaauggaguuugaagucuugagccaguuucucauuuuccauuauauugauuagauuuuggauguagcauauuuauuuauuuauuuagagacagagucucacuucguugccgaagccuggugcaguggcgugaugucaguucauagcaaccuucgccucccggguucaagcaauucucccaccucagccuccccaguagcugggauuacaggcgcgugccaccaugcucggcuaauuuuuuguguuuuuaguagagacgaggucucacuauguugcucaggcugguuuugaacuccucggcucaaggcauccaccccccuuggccucccaaaguuggguuuacaggcgugaaccaccgcagccugccaguguagcauauuuaaaaauaaagauuuuaccagcuggguggggugacucaugcauguaaucccagcacuuugggaagcugagguggguggaucccuugagcccaggaguuugagaccagccugagcaacauagugagaccucgucucuacuaaaaauacaaaaauuagccgggugugguggugugcaccuauagucccagaacucaggaggcugaggugggaggaucaccugagcccaggaggucaaagcugcaguaagcugugauugcgccacugcacuccagccuggguaaagagugaggcccuaucuuaaaaaaaaaaaagggugggcgugauggcucacaccuguaauccuagcacuuugggaggccaagguggguggcuuacuugaggucaggaguucaagaccacccuggccaacauggugaaaccuuuucucugcuaaaaguacaaaaaaauuagcugggcgugguggcacguaccuguaaucccagcugcuugggaggcugaggcaggagaauugcuugaucccaggaggcagagguugcagugagccgagauugcgccauuauacuccagccugggcuacaagagugaaaugcuuucucaaacaaacaaacaaacaaaaaagauuuuaccaaauugauauguuaaacugcuagccugguuagaauaaaaauuagaauuuuagauacuuagcuucuuuacugguuugcuguggcauugcagccaggucaggaacccuuuaccaaauuuaucaccaaaguccuaucaucguggaaaaauuuuugguauaacugagaauauaaaauggacgguaauaucugucagauucuuacucauugaggggagacaguucuggauuugguguagauaacuuggugcagccugauaguagaaguuaguuuaaaggcuauuuggaaccagaaaaagauguuauuugguauauaugacaacuuuuuuugagugaaauuauaagaguucacgguuagagcagcaaaaaaguccaagaacugaagugcagccaagagaaugaugauguaacugaggagggaauuuaauucuuuuaaagaugcugcccuaaauucuacugcucagaagugggacauaacaaaacagaaaaucaccacuaaagaguuucaaaauggaugguaggaguuagugcaaggucuuugaaacuguuuuguaauuauugcagauuuuaucgauguuuuggaaacaauacccugugcuugcuaagaaaaugcaaaauaggcugggcacaguggcuugcgccuguaaucccagcacuuugggagggugaggcaggcagaucacuugagaucagaguucgagaccagccuggccagcauggugaaaugcugucucuacuaaaaauauaaaaauuagccaggugugguggugugccccuauagucccagcuacuugggaggcagaggcaggagaauuguuugaaccugggaggcagaggcugcagugggcugagaucacgccgcugcauuccagccugggcgacagagcaagacuccgucucaaaaaagaaaaagaaaaauaucuuucuauaaguauaaagagaaaagaguaguuuuuguuugcugaaugaaaauguuuucauuuaugguaaaaauuuuaaaauaguauggaaaaaaguuggauaaucccaaauacuauaaacuacagaguuauuaaucacaaaguuuagccauauaugcccaaauuaaaccuuauccuccuacaucauaguuuaggcuuuuugcuuucauaagaauuguuuuuauguucugguuuauggaucugcaaacauguagucuuuauuauguggauauuagauaagcuaaauguauuugauuuagcuguauuucagcuucagugcaucuauaauauauaauugcccuaagaaaaauuuauuaacucuagcuuuauauaauguuugaagucucuuccucaguguuuaucuugggauauggaucuuaauuuuuuuacguuuuauacaucauuuggaagcuguuuaacuuuuaaauuuuguaaacuaaaucaguaaugauuuguuuuuuuuuuuuaauuugagacggaguuucgcucuuguuacugaggcuggagugcaguggugcgaucucagcucgcugcaaccuccgccuccuggguucaagcaauucugccucagccuacugaguagcugggauuacaggggugcaccaccaugccuagcuaauuuuuuuguauuuuuaguagagacgggguuucuccauguuggucaggcuggucucgaacuccugaccucaggugaccugcccgccuuggcuucccaaagugcugggauuacaggcgugaaucaauaauaauuuauacaaauagcacauauuguauuuaugagucaaguuuuaucaguugugaauuccuuuaggggcauuugaauguagggcuuuuaaauacaaucacagaauuuagaauagaggacaguugcuucagcugguuguacuccaauauuuuugaugauuuucugcacacacaugcacacacacgugcgcacacgugagaagugaaacuacaagaaaaauccagcauguuuaagucacuguaaucaccaucugaacauggauuuugcuucuguaaaaguaagcauauuguaaagguuucauuuuguugauauauucucuguauuuuaaauauuguuagcugggcacggugacucacuccuguaaucucagcaccuugggaggccgaggcaggcggauugccugaggucaggaguucaagaccagccuggccaacauggugaaaccucgucucuacuaaaaauacaaaaaaauuagcugggcgugguggcgcgcaucuguaaucccagcuacucgggaagccgaggcaagggaaucgguuuaaccugggagguggagguugcagugagccgagauuguaccacugcacuccagccugggcgacagagugagacacugucucaaaaaaaguaaagauuguccagugauggauuagaggcuauuuuggucucuuguguguugguauaauuaagcccaguggaauagcugugucuuucuaguuuuuagugccuaucacuuuaggaaguuucccaauucccaaacuguacagaagugcuuucagguaucaacaguaaucaguuacaucacugacauacuuuuuauuuuauuuuauuuauuuauuuuugaaauggagucucgcucuauugcccaggcuggagugcaguggcacgaucucggcucaccgcaagcuccgccucccagguucaugccauucuccugccucagccucccguagcugggauuacaggcgccugccaccaugcccagcuaauuuuuuguauuuuuaguagagaugggguuucaccguguuagccaggauggucucuaucuccugaccucgugauccgcccgccucagccucccaaagugcugggauuacaggcgugagccaccgcgcccggccagcgucauacuuuuuaaaauguuggugagugguaugcuccuguggaaauauuuauuaauaguuaaauuuuauguuaagucguuauaugagcagugcauauugauguguagagcaaugcauugaguaacuagaaccucuauuuuauauuauuguuucucaguuuauguagcuuaauuacguuguuauguugaaaaguaauuuccaucuuuuuuuuuuuuuuuuuuuuuuuugagacgaaaucucacucuguugccugggcuggagugcaguggugcaaucucagcucacugcagccuccgccucccagguucaagcgauucucuugccucugccucccgaguagcugggacuacugucgugcaccaccacaccuggcuaauuuuuguauuuuuaguagaggugggguuuuauguugaccaggcuugucuugaagucuuaaccucagugauauacccacuucggccucccaaagugcugggauuauaggcgggagccaccacacccggacuuuugagcaguuucuguuugcuaagcauuauuauaagugcauuauuguaagugcauuacauguauaauuccaugcaaucuucacaacaagccuaugaaguaggaauucuccucauuuuacagauaaagacagugaggcccaagaaaguuauguaacuucugcagggucacauaacugugagugguaaauccucaguuugaaccuaggcaguuuaauucuagagccaguacucuuuacuuucugggcuguauaucagauguuguuggcaaauagcuuauuuaucugaagcuuaacucucuagccuuaguuucuucagcuguaaauugaggaauuguacuagaucucucaggucacuuccauuucuaaccuaagaacucugucauccugauuuacaaaacacaacacguuuaauguuucaaauuacuuucuguuuguaaucucuggaucccuuaugagauaaagguuaagcuguuuccaacaucacacuguuaaugggucauggaacuggaucagaucuuuucugggacuuccugguuuugcugguugccucaugcauauacuuaguguguauaugcauauauggguuaauaauugaauuuaauugaccuucuuaauuuuuuuuucuucuuuuuuuugacugagucucacuuugucgcccaggcuggagugcaguggugcgaucuuggcucacugcaaccucugccucccagguucaagcgauucuccugccucagccucccaaguagcuaggauuacaggcauccaccacuaugcccagcuaauuuuuguauuuuuaauagagacagcauuucaccauguuggccaggcuggucuugaacuccugaccucaagugauccacccucuuuggccucccaaagugcugggauuacaggaguaagccaccaugcccagcgacuuucuuaauuuucuauuuauaucuguuuaaaugagauuugcuucaaacagugaaaaauaauacugcuuucauuuucuuucuuuuuucaaaaucauaucacaucauuuucuuaaaaaaaccuuuucucucugauuauaaguauuacauucuuauuguauggaauauagaaauuuuagaaauuuuuaauguagacagugaaagggcccauucaaggaguaaauauuacuaguuugauauuuauuuauuuaaaaauauacacauauaccauauuugcuauuuuuugggacauugugcuucuuuuaaaauuuucucaguuuuuauuuugaaauaauuauaggcugggcgcaguggcucacgccuguaaucucagcacuuugggaggccgaggcaggcagaucaccugaggucaggcauucgagaccagcuuggccaacauggcaaaacccugucuccagaaaaaaaauagaaaaauuagcugagcguggugggggcaccaguaaucccagcuacuugggaggcugaggcaugagaaucacuugaacccuggaggcagagguugcagugagcugagauuaugccacugcauuccagacugaaugauagacggagacucugucucaaaaaaaaaaaaaaaaaauucuuggcugggcacuguggcucucuccuguaaacccagcaccccagcacuuugggaggcugacaggaauggaugcuugagccguggaguuuagccugggcaacauagcaagaccccgucucuuaccccuuccccaaaaaauccuccucuguuagcaguuuucugacaauuuguauuauaaauggguauuugcgauaaaaauuuuguuagaugcuuuuuuuauuuauaugcuccuguguuuuuucuccuuuagcagguuaacauggugaguuacguuguuugauuuucaaauauugaaccagccuugcaucccuggaaugaacccuguuuggucaugauauauaauuaauuuuauauauugcugaauucuguuugcuaauauuugguuaaguauuuuugcaucuauauucgugagggauauuggcccuucuacagacaccaucuccauagugccagguggagaaggguuaaguuuuguaccuugcuugcugggaaggaaauggacaccucaugcuugcuucccaccccaccucaccccaccccaccccaccccaccccaccccaccccaccccaccccacccugugcaggggguugggcggguaaaggagaugaggguuguggguggcuuuguuaccuccgauauaccacugagugguguuaauccugagucuccagcaggcuuccucugguaguaccucggcaaggagcaggaggggugccucauaagugcuguuuggguuugaaguccaaguuccccaaauggacuccucugacagcauguuaagagagggggagagacuuguuacugcuagacaaugaugacaaucccagcucccuacuuggucuucucugauaccacccugguguggagagagauauggccggauuauaaccugacaggcuuaaaaaucaaggcucuccauuuggccuuuccuggugagggugggaguggaaauggggcugguuuuuuaugugguguuuggcuggaauagaguggguuauugucuaaaagucuuacaucuugcuaggcugucucuuuuucugguccuuugguuuuucuuuucuuucuuuuuuuuuugagguggagucucacugucucccagguuggaguacaguggcaugaucucggcucacugcaaccucugccuccagggcucaagcgacucuccagccucagccugagaguagcuacucagccucagaguagcuacucagccucagaguagcugggacuacaggcacacuccaccgcgcccagguaauuuuuuguauuuuaguagagacggaguuucaccauguugcccaggguggucucaaacuuuucagcuccagcgauccgccugccucagccucccaaagugcugagauuacaggcgugagccacugcacccagccggucuuuuguuuuuucuuggagcuuuuuuuaucugcaccuuugacauuuccagguugcuagcuucucuaguauccacuuugggauauauauggcaaaauaaacaaacaaaacacccaaagagcucacuacuguguuguuccuugggucccaaggugccuggccagucagucuuccucuucauuucucagagucuucuuauguuuauuuuauauauaauguccauagaguaauaggaaaaaguaugucuacuccaucuuccugcaagcagaaauccauuuauuuuuuaaaauguaccugucagaggccaggcaccauggcucaugccuguaaucccagcacuuugggaggccaagacgggcagaucacuugaggucaggaguucgagagcagucuggccaacguggugaaacccugucucuaguaaaaauacaaaaauuagccaggcgugguggcgcacgccuguaguuccagcuacuuggaaggcugaggugggagaauugcuucaacccgggaggcggagauugcagugaguugagaugguaccauugcacuccagccugggugacagaacgagacuccaucucaaaaaaaaaaaaaaaaagguaccugucagaaaaaucuagagagcaaaacgguacacauacugaagaguagcucucucuucuguuccucuacuuuuuagaagcuguuuccuucauucugucuucaugucugucauuauauuccauccugucucacaaucuguuuuacacucuuaagacaauuuuucuuucuuuuuuucuuuuuuuuuuuuccuaagauggggucucacucugucacucaggcuggaaugcaauggcacagucauggcucagcuuccuaaguagcugggaguauaagcacaugccagcacagccagcuaauuuuuuuguuguuguuguuuuuguuuguuuguuuuuuacagagaugggauuucacgauguugcccaggcugguuuugaacuccuggccucaagugauccucccgccuccagcuaccagagugcuaggauuauagguaugagccaccacaccuagccaauuauucuuucuaaaacacacucugauuaugucauccucuuuuucagcuaucugcagagaaucccauuguguguagaauguuuuuaacuugacagagguuuccauggcucucucagguccucguuuccaagaaggaacaacuguugugucuaaaagggcuacugccuuaugcagccuauuugcugcaugaacugugcaugauguaugcccagggacaagccuuuuaagaaguucaucauuugaggcuggguguggugguucacaccuguaaucccagcauuuugggaggcugagacgggaggaucacuugagcccaggaguuugagaccagccugggcaacauggcaaaacccuaucgcuacaaaaaaaaguacaaaaauuagcccagcguuguggugcacaccuguggucccagcuacuugggaggcuuagguggaaggaucacuugagcucaggaggcaaagguugcagugagccaagauugugccacugcacuccagccugggugacauagugaggcccugucucaaaaaaaggaaaaaaaaauaaaguucauuauuugaaacauagucgagcccacagcuaucagggacauuucugaaacaaguaccuugggcaccuaugugcuuccaaagcuguaugugaagcuacauaacuacaugaguugugccauucgcagaaagguagucaagaaucgaacuuguaaagccugcaaggaccaaacaugucuaccugacuuagacuuuugagugcugccccaugaccuccaccaaaguccguauaaggagccgacuccuuaaggacugaagaaaaacuaucuucuggaaaaagauaaaguggagauuauacuaaaaacaaaaacaaaaagguuuucaucaucuggccccaguuuauauuuucaacuuuuuaucuuguuauuccccugugccuuuuacauacugaugguucaccacuguuuccugccuucauacuuuggucaugcaauuuccucugcuaguauacuuuuauuuuuauuuauugaucuauuuauuuauuuuuaaauuuuugcuauuguacuuuauucaucucuauccacauaauuuuacuacuccuuuaacgcuuagcucaaaagucacuuccaagaacucuuuucugauuuuaccaacuggaaauaacuucucuuuuccaacuccuuuaacuuuccaauuuuuagcaaauuagauaaauauccacuuuauuagucuuuugaggauugagugaacuaauuaugacucucuuuaauaucccuuucuagacuguagaaucauugagagcaagaucugauucagauucauuuggaugaaugccacauugccuaguguaauacccuucauauaguauguguacaguaaauauuuaauagaugaauaaauguaacauaugagugcuuuugcuuuuuuuuuuuuuuuuuuuugagacaguaucuugcugugucauccaggcuggaguacaauggcaugaucauagcucacugaagccauaaccuccuaggcucaaguggucuucccaccuuggccuccugaggaccugggacuauaggcacgugccaccacgcuggcuaauuuuuuuuuuuuuuguagggaugaggucucccuauguugcccaggcuaauuucaaacuccuaggcucaagcaauccucuggccuuggcuucccaaagugcugagauuacaggccugagccaccggguuggccggauuguauccucagugccuuagugucuggcaucucuauauaauagacacuuaguaaauguuugagacugaacagugcaaaauugugauucaaaaagucuucauuaggcugcgcacgguggcucacaccuguaaucccagcacuuugggaagccgaggcggguagaucaccugaggucaacgguucgagaccagccuggccagcauggugaaaacgugucucuacuaaaaaauacaaaaauuaguggagagaggcggcuugugccuguagucccaacuacucgggaggcugagacaggagaaucgcuugaaccuggaaggcagagguugcaauaagcugagauugcgccaccgcacuccagccugggcacagagcgagacucugucucaaaaaaaaaaaaaaaaaaucuuuguuauguaauguaacuuugauacauucuucugcugauaacuagaaaauauuuaguauuuuauauuugagauuuaguucuugcagaaguacaagagcccucaguucaugugaggcaguauauugucauggguaagaauaugaacuuuaaaaugagauugccuagguugaacaguucucuguacuacuugcuaguacaaguugaucuuggggaacuuaacccauuuauaucaguugucacaucuauaaaaugaggaaauuaauaguaccuacuuuauauaguugugaggauuauuugggcauauaagucaaacacguagaacaguuccucagacacuguaaaugccaugaauguuagcuaauuuauuguuacuuccugaaaaugcacugaacacgguucagaacuugaguuugugaguuaggguguacauucuuuuuaaggaauaacacucugcugacaucacauauccucuagcuguacauccugucugcuuccuacuauuuuaacuagguauugaauggauagcugauaaucccaguuacaugacagacaguauucagcauguaaauguuaaauaaacaaguccucuugagacauuuuaacucagaaaggauuaacuaguucaugcuaaggaacaacauguacuuuuguucacuguauuuccuuugaagaauauuuuauuuguucugguugaauauacuuucccauucagugcaguuaacucuuccuaggugauaaacccuuuaccggucuuuacugacaaauuaaaaugacuauuuaacguucccuguauuauuuugaaccuuaaaacuguuuuaacagcccucuaaaauuaaucuggcucugauuuuuuuuucuucuuuaauuuuuuuuuuuuuuuuuuuuugagacagagucgcugucaccuaggcuggagugcaauggcgcgaucuuggcucauugcaaccuccgccucccagguucaagcaauucuccuaccucagccucccgaguagcugggauuacaggcacaugcuaccacguccagcuaauuuuuguauuuuuaguagagacagcauuucaccauguuggcuaggcuggucuggaacuccugaccucaagugauccaccugccucgaccuccaacagugcuaggauuacaggcgugagccaccgcacccgcccuucuguuuuuuuaaauuuuaauaaaaacaaggucuccauauguugcccaggcuggucuugaacuucuucgcugaagcaguccuccugaguucgccucccaaaguguugggauuacagaaaugagccaccauacccagcuuagauauuuuuaauaacaggugaauucugaaaucuacauugguguaagauuaaaagaauacauaugguauuguuccauucauauaaaguacaaaugcagggaaaacuaaacuauauuguuuauggauauaugcuuagguaguaaagcuauaaagaaaaacaagggauuaucaugaagauagguuugugguuacuauggguggucggcaggggguggggaagggaauuauugauuagaagugguacacagugauacugggcuggugccuuggggugauuacagauuaaaggaagugaauaguugcaagccugagaugaaaagauuugcuuuuuuauccagcuguuuguauugcauuauuaauacaugcauauaauugguuuuagugccuaaauagcaaaauuucagacacauacugacgaaaauguauuacuucuucugcaaaagggucuuuuaacaaaaguugacacuuucguaauauagaagcccuacuuuuccuccauacuucuuucuguauucugaaucaccuaaaaaaaaaccaucucaacuggaucuuuuuuccagugugcuuuucuucuaauucuaaagauauuuauuauaucuucuuuguacuuccucuucuucuucuuauuuuuuuuuuuuuaaagacuaggucuuguucuguugcccaggugcaguaauagcucacuauagccuggaaguccccagcucaagugacucuuuuggacuucuggguuuuuuuguuuguuuugagauggagucuugcucugucaccaggcuggagugcaguggcaugaucucggcucacugcaaccuccaacucccugguucaagugauucuccugccucagucucccaaguagcugggauuacaggcaugcaccaccacacccagauaauuuuuguauuuuuaauagagacaguguuucaccaugucggccaggaggcucucaucuccugaccucgugauccaccugcuucggccucccaaagugcuggaauuacaggugugagccaccgcacccggccuggacuucuuuaaaguuaaaaugauuagcuaguuucauuuggcaucuuuagauuugaauuugucaucuacguaggaaaaagaaguuauauaaucuuagggacaguagaaaaugguuuguuuauauagccuuagauacauaacaaagccauuaauguuuuaagaaacaccccaaagccaucugaguagcuacaugaauacauaugauuggagauuuguguuagguuuagcugugaucuuaacccuugacaucauaguauagugguuaagaguagaggaaauaaacaacuagguaaaucuagaauacagguuauucuacaaagaacuacccugaacuugucucccccuaaaaagaaacaagagcuagggcacuguucuagacuaaaagacacuagcaagaugugaugaccaaguguaauacaugaaccuaaauugaauccugauuuuuggaggaaacagaaauaaaauaaauuugaggggcaauuaggggagauauuaugguuaauuuucuuaggugugguaauguguauuguacuuauuuaggaaguugucauuauuauuagaagaugaauaacaacuggaugccgaaauauuuauggugaauaucauaaugucuuuauauuaaacaguuaagaagugucuucaaaauaagauaugaaugcuuaaaaaaaaacaccuaugaucagccaggcacggugacucacgccuguaaucccagcacuuugguaggccgaggcaggcagaucaccugaggucaggaguucgagaccagccugaccaacauggagaaaccccgucucuacuaaaaauacaaaaaaaaauuagccgggcuugguggcacaugccuguaaucccagcuacucgggaggcugaggcaggagaauugcuugaaccgaggagguggagguuguggugagccgagaucguaccauugcacuccagccugggcaacaagagcgaaacuccaucucaaaaacaaaaaaaacacuaugaucauucuuuaaaucucugguaggauuuaguagcuuuauuuucaacccauccuuuagcuccaaggaaaagcagcaugaagugauggaaagaguacugaauuuguugucaaaauucuuggaguuuaauuucagcaucaauauuaacucucuaggugacuuuaaaucauuuaaauuauaauaauuuaaauaauuuguguaaagcaaaucuggcaaaauguuugaaucccaaauuugaauccuggcucggacaauuucaaguaggaccuuggucacuucacuuaacuuuucugugccuucauugucucguguaaaaugaagauaauaguaaugucuaccucauaaaaguguugugaggauuaaauaguauuauaaagauaaagugcucagaauagugccugagcauucaacaaauguagcugcugcugcuguuauuguuuuauauuuauuuuauuaucuauuacuuugaagagagcuuggaagacucaagagguagaaaauauaaaacagaaguccaggcaggcagaacccucaaaacaacuaggcaaagaucaagcaguuguuguuauaauuaggaaaugagaucccacaugaaaucacccugcagggucuaaccuguaguagguauucauaaauguuaguuuccuucuguuaucccuuucuuuccuuccucauuuuauaguauuauuuaaucugaggcuugcagagcacuaugugaccauccauucuaauucugcuucuucucugcuucugguuuguauaacauugagucuucgaggugccuuugcacacaucuuauuucaucuauuacauuuugauuugauguuggcuuguugccucuacuaauuacuacauaauacaguugaauaaaauauaguuuaagcauauacacagaacugucugaaaagaaaaaucacgcucuaguguugacugaagauauauaauauuaagaaaaauuauagguuauuuuauauuaaaacauauacuaauuagaagcuuagaaucugucuauaauaccaaaaucuaauagccagaaaacagaauuuugauuauuaaaaauaacugaucaaauuuaucuacaauuuauauauuucugauaauuaaagaaauaagugagucuccaaaauaugguaagaauauuuuuuaaaaaucuauaauaaaucuuuaaaucucuguuagaacuugauagcauuauuaacucauccuuuagcuccaaggaaaagcagcaugaaaugguggaaagaacacugaauuuguugucgaaauucuuggaguuuaauuucaacaccaauauuaacucucuagaugacuuuaaauacucuaaacaucuuggcaucucaagccucacugugcauuagaaucacguggggagcuuuuuaaaaaaugcagauauaaaauuucugucucuucugagauucugauucaguuguccuaggaugaggcauggacauugauacaaauacacuguaaaauuucagacuauucuaauguauagccaggguugaaaaccuuuguauauguaguuuccuuggaagccuaggcaaaggaggcaucaaagagaauuggcuuuuuauauccuacacugucuaggagagagagagacugaaacugggagaugcaaacaaccuuuucuagacagguacucucugcucuguggcacugauguuacguuaggucucacaggaagcuggauuagauuuugcccaagacgaucuguuuuucuuugcccugauuacuugcucuacaaguagcguucugauuauuaaaucagccuccuagacacuucagaauuauaaaaggaugugccugagauaaugcuugagcauucuuuuuagacacuugagugucuagaauugguucucuaguuuauccauuaguaccuugugaguuugcuuuuagucucucuugguuugaccaacucuggggaacugacagggucaaguuuugaucucuaagggugaauaccagauccugauuccugguaaauuuaccaaauuagugacccuguguuaucucuugacauuuggacauuuuaaauuuauggauauaaaacucccugaagccgugaagaauuuguaauaaaguauuauaauaaaaauauaaauaaagagaaauauguaauaaaaucuuuccuguauacucuuaagacugaaauagcuguccaaaggcagauuuuuuuuuuugccagcuaugguggcucacggcuguaaucccagcacuuugagaggccaaagcaggaggaucacuugagcccaggaguucaagaccagccugggcauccuagggagacccuaucucuacaaaaaauaagaaaacuaauugggcuuggugguacacaccuguggucccagcuacucaggaagcugaggugggaagaucccuugggccugggaggucaaggcuacagugaaccgugaucacacuacugcacuccagccugagcaacagagcaagagucugucucagucaaucaauaaagaaagaaaaaggcagguuuuuguuuuguuuauaaugauccugauugacuguugguggaaauguaaauacagccauuauggaaaacacugugaagguuccucaaaaauuaaaauagaggcuggguguggugacucacgccuguaaucccagcacuuugggaggcugaggcaggcagauugcuggagcucaggaguucaagaccaaccugggcagcauggcaaaaccccaucucuacaaaaaaaauacaaaaauuagcuaggcgugguggugcgugccuauagccccagcuacuugggaggcugaggugggagaauugcuugagccugacaagcggugguugcagugggccaagacugcaccacugcacuccagccuggauuacacagugagacccugucucaaaaaauaaaaugaaauagaacuaccauacgauccagcaaucucucuauuggauauauguccaaaggaaaugaaaucaggauguugaagagauacugcacucucauguuuauugcagcacuauucacaauagccaagauaaggaaucaaccuaaguguccgucuacagauaaauagagaaaauguguguaugucugugugcaugcaccauauucauauucagccacaaaacagaaugaaguccuguuauuugcagcaacauggaugaaucuggaggacauuauauuaagugaaauuagccaggcacagaaagacaaauacuacaugaucucacucauauauggaaucuaaaaacaaguuaaucuuguagaaguagaaaguaggauagugguuaucagaggcuagagagaaaggauaggagaggaggauggauagagguuggucagcaaguacaaaauuacaguuagcuccauccaugucccugcaaagaacgugaucucauuccuuuuuauggcugcauaguauuccgugguguauauguaccacauuuucuuuauccagucuaucauugauggacauuuggguugauuccaugucuuugcucuugugaauagugcugcagugaacauacgugugcaugcaucuuuauaauagaaugauuuauauuccuuuggguauauacucaguaaugguauugcugggacaaauggcauuuagugggagcugaacagugagagcacauguacacagggaggggagcaacacacacugggccugucaguggggggcagccgggagagggagaacaucaggauaaauagcuaaugcgugcagggcuuaauaccuaggugauggguugauaggugcagcaaaccaccauggcacacguuuaccuguauaacaaaccugcauguccugcucauguaucccggaauuuaaaauaaaauaacaggccaggcgcaguggcucaugccuguaaucccagcacuuugagaggccgaggccggcggaucaccugaggucaguaguuagagaccagccuggccaacaugguaaaaccccaucucuacuaaaaauacaaaaauuagcugagcgugguggugggcaccuguaaucccagcuacuugggaggcuaaggcaggagaauugcuugaauccaggagguggaggcugcagugagccaagaucacgccacugcacuccagcuuggguggcagagugagacuuucccccccccaaaaaaaagauuacaguuagaugagaagcguaacugguuuucuguuguacaguagggugacuaugacuaauaauaauguauauuucaagguagcuagaagauuuugaauguuaucaccacaaagaaaugauagaugugacuggugugguggcuuaugccuguaaucuuaacacuuugggaggccgaggcaggaagaucacuugggccuagaaguuugagaccaaccugggcaacauagugagacccugucucuacaaaaaaguaaaaaaaaaauuagccaagcaugauggcacaugccuguaguccccgcuacucaggaggcugaggugggaggaucacuugagcccagggguuugagguuucauugagcuauaauugugucauugcucuccagccugggaaagagaacaagacccugucucuagaaaaaaacaaaaaacaaaaaacaaaugauaacuuuaaaauuauauaugugcuaaguaucuuuauuugaucaucauacaguguauacauguauuaacauauuacacugggccagacgcgauggcuuaugccuguaaucccagcacuuugggaggccgaggcgggcugaucaccugaggucgggaguucaagaccagccugaccaacauggagaaacuccgucucuacuaaaaauacaaauuuagcugggcagugguggugcaugccuguaaucccagcuacucaggaggcugaggcaggagaaucgcuugaacccgggaggcagagguugcggugagcugagaucgugucacugcacuccagccugggcaacaagagcgaaauuccaucucaaaaaaaaaaaaaaaauuacacuguaccccauaaauguguacaauuaugugucaauuauaaauaaaguugaaauuuuaaaaaugaucuguggcuggccgcgguggcucaugccuguaaucccagcacuuugggaggccgaggcggguggaucacgaggucaggagaucgagaccauccuggcuaacauggugaaacccucucucuacuaaaaauacaaaaaaauuaacugggcaugguggugggcgccuguagucccagcuacuugggaggcugaggcaggagaauggugugaaccugggaggcagagcuugcagugagcugagaucgcgccacuacacuucagccugggcgacaggacaagacuccguccguaucaaaaaaaaaaaaaucuuguuuagaaggacauuggggaacugaaugaauuauuauuuugauugcugcuuuuuuuuugcacauuuauuuaauaaauguuuauugagaaccuaccaugugcuaaucauauaggccuuaguaaucaucuugauuacucuaucuuuccuaaaaauaaaacaaaaauaaccuaacaaaaacccacuaagcucuucugcugcacugagugcuacuuuucuuuucuuuucuuuugguuuuuuuuuggcuagauacacucucauuuugccuuuccucccuuuucuuuuucuuuaauuuguaguaugguacuugucugcuuucauguucuuacuacuguugaaccugcuugguagaugaaguagccagaucagagcuuuuguuuuguguaaguuacuaauagguuauuuuacuauucaagucuuuuuccccugucacuaaguacuugguugagaaaaaauaauugaauagcuuuuugaaauaaaacaugucauucauuccaaagaaugcaaaaguacauauaguuaaugagaagagagcugaaaaacauauccugcuuaguuucccaggaagcuaaggggaaaaaacauaaacuuaccuugccuuaccuagaauuggaccagaauguggaccuuauaugagacagcuugaagccuugaccuuuggguacuuagcuuguucugaaaucaacaauucagaggacuaaagagccuuugguaaucagucaggguucacuugcaagagagagaaacuucuuuggucugggcuaggaaugacuucuacuacaauauuuaaauuggccugucagaggaaugcuaccuuugcuacagucagaagguuggcauuaggaggccaacaugaaaugcugaguuugagaaugcgccaucucaauaccaaaaaaacccaguaaaaacauaggcaaaagacuugaguagguguuucuccaagcaaaauauacaaaggucuaguaagcauaugaaaagauguuccacauggcuaaucauuacugaaaucaaaucaaaaucacaaugaaauacuacuuuaugucauaaaauggcuacuauuaagaaaaagaacagaaaauuacaaguauuagcaggaauauagagaaauuagaacacuuugugcauauuucuaguaggaauguaaaaugguucagcugcuguggaaaaugauauggugacuccucaaaaaauuuagcagaauuacuguacaagccagcaauuccacuucuagguauauaccugaaguaaaagcagggacuugaacagauauuuguuuacccauguucaaagcaguauuauucacaauagccagaagaugaaugcagcuuaaguguccauggauggaugaauguguaaacaaaaugugauauauacauagaaggggauauuauucagccuuagaaagaaaauucugggcugggcguggugacucaugccuguaaucccagcacuuugggaggccgagguggguggaucauuugaggucaggaguucgagaccagccuggccaacauugugaaaccccaccucuacuaaaaauacaaaaauuagcugggugugguggcaggugccuguagucccagcuacuugggaggcugaggcaggagaauugcuugaacccgggaggcggagcuugcagcgagccaagaucgugccacugcacuccagccugggugacagagugagacuccgucucaaaaaaaaaaaaaagaaagaaaauucugacauacacuacaacacagaugaaccuugaagccuaagugaaaugagacacaaaagaacaaauauugcaugauucuacuuaugugaaauaucuagaauagggaaauucauaacaacagaauauagauuagagaauaccagggacugagcaugagggggauagugaguuauugcuuaauagguuacaggguuuuugcuuggagugaugaugaaguucugaaguuggauggugguaauuguggcacaacauugugaauguauuuaaggaaacagaacuauaacacuuaaaaugguaaaaaugguaaauuuuauguauaguuaaccacacacacagaaaagagcauguaucuguuaugcagguauuaggaaaccacuacuacuugccccacaacugcagcugcuucaugacccuuacaaaguuagugacugaaaccuggagaauuaugugcauguggucagcauuuccauaauccuuguggauagccaaaacuucaguaaaacaacucccauuucaccaucuguuuuccauaucucaugagcaucucaugagcaucuaguuggcugaaccugauucacauuugaauccuaguagcaagggacccugaggaauaaugauuagcuuuucagacuguguaguaggaggaaacgacuagagggagacuagaaaggauacugagugcugcuucaucauaucugccacaggcacugagucagaggugauucguagauggcagugcuccuuuuagucaggucaccauuuccaguaguauugagaauguccugcagcugauaaguuggagagguaggguggggacaaagucauuaucucuuuuugcaguuaaugggcugauugugcuaugguauuugcaguuuuaaugugguagaacacauuuggauuauuuaaauuauuguaaagagauuugggucacucuaaugggaugcauuaaagacucauugacuaaagacuaucugggcuaauguuuaggaguaccaaauguaagguuguuauguuuaugauaagcuuuuuucauuucaucaaguauggauauaagaauauaauagaaaauauacugaguucuuuugcucuuaggcugcugaaaucucuaauuaguaugaacuaaauuuguuuggagagaaaagaaacaaauuuacuaguaaagcauuuacuugcugaaaauugcacuucuuaaaaacaguuuucaaaaauucuaaccagaggucacccaaaagauaagauauuucauauuguucagaacaguccgguguuuuuaucuguuaucugugacuuaaaacuaaguuugaauaauuccuguugauaaucggauucugcaggaaugacuguucucucagcaccuugauagguauugaccuuugaugcuuaagugguuuuuucuuuuuuuuuuuuuuuuuuugagacggaguuucgcucuugcugcccaggcuagagggcaauggugugaacucaguucacugccaccuccgccucccaggcucaaacaauucucccgccucagccuccugaguagcuggaauuacaggcaugcaccaccacgcccgauuaauuuuuuuuuuuuugcauuuuuaauacagacaggguuucacaacauuggccaggcuggucucaaacuccugaccucaagugaucugcccaccucggccuuccaacguacugggauuauaggcgugggucaccacccauuaacauuuuggacaaguaccaagcuuugcaugaaaugcuuuuuaagguggaccacgcuuuaaugguguaauaagaguuaguauuuaaaucagauuuguugauacaguuauuccacuucuagaaauuuaaccuaaagcaaugcaaugccauuuauaauaauaauaaaauagugaacaauuguuaacaauggggagauggauaaauuauuguauagucauacaauggaauguuuuaaaacuaucuuuucaaaagauauuuaauagcauuagacaggacucaugcaauaauguuaagcaaaaugauacagaauuauguaugaugugauuucucuuuauagaaaauuuugugugugagagaaauauaacaaauuauaaggagugauccuuuagggauuaguuuucaaauuuucuguucuucagugaauauauauugcuucuauauauuuggcuuuuuauuauagagagacuuaauuauaaaagauucaaaccaugcagaaacuugcagacuaaaaacccuaaaaauccuuccucuguccccgaccuagagaaauggagaccaauucaucaauuuguuuuuauauggauuuuguuuuuggugucacaucuaagagaucuuuaccuaacccaggucagaaagauuuucuccuagaaauuuucuagucuuagguuuuauguuaggucuaugauccauuuucaguuaauucuuauaugugguagaaguaugaauugagguuuuuacauauggguauccauuuguuccagcaucauuuaaugaaaagacuguguuuucuccacugaauugccuuugcacauuuguagaaaaucagauaucuauauauguauagguuuguuucuggacucuauauucuguuuccuugauuuauguuaacaccacuuugucuugauuugaguacugagauaggcagaaguccccggguucaagcaauucuccugccuuagccuccugauuagcugggacuacaggcaagcaccaccaagccgggcuaauuuuuguguuuuuaguagagacaggguuuugccauauuggccaggcuggucucgaacuccuaaccccaagugauccacccgccucugccucccaaaguacugggauuacaggcuugagccaccccgcccugucaagauacagaauucuaaaaugacuccuaaugaccuaugcuuuuguauaaugggagggaccuguaaucccaccuaaucaugggauaucacucccauggugacuaagaaagggagauuauccucaguggaccugaucuaaucagacaaacccuuaaaagggacugggcuuuuccuggagaaauaauccaaguacaagggaagggaauucaacacagaagaagcugcugauuuuugggaaaagaggaggccaugcaguaaagaauucgaguggucgguaagcuuacgguaauuuguuacaaagcaauagaaaacaaauacagguaguuguauaauaaguguuuaaaucagcuguuuaugaaauguaucaauaucuacaaaauuaaaggcccguugggauuuugauuggaauuggguugaaugugcagauaaguuuggggaaaauuguccucuuaacaguauugauucuucugaccuacucauuucucauuuuuagguguucgucuuagcaguguuuuuuguuguuuucagcauauaggucuugcccauguuuugucagauuuaucccugaguauuuaauauuuuuuaugcuauuauaaaugguauuuuauacauuuuaauuuuugauuguuuguugcuaguauauggaaauacaauugauggcugggugugauagcucacgccuguaaucccacacuuugggaggcugaggcaggugaaucuccugagcucaggaguucgagaugggucugggcaacauagcaaaacccuguuucuaccaaaaauauuaaaaauuagccaagugugccaaguguggugcgcaugcaccuguggucccagcuacuuggaaggcugaagugggagaauggcuugagccugggagguggagguugcagugagccgagaucgugccacugcacuccaaccugggugacagagugacacccugucucaaaaaaaaaaaaaaagaaaggaagacaauugauuuuuguuugucgauacuauauguggcaaucuugcuaaacugacuuauucuaguaacuguuuuugguauagucuauugaauuuucaacauaaauaaucaaguugucagcaaauagaguuuuauuucuuccuuuuuaaucuguaugccuuuuacuuuuuuuuuuuuuuuuuccucgagauggagucucacucugucucccaggcuggaguucaguggugcgaucuccgcucacugcaagcuccgucucccggguucacgccauucuccugccucagccucccgaguagcugggacuacaggugccugccaccaugcccggcuaauuuuuuguauuuuuauuagagacaggguuucaccguguuagccaggauggucucgaucuccugaccucaugauccaccugccucagccucccaaagugcugggauuacaggcgugagccaccacgccuggccugccuuuugcuucuuuuuuuuaucuuauuacacugaccagaacuucugauguuuuguagaaguggugagagugacggucuugccuugcaucuuuuuuuuuuccuuacacuugcuuuuuaaaaaaauuuuauuuuuauuuuuguuuuugagaaagagucucacucuguugcccagguggcucacugcagccuccaccuucuggguucaagcaauucuccugccucagccuucugaguaccugggauugcaggcacccaccaccaugccuggcuaauuuuuguauuuuuaguagagaugggguuucaccauguuagccaggcuggucuuaaacuccugaccugaggugauccgccugucucagcuucccaaagugcugggauuacaggcaugagccaacaugcccagccuuuguuauugauuucugcccucaucauuauuauuuccuucugcuuuggguuuaauuuucucuuuagcuucuuggugguauuauuuuagcugauauuaguggauuuccauuucucccaaccuuugugcuauuguuaacauauguuuuacauauguuauaaaucccacaguacauugcuuuuuguuuaaacaguaaauuaucuuuuuuuugagacgaagucuuguucugccaccaggcuggagugcaguggcacgaucuuggcucacugcaaccuccgcuucccagguucaagcgauucuucugccucagccuccugaguagcugggacuauaggcgcgugccaccacgcccagcuaauuuuuguauuuuuaguagagacgggguuucaccauguuggccaggauggucucgaucucuugaccaugugauccgcccgccucggccucccaaagugcugggauuacaggcaugagccaccacccggccuaaauuaucuuuuaaagaaacuuaaggccgggugcagugccucccaucacuuugggaggccgaggcaggcagauuaccugaggucaggagucuugaaaaaccaaacaaaacaucaauacaaaugaauauccuucuauccugaaggacaaaugaaugaggacagcauccucuuccuuuucccacaauguaauaauucuugauuugaguguuuaucauggccuuauaagugcauuguuggcuauuaaaaacuuucugugcuuccuuacaacaagcaaaguuaaaagcugguacugcggcugggcgcgguggcucacgccuguaaucccagcacuuugggaggccgaggcggguggaucacaaggucaggagaucaagaccagccuggccaacauggugaaaucucgucuuuacuaaaaauacaaaaauuagccuggugcaguggcacgggcccauaaucccagcuacuggggaggcugaggcaggagaaucucuugaacccagaggcagagguugcagugagccuaggucaugccacugcacuccaggcugggugauagagugagacucugucucauaaauaaauaaacuaacuaacuuaaauaguaagaaaaaauguauauauuuaugcauguggcuaccauuuugguguucauuucuuuguguagauucauauuuugguaugguaacauuuucuuucugcuugaaggaccuuaaauuuuuguagugcaugucugcuggugaugaaaucagcuuuugugugucugaacaaguauuugccuuugcuugugaaugauauuucacugggccuacgguuuuagguuguuguuuuuuuuuucuuucaguacuuuauguuguuucacuguauucuagcuuggcuugagcccaguaagaaaucucuuaucauucuuaccuuuguuccuaaugugucuguuuucucuuuuugcuuuuaagauuuucucauugucacuguuuuuaaguaauuugauuuugguaugccuugguauagcuuucuucuuguuucuuauuuuuggaguuuguuaagcuucuuggauacacauguuuaugguuuucaccaaauuuggaaaauuuuuggccauuguuacuucaaauauuuuuucuguucucucuugucuuuuggaagcuguuugauguuguuccaccucucacugauguucuuucuuugguguguuugugugugugguaaaauauauacaaccaaauuuauaauuuaaacuuuuuuuuuuuuuuuuuuggaguuggagucuugcucugucacccaggcugaagugcaguggcacgaucucggcucacugcaaccucugccucccggguucaagugauucuccugccucagccuccagaguagcugggauuacaggcacccgccaccaugccaggcucuuuuuuucuauuuuuaguggagaugggguuuucacaguguuagccaggauggucuccaucucuugaccucgugaccgccuaccucggccucccaaagugcugggauuacaggcgugagccacugcucccggcugaaaugauuuuuuuauauaguucaguggcauuaaguacauuuacuguguugugcaaccauuaucaccauccaucuuuagaacuuuuaaaaaaucuucccaaacugaaauucuguaccuauuaaaaaaugacucauucucccugcucccagucccugacagccaccauucuacuuucuguuucugugaauuucacuacucuaguuaccucguauaaguggaaucauacaguauuuguccuuuugugacuggcuuauuucacuuaguauaaugucuuuaaggcucauccauguuguagcaugcgucagaacuuccuuccuuuuuaaggcugaauaauagucucuuuuuuaaaguucucuuuuuuuucuguguuuuauuuugaaaaguuucuuuucuuuucauuguuuuuuugagacaggcucuugcucuguugcccaggcuggagugcaguggcgcgaucucaguccacugcagccuugaacuccugggcuuaggugaccuucuugccugagccucugaguagcugggacuacaagcaugggcaaccaugucuggcuaauuuuaaaaaauuauuuauagagacgaggucucacuauguugcccaggcaggucuugaacucauaggcuuaagcaauccucccaccucagccucccaaaguguugggauugcaaccagcgcccuugaauuguuucuauuguuacuuaguuacauuuauugcucuuaccuucugcaguggcucagcagcuguuagucccauccaggguauuuuucaucucagauuauuucauuuuaucucuagaacuuggaguugcguuagucuuuuuuuacuuaucuauuuccuuuuuuguugagauggugcaggggcaggggacaucucccuuuguugcucaggcugaccuugaacuccuggccgcaagggauccuccugccuugccucccaaagugcagggauuacaggcgugagccaccaccuggccauuaugugucuauuucuucauuuaacuuuuuggacaaauguaauacacaauuaucauaacugaguuaauuuccuuaucugcuaauuuuauuaaaugugucaguucuugauugauugauucuucuccucauuauaagugauacuuuccugcuucuuugcaugccugacaaucuuugaauagauuccagacauuaugaauuaguuguuggacauuaugaauucauuguugggcucuagauacuuugguauuucuauuaauauucuugagcuuuuugugggaugcuguucaacuacuugaacagaguuugauccuuuugagucuuccuuuuaagauuuguuaggaugaacccagagacauguuuagucaaggguaggguuucucaauagcagcaccauggcauuuggggccaaauaauucuuuguugggggaggggauaguccugugcauuauagaauguuuaacaucauucccccccaaaguuguaacaaccaaaaaugucuucagacauugccaaauguuccaggaaguggggaggauugcccgcaguugagaguugcugccuuaggguuaguuuugccuuacuacuauggcaagaucuuucuguguacucuacccaaagcuguucaugagaccuuuuuucaaucuggcucuuuggaauagguacuuuucuuggccucaugugagugcugggaauucaauuggguggucuuuccuuggucuugguuaguuuccuuacauacaugugcugauaggcauucagcuaaauauucaagagagacccgcagaucucuggaguucuugucuguguaucucgucuccaguauugugccccauaaacacuagccaucuugauugccccaaacucucagcuccaucucuucaacucagugagccugccaggccucacaugaguuucccauccugugccucuuguggcugggaaacucaaggccguaaccuggggcaguaggguucaccuuauuuguuuccuggcucucagggauuuuccugauguccagugucuugacacuuuuuuuuuuuuuuuuuuuuuuuuuuuuggagacagaguuucgcucuuguugcccaggcuggagugcaauggcacgaucucaacucaccgcaaccuccgccucccggguucaagccauucuucugccucagccucccaaguagcugggauuacaggcaucugccaccacaccuggcuaauuuuuuguauuuuugguagagacaggguuucugcauguuggucaggcuguucucaaacucccaaccucaggugauccgcccaccucagccucccuaagugcuaggauuacaggcgugagccaccgcaccuggcugaaacuuuuuuuuccccauauauuuuguuuguuuuuugguuguuucaggucagaggauaaaucugguucuuguuaguaaaucuuggucagaagcacauguccuuuaacagaucauuuauuuguauuaauuauugauaaaagcugaauucuuaaacauuuacuaaucuaauuuccuuauuuuaucaauuuguauuuaucauucaaagucuccuguucccuguaauuccuuugguacaacauaaauauuaaauuggcccuaaagcuuuuuaucaucuuuuaauauaccucuuucaugcaggcuuucacaggguuagcuaaguagugauuuaguaugggccucuuaacuauuauauaguagcauacaauuaaagggcaugcacugaccugauaaagcagaacagugaaaugugucaugcuuuuagggcauucccacagcaggcucaaagacuuccaagagacuuccacguauaacuuauauuuucuagcagcuaaaacgucagcaucaaagccuauuagccugauugagguuguaaagaacuggugagcuaagacaguggaaaaaaacauauaaaagaagagaagaaucauuuugaacagaguaugagaggaaacuguccuaacgaauaaugcuacaagaaugggagugacauggaacccauuggugguaagcuguuagagaaaggggaauguuaacagacuagaaauaaugugacugaagaaaucuggccuuguauuuuuuauuuauuuuuuuuuauuuuugagacggagucuuacuguguugcccaggcuggagugccguggugugaucucuacuaacugcaaccuuugccugccagguucaagcgguucucugccucaaccucccuaguagcugagauuacaggcgcccgccaccaugccuggcuaauuuuuuugcauuuuuaguagagacgggguuucaccaucuuggccagguuggucuugaacucaugaccucgugauccacccgucucagccucccaaagugcugggauaggcgugagccaccaugcccggcuggcuuuguuuuaugugaaggaaacuugucucucagauuugcuauaucauaaccacuacagagauuauagcaugugcuuguuggauauccaaggaugaaguaauuuagucagagauacuuuggguaaaagaagauauguauaguagguagggugaaagcaucuaguuauccaugugaacuaaaacagcaaaaucauauuucuaauggaauuguauauaugauauaauaaaugauauaaaauaauauaauaaauguauaaguuccauguguuaaagugaauaaaucauaauucuuugacauuugagguggugaugauaugcuacagcuaaaaagaguuaagaguuuuuguuauuccauaaugcauaagaauuagacaacuuuguaaaaaauacagacuccuuguaaauggauguuauaauaauuuucaaagacagggaaacuaugugggucaauaauauaaguucuuuugugaaacaaaauaugacuuaagucuuccaaaaauuacgauugcuuuuaguaauaaagaaauaaauacuuaauguuuaacugacacuucccugacauucaucuguggguggauuuuaucaagcuuauuucuuguuuucuaaauaguuuugaugauauaaauggugcucauguaguuagugucugccuuugccaaguuacuguaagucuucguggcaggaguuuauguggguagggaaagaaugcagagcaauaccagcuuuuuuuuuuuuuuuuuuuuuuuuugagacagagucuugcucugucgcccaggcuggugugcaauggcacaaucucggcucacugcaagcucugccucccagguucacgccauccuccugccucagccucccaaguagcugggacuacaggcgcacgcugccaugcccggcuaauuuuuuguauuuuuaguagagaugggguuucaccuuguuagccaggauggucuugaucuccugaccuugugauccacccgccucggccucccaaagugcugggauuacaggcgugagccaccgcgcccggccgcaguaccagcuuuuaacuuugcuuguuguaaggaagcacagaaaguuuuucauagccaacaaugcauuuauaaggccaugauaaacacucaaaucaagaauuauuacauugugggaaaaggaagaggaugcuguccucauucauuuguccuucaggauagaaggauauucauuuguauugauguuuuguuugguuuuucaagacuuugaaaauaaaguuuaaucuaacauauauagagaaaaguauagaucacaauuauacagcuugaugaauuuucacaaaaggaacaaacucauguaacuaauaugcagauuuuuaaaaaagaacauuuguauuagaacaguuuuucuuuuuuucaagcuggguaauaggcacauagguguucguuguaucauuuuauucuuuuaugcuuugaaguuugccuaccauuuuuaaaaaauuaucucagguggaaauacaaucuucagaggucuggaaagugucagaaaaccuacaggcuuuaauaguugagaaaguacuuuugagaaauaguguuuuuuuccauguaggccuuugucuccuauguaucugauauacuuuauaaaccugagaaggcccaaguaacugaauguuuuacaauaaaagaagaacauaaauagagcugugugaaaucaaaguaguaaaaauuauugguacuuuuuaaaacauagcaccuuauuggccuuuuauucugcaguauaaagucugggucaucaaauuugugaguacauggaaaugacaguuuucuuuuaaaaauuuuauugcuaaaguccgugauaguuuaagaauaaaaugcccuauucaguucuauaauguaauauucaaagcuguagaaagaacugaguuauuauugagauucaaauauaugucuaguuuaaaggcuucauaucuguuauagaaaucauuaugugugcaguaguuagaaauacgcuuaaucuaaaggguucccuggaauuacaguuaucuacuuuccuuuauguuuauuuccccccagguggggagauacguuuuccaugaacauggagauuucagaaaucggauuuuuuucucuuuucuuugauuuuuaaaaauauaauaaaucuuccuauauuucuugauuuuaugaaaaguauuaaaaugggauuuuucucaguucucgaguaggcuuuuuaauuaaauugugacucaugcaguggaaaagccauuuguaaaaugucguucuguaaaaauguuugguuauuaaauuuucuucugcuguuggagucauaugcauaaaauuauuaguguguuaaucuauugaaaaccauucauuauugaauaauuuuuguuucuuuuacucuagaaaccaauaggauaguguagguaaauuacuguuucuggggugcguguguguauauacauaugugugcguguguguguguguacaucucucucucucucucuacauauauauauauauaguuuuuuguuuuuuuuucuuugagacgaucucccucuguugcccaggcuggagugcaguggcacaaccauggcgcacugcagcuuugaccucccagacucaggugauccucccaccucagccugccagguagcugagacuauaggugucccaccaugcccaggcuaaaauuuuuuuuuuuuuuuuuuuuugguagagauaggaucuugcuacguggcccaggacuggucucgaacuccugggcuuaagugauccucccaacucagccucccaaagugcuggggauuguaggcaugagccacugcgccuggccuguuucugguguauuuauguguguuugucuuugaagaaauuguuaggacauacugaagcuuuuguuuuguuuuccuguuuucucucuacaggcagcggaggaggaaauggcagguccuaaucaacucugcauucgccgcuggacuaccaagcauguagcuguguggcugaaggaugaaggcuuuuuugaauauguggacauuuuaugcaauaagcaccgacuugauggaaucacauugcuaacauugacugaauaugaucuccggucuccuccucuggaaaucaaagucuuaggggacauuaaaagguuaaugcucucaguccgaaaauugcagaaaauacauauugauguuuuagaagagaugggcuacaacagugacagucccauggguuccaugaccccuuucaucagugcucuucagaguacagacuggcucuguaauggggagcuuucccaugacugugacggacccauaacugacuugaauucugaucaguaccaguacaugaaugguaaaaacaaacauucuguucgaagauuggacccagaauacuggaagacuauacugaguuguauauauguuuuuauaguauuuggauuuacaucuuucauuaugguuauaguccaugagcgagugccugacaugcagaccuauccaccacucccagauauauucuuagacagguaaguuuuguuucuaguugcuaaguuuguaggauguugcuauaauuaacagcaaugauacuauauuuaugauaauuauauuguuucuuauugugguagauguauacuuuccauuugcuuuaucuggcgguauaaaaugcuuugaaauuaccuuuuucacuuagaguaaauuaggccuuaagccuaggugugugagaaaaaccacugcucuuuuaauuuuucaauuuaauuuaauuuuaauuuuaauuuaauuuuuuauuuugagacagucucacacugcacugucacccaggcuggaaugcaguggcaugaccauggcucacugcagucucaaccucccgggcucaagcaauccucccaccucagccucccaggaaacugggacuguagacauguuccaccaugcccagcuaauuuuuaaguuuuuuguagaaauagagucccaccguguugcccaggcugggugaacuccuaggcugaaacgauccucccaccuuggccucuuaaaguguugggauuacaggcaugagccaucauggccuggacugcuuaauuuauuuuuguguaguuauagcuccuuggguacuuuagauuuuuugagacagagucucgcucugucacccaggcuggagugcaguggcaugaucuuggcucacugcaaccuccaccucccugguucaagccauuccccugccucagccuccugaguagcugggauuacaggagcccgccaccaggcccagcuacuuuuuuuguauuuuuaguagagauggggcuucaccauauuggccagacuggucuugaacuccugacuucaggcaguccgccuaccucggccucccaaagggcugggauuacaggugugagccaccgcgcuuggccagguacuuuagauuuuaagaggguaucuggaaugauguuuguaauaaauggaacuuggcugccuuuuuuuauuuuuuuuuaaaugaagaauaggguucugcuuuuucaaaaauauugauggugucauaucaccaaaugaauuggaacuaucacaaagaggacaaguggauucagugauagcaugcuguuuuauuaaauauugaauacauaaaaaaauguaguauauguguaacauaugaaaaauaagaauagggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcauaguggcgggcgccuguagucccagcuacuugggaggcugaggcaggagaauggcgugaacccgggaggcggagcuugcagugagccgagaucccgccacugcacuccagccuaggcgacagagcgagacuccgucucaaaaaaaaaaaaaagaaaaaaaaaaaagaaaaauaagaauagaacaguaggccaggcaugguggcucaugccuauaaucccagcacuuugggaggcccaggugggaggauugcuugaguccaggaguucaagacuagccuacaaguucaagacuugcaacauagcaagacccccaucucuccaaaaaauuaaaaauuagccaagcaugauggcacaugccuguaguccuaacuacucaggaggccaaggugggaggaucacuugagccuaacagguugagguuacagugagcuauaguuacaccacugcacuccagccugggcagcacagcgagacccugccugucuccaacaacaauaauaauaauaaaacaguaaacaaguacucagaacuguuuucacauuuuugauuuuuaaaucuuuuaaaaauuuggguauuacuuucuuguuuguuaguuuuugguuuuguuuuuguuuuuuagauggagucuugcucugucacccaggcugcaguacaauggcacgaucucagcucacugcaaccuccgccuccuggguucaagugauucuccugccucagccuuccgaguaacugggauuacaggcacccaccaccacgaccggcuaauuuuuguauauuuaguagagacgagguuucacaguguuggucaggcuggucucgaacuccugaccucaaaugauccgcccaccucagccucccaaagugcugggauuacaagcaugagccacugcgcuuggccccuuguuuguuuuuuauaaaacauuuugcccuucuaaaagugccuuugcugggcauuagggcucauaccugugaucccagcacuucgagaggacgaggcuggugggaucaccugaggucaggaauucgagaccagccuggccaacauggugaaaccccgucucuacuaaaaauacaaaaacuagcuggaugugguggcggacaccuguaauuaucucagcuacucaggagacugaggcaggagaauugcuugaaccugggaggcagagguugcagugagccgagaucgcgccaucgcacuccagcccgggugucagagugagacugucucaaaaaaaaaaauacauaaaguaaaauaaaacugccguguaguauuuguauuugaaaaugaaaugaauuuaaaauguccguguuccuaugccagaauaauguauacaucucauuuugcucccugucaaaccccaacuaaaacuauaguaaagagguuuuuuuuuuuguuuuguuuuuguuguuuugagauagaguccaggcuggagugcagugacacaaucucggcucacugcaaccucugccucccggguucaagcuauucuccugccucagccucccaaguagcugggauuacagacaugugccaccaugcccagcuaauuuuguuguauuuuuaguagagacaagguuucacuguguuggcuaggcuggucucgaacuccugacucaaaugauccacccaccugggccucccaaaguauagggauuacaggugugagccaccaugcccggugagcuguaguaaagaguuuuuuguuuuuguuuuuuaaguaagcccacaggauggaguggauaaaauaggagaaaacagccauacauuuuuggaaguuggaagauggauggaugaguggcaauugacaaacccaaaauuaaccuaauuauaaaauuugagcaauggggaaaacugagaaccaaccccguuuauauugcagauuucuccaaaguaaggagaacuuacugaaagcuguuuaagaaguuguuauauccguguaucuugucuccccuucuauacaguuuuuccaacuguaaacagaagaccacuaggaaguaaggaagaaaucauguggcugucuggggaaaauaguacuuuaggcaaagcaaacagcugggugcaaaaaucugaacugggaguguuccuggcagguuuaaggaacaaccagugagagaugagcagaucugagaggagacaagaagccagguuguguaaggacuugaggaccauuguaaggacuucagcuuucauucuaaaugaaaagggaaggcacuggaaaguacugaggacaagaguugagggaucuaacuucuauuuuaaaaggucauucuaguuguuguauugagaauacccugggguguggguggggaucuagagaucauuuaagaauuuauuaaauucaucuagacaaagauuuuagauuggaugagaacagugguagaggugguaugaaagagucaaauucuauauauauuuugaaauuagaaaauuagagcuaacagaauuugcugaugaauuuggauuugaugaauuaagagagagaaaucaaauauuauuccaagauguuuuuuguuuuuuguuuuuuuugagacagggucucacucuguucuccaggcuggaguuuaguggugcauucauagaucacuguaaccucaaauuccuaggcucaagugaucuccuuccuuagccucccgagucacuacgacugcaggugugugucaccacaccugccugauuuuuaaaucuuuuguagagaugggguuuugcuauguugccuaggcuggucucaaacuuuuggccucaagugauccucccaucccugccucccaaagcacugggauuguaggugugagcuaccaccccccagccuauuccaagauuuuuaaccugaccaucuguaaagauggaguugccauuuacagagaugggaaaacuguggaaggagcugacuuggagggaaaauuaaggguuugguuuucgacaugucagguuugaaauauguuuuguagcaaauucagaugucaaggaagagauggaaauaugagcagaaguucagagagauugagagagacagaaaucuaggcuaagauuugggaaugggcagagagagagaacaguaugccagaagccaagcaaaaaaaaaaaaaaguauuuuaagaaguuuaggaacaauuggcuguagcaaaugcugcugaaaggucaaguaagaugaggauaauugaccauuggcuuuagcaacauguuggucaucagugacuaugacaagaguuaauaagggcaaaaauggguuauaauagguucaggagagaaugugagauguauuggaauuuacaugaagguacuccacaaaugugaaacaacaugagcacaacaguauuuguugugacauuguuuguaauaauuauaaauauuguaaauaaucuaaaugcuuacccaugggaagcugguugaguagacuaucauacaucuauacaguggcauacuauuuaaucauagaaaagaaugaagacaauuucugugagcugauacaaaaugauuugcaggaaaaacucagcaacaauagcacuaugagcacacagaucgugguuuuaaaauacuguucccaggccagguaugguggcugacuccuguaaucccagcauuuugggagacccaggcgggaggauugcuugagcccaggaauucuagcccagccuggacaaccuagugagauccagucucuacaaaaaauuaaaaauuagcuaggugcggugguguaugccugcagucccagcuacuucagaggcugaagcaggaggaucacuugagcccaagagaucaaggcuguagugagcugugaucaugccacugcacuccagccugggcaacaaagcgagaccuuuuguuugucucaguaaguaaguaaguaaacaaauaaauacauaccauuccucacgaaaaugaacuagaccagggcugagaccaagcaaacaaaaauuguggggugagaggggaagcucuucaagaauaauacgagcaaauaaaugugggcagcaugauuauucugccuccuccaguguauucaggcaagucaucaguagaugauaaaaucuauuaggugaaaggccacugagggggagcuuauucacaugaucugaaaguuucaucucaccuauuacuuaauuacagagggaaugagguagcuuuacaauggcaagaucugacaugcaucaccuuaaccaaaugaucaaauguaguagcaucacagugggacaaacagacauuaugugcauuggacgugauguccacagcaucaccuauguaaucaucuuguccaaaaaaaaaaaaacuuuaaccuauaucuaaucacgaagaaacaaucagacaaauccagaacauggaacauucuacaagacagcugacauggacucuaaaaaugucagugucauggcaggcaaaauccagggggaaauguaagggaaauugaagagacaaccaagagccacgugaaauuuaauuagauccuauaucaagaaaacaaaaauaaugcuauacaggacauuuuugggacaauuaggaaaauuggaauauggacugcauguuaaauaaugguacuaaaucaguguuacaauguccuugguguaauaguauauuggguuaugaggaggauauccuuguuccuagagaaacaaaggggagaagugucauaaugucugcaacuuacuucggggagggguucaccuccccgaaaagaguauguguguauauguguguagguauguauagaaagaaugaaagcaagcaaauguggcaaaauguuaauuauuguaaaugaugaguuuaggugaauaauauaguguugauucuuuuaacuuuuuuuguagaucagaauuuuucacguuaaaagaauuaggcaaagaaaugaugagggggagagagagagagagagagagaauaggaacagagaaauuggagacauaugcuauaugauagcauguuuguuguauugauaauaagaaugacucaauguagggggguaaugaugguagaggaaagagaggguauaauguuagaacagugcccuugaguagaugaaaaggaaugguaccuuguggcugggagaggcuggccuuaggcccuugggcuguuccuucauaacagaggggaagguagaaaauaggaaaauagguggagguugccauaugugaugguggagcacaacgaagugcucuccugauuguuuuuauuuucucuguuuaaagacaaaauggagaggaggauggaggcuugaggaggaaggaugagauguauaaaauaagccaucuaggagaguaggagagugaauagacuuguguaaugcauuagcagcacuuaauggucuccuugagguuaguagucauauuagcauuguguguuuuuaccagccucauucaacagcagauacagguauggaauagguggagaacuggauuuaagcaggguugaguauugcuaggcaguacaaugaagggaaaaguggcaagggagugguuuuaaugagggaccauggacugauauggaugaggaaagaaguaaggccgggcgcggugucucacgccuauaaucccagcacuuugggaggcugaggcgggcagaucaccugaggucgggaguucaagaccagccugaccaacauggagaaaccgcaucucuacuaaaaauucaaaauuagccaggcaugguggugcaugccuguaaucccagcuacucgggaggcugaggcaggagaauugcuugaaccugagaggcggaaguuguggugaguugagaucacaccauugcacuccagccugggcaacaagagcaaaacucugucucaaaaaaaaaagaaaaaaagaaggaaguaaaggauauaagguagaugaaaaaauaauaaaaaacaagcaaaaaauaaaaaaacaaagcauagugggagagcaggaaaugguccagcagaacaaugaggcuuuuauuauuuuaaaguauacaggcugagugcgguggcucaugcccguaaucccagcacuuugggaggccgaggcagguggaucaccugaggucaggaauucgagaccagccuggccaacauggcgaaacccugucuuuacuaaaaauauaaaaauuagccgggcgugguggcaugcuccuuuagucccagcuacuccagaggcugaggcaggagaauugcuugaaccuaggagguggagguugcagugagccgagaucaugccacugcacuccagccugggugacagagcgagacucucucaaaaaaaaaauaauaauaaaguauacaauucaguggguuuuaguguauuuacaaaguuguagagccaucaccacuaauuccagaacauuuucaucauccugggaagaaacucauacccauuagcagucauacucuauuccuuccuuucuccagacccuagcaaccacuaaucuacuuuguuucuaugaauuugucuauucuggacauuucguauaaguggaaccauacaauaucgggucuuuuugugucacucagcauaauauuuucaagauucauccguacuguagcauguaucagcacuaccuucuuucuuauuaccaaauaauauuccauuguauggauguaccaauuuuguuuauccauuuaucaguugauagguguuuguguuguuucuacuuuuuggcuauuauuaauaaugcugcuaugaacauucauaugcaaaguuuuguguagacaaauuuuuuuuucuuuuucuuuuuuuuuuuuugagacagagucucacucuguuacccaggcuggaguauaguggugcaaucucaacucaccgcaaccuccaucuccugggucaaacggugcucaugccucagccuccugaguagcugggauuacaggugcacaccaccacacccagcuaauuuuuguauuuuuaguagagacgggguuucaccauguuggccaggcuggucucaagcuccugaccucaagagauccgcucaucucagcccccacaaagugcaagcauuacacgugugagccaccacacccagcgggacauguauuaucaauuugcagugaggauuucaaaccaaauuuugccuaauucuuuuuacuuacuaugccacucacuaaaacuccauggucuuaaacaucuaaacuuuauucauaggagaaugguagcagaugcugucaguguuccuucuauauccccucagaucccuuuuccauuuucuugcacauggauacucccaacauccagcagauacgucuccguuggagggcugcucuuugccuacuuggagagaaagccaaaaaauacuuggaaauuuacuucccaccagcagcuguucuuaaccagugacucauuucucuuugcccuaauugggacgacauuuagauuggaccuacacugucccaaauuacccauaagccugagcgaaaguuacccuuuccugaguucuccacagggcuuugcuugaugucucacccuugcuuugcuuccuugccuucuaaucucauaacccacuacccuguggguuuucuuugagaacauuucccuguaauugacuuucacacugauguuuguuucagggucugcuucugaagcuuauuuuacacaaauccaauauguucagcauauagaaacagaaaauuagaagaagauaggaauguuucuagaagcaggcccaccuacagcagugagaagugagagcugauaaccauaauagcaagggaggaaacaaaacacuauaaaaagcaaacauaaauaauggaaaaacugcaucaaucuggggcuuaacugcccuucauuucucaguagucuccaaggucauuaccauauacaguguaauaaucaguguucauagugaugacucuaaauuacuaaagaaaauuaaauuuuuuuuuuugagacagagucuugcucugucgcccaggcuggagugcaguggcgcgaucucggcucacugcaagcuccgccuccuggguucacgccauucuccugccucagccucccaaguagcugggaguacaggcgcccgccaccacgccaggcuaauuuuuuuuuuuuuuuguauuuuuuaguagggacgggguuucacuguguuaaccaggaugaucucgaucuccuguccuugugauccgcccaccuuggccucccaaagugcugggauuacaggcgugagccaccaugcccagccaagaaaauuaaauuauauccagaaaaaagacauauccauguauaaugcauuuuaaaagcuuagcucaaaauaauauaagggauugaauacacauuugacagguuccucacaacaguccacuaaaauggcaguaaaagagugaagaaacuguauaaucccaugaaagcaaaaacagugcuaauaaugaaaguuuggaaaguagaacgcuaaguaccuguugugagguuguggguggaagguggcccugcccaagagguaaguuuauuuguacuucagagcucccauaaaacagaaaguaccaagcaucacucaaggccagguacagauaggagcuaaauaggggaaaguugguuaaaaaucuucuuaagccugggcaacauggugaaacccuuucucuacaaaaaauacaaaaauuagccaggcaugguggagugugccuguagucccggguauuggggagucugaggugggaggauggcuugaucccaggagguggagguugcaguuagccgcgauugcgccacuguacugcagccugggccgcagagugagacccugucucaaaaaaaaaaucuacuuaagcuuuuagaccugcucuacucugacagaagacuaguggucuguucuccagagcaguugaauaugaagcacuguugacuuagggauaccguguccagaugagaacagagcugccauguuuuaaagaggauucauuaaaagucuauauaccaaucacagagacuucuagcucccuuccuuaaguagccagacuuauuucucaucuccccuccuacccaaccccagccuuccaagaaggguaagauuccuuuccuuggaaaaccugaagaaaaacaauguaaauagcugguugggauauccuuuucuaaucaaccagaucucugcgcacccugagugcgcagagaaacccaaagcuugacagagcucagucuaugcccacagaaugucucaucuuuuuuaguacuuuacugucaaauaugaauggucagucaagaaaccagacgucugagaaaaacauaagcgcaaacagaaaaaaaaaaguaaauuggaaaacaaaauaaggagcagacgaacacuuaaaaaaaaacuuucguguuuucaagagaaauaagagauguugcauucuaugugacaguaaugagaggcccaaagaaaauucagagaaaaagagcuuuugggggaaaaaaaaaaaguagagauuuaaaauccagcaggggcugggcguggugguuuacaccuguaauccuuugggagcgcuuugggagcacuuugggaggccgagguggccaggucaccugaggucaggaguucaagaccagccuggccaacaugggaaaaccccaucucuacuaaaaaugcaaaaauuagccaggcgugguggcaggugccuauaaucccagcuacucgggaggcugagacagggagaauugcuugaacccaggaggcagaaguggcaguaagccaaaaucacgccacuacaguccaaccugggcaacagagcaacacuccgucucaaaaaaauaaauaaauaaaaaauaaaauccagcaggauuggccagccaccaugguucacaccuguaauccuagcacuucuggaggccaaggcagguggaucacgugaggucagcaguuugagaccggccuagccaacauugugaaacgcuuucucuacuaaaaauacaaaaauuagcugggcgugguggugggcaccuguaaucccagcaacgcgggagacugaagcacgagaauugcuugaacucaggagguggagguugcaaugagccaagauugcaucauugcacuccagccugggcgacaaagcgagacuguguuucaaaaaagugaggcugggcacguggcucacgccuguaaucccagcacuuugggaggcugaggcaggcggaugaccugaggucaggauuucgagaccagccugaccaacauggagaaaccccaucucuacuaaaaauacacaauuagccgggccuggugcugcaugccuguaaucccagcuacuugggaggcugaggcaagagaauugcuugaacccaggaggcggagguuguggugagccgagaucgcgccauugcacuccagccuggggaacacgagugaaacuccgucucaaaaaaaaaaaaaaaaaaaaacugaauugccaagaugagaguuaauuuuauucuaggaaauaaccaugcaggaggauuggaaaauacaaccauucuaaauuggaauaaaagggagaaggcucuaggagagauugcccuggaggaaaaauugaaauugauaguuuggggaugaguuaguaauaagcacucaggaaacacagagcaaacuaaaaaaaagaagaauuuauuagcuccagagaauuacaaaaaguuguacaagagaggaauuuuuuuuucuuuuuuucuuuuuuuuugaaacagagucucgcucugucacccaggcuggagugcaguggcaacgaucucggcucacugcaaccuccgccucccggguucaagcaguucucugccucagccucccgaguagcugugacuacaugugccugccaccaugcccggcuaauuuuuuuguauuuuuaguagagacgggguuuaaccaugugggccaggcuggucuugaacuccugaccucgugauccacccgccuuggccucccaaagugcugggauuauaggcgugagccaccgugcccagccauguuuucuuuuuuuaaauaccuuuauuucccuaguuauaaaauuaacaugucauuguagaaaaguuuuuaguagaaauguacaaagaauaaaagaaacgucaauaauucuggcacccagagaugaccuauuggacuauuuuguucguuucagucuccuuccccuuccuuucuuccucccuuccucccuaccuuccuucuuucuucccucuuucuuuuuuucuuuuuugagacagggucugguucugucgccuagguuggaggcagugaugaaaccucggcucacugcaaccucugccucccaggcucaagccauccucccaccucagccuuccaaguagcugggacuuacaggcgcgcagcaccgcaucuggcuaauuuuuguauuuuuuguagagaccugggaguugggguuguucaccauguugcccaggcuggucuccugaacuccugaguuuaaguaguuggcccaccucagccucccaaagcacugggauuacaggcgugauccaccaugcccagccucuuucuuucuuuuucucucccucucucuccuuuuucuuucuuaaagugaccuguccuuuauuaguggguaaucauaggagcuguuugguggggaggaaaaagggacaaauugaaaauagaaaaaaaaccaggguuacaaaacaaggggggauagagagaaagagguaaaacaaaaaacaaaaacaaggggccaggcgcuguggcucacaccuguaaucucagcacuuuggaagucugagacgggagaaucacuugagcucaggaguuugagaccagccugggcaacaaagugagaccccauacaaaaaauacaaaaaguuagccaggcauaguuucacgggccuuguagucccggccacuuagguggcugaggugggaggaucacuugagcccugggcugucuaggcugcagucagcugugauggcaccacuguacugcaaccugggugacagagcaagacccuguuucaaaaacaacaacaacaauaacaacaaagcaucaaguucaaacccugauuguuugcacucugaaaagagcacuucaugcaagaaaugggccuuucucccauuguccuuuguggguaguccuauauccagaucugcugugcuauaggaugggagaaaaggguugccacuucuuuuuuuuuuuuuuuccucugguauuugcugucagagaacccuaacugggaaucaauggacaagaaacagguuccgauagguggggguacuuuaugacacagauuuuuucucccaguuucuccaaauaucauuuucuguaagagauaaguuauauaaaaccaauuuuaaggucauuauuaaaagagcaccuuacugaaaaggguggcaucauucacauguauacuucuucaauucaaaaucauuuuuuucuguuccagcguuccuagaaucccaugggccuuugccaugacggaaguauguggcaugauucugugcuauauuuggcuccugguucuucuucuucacaagcacagguaccucauuacuccauuaaaugacugaaaauguuuugacuccuguaucaagaucauaaaaucuuaaccuuucucuuugcaguuuccuuguuaauuuccuucucuggucauugugacauaguuauuaacaaaggauuuugaguuugaucaguaagagucagccuaagauaauaucuacauauuuaguaauaauccugaaugcauuuugcacggaaagaucagagaugcccuauggcugaucgugcucaucucugaucuaaaaaaaagaggcugggcgcgguggcucaugccuguaaucccagcacuuugggaggccgaggcaggcggaucaccugagguuaggaguucgagaccagccugaccaacauggagaaaucccgucucuacuaaaaauacaaaauuaacugggcgugguggcgcaugccuauaaucccagcuacuugggaggcugaggcaggagaaucgcuuggaccccagggucggacauuguggugagcugagauaagaaagccuuuucuuuccuuagaaacaaacuggaaaaguuacuuucuguaggauagaaacucuuccaaggacauucuuuggucacauguuuagauggaagaaauuuucucugcuuugaggaggcccauuaaaaaagagauuauuggccgggcacgguggcucaugccuguaaucccagcacuuugggagggcaaggcaggcggaucacgaggucaggagauugagaccauccuggcuaacacggugaaacccugucucuacuaaaaauacaaaauauuagcugggcaugguggcgggugccuguagucccagcuaacuugggaggcugaggcaggagaauggcaugaacccaggaggcagagcuugcagugagccgagauugugccacugcacuccagccugggcgacagagugagacucugucucaaaaaaaaaaaaaaaagauuauuagccaggcacaguggcacaugccuguaaccccaguacuuuaggaggcugaggugggaggauugcuugagcccagguguucaagaccagccugggaaacaugaggagacccugucucuacaaaaaauuuaaagauuaaccaggugugguggcacaugccuauagucccagcuucucaggaggcugaggugggaggauugcuugagcccaggaggucaagguugcagugagcugugauugugccacugcacuccagcguggggugacagagccagacccugucuccaaaaaaaaaaaaaaaaaaaaagaaagauuauuuuguacaacauguacauauagucugugugguuuacuucagaugguaugggaaguugcuaaauuggaaagugugucuuggcacuuucaccaaaaaauauagacgaaagaauuuauuuacuuucauuuuauuuacuuuuacugcuucuuguggagcagggcuaacucacaggcaguguacccagagucagccaggaaaaauuuuuuaauuaaaaaaaggaagccuggggggcuccuuuccuaguuuaaugggcaggaagaauuaguggauuuaaguaaaaaacaaggcauuguaaacaaaaaauuuaaagauaaaauuaguagauauugcauaagagcuccugaggggcuuuuuaaaaaacuguagauaugugagcuuuugagauugcuuaaaaaaaaaaaaaauuguagcuucugcucuccauugucuuuggaacacuggagagaggaacaaggguaguugcuugagguuuugaccuuucuccucaccaggaagugcuugagguaaaccacagugaugagcuuuagguccuaagcagcaguuauuucaguguucugaaggugaaaagaaagguuggugguuacuauucuuaucauacuuuuaggccacauugagccauauucucucccauuuuguccuguuuugcagcaauauuuuaaauucuggauugcuuaaaaccagaggugguuuuaaaacauguguaucauugcugcuuucugguuaacuuugccucacaagaucucaugaacuugaauuuaucuacucuucaaaacuggaguuuaccuuacaggaaaccuugguagguuuaacaaagcauagagguaacccguuaaauccaaguguuaauguuuacuuagucaaagaaaguguuucucaaaguguuuguaccacuuucauuagaaucaccugggugcuuguuaaaaugcagauuccuagguuccaucucaggagugcacacuaaugcuugaaacauaccuagccuuguguucagugcuuucucugagggugggaggaucauuucaaaaauaugugauguauggucccuguccucaggaauauuaguccaacaguacugguguugucacagugcaguucaugauuacccaagugacaguuacucagaauuuuuauuugauauauacuugauauaaacauuuuuuuuaaaacauaguguuuuauagcuuaaguuuaaguuaagagaaguuagaaugaguauucgauagcuacuaucauuaacuaauuuacaguggguuuuuuuguuuuguuugagauagggucuugcccugucacccaggcuagagcacagugacaugaucauggcucacugcauccuugaccuccuaggcucaaucaguccucuccccucagccuaggacugcagauacacaccaacaugccugacuaauuuuuuauagacaagauguuacuguguugcccaggcuggucucaagcgauccuccuuccugccuuggucucccaaaguucugggauuauagacaugagccacugcaccuagccuacaguguuauuaaugagcaaaaaauucccuggaaucacagguguuuaacuuuaccuccuuuuuuuguuuuuuauuuuuauuuuuugagacaagucucauucuguaacccaagcuagagugcaguggcacaaucauagcuugcugcagccuccaacucccaggcccaagcaacccucccaccucagccucucaaguagcugggaucacaggugugcaccaccacauccagcucauuuuuaaauuauuuguagagaugaggucugguuauguugcccaagcuguugucaaacuuuuggacucaagcaauccucccaccuuggccucccaaagggcugcaauuacaagcaugagccaccauccucggccaacuuuaucucuuauaaauaauuuaagagcaauuuucaguaauaggacuaacaccaggcuuacuugucuucugucuuguauaacucuuuuacuuucuuuuagccauauuuucuuuuuuuuugagacggaguuucacuauuguugcccaggcuggagugcaauggcgcagucuuggcucacugcaaccuccaccucccggguucaagugauucuccugccucagccucucaaguagcugggauuacaggcacacaccaccacgccuggacucuuagccauauuuucuuaucagugaaaugaugcucuuagaaucuaauuuaggucuguauuguucauuauggcaaaauuuaaauuaacuaaaaugaaauaaaauuuaaaacucaguuccucagucauacuggccacauuucaaguccguaagauccacauaguauauaaauagcuucuuggacaguauauggaacauuuccgucauugcagagaauucuguuggacaacgaugcuuuugauggucuuuaagauuucuguccucuucaaagagucuagugauuuuucuguuugcucuuccuugaaguaaauauuugaugccugggguuuuuugguuuguuuucuucugaucuuucccccuuuuugguugaucuguuacaggucaauacuucugcgaaggcucuguagucugaugggaacuguauucuugcuucgcugcuuuaccauguuugugaccucccucuccgugccaggacaacaccugcaguguacuggaaagguagccugcuaccuucuuuaucauucuuguuuuugguggguugauggcacacuauaugcaauagggcuaagauuuugcuuauaguauuaaaaugugcuuuuuaguaucugcaaugucuauaaaaaaaacuauagaaauaauuugguaaaagucuuaagccagauucuaccucucucuuauuucuguugaaacucguucuaugcuauggagcuauagaaaacaaguuucuuucggccgggcgcaguggcucaugccuguaaucccagcacuuugggaggccgaggcgggcggaucaugaggucagaaguucaagaccagcugggccaagauggugaaacuccgucucuacuaaaaauacaaaaauuaguugggcgugguggugggcacuuguaaucccagcuacucaggaggcugaggcagagaauugcuugaacccgggagguggagguugcaaugagcugagaucgugccacugcacuccagccugggcaacagagcgagacuccaucucaaaaaaaaaaaaaaaaaaaaaaaaguuuuuauuuuggccgggcgcaguggcucaugccuguaaucccagcacuuugggaggccaagguggguggaucacgaggucaggaguuugagaccagccuggccaagaugguuaaaccccaucucuacuaaaaauacaaaaauuagccaggugcagugguggacgccuguaaucccagcuacucgggaggcugagguucaaucgcuugaaccugggaggcggagguuguagugagccgagaucgcaccacugcacucuagccugggcaacagagcaagacucugucucaaaaacaaagaaagaaagaaagaaagaaagaaaacaauuuucuuucaauuaucauuuucccuuucccaccauccuuagcauuuuaaaaguuucucauauggcaugcucugguuccuucacuguccuccucacuccuuuaaaaauguugccggccaggugcaguggcucacgccuguaaucccagcacuuugggaggccaaggcggguggaucaccugaggucaggaguuaaagacccagcguggccaacauggugcagucuacuaaaaauacagaaaauuaccuggucguggugacgggcaccuguaaucccagguacucggaaggcugaggcaugagagucacuugaacccaggaggcggagguugcagugagccaagauggcaccauuguacuccagccugggcaacaagagugaaucugcaucucaaaacaaaacaaacaaacaaacaaaaagaaaguugcaguuugacgacauacucagcacucuaaacuuuacucuuucugagauaaacaaaauaauggcugacuuuugguuuucauuuuauauuuuguggauuuguuuugguguacuguagacaucucuucucauuaaacagaagaaauuaugcagaugggaacaaaauaagacuguuaaaaucgccuguacuuuauauacaaaauuggcuaaaaucuguauacaaauuugcaaagaauuuuguccaaauuauauacaaauuuggacaaaagaacucuacuuuucuaggccucuaugcuuuaauucuguguucucacauauucaaauaaauguauguguuaacaccuuuguaauuauuuuaauguuguuuguaacagcauucacguucacuucuuguacugcaauaucauagcugaaaugccaacaagggaagauuaagcagccaaaggagaucaagagcuaaaaauauaccccugagcugaagggugacaaaacuuucuccugguauuaggaaggcuuagacugaccaguaagaaagggggaaggguugauaugacacaggauuucauguaaaggaaauguuuuauuuuuaagguaaaagcuguuuugaggucuuuuuuucuuuuuccaaaaaggaaaaguaauuuuuucaaauuauaaaauuauauguuuauuauaaaaauucaaauuauauagaaauguauauauuaaaaaguaaaaauucaccugauucuuuuuuaccacacccuauaaauaauacaguuaacaguuguguguauagccacacagaccauuuuuaagcauacuuacacacucauauaaguuuuuuuggguuuuuuuuuuuuuuuuuuuuugagguggagucuuucccagucgcccaggcuggaguaguguggcacagucuuggcucacugcaaccuccucuucccaaguucaagccauucuccugccucagccucccgaguagcugggaccaucacaccuggcuauuuuuuguauuuuuaguagagaugggguuucuccauguuggccaggcuggucucgaacuccugaccucaggugauccacccgccuuggccucccaaaguguugggauuacaggugugagccacagcgccuggcccucauauaaguuuucauagauacuuuugaaacaagguaggauuauauugcaaacauuguucuuuaaccuaguuuuccuuuucuuucuuucuuucuuuuucuuuuuuuuuuuuuuuuuuuuuuuugagauggagucucgcugugucacucaggcgggagugcaguggcacaaucucggcucacugcaaacucugccucccagguucaugccauucuccugccucagccucccgaguagcugggacuacaggcgcccgccaccaugcauggcuaauuuuuuuguauuuuuaguagagacgggguuucacuguguuagccaggauggucucgaucuccugaccucaugauccgcccgccuuggccucccaaagugcugagauuacaggcgugagccaucgcgcccagccucuuuagccuauuuuucauuuaauaguauguuguuuacuuuuuucugaagaaguacauguggucauauucaucuuuuuaacaguauuccauuguggauaccaggcuccaaaugauguacauuuugguuguuucaaaauuuuaguauuuauaaacagugcuauaguaaacauucuuguacauugugcuuuugcacuuacucaguuaucuccuuaagauaaauuauugcaaguaaaauuauagaauuaaaggacaugcacauuaaaaaauauaauaugggcuagacaagguggcucaugccuguaaucccagcacuuugggaguccaaggugggcggaucacuugaggccaggaguucaagaccaggcuggccaacaugaugaaaccccaucucuacuaaaaauacaaauaauuagcugggcaugguggcgggcaccuguaaucccagcuacucgggaggcugaggcagaagaaucacuugaaccugggaggcagaggcugcagugagcugagaucacaccacugcacuccagccugggugacagagcgagacuccaucucaaaaaaaaaaaaaaaagugguauguguugcugaaauacacacuugaaaagaugaguuuuucacuacugccaacauguaugcgugucagcuuucucacccucuugccagcagugccauucugauugaugaaagguaauaucuaaugcuuuuauguucuuauuuuuuuauauuuuacauguuuaauuuauuuugaauuuguuucugugcauggugugcgcaguuucuucaaaauaguaugcuguguacaugguaugaagcguuucacccaaauaguauucuaguugauuaggggagauuuuauuguauuuuagucauuguuuuuuuaagacagauucucgcuuugucacccaggcuagaguauaguguggcaugaucauagcucacugucagccuaaaauuccuggucucaggcaguccuccugcaucagccuucugaguagcugggaccacaggcacacgccaccacagccaacugauuuuuuuuuuuuuuuagacggagucuuucucugucgccccggcuagcgugcgguggugcgaucuuggcuuacugcauccuccaccuccuggguucaagggauucuccugucucagccucccaaguaacugggaucacaggcgccugccaccacacccagcuaauuuuuguauuuucaguagagaugggguuucaccaucuuggccaggcuggucuugaacuccugaccccaugauccaccugccucgaccuccgaaagugcugggauuacaggcgugagccaccgugccuggccuaauuuuaauuuuuuuuuuguagaaacaggauuucacuuugcugcucaggcuggucucgagcuccugacuucaagugcucuuuccaucuccaccucucaaaguguugggauuacaggcaugagccaccauaccuagccaggacagauuuuaaagaagaaaaauauaagcuuauuacacugaaaagagaaaauuuuccauagcuaagggauuuaauuguaggacagccacugaggagagggauauccgugcauagggcugcaacauaugcugcaaaaauaaauuagauaccauccuucuaugguauaaacagcccuuuuucugucucuaaugacuguuuuuaucaguugguuauauauagauauuucuacuccaaucugaccuaaauacuguuaauugcuuugaauuauaauauaaccuacuuauugacccguauuauuugcaguaauuguuauaaauagaaaucaaaucccuuacagugaauuccauaagguaguuucauuauaauaaauuaauugcuugaaauugcauuccuggaaguaagggguuugaggacagaaccaauaacaugccuauuuuugaaauuuagaaacacuuaaugcauauuucuacaccuucucuugucaaaacauccuauucauucugcuccguuguguuucaguuuuuauuuuuuggaaggauauaugagacauuuaagaugggaaaggauggagagauaacugccuuuugacuggcaucacuaguuuccuauccuugguugagacauuuuccuaccagucucuucuguuuauuuacuacaugauuuuuuacuuucucaagaguaauauaucucuaagcccguguucauagcgaucacagaagaaccaaacccauguguauuaucuuucuuucucucuaauaauaaauucuucuuccuuucuuucccucaaaugaggcagaaagggaaagcugggcaguguauaaucagcaggugagauuccuaaugagauugugauaucuaugagguuguuuauuuuggucauauuugauagaaucuuuaagacauagggcuuuggaauuggguucccuggguucacauccugacuguguuacuuacuagcuaugugaccucucuaagccaguuuccucaucugcacaauuaaaucacuucauaggauugcuguggaaauuaaaugcaguaacauauaaagcacuuagcagcaugccuugcacauaguaaauguacauaaaauuuuagcaccuuuuuguaccauuauuauguuauuauuaaauuguauuauuauaauaauacuaguaugccuuuuugugugugguuuuuguuguuguuguuguuuuuuugagacggagucucgcucugucgcccaggcuagaguguagucaggcuagagugcaguggcgcgaucucuguucacugcaagcuccaccuaccggguucacgccauucuucugccucagccucccgaguagcugggacugcaggugcccgccaccaagcccggcuaauuuuuuguauauuuaguagagaugggguuucaccguguuagccaggauggucucaaucuccugaccuugugauccacccaccucggccucccaaagugcugggauuacaggcgugagccaccgugccuggccucuuuuuuuuuuuuuuuuuuuuugagauggaguuuugcucuuguugcccaggcuggagugcaauggcacgauuucuacucaccacaaccuaccccucccgggaucaagagauuuuccugccucagucuccugaguagcugggauuacaggcaugugccaccaugcccagcuaauuuuuguacuuuuaguagagauggguuuuccauguuggucaggcugaucucgaacuccugaccucagaugauccacccaccucggccucucaaagugcugggauuauaggcgugagccaccgcacccugcaguaugcuuuuuuuuuuuaagugacugucccucuuuuguaaagcaguugucacucaaggucuuccucaaaauggacugcuuuuuuaggcguaugugugggaguugggauuagguuuggcuauugauaacuggaaauucaaaguggcuaugguuuaauaaacacacaaugguuuauucucucucaaaaaagagucugaagguagguacacaaggucugguaugauaauuuuacgaagucauccaaaaaaaccccauaauucuucugucuuucuggucugcuaucccaauacuuggcuuguauccucaaggccacuuugugguccaagaugguugcuggaguuucaccuccaguugaaugagucugaguuguagacuaaaaaaaggaaagguaaaaaguuagaaaagacuuccucaaaacuguugucucuuaccuugauaaguagccuucccagaaacccuuaacacuucuacuuagaucuuauuguacagaacuuagucacguggccacaccuagcuacaagggaggcugggaaaggcaauauuuuggcugaauucauugcugccucaauauauuugagauuguguuaccagugaagaaggggagaguggauguugaaagguagacauugaucuccgucugucauagccuaugucuuauuggcaagaauagccaagcaacuacuacugugauauuggauuaaaaacuuggagauguuuuuguauuauagagaacuuuuuauuauaaaggaacuccuaguaaaggaguucauguuacagugauuucauuuauuuauuuauuuauuuauuuauuuuuaauuaauuaaucaauuuuuuugagacagagucuuacugugucgcccaggcuggaguacaguggcgcgaucucggcucccugcaaccuccgccucccagguucaagugauucuccugccuuagccucccuaguagcugggauuauaggugugcaccaccaugccuggcuaauuuuuguauuuuuaguagaguugggguuucgccauguuggccaggcugauguugaacuccugacaucaggugauccacccaccucagccucccaaagugcugggauuacaggcaugagccacugugcccagucugauuucauuuaauuaccaaaauauuucugaguacagccaagcuuugcccacccauucuugaagucuggcuggaauucauuagacugaaggccuagaugcuuuggcuuagaucuuauuucuaaguuauucagcauuugaauuucaauaggaauggauguugggaaguucccaccucccuaagcauuugaagcacuaauucauaacuuuucuucauagauauauggcaguguaugggagaaauuacaucgagccuuugccauuuggaguggcuuugguaugacccugacuggcguucacacauguggagauuacauguuuaguggccacacagucguccuaacuaugcugaauuucuuugucaccgaauguaaguaucuuuuuagugcuucuaugcguauuagguaacuagcugcagugaaggcugugggaagggugucagauccugugaagaauggcaaaacagccugaccugagaaacgugacugagaagcauuggaaggaauguagcuuuaaaaugaucuuucuguccuuuuccuagauacaccaagaagcuggaauuucuugcacacuuuauccuggguucucaaccucuuuggaaucuucuucaucuuggcugcccaugaacauuauucuauugauguguuuauugcuuuuuauauaacaacaagacucuuuuuguacuaccauacucuggccaauaccagagcauaucagcagaguaggagagcaaggauuugguuucccauguucucuuuuuuugaaugcaauguuaauggcacaguaccuaaugaauauuguuggccauuuucaaaaccagcaauaaugaaaagacuaauuggaugaauacuaucuuucuaaugaauuugugauuaaauauauaauaguuguugaaaaugaguaacuuugcguucucccccuagguuguucuuagaugccuggcuuauguguugacaaaguaaaguuuucuguucugagcaaaguuaugauuauaaaaagcaagaaagaacaaucaagaguccuuauguagcuauuugaacagaaagcuuaaguagauguuuucugccccuucucuuuaggaagacuuaauguugugauugaagucaggcuguacccuuaccuguugaguauuugcuuauugaacuuuaaacaagucaacuugagcaguuugcugguugaggaauuuucauugauuuccaguagggcucuagucaagaaauaauauguuuugaagcuccuuauuaccuuuagaagaagaaacccuaacaagugacaguacuuguucuuuggacuaaucuuuguuucauuuuaaaaaaugcaacccugggacaugaucuguuuuacugacaaagaguuuuugccuucugaaccaucuuuaaauauacugagcauaccaggaugccugaaauaagaagagaaugaaagaggccauagaugacgugacagaguacuggcuaggaugccauuggucuccucauuaaugcaaauguagggcuggcauauuucaccaaagaugcaacaaaagaugcagugccagugugacccucagugaguauucaugagggaaaaauggcugcauccauaaaaauaaaugggcuuaauguuagugguauagguacccagaauaacuucuuugugcuauaguuguuagaugacaguucaauuuuaugcuuuuuuaaugguguuauuaaaugagccaaauaggaguguuuuaccagauguuagauaaaguucuuaaugccguuaaguagggagguaugcaugcaaagaauuguuuucuccugaaaagaaacuuacagcacgcaaaauauaacuuuuugguuuuugaaauuuaucauucuuggcuguuggaaguaaacagucucagacauacuuggauaugaaaaaguuucguuguuuuuuacuuuuaaauauaaugguguauauacauucuuucuauuuagucuuaauuuggcagucaggaagugauauaacuuagcugcuauuuacaacacuagaaauuuaguacuuuaaguaauuucacaucuaugauaacauuuguuacuuuauuuuuaaugauuuuuuuacaguaguuaugacaguaggaugguuauggaauuggaauuuaaacucccaacuaaugagcuuaagcugcuuggaauauuaauuauguaguuuuuacauuccauuuuaaaacaaaaacuuagaaaaggugcuggcauucugaggccugcaauuaggccacauagcagaagcuugcuccuuccuuaucugggugaaauauuuuauuuuugcacuuugagucauauucccaccccuguauaagcuacauaggagccugaaugaauuggguaggaaaggaaauuaugcaaacaagucucagcuagugcugaaugaccccaauuugggucugcugugaacaucauuuuuguauuucucacuugagaaaugcugcaaggcaauucaacuuuuaugcuuuuaaaucucacaacucagaaucugauaucuuaaaucacugauucuguuacaugcuaggaacaaaaugccaacaucucauguaaagaaguugcauaaucaugaaaaauaaaggauguuuccuaugccaguuagagugguuugacccuucagguaaaaagauauguuacuguuauuuuucuacgugacagaacagacugaauuuagcuagggaggcagugauguuggcuuuugggaaaggguucaaaaaacuguauggcaacauuaaugcuaaaauguuaagccgagugcaguggugcaaggcuauagucccagguucugaggaggcugaggcaggaggauugcuugaggccaggaguuagaaacuagaguguguuauaacgccuaugaauaaccacugcauuccagcccgggcaagguagcaagacccauucucuuaaaaacauggcugggugcaauggcucacgccuguaaucccagcacuuugggaggccaaggcaggcggauggcuugaggucaggaguucgagauuagccuggccaauauggugaaaccucaucucuacuaaaacuacaaaaauuagcugggcaugguggcacgcacuuguaaucccagcuacuugggagacugaggaacaagaaacacuugaacccaggagguggaguuugcauugagcugagaucacuccacugcacuccagccuaggugacagagugagacuccaucucaaaacgaaacaaaacaaaacaaaacaaauuagagugggugcagugucuaaugccuguaaucgcagcacuuugggaggcuaaggcaggaggaucacuugagcucagguaaaagagaccagccugggcaacaaagugagaccucauccccacaaaaaguuguuuagaaaauuagcugggcguggugaugcaugccuguggucccagcuacaugggaggcugaggcagaaggaucacuugagcccaaggagguugaggcuacagugagcuguaaucaugccacugcacuccagccuuggggacagagugagacccugccucaaucaaucaaucaaucaauaacaaaaacuuaaauagcuauuaaccucagucuucuuuccuucauauaaauucuauucuaagaccaaauagaaaaauaaauguaacuaacuuugcagagcuauugacauugagagaccuaacaacagacugcaauggggauuguaaaauaacuuuucagccuugcacuugcucauauauguuuugagaaaaauguaaguuagguauaacuuauuguuuuaacuauuauaaggcaguguuuacauaaauuaaucaucucuuucuuggaaaacauugagacaaauuuauuuucaguuuuacuuaaacaugaaaccuguauuuuaguugcuuuuuguuuuguccagaaauuuccagauuuugucuucauuuuuuuuccugguuaaaaucuaaaccauagugaagauaguauuuauguuuacauuuuaucugugaauguggcuaagcagagaagcuacauggcuuuggucuacauauuuuuugaccuuguauuugguucuguaguugcagacuugugaaggcuuacaucaucauggagacuuuaguaaggaaggaaccaaaagguuuuugguuuggggaugcaaacuggagguuauguuacaagucuucaaugcauuuucuguguuccuggcagcaguguugccuuuuuuuuucuuuuccuuuuuuuuuuuuaaagaccagguaggguaguguuauugaaggguaauugaagagugguagagaguaagagguuuugaaggaggcagguuugcuguuaucacaaaauaauuugggggaaaccuuucguggcugugcugcaagaauucuuuauguggcuauccucuccauaguuuucugaccagaauugcaagggcaaaaauagaacuucuagcucuauuuauuuguauccuuugaaaucagaacuuauccuuagaaccagucaguuaaauaaugcggacuaugccuauaaucccagcacuuuaggaggcugaggcaggcagaucacgaggucaggaguucgaggccagccuggccaauguggugaaacuccgucucuacuaaaaauacaaaaauuagccgggcgugguggugcacgcccaugccuguagucccagcuacucgggaggcugaggcagaagaaucgcuugaacccaggaggcggagguugcagugagccgagauacugccacuacacuucagucugggugacagagcgagacuccaucucaaaaaaacaaaacaaaauaaaauaauaaugugggcuauucagaagaaaaagucagugacagagagaccagaacccauuggaucaagagaccugcagggauuauaacucuuuacucugugagcagcgguguuucgugcccugucucugccuguguguuuuuacuaagaauuccagaaauccuguaauuuguaaaugggaaacagaggaaccagauuguuuuauagcugauaagaaacagucuguuuuagaaacaucuguuuggaaaguauuacucauguauucacaaagucauauuuauaacacuagucuucuuugacuguauucaacaaaaggcaguuucaccauuaauuucauaguaagcuuuuuuaaaggauucuagaucuaaauugccuaagaauguuaaccacauucuuguuuuaaacucucuaauuuaauaaauguaauuauuuuauagucuuuuauagacuuacauuuucuucauacuaaagguaaugauaauauagucauuugccaguacuuuaagguauucaggcauuugagacaagaaagcugucuuguagaauaguccaauugcuuucuuaaacaguacugguuucauuuagacaguuucuaagccagcaaaggugucaauuuuaaugccaacuugacaguuuaacaguuaguguuuguaagcaguuuagccugaauuaucccauacugcuguagaggagaauuguuaguaacaucaaaggucagaaugcuucaggugacuaauaagaauggaaagagacugaguagguuuuuuguuucuuuucccugucuuugaguaacuuugaaugacuaaaauuaguaugaaacuagguuuuggacccccuucucaccucacccggauguaaugccaccaauuucaaauaacuaaaaugugaccaauuacuuugcuucaaguucuauacaaauaucucugaaaucuguaagccauauuucagcuauucugguuuuuauaauacauucuacccuaaauuaaccaaaggacuuuuuauucaguguauuccauguuucagcauaaggaaaguuugugccugauauggcaggagaaagaacacuaugguaauuucauuguuacuucaggucucuuucaaucugaagaacuggguugucuggagaauugaacauagccaagcaauauuaucaauuaguaaugucaucuuaaaaauguucacuuuuacuaaguuuuauucagaggaucuauguauuauuagaaaaaugaaguauuucugacauggaacaaagaaaguggaaacugguacuuaaugggggaagcaaaauuagcugggacuaaaacggacauguuuuguuuugugaauucuaccuaaaugucucucuauccacagagaaacuaguauuacuugaagaugugaaaguuccugugguagccauaccuugaagcacaguguuuguacauaaguaaauaucuugauucuaaauuaaauccagauuuaacuaauauauauuauuuuauaucuuuguuguauuaaaauguuuaaaaacacuaaaaauaaaacauuugaaaguugga

SEQ ID NO: 192473 - RNA, 20908 nt, Homo sapiens
gcgguccccagcgcgcugccuccgccguuccccgcccccucgccucugaggcugcccggauagcugccugauccaaggcccagcagcuucugccuuccggauccccaccgacggacggaggcagcccaccugcaggaccggggcgcugucgguccacguggccgcucuggagcagguuggaguuggcagcgggcugcgcugcagggacaggcgcggcggacagccccgggggcagcggcgggguccugucugggagaggacaggguugcggcgggcggaacggugucuccuucacuucgcccuccagcugcuggagcugcagcccgaccgcgagcgugccaagcggcuucagcagcuagcggagcgguggcggcggccccccucaggacaccaccagguaccgccgcgcccgccucacgccgacccaggggccuaggccgcggcggccaagccggaggcccgcgccggacucggagucggcccuggcuuccuaagauggccgcgcugccccgcggccccucgccccucucugcccgggaucucccuuuggcccuuugaccccagcuuaccgcacuucuugucccucccgcagauuccccucuucccgcggccucgccauggcgacccacggacagacuugcgcgcgucguaaguaaagcugggaucucugcgggauggggcggcggagagucgaagccugucgaccagaaacccaguuuguuucccccuaucuuuccaagaacuuggaaauucggcugcuuuugguggucgccccaccgucugaccaccuccucugcggaggaggggcugggcugcuggauuucaaauggggaacaaggcccggggaguuggucuguggccgcauggacuuuucagccuuuguacaugucuuugacguauagaaguaaaaaguuguuaauuggggauucugccuuuggaggaucggaucaaucacuuuucuagaggaaguagcagucccucuugugagagcgcaaggucauuacuugugcuccuaagggcguggacgugcuuuguggaaugaaugagcugguguaaugagcucagauugccugcccuuaagcagcacagcauuggccgaggacuugagagucacauuaguaaguuugaagcgcuauuugauauuuaguugauguagacauuugagugaaacacacauggcaguauuuuuuccaaguuucaauauuuaaauucccaguauuaaauucucuucccacuccaggguguugguuuuccccucagcgaagauauuaaaggacguaucaggguaaagggccuagucuuagguuucgguuuuaucuaauuuaguuaaaucagcucaucucagugaauuuuggcagauacauaaauauccauacacacaaauacuuguuugauucuuuguacuuguccaguccuaggaagugaggcuguagguaauagacuguuuuuccguuuugaaacgaauuccccaaguuuguauaaucaugguuaucuguuuuagaaauaauucguuggugguaucuccuuuaugggucguuauaguucuauuguagcuccugaccgcauaaaaaacauuccaacaaaugggauugcuugaauuuuaauaucagcagugggucaugcucuuguucuuggauagaaggugggagaauagagacauuaacacuggaauguuuuuuuucuaccagcaauguguauuccuccaucauaugcugaccuuggcaaagcugccagagauauuuucaacaaaggauuugguaagaaccuuauuuuuaaaacguuuuagauaaagagugaaaauguauguuuggguugcuuagcgaaaucagaucaaucauugcaaauuguaaauaucuugcugcuuuaaauuuagaguuacuuauuuuuuugagacagggucucccucuguugcccaggcuggaugcaguggcaugauuauaccucacugcagccuggaccuccugggcucaagcgaucaucuuuccucagccucccacgucccaaguagcugggacuacaggcacgcucugccacaccuggcuaauuuuuuuuauuuuucguagagguggggucucacuguguuacccaguaaacacaguggccucucaaagccugguuggauuacguuacagacaugagccacugugcccagccuuguauuaauucuucuauuagaaacuuaagauacuuagauuaaacuuaugugaaaauaguucuuuuacagucuacaucccccucccccaauuucccaaaauuuuuaaaaacuguacuuagaagauuugagccuuuaagaaaaacggcucgugcuuuaauuuuuuuucaguuauagcuuaggcccugguugacuagaguuacgauauauuacuguuuugcuuuuguggugacuccuaauacuuuaucuagaguuaugagcuuuuucaggugaauuugaguuuucuugaaaauuuuguuccauacccuccuccccuuuauuuagacuguuggaaauaccccauuggcauaaauguccuaaaugucuguauuaugauaaguugguuuuguuuuuguuuuuuuuugagacggaaucucgcucuguugcccaggcuggaguacaggggcgugaucucggcucccugcagccucugccuccuggguuccagcaauucuccugccucagccucucugguaacugggauuacaggcacaugccaccaugcccagcuuuuuuuuuguauuuuuaguagagacgagguuucaccauguuggccaggcugguuuugaacuccugaucucaaguggucugccugccucgacuacccgaagugcuaggauuucaggcgugggccaccgcaccuggccauaucaugauaaguuauuagcuauucugaaauuucaguugaaugauuuuuuaaucugauauuuaaguuuaagaauaguuugggggcugggcgugguggcucacaccuguaaucccagcacuuugggaggccgaggcgggcagaucacgaggucaggagaucgagaccauccuagcuaacacggugaaaccccaucucuacuaaaaauacaaaaaauuagccaggcgugguggcacgcaccuguagucccaacuacucgggagacugaggcaggagaaucgcuugaacccaggagguggagguugcagugagcugagaucgugccacugcacuccagccugggcaacagagugagacuccgucucaaaauaaauaaauaaauaaauaaauaauuugaaagcauucuuuuguguaccaacuaccaaaaacuagacaaagcagcauagggauaauucugcccuuuauaagccaguuuacaaaagacgaauuuguaacaauuucauuuaaauauuguauauuaacacauuuuuauccaccucugaauauguggaaucuuuuuguuuuuuauguauagucaacaauugcuaugcaucuuucauacaaaggaaucauuuuguuucuuuugcugucuauuuguugaagguuuuggguuggugaaacuggaugugaaaacaaagucuugcaguggcguggugaguguuacuguugaauaaguucuauugaaccuuuauaauuuuucaacuuguaaaauggucauaacugaaagaugucuaccuguuuugucuuaaagaagaggcagaaguuaacuuuguuuuaagagauuugcguguaaccugauuuauuuuggccuugaaugugauuucugauuuucauguggucuuucgucauauuauguaugcacaaggaacuuaggaaagaccagucaggugguacucuuuacucguaagauuacacauuugaaggcagggaacccauuauuagacuuuuuuguaacccuuugucaacaaugcucgucagaguuaugggcauaaaaauaucaggaacucauuaauuugaguguacuaaucauuuauauaauguccauuuucuagcaguucucccuggagaagauuuccacauguauuuuaugaguuuagggaguccugaucugaauuuuuuuuuuuugagacggagucucacugugucacuuagacuggagugcaauggugugauuguggcucacugcaaccuccgccuccugaguucaggugauucucuugccucagccucucuaguagcuggaauuacaggugccugccaccacgccugacugauuuuuguauuuuuaguagagcugggguuucaccauguuggccaggcuggucuccaacuccugaccucaggugauccacccaccuuggccucccagagugcugggauuacaggugugagucaccaugcccagccaagaauauuuuuaaagagguuaauauuuugguauuugggugucuugauaguucaaugaacuguuuacaaaggggauaaacuaauauuuaacuuuuuucgagacagggucucacucgguugcccaggcuggagugcagugagugcaguggcacaaucucagcucacugcagccucgaccucuugggcucaagcaaucuucccaccucagccucccaagcaucugggaguacaggccguauccaucaugccugaguauuuuuuguaguuuuucuagagaugacguuuugccauguugcccaggcuagucuugaacuccugagcucaagugauccacuugccuuggccucccaaagugcugggauuacagaugugagccaccaugcccagcuaguaaaauuuaacuuugugaaauuuuuuuuacuuaaaaaauuuuuguuuugagauuauuuuaggggugggugugugugcacauuagaauacuauagguuauuuugauauauguauguauguauauauauagagagagagagacuuuuuuuuuuuuugagacggagucuugcacugucacccaggcuggagugcaguggcaugaucucagcucacugcaagcuccaccucccagguucaugccuuucuccugccucagccucaugaguagcugaaacuacagacacgggccaccacgcccagcuaauuuuuuuguauuuuuaguagagaugggguuucaccauguuagccaggauggucucaaucuccugaccucaugaucugcccaccucgggcucccaaagugcugggauuacaggcgugagccaccgcgcccggccuauauagacauuuuugauguagugcauguaacugauauuuauuuaaucguauuguaguuuuuuuguuuuguuuuuuuuuuuuuccucugagacgcagucuugcucugucgcccaggcuggagugcaguggcaugaucucagcucacugcauccuccaccucccagguucaagugauucuccggccucagccucccaaguagcugggauuacaggugcuugccaccaugccccgcuaauuuuuguauuuuuaguagaaacaggguuuugccauguuggccagucuggucuuaaacuccugaccucaagugaucccaaaguguugggauuacaggcgugagccacagcgcuagcccuguaguuuaaaagccuaggccuguuggauuucuggggauuuacauugaucauaucugucgcuugguuuuuuuggucugaaaggaagcuuagguguuuaguuaugauuggaugacuuauuuggccaaguuaacagguuacagagcagugauuuuuaguguuuuuuaauguucccauuguuagucuauugaggccccuaguguauuuguugaaacacaaaaggccuucuaaaaaagauucaguccuuguguuuaaaaagcuuacuuucuaguuggagagacaaaauaaacugagaguacugagguaauuaauaucaaauauuagaucguuggauaaucaaaucuuuguuggaaaggaauagauuguuguguauaggguuagggaaaguuuuauggaaguagguuuaagagcaugaaggauauguaggagcuggauuagauauagcauguuuuuauucacauuuaauacauguaacucaacaaccaugguauugauccuauaguaugucucuggccccagauaagucccauuaauaccuggcucuguuuucuuaccugaacagcaaagcuacugaagccaccccagaauguagaagccaaaauuucuggugguaaaggguaugagcuguaaucuggcccaacucuggucccacagggugguguuggcuuuguuucuugaggcuuccuuggcauguguauauaggcuggcucuugaucugugggcugaugaauggccguagguggggccccaagagucauuaaugucauucaggauuaaaaauagcuacucacacauuccccauucaaacugcuagaaaaaccuguuccauauauauuguuuuaguaaugcuuuccuuuucuguggagcauaugaaaacguacaaacuuucacagugucaguucaauuuaaucauucggagguaggcuuuguaauuauaguugcagaaacagacccaaaaaaguuaagugaggcuggucacaguggcucauuccuguaaucccagcgcuuugggaggccaaggcaggaggaucccuugagcccaggaguucugagacucaccugggcaacauagugagaccccgucucuacaaaaaaauuuaaaaauuagcugugcuuguugguggguaccugaagucccagcuacuugggaggcugagauaggaggaucgcuugagcccaggaguuugaggcugcagugagcuaugacuguggcacuguacuccaaccugggcgacagagugagacccugucuccaaaaaaaaccgcaaaauguuguguccugcucagugugaugcauuuaguaaaugacacgaagaacuggacaucagaacuccuaauuuuuauaucuaguguuuccuaacaugauccagugcuuuuuuguuuaauuggaaauggagucucacucacuccaucacucaagcuagagugcaguggugccaucuuggcucacugcaaccucagguucucagguucaagugauuuuccugccucagacuccugaguagcugggauuacagggaugcaccaccaugcccggcuaauuuuuguauguuuaguagagacgggguuucaccauguuggcuaggcuggucucaaacucccuaccucaagugaucggcccgccuuggccuccugaagugcugggauuacaggugugacccaccacacccagccaguccagugcuuuuuaguauagguauugagggcuaugcuuugacuugaaauuccuguuaaugaaagggucuaauuuaggagagugauguaagaccuaaggauuugucucuaacagcagagcaauaguuauacaaauguucuauuuucugagagaagguugacuggccuuuccuccuauugauacaauuuuugauauuucucacucuacagauaucacaauuucuggcuguagucucuuuauuauuuucacaucagcugucuuccuuaggcuuggcguggugaugcuugugaucccagcuacucaggaggcugagguacguggaucacuugagccugggagguugaggcugcagucagcugugaucacaucauuguguuccagcuugggugacagaggcaagaugcugucucaaaaaaaaaaaaaaaauucagauaagcccuccguauuuuuucuuuuucaguucgugugcaaccagggauuggcacauuauuauuuuuagacagggucucacugugucacccaugcugagugcaguggugggauuauggcucacugcagccuggaccucccaggcucaagcaguccucccaccucugccuccugaguagcugggacuacaggcgcacaccaccacgcugagcugguuucuuaauuuuuguagagacauggucuugcuauguugcccaggcugguaucuaagugcugggaucacaggcaugagccaccacacucagucccccauugauuuuugaaucccaaauaaaaucaccuuagcaaaaccuuccuuaaaagauguacaguuagcuggggugguggcuuacguuuguaaucccaacacuuugggaggccgagguggguggaucaccugaggucaggaguuggagaccagccugaccaacauggugaaacuccaucuguacuaaaaauacaaaaaucagcugggugugguggcgggcaccuguaaucccagcuacuuggaaggcugaggcaggagaaucacuugaaccuggaaggcggagguugcaguaugccgagaucacgccacugcacuccagccuggcgauagagcgggacucugucucaaaaaaaaaaaaagguguacaguuuguucacuugagaauucacuacagguuaacuugugauugauuggaagugucagcuguguauguaaaguggcagucaguugcucaaaggcuuauuugucacucuuauauaugcuuagagaguagcacagugcagaaggauacgaguguuuaggaagcuagaaaaaggauucaugaauuuaccaaauguuucaggggguuugugugugugugcguguguaaggcagugaugaauucuaggcuuaugagaauguucaugaaguuauugauugucuuguuaggaauuuucaacguccgguucaucuaauacagacacugguaaaguuacugggaccuuggagaccaaauacaaguggugugaguauggucugacuuucacagaaaaguggaacacugauaacacucugggaacagaaaucgcaauugaagaccagguaacauuuugaaaauuuuaguauuaauuuuauuaauuuauuuuuguauuucaaaaaaagaaaacaaauuacuuuucuuucaaaauagauuugucaagguuugaaacugacauuugauacuaccuucucaccaaacacaggguaagcacagacauuuuuaucuguauuacauuuaaaaguauuucucuuuuguauauuuagaaaagguguacauuuacuguuugauagcuuauuaagcuaccuugugguggugaaaucucuguaucugcuuuuauuuauuuauuugagauggagucuuugcugugucacccaggcuggagugcaguggcaucaucuuggcucacugcagucucagcuuccuggguucaagcgauucuucugccucugccucccugaguagcugggacuacaggugcgugccaccacgcccagcuaauuuuuguauuuuuaguagaggcgggguuucgccauguuggccaggcuguccuggaacuccugaccucaggugaucugcccaccuuggccucccagaguggugggauuacaggcaugagccaccacgcccagccuuuuuuuuuuuuuccauauuuuauuuuauuguauuuauuuuauuuuauuuuauuuucauuugggacagagucuuacucugucacacaggcuggagugcaguggcgcgaucucggcucacugcaaccucugccucccggguuuaagugauucuccugccucagccuccugaguagcugggaucacaggcaugugccaccacgcccaccuaauuuuuguauuuuugguagagacaggguuucaccguguugaucaggcuggucuugaacuccugaccucgugaucugcccaccucagccucccaaagugcugggauuacaggugugagccaccgcucgcagccuguuuguuuauucucugucacccaggcuggagugcaauggugcgaucuuggcucacugcaaccucugccuccuggguugaagcgauucuccugccucagccuccugaguagcugggauuacaggcauaugccaccgugccuggcuaaauuuuuuuguauuuuuaguagagacgggauuucaccaugcuggccaggcugaucuuaaacuccugaccucaggugauccgcccgccucagccucccaaagugcugagauuacaggcgggagccaccaugccuggcccauaucugcuuuuagaauacuaugguugcuaucauuggcuugccuucaaauauuugccucuuuguuguugcacuaacuugggcaacuaauguguuucuaacaggcuuuugugacugauuguuuguucugcaaagcaguuuuccuagauggcuguccaguugcuucauguguccuugucuuguaguucauugagcugacuuuuuuacucccuguuauuguauugcugauuuuuacucccuggucauacugcaguuuauuuaagucuguuuugugcucucuugugcagaaguguguguaaauuuuucccaaugacaucaguuuguucuuuuuccagaaagaaaagugguaaaaucaagucuucuuacaagagggaguguauaaaccuugguugugauguugacuuugauuuugcuggaccugcaauccaugguucagcugucuuugguuaugagggcuggcuugcuggcuaccagaugaccuuugacagugccaaaucaaagcugacaaggaauaacuuugcagugggcuacaggacuggggacuuccagcuacacacuaauguguaaguauuucuuucauaggauacugugaugugggcccucagaggaugauuuugaugucugucaucuuauugaucugggugcacccuaaaggauuucucauaacauuuaaaaacaaaaucauucuuggucauuucuagggugccccuugaaaguuuauaguagaagacuguuagucugaccuuuggugcugagagaguaaauguucauuuuauaugggguuuaaugugcuuuguauuuuuacaagaggcauuauauauuggcagacugcuaccaguacauucauuuuacuuaauuauuuugaugugugagaugcugacuugauaggauugccuaaaauguaugguguuuugugguuggguuuuuuuuucuuuuucuuuuuucuuucuuuuuuuguuuugguucagacagagucuugcucuuuugcgaucucggcucacuccaacauccgccucccggguucaaacaauucuccugccucaaccucccaaguagcugggacuacaggcgugugccaccaugccuggcuaauuuuuguauuuuugguagagacgggguuucaccaugcuggcaaggcuggucuggaacuccugaccucgugaucugccaaagugcugggauuacaggcgugagccacugugcccggcuauuguuguuuuuuuguuuguuuguuuuuaauuauuuuuguagagauggggucuugcuauguugcccaggcuugucucaaacuccuggccucaagcgauccucccgccucagccuuccaaaguguugggauuauaggcgugagccacugcauccagccugguguuuuuaccuagcccaaacuagauagauacauagaaaguacuuaaaauguuuuucuuuccauuguaaaaauucauugguaaauaacagaagcacaaagaagaaaaccuacguuucuuacaaucaugccagcuagguauauaaucuuuguuaauguugugguucaccuuuuuauauguguguguauauauacuuauauauaaaauacguaaccaaaaggcuguuugagaaccucuugcauguuuaauacagugugauaauuccacugaauggauauucugugguucauuuuaccaaucccuguauggguauggguuggggaaaaaaaccuguuaaaacuugcaaguuuucaguggaacacuaaagacccacuugagcugugguuuuuuauuuaaauguaaugcuacaaaucagccugugccuuagacauuauuacauugucuauucuagaucuacuaauuuaaaauaucuuauagcaaugaugggacagaauuuggaggaucaauuuaucagaaaguuugugaagaucuugacacuucaguaaaccuugcuuggacaucagguaccaacugcacucguuuuggcauugcagcuaaauaucaguuggaucccacugcuuccauuucugugaguacuuuuguggacuuagaauggggguuuugguugugggaaugagucuuuggguauacugaauuauguugaaaauuugaacugauuucacacaguccccaguuuacagauagauuaguuuuagauuuugaaaugcgcuuuuuugauggauacaguguuagacguuuuauuuccaggccaggcugguggaguuuguuuaaccucaaaagcugccgaguuaauguugaugauaaccuugagccauaggccugucuaaguccagguauagcugguguuuggucccugagugguucuuacugugucagaaauaauagugcuuuuuuaaggcucucuguugucgaggcuggacugcaguggcacaaucacgacucccggcaccuugacauccuggguucaaccucagccuccuacuauucccaacuaauuuuuugauguuuuuuuguagagaugggaucuccauauguugcccauccuaggcucaagcuaucauccugucucagccucccaaaggaggcuguugggauuauaggcaugagccacugcaccuggcuaguauuuuaaucaucacuuugucuuuuuuuuuuuuuuuucuuuuuugagauggagucucugucgcccgggcuggggugcaguagugcgaucuuggcucacugcaaccuccgccuccuggguucaagcagcucuucugccucagccuccugaguagcugagauuacaggugcccgccaccacaccuggcuaauuuuuuuguauuuuuuaguaaagaugggauuuguuggccagacuggucucaaacuccugaccccaagugauccacccgccucagccucccaaagugcugggauuacaggcaugagacaccacagcuggccgccuucuccauuucuaauugcacuacagcaauaaaaaccucaagauucauacaguacacuauucuguuacuuacauugauguucuuggaugucuguggcauuuuaacagauuuaauguaaguggaagaagcuucucucagcuacuaggaguucauaguuaaaaugggaaggcagcuugggaccccugugucauuuaaugacuccugggaauuaguuuggaaauguaccuagccuuucccacuucaguaauguuagcugccacuccaauucagcaguacccagaagcauugcuuaaugcuccuugugauauuaggaaguauauauuugguucuccuucccucuccuggcauagaacuccuaaaaaauccuuggaaucccgaaaguauuaaguaucuuuuuguaugcuaaugaguuuugacugguggcuggccaccuuuagguagcuucgggcuggaggcuagucaguggagagaccaaggugugauuagaggggguggggagaggggcuguagguuuaauuguucaccaauggcuagugguuuaaucagucaugccuguauaaugaagccucaugaaaacccacaaggacagaggucagugagcuagguagcugagguuacuggaagguggcaugucuggagagggcauugaagcugugucccuuccuauguuuugcacuguacaucucuucaucuguauccuuuguaauauccuuuauuaaaacugguaaauguaaauaaaguguuucuugaguucugugaccugcucuaggagauuaauugaacccaagaaggggcuugugggaaccucuguuuagaggugccaggucagaagcagaguuaaaacaaccuggggcuugcaguuggcaucugaagugggaggagggcagucuugugggacuaagcccuuaaccuguggcaucugaugucuccagguagaauuagaggacauuuagccagugucugcugcagaaauuauugcuugcuuggugugugaggaaagcccucacacauguggucacagaagcauucuguguugugagagaauaguaggagaaacugaguugguuuuuuucuguauccucagaauugaugucaggauugggauuugcuagaguggcucuagcuagaguggcucaucgaagcaugguuuaggaagaaaaaggauaaauggaugggaaaugaggaacuuuugacuccuggguggucagauggucaccccugcuauggagccacaacugugcugugcucagguacuuaaaaauuaccaguggaauucaaagauagauccaacuccaagggaguugguucacugggugcauaaggaaacgcaaacaauaagaaacaaacaaaauauacaaucccuugauuauuguuauuugugauagcuaaaaucaaagugaaagagugcuggauuguaccuugaugcuagaccaagcucagguuucauuugguuuaagccuuggccaccagccucaaagccaccuugcaaggguaaaaaguaccccuaagaccuguauuugcuguauuuugcccaguuuggagaaauuuaaaaagucagaaguuagagauuacauugagaaaugugaucugaaauugccuggggcaguagucaggcuuauuaaucaagauaaaggcugacaaauggggaaggguagauuucuguuggaaaggcaaagcaaauaucucuaauucuuacugaucuguaacgaaacugauuuuuuuuguaccaugcucauacugccauaugguaauauuguuggcagauuaaacucccuuguguaaauaagucuuauaauacugauugaugauuauauguauugugaaauugaguugaagccuccucaggauauaauaccuauggaaagugacuggccugaggaggaacuggaucucacuaucagcugauuuccauccugaauaguucugcacaagguacaaauaacaguagaucaagggaaaagaaagcugguacaagaugauaaagauguuucuaauggcuucugucaaccuaaaggaagaaacuaaggcacaaaauacaauuuuaaagaauuuauuugcaccauaaugaggacagcugcccagcagacucagauccaaguggauuugagcuccauuuggcccuuguuacaaacagguuuuuaaaggccaaaaauucgggacaggaugugggcugauacaaaguuguuuggcaggaauucucuuugguuuacagaaauaacauugauuagugauuggcuauacauuguucuuuguaucacagauuccaggaacaugaagauaaugggugagggucacauugugcaguaacacuuuagauauuugccagcgagccuggaaacuacaaggaaggaaaaaaagaacaaaguguuuuuaaacaauuuccccuaggcauggggguguguccugugacuaaagucucauucucaugucucucugggccugauaaacuuugcauaccucacauuccucauacugcugagcuauuuuuuuuucucuucauaggaccgaguagguuuuuuuuguuuuguuuuguuuuguuuugagacggagucauccaggcuggagugcaguggcgugaucucggcucacugcaaccuccaccuccuggguucaagccauucuugugccucagucuccugaguagcugggauuauaggugcccacuaccacacucggcuaauuuuuguauuuuuaguagagaugagguuucgccguguuggccaggcuggucucaaacuccugaccucugguaauccgcccgccucagccucccaaagugcugagauuacaggugugagccacugcgcccauccuaguugcuucuuuaaaccuaucccuaucccacaguagcuucuccagaugauaggcauauuuguguuuguacucuuguagauaugucuguuauauaaaugcaacaaguguaaacauccuugacagauauauggaccuuuuugcuguaagggaucccuguuugaaaccaggggguggccuaugauacuaugguguauauauuuugguuuuugucaaguuccuggcucacagcuucuauaacccuugcaauuucccaagugacuagagccguaagaguguauuuuguugagauauuuggccauuuguccucgguuccugaaacagcuccagagcauaaaagugaaagacagucuuuuguggguuuuuuuuuuuuuuuuuuuuuuuaaugaaaucucacugucauccaggcuggauggaguacaguggcaccaucucugcucacugcaaccucaaccuccgccucucggguucaagcaguucucgugccucagccuacuuaguagcuggguuuggaggugccugccaccaagcccgacuaauuuuuguauuuuuaguagaaaugagguuucaccguguuggccaggugggucuccaaccccugaccucaggugauccacuugccuuggcucccaaagugccgggguaacaggaacgagccacugcgcccugggcuauguuguuauuuuuaacaggccucuuucaaccacaucugaacuuauguuaaugaggugauuuuuggauagucccuagauggccacaugguagggggugcugguugcuagggaacaaaccuucugccuuggggagggcauaguagcuaaagguugagccaguggccagugauuuaauuaaucgugccuuuguaaugaagucuccuuuguaaugaagucucuguaaaaacccaaaggacugaguccagggggccuucaggaagguaaacaauaauacauucaugucaugggaggguggggcaccccagcuccacagggauggaagcuccugugcuugggacccuucaagaccucaccuauaaaggaaaagauauauaaguaucuuuucaucuggcuguucauuuauauccuuuaaaauauccuauauaacugguaaauguguuagucccugaguucugugugccacccuaggaaauuacuugaaccccaggggguugugggaaccccaguuuauaaccagucuguaagaagcagaggcaaaagaaccuggagcuuucaguuagcauugaaaaugagggcggggcaguuuuaugaaacugagcccugaaccugugugauccgaugcucucucuccagguagauaguaucagaauugaauuagagaacaucuagcuggagucugcugcagaaucguuugcuugaugugugggaaauucucccuaggccuuaugagaguauagagggagaaacugaguuuauuuuuucuacuccuuaucacaguuucaugguuuaacucuuacuguuaaauaauaggaauuuuuuuuuuuuuuuuuuuuuggagacagagucucacuuuguuacccuggcuggagugcaguggugcgaucucugcucugcucacugcaaccucugccacccggauucaagugauucuccugccuuagcaccccgaguagcugggauuacaggcgccugccaccgugccuggcuaauuuuuguaguuuuaguagagacgggguuucaccaucuuggccaggcuggucuugaacuccugaccuugugauccucccaaagugcugggauuacaggcaugagccacccagcccggccaauaaugggaauuucuuucuuucuuucuuuuuuuuuuuuuugaggcggagucucgcucaguagcccaggcuggagugcaguggcaagaucuccacucacugcaaccuccgccucccggguucacgccuuucuccugccuuagccucccgaguagcugggacuauaggugcccaccaccacgcccggcuaauuuuuuguauuuuuaguagagacgggguuucaccguguuagccaggauggucucgauuuccugaccuugugguccgccugccucggccucccaaagugcugggauuacaggcgugagccacugcgccuggccaauaauaggaaugucuauccagcugucugaggcucuuauuuguaggguacaagauggucauuagugagguauuuuucuuucuuuuuuuuuuuuugagcuuuguugccuaggcuguaguucacuggugcaaucacagcucacugugcccucagccaccugggcuugagauccuuccacucaccccccacuucccugguaguuggguaggugugcaccaucauaccaagcuaggaaaauuuuguacagacagacaggggucucaccguguugcccaggcuguugaauuccugggcucaagugguccucccgccuuggccucccaaagugcagggauuacuggugucagccacugcgccaggccuguuuuuuucuuuagauggucauugguagcucaugaauauuuggcuguagugccaagugaauacagguguuuuggaugugguuugugucuguauaguuacaucauuucuuucucuggauugggcucuuuggauguuacacauuauaagaguauagacaucgaaucauuuggagaucuguuuuggucacauagucuguuuguuaccuuuauauuguagcccucagaaugcugaaagcaaagcaaaguugcaugucuaggcaaccuaggcccuggaaaugaaggcagguguuccuggccucuggugugucuucauaauguuaggggugguagagaauggagcuagaaagaaucuacucuuuacuaugucuuacucuucaggguucauuccagcccuugaagucgguaacuaaguccuaaaauguugggauugugcaaggaaggcaggggccuggauugguacaugauaccucacugggaccuccucccaaacgcagugguuacauacagccagaacucagcagcaccggcauuuaugagagguguaagaaugugaggauaaaggauuguuugaucugauucuucagaggaauuacuugucguuuggagauuuuuuuuuuuuuuuuaaacauucaugguuuugauucuuuaggaagaguccuggaaguaguaauguguguaacuaagucaugaauuuaaacuuuauacccugugcuuuaaggcugcugugugucaccucuagugagccugacuuguaccacauuuuggucugguuuguugugcuagacuagaauuaacaaagaugauuuuuaugagagugcuuaggcuuuugugcuguauggacaguuuggggucuuuggauacauuccaguggcuaucaagaguauuguguccuacugagaauuugauuuuugaguugaauggauacgaauuaaauaguaccugguuuguuuggcuuaauacauaauauugaauuuuauugucucacgugaauaaaacugaacacuucaugauuacaugauggggaaacauguaggggcuuugucucuauugaaauauuuuucuuacaguuguuuuuguauuuuauuuuaggcaaaagucaacaacucuagcuuaauuggaguaggcuauacucagacucugaggccugguaaguauucuugauaaaguaggauuguuuugauaguauuaaaaaauuuaguuuucauucuucagcuuacuuuucagaccuuucaagcacacagaagaguugaaagaagaguacaauaaauacguguuuaccuuuuaccacaauuuuuuauuucuuuuucuuugcuuuuuuuuuuuuugcugggccauuuggucaugacacuucucuucagaauaaggcccgucucuucuuuucugcauaacuauaauacuaucacaccuaagaaaguuagugauuccuuauuauuuaauacccacuuccugucaguuuccucgcuuguaucugaaauguuuuguaguaauuuuuauuuuguugaucaaaguucacucauugcuuugguucugccuauagucuuguugacuuuauauaauauuuugaagcgugcugugucuagaacagcgcuucuccaacuucagagugcacaugacucaucuuggaaucugcuuaaaguacuggagacuucccccuucagauagggauuuuccuccccaaaguuuauuuuggugauuuugaaaccuaaagaaaaguuggaagaaugguacaaugaacaucauauguccuuaccuugcauugaccaauuauuaacaauuuauuaacaauuauuaacauuuacuacauuuauuuuaugucugaaacuucacauacuuuuaaaaaaauguauguuuugcagacauacagacauggcagccccuagcauguguauccuaagaguaagacauuuuucuuuauaagcacaauaccauugucgcaucuaagaaaacuaacauuaauguaauaccaaauacauauucagauuuacccccguucccaaaugugucuuuauuguagguuuuccuuucuaggaucgaauuaugauuaugucuuuagucucuuuucaucgggauaguauacucaacauuauaguauauucuagaacacuuugaaguuguuauuaaaacauuucucugugacuuggugccuuagcuagaaugguaacccaguucuucuggugucucagauacuuccaagcgcccucugguggccagcacuaguaggucagcugacaggcugaggaagugacaggcaggcucuggggaugacugugaaagaaggcccagacugagugacgugccagguacaucacgguuuuuuguuuuuguguuuuuuugucuuaauaggugugaagcuuacacucucugcucugguagaugggaagagcauuaaugcuggaggccacaagguugggcucgcccuggaguuggaggcuuaauccagcugaaagaaaccuuugggaauggauaucagaagauuuggccuuaauauauuuccauugugaccagcagcaggcuuuuuucccccaagaagaugaucaaaacaaaggaugaucucaacaagagcuguauuuuaaguauuuagacaguucuuuguuagcugguuucuaguugguuaucuaguuaccaaugcugcaguccugcagucaccuauacauuauuuaaauguauuuaacuguuaaaugcgcuacccaccaauaaugaaauagaccuuuaugaaaacugugcaauugugugcauguuuguuuuuauguuccuuuagaaaacauugacuguuaccauugaaugagauggaucaguggauauuaagaugagguuacaaauuuuguuaaguucagccauuauuacuuuugguaucccagaacaugacaaauuaugaauaaaacaaguauacauaau

SEQ ID NO: 192474 - RNA, 50449 nt, Homo sapiens
gcacugccucuggcaccuggggcagccgcgcccgcggaguuuuccgcccggcgcugacggcugcugcgcccgcggcuccccagugccccgagugccccgcgggccccgcgagcgggagugggacccagccccuaggcagaacccaggcgccgcgcccgggacgcccgcggagagagccacucccgcccacgucccauuucgccccucgcguccggaguccccguggccaggugagugagggucccgagccggcugggggccugggaccaggcggcggcagugcaccgcggcgccgcgggugaggcccggggcugccuggcgcccagcccagcgcggcccugcggcuuccugguugcacuacaggcguggggguggggggcaggggagggcgucggcgggucgcgggcgggccgugucggccuggcagcccccuagaucagccucggcgucuggggcugcucccucauguguggucggggugcacucgccguccccccgggcucaggggucggggucucagucugggccuggguagggccaggggccgugacccugggcgcaggaggcaacggguggcgggaggggugccggaggcccggccccgcagcccugcggagcccuccagggugcgcgcgcccuucuaggcgaggcuuggggagauuaagcagagaaggcuaucuucaggaacuuuccuccgaaacugggagcacgcacauuccugggagcugcuaccauugcaguuuauuuguaaggaacucuccccaguguuugagggaaugcgggagccaucccaggugcugugcgugccuucgccccuuccccaaccuugauccccaguuucaggaagggauuccuggacuuguaucucccaugggugcaggccaggcccuuaagacuuagguaaaauggucuguugguuuaaaggagacacgcgaaguuuguuaccuagagacuuuggaggggaaaaguuaagccagccagugcuagcccaagcuggaaacagucagcccggggcauuucugucucugcccuccaauccuugaccucucuguagagauucggcguuugugguagcucuccccucuguucucugcgcugggcauggaguggagcugugaggccgagccccugcccugcccugcccugcccugcccacgcaacagggacuagguuugcagggcagggccugguaugcucacccuucacuggcucucauugcuuuccucauuccuuuuaugcggcagucaauuguuggggauuccaggggauuaacagggccccuuuccucaaggcauucuuugugcugcaagguguucccugauaagagaggccaggugaggugccagggcaguuuguugcccuggcauugggugcccacuacuucaggcuccugcauaccuugcuaucuuuucuuugacuauugucugugcuuugguuuuucaucuguaaaauggggguaauaguaaucccugccucacaggcuugugagauucagugcauucauuuauuuaauaacaauacagagcucagguacggaccagucagaacagguggugacugcugcaccacacuuguguaucccagaugggugucacccacauuagccauaaagugugugaggcaggccugggucauaaauaaucagguguaagggucaauaaauaguagcaguggaagguucagcuaaaguugaaaugcacuucuccugaaccgucuuucuggcuuagcucaugcuaagcucaugcucucugucuuacuggaaugcccucccuccccugucuggccuagcauucuccacccuccugggagccauccgggugccugcucccagcaggagggacgggauaugcucugagcucacucagcccuucuggcacugacucgguucucaucucucgccuugcauaguauuuguguggcgguguggcuuaucgcugcccuguccucugacucuggagggugggggcuguuucugacuuaccucuugguggcagcacucaggaugggccuugccuaauguaggugcucagaaaauuaguugucguuaguugaacaacagagacagcacagggaagugguuucccugugguuaaaauauaggaccuugaaggcuggguuuggauagagaaacguggggagggugagauggagaugaauugggacuaagaggugggaguggaagccucaccugacgccuuuaugcaugauacuauagaaagggcccacccuggguggaugugucuagaaggccaggaucgauuagugaugccuaguucacgugauuggggaggugauguguggcuugggaugacaggagugggaguugagacagaauagguuaguguggguucuucuuggaaauuguagaauagagaaaagaaacuggugugggcaggagcugaauguggaaccaaaaugcaugcugaaugcuggaacaucagagguccugggaccuuucuggugcacccccuccuuccuccuggauucaccccucuucuucugcugucuuuuuuuuuuuuuuuuuuuuugagacagauuucgcccugucacccaggcuggagugcagugaugcaaucuuggcucacugcaaccuccgcucccuggguuuaaaugauucuccucccuuggccucccgaguagcugggauuacaggcaugcaccaccaugcccggcuaauuuuuguauuuuuaguagagacggggcuucaccauguuggccaggcuggucuugaacuccugaccucaggugaucugccugccucagucucccaaagugcugggauuacaggcaugagucaccgugcccggccuccucucucuucuuagccacuguuuucccccguaagccugaagcaguuccuggcacuuguucccauggggaagcgucuguguaaggguaugcuucaccagcacugccaaggaaguagacuuuucacuuucucuggauuuuucucugcaacacccucugaucccauugcccccagaauaguaggaauuuugagugauaccuagauaggaaagcucuuaggauuaaugaagaaacugagauuuucuuggugggaguuugugcuuuuaaagggaguuguugcaauucaauggaacucuguaauaaccacugaaacuguuacacauuaggcuuacugacccuaucuccuauaacccaugaaauaaagaccugauagucacauaguuguuugcuauuugggaggauccuaaaaguacagccugaacagugacccaaaccacagcuggccuugcccaugcugaugugaggaaggaaugggugggggcaacuaagaaauugggggacagaguucucugugcuagguauccuaggacaagccacccagccacacagagaccccccgcuucccccccacagaacaguucuggaugauaaaaugccugccuggaauggagaaucagaugagaagauguuugcaaagggguuugagaucaguuagcggguggugaugacaauguugauaccgugggugugugacugccaggagcugugaagcagaggguggagugugcgguggucaaagccugguucugggaucucuagcuuuccaggggcuuaggcuccgccuuagcagaaaagaaggaaaggaaauugagaaggaagucagguguccccugccccucacacuuggggauggcugacuuggaggacaugagaugggggaaaucugagugagggcagagaagagaaauguggaggcugcucacagggaggcuagggagcauauggcauauccagccuggggaguggcaccacugggggaaagggugcgugugacaguggggaaggaguggugauaacagaugugagcuugcuguguccacuaaaaaggucacggcuauuuuuaggaaguaggugacaaggcauguuccuguagaacugcuuauuacugagaacccacuguuggccucgcccugcguggugugcuuaaaaggagagaccgcccccacucacccuagagucauccaccuggugucccugagacaugggacacuggaugaggaccagguuuggaggaugaagaagaucauguauuugguuuuggacauguuguguuugaggugucuuugagauaccaaauaagcuggugggucuggggcucaggaggcgucuuggcuagacagacauuugucuagguuguguuuguauuugaagucaugggcacagcgagauugaagaacucaccucgaacagcugaguaaaggaagaugagccuauaaaggacccagaaaaagagcgaccugagaggggcccagaaagccaggacagaguuguaucccaggggccagggugagucugcuucgugggauggaguggucagcuuggcaucgcggcuguggugagugauauggaggagauguggcugccuucacugcuuuggugggaugaugugagcagaagcgagguuggagugaaugggugaggaguagcaggacgugaggaucugaugauagacaggcucugaaauguuggcuuugaaggcgaagaggacgucguugagggaguguuugauucuguugccucgauuuacccuccugcucccuuuccaaucccagaagggaacauguggauggccugccacugacaucccuccccacggcgcuccgugcucaggcagaccuagguaccugcaaggguuugcuucuuucacaaaguggauucauucucaugaaugaaugaaugagugaaugaagcauguugcccagguuggucucaaagcccuggccucaagcaauccccccgccccgccucagccucccaaagugcugggauuacaggagugaaccacugcaccuggcugguauuaaauuuucuuuguggccaacugcaugauaaauauuaacauguuucaugggcgugaaaggagaaaauagguccucugcgggacgcugacuuuagauagaucucuuaacuucaguuacccuuauaucccugcuugccuggcugucagauucugagagguauaacaaaaacucucacuguaguuuuuuaaaguccagcucuacuuauauuugugggaguucuagccuuuugaguuuggcuuucguguuucauguauauaggcuuaucaagcugaucuuccuaccugucauuugcugguuauuuaaugccuuuggucuuuggucuuaaauuccauauugucuguguuuuaggagaauacauggccaaggaucugggagaaucucuuuucuuuacagucuuaaaauuaauaaauaagugcauuuuauaagauaauaagugaaaggcucagaaauuuaaaugcaggcaucagaggacauucaagccaugccccuuuagcuucuguucaggcucacauggagcgguuaguaaucaggucucacugaugaccaugagcucccuguccuuggcuguccuaaugguucccaugauagccagauuuuuaggagggguggauaaaaugagauuugcgugcaaacuccugggacguugccugggaaccucuucucucacuuugcaauuccugccccuuccuguagguccaagaagcggacugcucugccucucauuuacgcauuuccuuccucauuccagacagcaagaugaguuuuugacagaguagccaguacaaacacuucucagggccagaagucagaaagacgcgggccccaagucauaagcucaucucugugcuuguguuuuaagccacauaaacugucucagcgggcuggacuaggcuaugccuuguuguacccugagauccuagugaguaguucuccaaguacuguguuuacagauaaaggcaaaugccagagagaaauggcuggaaaaaccccuuggcuugcuaaggcaggauuaucgaaaagucuucaacauauauguuuuuaaauuuuacauauuuuuucauuuuuauuuauuuugagaccagacuaauuuuuguauuuuugguagagaugggguuuugccauguugcccaggcuggucucaaacuccugggcucaaguaaucugcccaccucagcuucccaaagugcugggauuacggacaugagccacugcacccagccaaccacugugcccagccuauuuuuacuauuaauauuuccaccucuguuuuucuuugcauuuauuugguaugucuuugcccaacccuuaguuuuaaauauuucuuucucacuuaaaaaaguuuaucuuggcugggcgcgguagcucacgccuguaaucccagcacuuuaggaggccgaggcgggcagaucacgaggucaggagauagagaccauccuggcuaacacggugaaaucccgccucuacuaaaaauauaaaaaauuauccaggcgugguagcgggcgccuauagucccagcuacucgggaggcugaggcaggagaauggcaugaacccgggaggcggagcuugcaguggagccgagaucgugccacugcacuccagccuggacgacagaucaagacuuggucucaaaaaaaaaaaaaaaaaaaguuuaucuugaagauggaaucuucguaaauaaaauuuguuucucuuauaaucagaacgugguugaggguggauggagguugacagaaggcaaugauaacagcaacaaaccuaauugcaugguuucugucuuugguagaggaauucugacuguugacauaccagauauacuugauuuuauucuuugcaucuugcuuauuacuuauuauacuugcaugcauuccuuuccugauuuuugcuguuggguuaaguuucucaucgucaucuuccccacgccaccuguauuacguuucagguuugguugugaaugaagagaggagccccgucucucucucucucucucucucacucacucucucacucuuucuugaaaaaucagggucgagguuaaguguguguuccaugagauugucuuggcaccaggcuccuuauggacuguugucccuagcauucucaagggcugugguuuucaaacuugagcauguauaagaacaaucuggaaggcuuguuaaagcauagauucuuggacugcacccugaaucauucuaauuuaggaggucugugaugggaccugagcacguuaauugcuuacaggcucccauauuguauaaugccgccgggccacauguuggguagcaccgucuaggugccucccuuaacugcauggcccaagacagcucacuuucacauccccauggcaggcccuccuagcugcuaggggucuggaaagcaguccuuagugggggcugcugugugccaggcuaugguguguucuguuacuaaagcaagagagaacagaugguugaggaggacaaucagaaguuucuggaacaccacccacugcucuccugaauuugaaacuacuacuaugcuuaucagucuugcuguuggcuaagccuguguuccucagguuaggaagugggaaugguuucucaugacaguggcaagcccgcaggcagugcaagcaaggcagcuucuguuccugugggcuggugcacaagcuggcaagcugcuguggcuuugcugaugccccgagagucaucugcugcucccagccgucaggucuggcauccgcauacuccauugcugcagccaccaccagaucuuccagaccccaugggaucgaggggcccccuccaagacccagugggauagggguuauuuuuuuuuuuuugagacggagucucacucugucgcccaggcuggagugcaguggcaugaucucggcucacugcaagcucugccuccuggguucacgccauucuccugccucagacucacaaguagcugggacuacaggcgcccgccacugcgcuuugcuaauuuuuuuuguauuuuuaguagagacgggguuucaccauguuagccaggauggucucgaucuccugaccucgugauccucccgccucggccucccaaaaugcugggauuacaggugugagccaccgcgcccggccagggguuauuuuuuugugcuaccuccucccaacuucccuucuucaaccccaaauaugacaccuaggugacuguuucuaggagaguuugagggcagaggcuauuugaacccugaacugaggugggggugauguucggucuccguggcugguaauauccuugagagaucagagcagugguugccaacccccauucucuguugucaucacacauagggaggggaucuggagagaaacagggucauaaggcuccuauggaguggcugguacuuuucugaguggcuugauuauaugggacauuauuugggaggcaguaguaacuuucuucucuuuccgggguuuaaccuuuguauuucucaaguccauucuccagccugagaaggugugauggagcccagaaauacguugagugguuggggaccagccugguucauaaugcacuggccuggaaauccagagaugugguucuagucauuguccugcccccagccagcucugagaccucaggcagagucuuucugcucucugggucucagcucccaccucaaauaaaauaaacagguugaaugaaaugauuucaugaaggcccuuuccagcuccaguauuuuaggauucuuauguaauccaaaugcuagugcacugggaauugacuuuaucuugaagaagugucuuucagaaccugcuugcucaaguucagccccuuggugaggcuccggacgcugccacucucccagccugccuugucuggaguuucuccaggcugagcugccccaggugccagcccucagaggggaggucugaggugcagccuggcuaaugauuaacauacgcuacagcuauuuuaguuccuggcauguggguggggaguugaaugcuuaacagcaccuguguaggcuuuuuguuuagugccugggaaaauauggucaggguugguggagugcugcccugaggcuggcuggcuggcuucggugacuuaauggcaccugugaccagcaagggcaggacauuggggcucuggagugcacgcccagggcccccacccccuucucaguagagcuggagauguucauacucccacucacaucacuuaagguccugccuugaggugggggagagaggggaauguccuagauguguccucccugcccccagaauuccuggggccuacguaauagaggcuaccgaaacaggugccacccagagagugaaagaaaugagucagaguccaccgggguuccugccaguauucaguaugugucaagggccucacagugccagcccuguggcaggugguggugggggacaggaagagaggccuguccuacagccuguagcacugaugcucucauggggaggccuagaaaaaaagugucuggcucuggcacuugggugugugaccuuugcaugucaagagucagcucagccuucguucccuugcuuauaaaaugaggaugauaauaccuauccaauaggagcauuguggagguuaaugagguaauauauagggauguaauauauguaucuauccuaggaguuagaaaaaggagagcuuauuagaacauuagagaacauggaaaacauuuuaggacaagugcugugagaguuccaagaagagugagcauuguggauaggagaucagggugggcuuccugaaagagauaugguaugguuuggcuguguccccacccaaaucucgaauucccucguguuguagaagagacuuggugggagguaacugaauggggcaggucuuuccugugcuauucucgugauagugaauaagucucacaagaucugaugcuuuuauaaagggaaauuucccugcacaaacucucuucucuugucugcugccaugugagacgugccuuucaccuucagccaugauugugaggccuccccagccacguggaacugugaguccauuaaaccucuuucuuuuguaaauugcccagucuugguuaugucuuuaucagcagugugaaaauggacuaauacaagguggaacuucaucuggacucagggaaggccaggagacaggaggucagaccagcuagagggaccaccuaagcagagguguccugaaaagggaaagugcugagcugggcugggcuaaggacaugcauuuuuugugcuucucuccaucaugcaugucccugagguaccuucuguuuucaugcuguuccucaguggcccagugugagugacucuuggcuccagacugcuugacacagcuuaggaugccagcugcagaagggucagcccauucccaagugaagguguuuucuccuccagagugagcugcagguccuugaacuuccaguugcaugcggcugacuggggacauugucaccaucugaagagcagaccuugauaagggauauuuggaaagguuuccugaggcuucuagguagagcaggggugcucagccauuuggagcuggaauauacacucuguuaagucucccaggcuugaaggggcugggcuuccagagugguuugaacaggccccgaggacuggcugaugggcaucagggccuuuccgggagaggcugggggacacacugcugccaucacacucuucagucuucuucgccucucuuccucagccuguggugagagacgggucugugccggccauucauaaggagaugagauggcucauaacacaccaacuggaagggcccugguaaaccucuacuccugugaucacaaaugcagauuccugcaaggacagcccggcagcugaaggagggagggaggugcgcagcuguugccagcccuagccgagugucaccaugcagaaauauggggcccuuguugccagagcuccuguuuuaauauuuuugaaggauuuaagccagagucucccuuuugcagcccuuuccucccuccaaugaaauaaugcuauugagcuccaaaaccuucaggagccccagguucugggaggcagcaugcaaaccacugaggcccugcaggcgcacucauugaaaauaggugagguagacgaggcugggagggcuuagauuugccaaggccccucagagagaagccaguuucucagacgccccuaugcuccacugccagggaacacauuuucugaauucuuugucuuccccccccgacucuuccuaggaguggcucuuaaauauuguaguguguguuucccuggaagugcgcuauuguguuuaucucgcuagcuagagggaaagcaugaugcaggccaggacuuuauuuuuuucuucccuauccuaggggguguagcccagccccuggugccuccauaaacccaggugggauugcugugaagcuaaugaaguggaagcuucagguccccggacuuguagcacccuagugaggggccgugggaggggcacuagcagugaguucacagagucauaugguuuauaacauuugcaaaaaacuaagauuuuuuguauucuuuguccugaagaggguuccuaaaauuguauaagcuucaggccccacaaaaccuggaccuacugcagauguugguaccagucucacagacuggcugcuaguguuuuauuuuaacuuuccccuaaaaaauauaugccuguuuuuucagaaagcaguugaagaauauaguucaccaggcuggucaacauggcgaaacccugucucuacuaaaaauacagaaauuagcugggcgugguggcgcaugccuauaaucccagcuacuugggaggcugaggcugcagugagucgagauugcaccacugcauuccagccugggugacagagcaagagacuucuucaaaaaaauaaaaaagaagaagaauguaguaauauucugucuuuuuuuuuuuuuuuuugagacagagucucccucuguugcccaagcuggagugcaguggcacgaucuuggcucacugcagccccagccucccgaguaggugggaguauaggcaugcgccaccacgccagacuacuuucuguauuuuuaguagagacgggguuuugacauguuugccaggcuggucucgaacuccuggccucaagugaucugccugccucagccucccaaagugcugggauuacagaugugagccauugcgccuggcagaaguaauguucucuuucuaaaguuagaugauaaaggaugcuuauuuuauugugcuuuauaauucauauauauguuguauuuauugcuauauuguaaaaauauuuuauaauaauacacgaaaaaagccaaauauguugauccaaaaggcuuauaaugaagccagcaguccccugacacauccuuccucuuucccuuucuccagaguuaaucauuuuuaacuauuuuuaauuaauaggcuuauaugacuguuucuuaauuuaucaguuuugaaauauguugacuuccugcuugguagauuaggaaccaauacauacaucaauauuuaauguaugcauuauugugaccauaaauuguauuguucgaugcugugcaaguaaugugccguggucacacauuaggaguacaauccuuccugucccaauauuccucagguggaugcuuucccuccuugggggccugauuuucuguguaucuauuguuccaaacuggucugguugcuccgcaggccugcugcucagcuguugucccgggacuucuuuuuacagucuucuguguuagauucuccuauuccuagauccuauauauuuuauuuucuuuauuuuccuuauuuaugucucauuuugcugaaaucauccagaaguuccuaagaaaagugcaugggagguagauuuuguuuuguuuuuuguuuuugaagcuugugugccugcaaauaucucuauuccucccuaauggauagaaauauccauuccaaauaucucuauccaguaguggauaauuuagcuggcuauagaauuauaagcugaaaauaauuuccuuucugaacacugaacacauuauucuguuaucuucuaguuucuaguguggcuguugaaguccaguguccuuccaguuccccugaaaaggacccuuguucuuucuuuucuaaaguuuuaguaucuucugccucuucucuucucaaauuucacaaugauugcuuugcugaucuuuuugcuuuguggauauaacauuuucucuuccgucucuaaggauauuauugauuauauuuuuguccucuauuucucaucauugucuguuucuuugguucucuucuaucucugaggauauuauugauuauauuuuuguccucuacuucucaucguugucuguuucuuugguuccuuuucuucuguuuuggucucucccuuucuugguguagacuuucucagauguccugugacccuuugcugucuauaugaagagggagaccauaaaaaucugauuagagugcauaggugaaauguacaggaggggcaggauuuuaucacaucucuucccccuucgguguguuuccuggaaggcaguuauuccccaauauugcaaaauuaaucucuccucagcgcuggucuucccacuguaccugcuguugccucgggcaggaagcagcaacccaggcuugaacucccaugggcugcccccgugauggaacaaaaagaaucauccuagagaacugggccugaguccgccagcagcucugaggacaggaagccucucuacccacccugcccuggggacgaugagcucuagccugggagugggggauucagcaccagcccucuuagggucuugcuguaucaccuuggcaugccacaacccucucucugguugucagugugaccauuugugaaauggggugagguggggucggugggagugaacugagucgucucugaggugcugagcuggccucuggcauccgguugugagguccuggcugauggggugugauggcccugccugugcaaauccgacugggcaaaugcugacugggcaugcguagccuggccacacggaagccacugagggcccaaguccccuggugacucauguugauugguaauucaaguuagcacaccugugccgagccuguucccgacacaugggagaggcgagcaccugguuccuccuugugccguuggaaaggguuuuuuuuguagucuuggugguuuaauauuucccuuguugaagaaagcuggcugaguuagguagacauguucacagagcucuuaugcaaagagaacagaggccuuuggaaagagaaugccauagaaggaucuggaaggaaagagaaggaauggucacuguauauauuaguuuucuuuaaaguuuuuuuuguuguuguuuguuuuuguuuuuugagacagagucucacucugucacccaggccggagugcaguagcacaaucucggcucacugcaaccuguagcuccuggguuuaagcaauuccugaguagcugggacuacaggcacgugccaccaugccuggcuaauuuuugaauuuuaauuuuauuuuauuuugagacagagguuugcucuuuuugcccaggcuggagugcaauggcaugaucucggcucacugcagccuccaccucccggguucaaguaauucuccugccucagccucucgaguagcugggauugcaggugcaugccaccacacccagcuaauuuuguauuuuuaguagagaugggguuuugccauguuggccaggcuggucucaagcuccugaccucaggugauccgccugccucagccucccagagugcuuggauuauaggcaugagucucugugccuggccaauuuuuguauuuuuaguagagacagggucucacuauguugcccaggcuggucucaaacuccuggccucaugcaguccgcccaccuuggccuuccaaagugcugggguuacaggcgugagccaccgugccuggccaauaguuuucuuuaaaaauuuuuuggccaggcgugguggcucacgccuguaaccccagcacuuugggaggccaaggcaggcggaucacgaggucaggagaucgagaccaucuuggcugacauggugaaacccugucucuacuaaaaauacaaaaaacuagcugggcgcgguggcgggcgccugugaucccagcuacucaggaggcugaggcgggagaacggcaugaacucaggagguggagcuugcagugagccaagauagggcuacugcaguccggccugggcaaaagagcgagacuccgucucaaaaaaaaaaaaaaaaaaauuuauuguaaauuaacauuuauaauuauguaaauuuauggaguacaaagugauguuauaaucuaugaauacaaugugaaauaaagcaaacuaguuaauauauccaucaccucaaauaguuuucaauaauuaguuuucaauuacugcuguaacaaauuaccacaaacuuguggcuuaaaaccaugcaacucuuuuugugguaaaaauauacacaacguaaaauuuaccauuuuacccacuguuaggugugcaguucagugguguuaaauacauucacuucguugugcaacagucauuacgaugcaucuccagaagguucucaucuucccaaacugacucuguacucaggaaauguaaacuccccauucccucuuaccugagcccuggccaacagcagucuacuuucuguccuuaggaauuugacuccuuuggagacuucauauagguggaaucagaaguauuuguucuuuugugccuggcuuguuucauuuagcauaauguguugaagauuuauccacauuguagcauaugucaguuuucuucuguuuugaggcugaaugauauucucuuuuuauguggagaucuuguuuuguuuauccauucauccaucaaugggcacuugaguuguuuccaccuuuugacuacugugaaugaggcugcuaugaacauggguauacaaaugucuguuggagucccugcuuucauuuccuuuagguauauagguugaguaucccaaaucugaaauguuccaaaguccgaaacuuugugagcuccaacaugacgcucaaaggaagugcucauugaagcauuuuggauuuuggauuuuuggauuuuggauacacaaugguaaguaugaugccaguauuccaaaaucugaagucaucuggucugaagaccacaaugucugaaacauugcugaucccacacauuuugaaugagagguacucggccuguaugcccaggagugagauugcuggaucguaugguaguucuauguuuaauuuuuugaggaaucuccauacuguuuuccauaguggcugcacuauuuuaccacaugguuuuuuuaucuuuacaguuuuaucucagggucuuuuggaucucauggugcuaaaaugaagguguuggcaggguugugucuuugucugguggcccuagaggugaaugcuuccuugcccuuuccagcuuuagaggccauuugaguuccguggcacuuggcccuuuuccuccauggguggaaucccucucaugcuuggacucuguccuucuuauucuuccuuuucauccuuaacccagcaacaaaggcucucugcuuugaaggacgcuucucacuggauugggcccacccggauaaucuaggcuagucuccccauuucauggcggguaacccuaaucaccucaggacagucccuuuugccaccuaaaguaacgcauucacagguaccggggaugucuuugagggaccuaaucagagaagcugaugguagcugaguuucaggcucugaaaagcccucccucuaccccuccccuuaccagcauuuuccugaggccccgggacccuaaggguuggcuggacacuccccucacugugugggcugggcugguccccuggcgggagccugacaccugaguuuagugugugcccaggaucugugacccuuuucucccucucgaaaugucagagccuggcuucuuuggccacuaggcguguuggucacagagugaagauaacuguguccugcuuuacaaagcgcguuccuguucuuuuuacuuuuaguccucauaguaauccaagguaggugggguacaucaggucuuugcagauagaauggagguucggagagguuaaguugcccaggggggucacacagcaagcaguugcguuaggaaccagaccuuggcuccaggcuaaugccuccuagggacuaaguuaaaauuaacugagcaccugcugugugcuaauaccuguuguagugcuauauauauauauauauauauauauauauaugugagaauacuacauucucacagcuguguaaugagauggaugcauuuuuccucuuuucacaggugaggagaaaggcucagaguggucaaucuauauauccagggucacacagcuaacaagagguagagcuagaauggaaucauugucacuggacuccaaacccuguguaccaucccaguggccuagcagcaguguuagaagaugauaucagagcugugugggcugcgguaaaacucaugcagcagaauugagaagucccuugugacuguccugugauguuuggggcccuugacgggggagugugggccgugaaaagaugggggagcugguuuagagugugugagagagaguaauugggggugguagaagccugccaagaaucuagggguagacauugugaaagccaaugucagugaggcucaggcccagugucuuggagcugcagagcuucccuuuaccucccacugcaaaaugagggaaggguuuagagaaguuucugcuuccuuccggcagagcugcugcaaggguugucuuguagauaguaacuaccacaggacuugggguguggcacaucccugugggcccaggagaucugggagaagcuggguuggacuuugcaguaacuggagugaccugacagcuaagaggggugggauugacagggaagccucagccacccugggacuugugcccaauugacaucagcucacuaccauuguuuugcuggucccuccuaggcgggcccuggcagaagcucccucugcucaggugguguaacuggcgguggcuuccccuugcggaaguggguaaacaaagacagagaccugugucuccuccccgccccugccaccugcacuuauaaacacaacccacuguuucccuuuuugggagugugugagagagagagagagugugugugugugugugugugugugcacgcgcgcacaugcgcgugcauccuuagguuccgucuaaauccguucaagcugcuguaauaaaauaucauagaccggguggcuuauaaacaacagaaguacauugcucacaguucuggaggcuggaaguugaagaugaaggugccagcagacucagugucuggugagggcccacuuucugguucacaaauaggauagcaccuucucccuguguccccacaugguggaaaggguugggcccucugggaucucuuuuauaaggccaugaaucccauucaugaggacuccaaccucauaaccuuccagaggccccgccuccaaaugucaucacacugggaguugggauuucaauaaaugaauuuuggggagacagaaguauucaaacuauagcagguccuggccacacuuuggagucaggacuuggguggggggcuuuuucugucacugccacugugucuguugcaagaaccucagcguccuccaggaccugagugcccaucacgugcuggccugcgaggcagccagauauuagcacugugucucugucacuuucuuccucugcugcccacuuuccacuccucagaaauucugaauuggacucagcauuugacugagcauuggcucuuaugugagccuguuuggugugggcaggccucagaggugacucugcccacaaagaggaguggccuggcuuccagggaagccugccauggaggagcgugacggagagaucugcgugugacgcugugugcucucggucugcguuguauggaaagugaguuccuccucacuugcccccaucccccuucucagcaccuggucuggagaggcaggcaggaggagagaagauggccccauccaugccacaccucagugaaaauucugaggacaggcucuggugcccgcaggguuggagcuucaugcaggcugaggcccugccucugcgggucccucucccaggcagguuuacucuccgagggucuuucauaucucccugcccgguggccucccuccaccaucagucuugccuucgcuguccccucuacucuuggaguggagcaggcccccauacacccaggcacguggaggggauggaaagaaaacagcgccaauuuccuguuggugcuuucucuauugggaggcuggaaaauccaacacagccaugccagugugcuccccacucccauccuccaccugucacacugcccugacccuccccaguuccguguuucucuccuaccccccuccuucccccuucaguccccacaguucucauccugggcauuaucaaauagcccaggguccucucuuucuuauuuuguuuuggagaaacaggaugucaugauauguuacaugauauaaugggaacaaacuugguauuaaacuguuaauauccccauuuuacagauggggaaaacugaggugcagaaaggucucguaaacugucaagaucgcguugcugguggggagcaggacuaggaugugaaccuggguagucuggcuucagagucuguguucuucucaccauccuccauugccuuuaaugaaguacuuuaaugaaguaccuuuaaugaaguauguaaugaaguuucauacagugaaaccggacuuagaagccagguauccugauucugaauuccaugcuauuucaucauaccaguguuucuaaagcucuguucuuaaaauacuagucccuggggccagugggcucugugaggaaguauaguguagugguaaagucugggcuuuggaagcagacugccuggcucagccauucaauagcuauaaccuugagcaaguuacacagccucucugucccucagucuucauuucugauaugagaaggauaauuuuaguauuugccucauaggguuguuauaaaguucaguuccgugugaagcacuuaacagugccuggcacauaguaagcauuuaauaaaugguaacuacuauuauggccuaauuaguuugggaaauuugaggauagaguuaagcaggcacuuuuguuacaggauuuaucagagcuuuuauuacgcuguugcaaauuggcaguuuccuggaaaggggauguguaguuauaguacauaacuauauguaguaagcauuuucuaaacuuuucgggcaacuaaucucuugcucuugucugccugucucgcuccuuaaacugcgugccuucuaacuucacaacuuguaagauaugaagcuggugucagggaacacauuccgggcagcacugagcugcccaucacucuaucugcuucuaagugaggcugagcuaggccugggcaucccgguuagaucugagcaagacuucugggggcaguagaugguagguguucagaagcaaacagacuuauagugaaaaugaacaagcuguccaucaguugacugucaugcaccagguggguucugcucuacagaaggccaaaaugcauauugugggagugugauguccuugcugagauccuuggauuuauaaguguuuauuaugcuguuccuugcccugcaggccaaauacauccuauuugauacuuaaauaaucucaggagccaaugaaggaagagguuauaaaggagaaaauugacuaacuggcaaagcagaggccaguccccagaacuccauccauucuuccacucaagcugcauuuaugaggugcacauucagccagaugcugggguaacagugguaaacaaggcugugggacugcauuuuugacucuggaaaacauuugcagaugguuggcagcaucaccacuagguagagcucagugguccuggaagaguccuggggagguugguuuucuggcccucuuguauugacaagugcccccucaagcauuccaagcucauacucuuccuaaggugaaucagcaccugagucuuuugcugauguagaagccugaucucaacuuagagucccagcuguauuauaguuauauaaacacacugucugucugucugucucucucucucguauuaguuauauaaacacacucucugucucucucucacacacacacacggucccugacucaagaugguugaacuuacaguuuuucaacuuuaugaugggguuacaucacuuucagaagggauguaaccagcuccuccacuuuugaugggguuacaaugaggcuacgguuuuuauugagugcaugucacucuugcaccaucauaaaguugaaaaaucauaagucgaaccaucauaaguuggggacugcuguguugccagcauuaaaugcauuuucaacucaugauggcuuuauuuggauguaacccuaucauaagucaaggagcaucuguauguauuuauauuuaaaguuccuaacauuuagagauaugaacaguuacagaugaaauaauauaugaugucugggauuugcuucaaaacaauacaggggugugggugggguucgggaugaaucaagaugggccuugaggugauaauuguugaagcugagggaugaugguuuauuaaacuguucuguuuuauauaugugcuccauaacaaaacuuugugaaaaaagucgaccauuauuaaucaccgccucugugauuaauggauuaauuaggauuguggcucacuccauggaauuccacagccacaguuagguacaugguccccuggggccagcuccugccacugaagggguguguggggcagagcuugggcucuaucugccuucccucgucuucauaguuaugggggaacugugagcugaugcacugaggguuucuggaaccuucuggcugugaggaguggccuuggcagacccuuguuuaaagcaugcuuauugcacugucuccuuuugcccuuggaggaggggucuucaaguagguugccaagggcagggcccacugggaccaccagugaagccagcucagcuuggacagaaguggcacacguuuugcaaugcagcacugugaggggaugucagguuuugucgucagcugccugcaggccaagcucuaccauggacccucuccgccacacccgugugaugugagcaagccaugucccugguguauuuuagcugcaaagcugaggaaguuagaacaugaucccuuccaauguggacauuuugugagucuguaagucuaggauuuggggugaaagcugaaagaggcccccuucagaaauccugagaucccagaggaaggaaggaccucaaaaaggguugccccugguuuugcccaugggucaagugaggucugggagaggaggccuggccucagguugcuggcugagauccuuuucuggcugagauccuuggaacaggacuaccguaguagacguuucugccucgucuuagaccuuccaucuugaguucugggcuccaggcccuugucugcaccuugcucuagccuggugccucccucucuccugcccagugaccugggacgagugccuagccacucacagggcacuguguggaggucgugagccacucacaucagcucagggcuaaguaagucuucauuuccccagcccaugccaggaggggcaccaggucggaaugugaacuaagaaggaaaacuccaagcaaaacucucaacacuucacccugcgaccagauguguguuuuuuuuccccacacugaccaauucucugacucuaacuggguguccuauaaugcagcucaauucugacccuaacuggagucacugcagacccuauagguuaaagggcucagucccacaagacugccagauauauauuucuuauaucacauuaucaccugagacauuacuuaaccagagccgagccuucucccggagugaagagaguuugcagaugcgucaguuucuuuccucuuuuaaaaaaauuauguacauauauggggaaugggaggccaagggagggagagcauuaggacaaauaccuaaugcaugcgggguucaaaaccuagguaacagguugauaggugcagcaaaccaccauggcacauguauaacuauguaacaaaccugcauguucugcacauguaucccagaacuuaaagccaaaacaaaauguacauauaucugagcauguauaaacacauaugcauauacauuuauauauuuauguaaauauauauacauguauuauacauuucuguguguuuuaaacuguacguugaaaacugcuugguggugaccuuuguguacaaggauagagggaagaaugcuugcuuuucauuuuguguguuucuauucuguuugaauuucccuacagugugcuuguauuccuuuuauuuguuaaauaaaauuuauuuuuuagagugguuauagauuuacagcaaaauuaaguggaaaccacagaguuucccugucccccugcccccacacuugcaccccccgccauuagcacucccaccacagugguauauuguuacaaucagggaagcaacaucgauccaccuauucauucuuuccuccccugaccucuggcaacuacucaucuuuuugcugucaccauaguugcuuucuccagaauaucguagaguuagaauuauacaguguguaaccuugggugcuuccaaauuguuggccauuaugaauaacacuacugugaauguccaugagcagguuuugugugcggcagaaguuuucaacuuauuuggguaaauaccaagagcaugauugcuggaucauugguaaaacuauguuuaguuuuguaagaaaccaccaaacugucuuccaaagugccuauaccgcuuuacauccccaccagcgaugaaugaaaguucccguugcucuguauccucaccagcauuugguguuaucaguguuuuggauuuuggccauucuaauagguguauaguaguaucuuauuguuuucauuugcaauuuauuaaugacauguugagcgucuuuucauaugcuuauuugccaccuuauauccucuuuggugaagugucuguucaggucuuuugccuauuuuuuaaaucguaagguuuucuuguugagauuuaagaguucuuuguauauuuuggauaauagucccuuuaucagauaugucuuuugcauuuauuuucucccauucuauggcuuguuuuuccuuccuuucauuuuauuuuauuuauuuauuuuuuauuuuuuugagacaggguuucacuuccaucgcccaggcuggagugcaauggcgugaucugggcucacugcaaccuccaccucccaggcucaaaugauucuccugccucagccuccugaguagaguagcugggaccacagucgcaugccauggugcucggcuaauuuuuuuguauuuuauuuuuguaacgacagggucucauuauguugcccaggcuggugucaaacuucugagcucaaaugaucugccugcgucagccucccaaagugcugggauuauaggcaugggccacugugccuggccucaucuugucauuuuaaagaauauaucagcagggauuauuggaccugccugguuuaaacuauugucuuaguuaauuuugugcugcucuaacaaaauaucacagacugaguaauuuauaagcaauaguagcuuauuuggcucacaguucuggaggcugagaagaucgugaggcugcaucuggcaagggccuucuugcugcuucauaacauggcagaagacaucaugcggguaagagagagcauguuauacuuuuguaacaaacacacuggugguaaggagcccacuuccuccauaacacauuaauccauucgugaggguagagccucuuaaaaguaccgccucucagaacuguuguauugaccauuaaguuugcagcacaugaacuuugggggauacauuuaaacaauagcaaugauauauuuaaauuuuauggauacaaccuuauggggaaaguauuuuaaaaaauaaauuguguguguguguguaaaaacagguuaaggaucuaauguuaaaaaaaaaaaaaacuaauauacaaaucaauauuccagccaccagacuggggaaggccaguggaaaaucacuccaugaaagcauccacuguagucccggucugcuugguuugcuguuaggcccugaggggcagggggugucacugcuguguggcuucuggcccgagaugauguuucuaggcccuugccucucagcauuaaccugguguaggcucuguucccaaaugagcccuguguugucuuucuggggaggacaguccagagucccaggcauggcacugacaccauccaccccuccuuucccuucuguaucccugaagucaggcaggacaccagcaaaugugcauggccuagccuugcugguggcuggagcccauaucuccaccuccaauuguuggguagagacacagcaaggcuucccuuuugguagggggaugacugagucggggcagugaggcucuucuugcucuggcaguugccuccugucccaguguagcauuucuagauuccuguguuaggggacuccagcuaguacccuuuuagagccuguggaguugaaugguacacuuacguacacguaacauggcuuuagggaacaggccauuuugcagccacugagaagcacccccagauagcugcucuaugcuuuuggcauucaccagacgcuuugaggcuggcuucugaugcagugcugucaugccagacuccugucaacuuuaauagggauggcaccauguuugagaggccgaagaagagacccagagccaacgaacaaggcauagggcuuauugaggggacuuacauauggggcgguccaguggcagcaggcuggauggaaggaccacuacuauuuguaaaaagcaugcaguuuguauagcauuuuaauuuagcauccuccuuccuaaccaccuccaccuggcaaccuucauuuaacgcagaacaaagggccuugaucuccuguauggccauggaauggcuuagggguucugauguuccuuauagauaaggaauggaucuccagguuggccacaguuccucagcucagaacucugaacacacauucuucuuagacuauagggucguucuggguaugcuuaagugauugcugucaggugcaucugucauacaacugugggggugccuaggucuagucugugucccuagagcuuacuauugugaagaagaguauauucguccauucucacacgacuauaaagaaauaucugaaacuggguaauuuauaaagaaaagagguuuaauuggcucacaguucugcaggcugggccuaugccagguugaagggcccagaauaugggagccaagguaccagcauuuuuagccagcucuccaagugagggaaagcaugaugcuggcaucugcuuggggaggccucaggaaacuuacaaucauguggcaggcagaucuuaaccuggcuggagcaggaggaagagagguguggggaggaggcgcuacacgcuuuuaaacaaccagaucucaccagaacccuaucaugagaacagcaccaaagggggaaaucugcccccaugauccagucagcucccaccuggccccaccuccaaugcugggaauuacaauucgauuguauuguaauuagaaauuacaauuugggcagggacacaaauccaaaccaugucaaagagugagaucagaugagcuagagaguguccaauaccuuaagggaaagaguguuuccuagaguguggaccacagaaccaguuacaucagaauuacuggggacugggggguauguaugcuuguuuacacuucagauuccugggccuaucccagguuagaaggcccagaauaugggggcuagggcgcuagcauguuuagugagcucuccaggugauuaucaugcaugaugaagcaguguggccugcaggcaggcagcaucagcaucaccugggagccacuggaaaugcaacuuuuugggcccugccccagagacacugauucaaagacucuggagguggggcccagcaaucuguguuuuaacaagcccuauaggggacuguuuuccagaagcaccgauuuaacuggagagggccccagcuggaugaaaucaggugcacagcugcagguggauggucgcagugaggaaggaagggcgguauuugugcugcagccugcccugagaggcaggaccagaggccagaagguccccagagacagguuucuaagaauuggacccauccuuaaggaggccagcugccugcugugugcaggaggcccucuccagugaguccccaugucagagggccgugauuagaagcaggcguagagcgggggacaugccccagccaucagaauugcaccagcagugugaagcaugucucuugccccaugcaaggaaaggaggagagaggcauuggucagggugaaagguaugauucucauggaugccagagagagagagagagagagagagcagaucuucuggauuauagcucacuguguugccucucuccuggggagugggugcuggacaggcuagggagggggacccgagggccuuagaagucuugccgagcccagauauggcagcccuggggugccaggaacgacuucuccaaggacagccccuugcgguagccucuuuugaaaaaaugcagaggucacaguuaccagaagacuggaccaugagcagauuucuuaauuuucaaagaaaaggaggagaagaaugcugcuucugugagucagagagcagugugcuaauccugcagccucuagccuccuagaacauggauagcuuggggggagauuggucagcgcugggagccuguguccaccugaaggucaccccuggcuauugggcugcguuuacuuuucuccuggggguaauuaggcagauaaacaggcucucuucagaguaaaugugcuagaacccucacuugggcauguggagaaauguguacugggugguggcagagugaguugggggagagcugguuaaaugccugcacccacaugaugccuaguguuugauguugaacuggggaguucugaguaugacaguucuguagugucccucguugucccuuucgucuugguuacuuggcagaacacaaaugccaugcuuauugcauccauggauguaaaacaaagcugagagagagggggaagauguuugauguugagcagaaucccagaaggucucaggagacuggagcaaugggcagaacccaggggagaaauuucacaggagcccacauaaggucuccguggccugaaaacccacuuguaccaguccggggagguagggaguagcauccacuggagggagaugaaggucccgcccugcacucuucagaccauaccuggggcguuugguccugaaaagaacuaaaagauaagaguggggucaggccaggcauguaaucccagaacuuugggaggcugaggcgggcggaucaucugagguugggaguucgagaccagccuggccaacauagugaaacucugucucuacuaaaaauacaaaaaucagccuggugugguggcaggugccucaggugccuguagucccagcuacuugggaggcuagggcaggagaauugcuugcaccgaggagguggagguugcagugagcugagauugcgccacugcacugcagccugggugacacagugagacuccgucucaaaaaaaaaaaaaaaaguggggagcaggcuugaaacuauuucaggcagagaaugacagagggaaaaaugaggcuauucuuucuaagaacggaggacuagagguauaucuuggggagaggggaagacccagggucgcaggaccacagcucacaguggggucgaccugcccuguggggccaugcagggcagagcuccuagccaggaggcagauuuugacuccugcugggaacucccuuaaaagccaccccaagaaugagcuccacgagcgccaucaaggcuggccugcaggcccuccaggguuaccaaggcugccuggaacugaauggacccuguguguguucuuuuagucuuggaagaccagccaggacuuugggggccagacggcuagccucaagugagcucagaaaucugcaccugaauugggccuuuuuaaaaguuguuuaauggccaauacauacaugcagcagaaaugcacagggaacagaucuaaaccggaagccucauuuucuagccccaccuuuccucucgagaggcagcuaguguuagcuaguuucuugugugucauuccaaggauguccgugcacgucuacacucaggaaccacuuaguuuguauguuucuggguuuuuuauuagcuuaguacauacacaguacugcaccuugauuaauaaugguggucauugcaucuuuccauauacagagcuggcuaaauccagaaauagcuacagaguauccauuguuggaucuguugugguuuauuuaaccagccucauugguggagguuuaggaguuguugcagauaaggcuguaguaaaauucaugucuguaugacauuucacacaggugugugucuggggaagagacuuacagaaguggaguugcugagucaaagguaugucauuuuaaguuuugauaucuuuguauuuuauuuauuuauuuauuuuggagacggagucucgcucugucacccaggcuggagugcaguggcauaaucuuggcucacugcaacuuccgccucccagguuccagccauucuccugccucagccucccgaguagcugguauuacaggcacccaccaccacgccuggcuaauuuuuguauuuuuaguagagacaguguuucaccauggccaggcuggucucgaacuccugaccucaggugaucugcccaccucggccucccaaagugcugggauuacaggcaugagccacugcgcccagccgacaucuguguauuuuuaauuggugauuuccucagcacauuggugaaggugagcaucuucagcuccuuuucuguaacugccagaucuguucacaucauuugacaguuucucuagugguuauugaucuuuuucuuauuauauuaauaaaacuuuuuuccuaaguuuuuuucucaucuuuauuuuuuuuuaauuugucucuuaugcugaaauuuuauuuaugucguugguuuuuggggcuacuucuuucacugcauuauuuggccuggcuggaauuuacuugguauaaggaacagggugguauccagcuucuguuucuuggguuuuuucccuggccuggcuguggauggagcuuuuggcuucauuucucugagaggaggccaggaguggagagugucuuuggugcucaaagguccugccuaguggugucuccagagaggaaggugacagagacaccaucccggcucuuccugcucaccugucgggcaguuccuucuauuagaagguuccuggccuacuggucauuuacaucccccagauuaccuccucaccagugaagucugaggguuuggcagagucugggcagaagggucaggcuggggccgggacggggagggcuuuguacugacagcccacccagccucagggacacccucucugaaggugaugccaccggggaccucauccaccacgugcuuaggggcucagagagaccgaaaacugcaaggaguagguccuugguccacacuacagggagccaauuccagcuuucuccaaagccauagggcuuugccuacggucaccucuggacccacugacccaaacaaaugacuacacccguagggcugaaaaccaggcccacccuauggggaccggugguaccuuaaggaaguucuuuagcuuccuuaaaaacagcauguaggcugggcacaguggcucaugccuguaaucccagcacugugggaggccgcagcgggcagaucacuugaggccaggaguucagaccagccuggccaacauggcgaaacuccaucucuacuaaaaauacaaaaauuagccagggaugguugcgcccuccuguuggaggcugaggcacaagaaucccuugaucccaggaggcggagguuacagugagcugagcucgcaccacugcacuccagccugggugauagagugagacgcuguuuaaaaaauaaaaguaggccaggcaugguggcucaugccuguaaucuuaacacuuugggaagccgaggcaggcagaucaccugaggucaggaguucgagaccagccuggccaacauggugaaacccugucucugcuaaaaauacaaaaauuagccagacaugauggcgggcgccuguaauccuagcuacuugggaggcugaggcaggagaaucacuugaacccaggaggcagagguugcagugagccgagaucacaccauugcacuccagccuggguuacagagugagacccugucucaaaaaaauaaaaauaaauaauaaaaaaacuuaaaaagaacagcauauaccagccucggcaacauaguaagacucucaaaaaaaaaaauuagcugugugugguggcacaugucuuuaggaggcugaggcgggaggauuaccugagcccaggagguccaggcugcagugagccaugauugugccagugcacuccagucugggugacagagcgagacccugucucaaacaaacaaaacccaauaugcccaguucuucaagauagauaugaagggcagcuagacucuuauaguuggauagcguggcuagaacaguggucuucaaagugaguucccuggaccaguaacaucaucuggaaacuuguuccaaaugcaaaaacugguuccacugucucagaaacucuuggugguggagcccagcaauguguuuuaacaaucccaucaggugauucugauaugcauugcagcgugaaacccaguguguaaaaagaagccacauacucgagacgagcaggugugauuguugagggacccugcagguuuccucacauguccgccugccauugggugucucugcagacugcagcagcagcugcuauuagcaagagcaggcagguugcacaauguggcuggugucacagcagaucugugucccuccucacaauuuaacuggcaggggacauugccaagggauccguguucagagggacuucgugagagcaggugucucaccuggcaccuguccaggcugcucuuccucccuuacugacagaucugcaaaucacuuacuucucuuaaucagcagccucuacugcagaaacagggugaugcugccucauuugcccugguucuucacccugcaucagaugaaccuccugagggcccuuuuugcuucuaggaacgaugauuccauaccuuaccagguccccuugccugaugaaccagagguuggagaaugaagagagacaggggccucugacuuccccuguugcuggagggauggcaauaaggacacaggaagauaaauagacagaccuggaguccugagaaugaggcagugcgucucuaccucugaggugggagaacaggcccagaggcgcacugcacccuugccagcagaggcaggagcaaagcuucagugagagggccuuucaaggaaacuggcucauggggagugaauccugucacuguggguggggccggggguguggcccuggcccagaagucaggcagcaugcugguggguacuguuucuagcuggaggcaccagcaggagacagugaacuggucugcgacaagcagggcagaugcagcaguuucuucugcagggucccaguuguggugguggcugcccuuucaagaagcugggucccacgggccagcaggggcucucaggcagagccugaaugugcuuucgucuucucuuccagaucuaaccaugagcuacccuggcuaucccccgcccccagguggcuacccaccagcugcaccagguaagagggucugggguggggaggagagugaaugcugccucuguacaguggcugggaguggagaggggagaacaguaguuuccucacuccccuccuccccucacagcacggcccagcaggggaggagaggacaacaggaguagugggacagccagccgaggcaggggcuggagaagagcaugacacuaaggccaucggaggccuagguuugaaacugccuccagaaagcccuggaccaggcccagggcugggucucuugccuuacucucuaguaacagugggcaaaugcugucacuuugagacucaguuuucuucuccgcaaaauugcuucaaggauuucucccucauuaggugguccuggauacugaugagauaggcaggcagagcgacacgguguccuccaaagcauugcuaggugaugguugccccuuaccaccucuccuacccucugcucaagguguguggguuugcagcaacaagaucccccuugccaagagaggaaguggaggcagaugcuaagggucaaaggucacucccuguuuucugcaggagcuguggguagucacauggagaagucgucuucucuggcccuggccccuuuugguccucaaaugagauuugguccccacugugggaaaggaaauaugagggcucaugagaccaaggggagaaaagggucauuccaaggcuggucauccugagggugccugagccgcugccccucuccccaggggacuccuaggcaucauugauuucuuuggagcugagguccugugguuugaacaccccagaccugcaggccauuuaccuucccucccauucagcaggugaagaacagacucagaccuagagguggcucagcugcugucccagggcauguuaggggcugagcugggccacugcccucugaaugagcccaccccagguuggcuggcacuggccuggguucucucucuauaguagaaauccugccauccagauccugccacugccaccuuugcuagcacagcugagcagccucugagcagcaagagaggaggaggcaggaaauuuagggaagguucuuccuggagggucuggagcccuggagaugaagagccgauccgaagcugccauguagaggaaagcaucuaacaggccagaggccccaugaugaugucgaaugcccaucgggcacccagcugagcccugcagguguuaacucagucuucgucacagcagucuaggcauacacucaccauuagcccauuuguaagcugaggaaacaagccuaaggagggugaaagccuugccccagggcacauaccgguccugcugguuucagagcgggcuuuucaccucuguuucuuccuguccucuuguggacugguaucuguguuuaccaugacccagccccaugucccuccagccucuuauccugcuucucccugccuuuuacagacuuguaauagcaaacagccaaacccccucccgccagugccuucgcauuacugaaaucucagagcucccuauggucaccucugucaugggcucagcauggugucccacaacagucuguccuugucuguccuccugcuccaugauggugaacuugggagggcagagccugccugggcucucccagccuccuuaauaccccacagagggucuugggaguguuuggggaacuccaccuuccucccugggaagaggggaagguuuccccuccucugccagugggauagggggagacuuuccuccugguguuuucauguggucuguggugucccgaggcucgaggcucgaggcuuuacugggccucccuuucugaccaccugggagcucucaucucugccuuuccccguguggugggggacuggcagggggcuaaagggcuugguguugcuuucaggugguggucccuggggaggugcugccuacccuccuccgcccagcaugccccccaucgggcuggauaacguggccaccuaugcggggcaguucaaccaggacuaucucucgggaauggugaguccagcucuccugcugaggcagcccuggggccacaccugcguggccagaggaaucaaagcugcuggccucuggggcuccagaguugucuauguguguguugcugugguguguaguguguugagcuguaccuuagaacaggguuuucaucaggcuucugccaccugcucucugccccucucugggucucacuuuucccaucuguaaaaugaggggaaggggaccagaugaucucacaggucccuuucagcccugagggguuaggguugggaagguggcgaggguaucugcaugagugugcaugcacgugcuauguaugaguauccacauucauauaccugcaugugcauguguguacauauggagggcucuucugguuaggccuugguggguguguggcagguaucuugggcagacaugcuacuuuuuaaauuuguuguuucacuuuuaaaauaauacauuuuaugauuugaaaacaaacguaugcuuaguuuaugauuugaaaacaaacguaugcuuagaggaaauuaugcaaccaauacacacccuaauuugugccaggcccaguucuaggcacuggggauaugugaauaaaacaaacaaaaaucucagccgugcugcacuuaucaucuauggggaaaagacaggcaguaccuuaagucaacgaugugauguuauugaaaguguaggugccauaggaacaaguugaccaggguaaaggggucaggaguggggguggggugauguaaggauaaugauuuuaaguuagcaguaaggugggucuggcugaaaagaggaugugugagcaaagaccugcaucaggggaaggaagugcuguauggaugucuagggaaugccggugcccugaggugccaaggggugugaggugcucagggacagggaggagaggccaguguggcuaaaguggaaaggcgagggggugagaugggaaaugaagucugggggucuagcucuugcaggguguaggaggcuauccauccuaaggauuuagguuuuuauuccuggugagugcagauucaccugaacaugccugccagaggugucuguggguagcaggcugaugugauggggaugcccccaacccugcauaugggacccacgcaccuucuugggcagugagcucuuaaccuucacccagguggucugggaugggaggagcaaccauguggagagggaaggcaucuccccugcagaaggggaugaggaucucugguuuggaucgagucgcacuguucacuggcuguguaacuuugagcaaguaaacucauucuguggucugugaaauggguauaacgguacuucauauuccacaagcggagaugcugugaggacugacuuggcuuagguaugaaaaaggguggagggacggagugcagcagggcccauuggccucaggcucugcuuuguguccuugcaggcggccaacaugucugggacauuuggaggagccaacaugcccaaccuguacccuggggccccuggggcuggcuacccaccagugcccccuggcggcuuugggcagccccccucugcccagcagccuguuccucccuaugggauguauccacccccaggaggaaacccacccuccaggaugcccucauauccgccauacccaggggccccugugccgggccagcccaugccaccccccggacagcagcccccaggggccuacccugggcagccaccagugaccuacccuggucagccuccagugccacucccugggcagcagcagccagugccgagcuacccaggauacccggggucugggacugucacccccgcugugcccccaacccaggugagugucagcccacugccucccuugguccaggccugggccccaaaggcuggagacacauggcucaguagauggggagacagggaaaggcgcaggccuccagcugcacuucuuguuuuaacaaauagugucggccgggugcagugacucaugccuguaaucccagcacuuugggaagcugaggugggcagaucgcuugagcccaggaguucaagaccaaccugggcgaaauggugaaacccuaucucuacuaaaaauagaaaaaaaauuagcugggcaugguggugcauaccuguaggcccagcuacucgggaggcugaggugggaggaucaccucagcccaggagacagagguugcagugagccgggaucaugccgcugcacucacuccagccuaggugacagaguaagacccaguuuuuaaaacaaaaacaaaaacaaaaaaagacaaacaaagagcgucaccuucuugcagacuccccaccucuggguuguguugcuuaaggcccaagggagcuguccuguuucuccuggugugaugagacgcuccacauccgaguugggucagaacaccccuggcgaguacuccuuauuccucugugucauuuacugccugggcuguguguuuuguaagaacugcccaggccaccugucucaaggcuuugugcucaacagcugucuucggucccuugauaugcaccacccccgccccccccggcacagacagguuuuggaggauuauuaaaauucccuuuggguagggagaauguuggcaguuccuccaggguugaucuuggcucauuuuggagaacaguucguguuugcagagccuagaauucguugucaugguucuguggcccaaccagccagcacagggguagugguaugugcucaaugacuauuuuuagacagagggucuccuuuccuccuucccuuccauacccacacguucccccacccugugccauccuccagccucccucccuuaucuuuucccugagcugcccucuuaauuguguuauaaccaguuuguaccagccccuaggaagacaauccacugggagacaguuuagccuggaaaguuccaguuugcggguuugugcagcuaucagggucuggaggaaguccggcagaugcuagucuagagaacagugcgagggaaccagugcuagaucaagaggucaucaggcugccaugcacaguuguggaggcucaauaccugcauccacuggaggggacacaugggcuagccagcccuguuaggaguacccaugugugcucacaugugcuguggaggccaggcaucgaugagagaggccacagccccugcucccgagaccugcccuucaucaggagccugagccccagcccuggaggaccugggcacugggcagauuuucagcaucaggacucagcuauaggugagcucccagccacuggagccaggaaaaagcuucaguacuagaacacaaggccagauaacagucaaguuagguagacgcggcguaaaguccucugcauuguugacuguggacuccuuuagauacuccaacucuuagagaaagggcuguucccagagucuagggguggagcagccuugaauguggggaaggcggcaugcacgacaucuuaccugagacuguuuguccgaguaguuuggaagccgaggcaccaucacugaugcucccggcuuugacccccugcgagaugccgagguccugcggaaggccaugaaaggcuucgguaagagacccuggguggcucaaauccuacucccugcccccuauuucccaggcaguuucacuguggcucugugggcugggguagcugggggacgcugaccuggccccaguggugauagaagguggauguggggguauggcuagcaugcccagaacaguugaggggcccaggccagggaagucucagcugcagagcaucucaugaccccuacccgacccaccccugcugccucuuccuccagggacggaugagcaggccaucauugacugccuggggagucgcuccaacaagcagcggcagcagauccuacuuuccuucaagacggcuuacggcaaggcgagcugcggggugggggcgcgggacagugaggcguguccugggcucagcacagcccugcucuccccugcuuuuccuugggugggcccggaucucccggauggacaguaaggagcaggagggcauuuccuucugcccauccagcugguggcaucguugggaggugaaggaugccaccgggugcugagguuugcugagaggcuccagacaucuaucccuggguucuagcccuugcucugccacaucucacugagguuguggccacaucauuuuccuuccccugcccucuucaugaccacccugggggguuuagcugauguaagagcuuugcagggaaaggcugugagugcugcccaaguacgaggggcguguaugagcauauuuugaacuucugggguuuugaaucuuagaaagauaaaaauucgguaaauauugauuagauucguguucuagcccagugcuucucaaacuucauugugucaccgauccccugggcaucuugguaaaauguggucucugauuugggagguuuggggcagggcugagagcaggcuuuucucucaggccccugggggauguccaugcugcuguuccucaaaucugggauauggcucuuauuagucacuuccuguggauuuuuuaaauagacuuguuuuuuuuuuuguugguuguuuguuugaauauccaaucaggauuugaucaaagaucugaaaucugaacugucaggaaacuuugagaagacaaucuuggcucugaugaagaccccaguccucuuugacauuuaugagauaaaggaagccaucaagguguguacgugugugugugugugugugugugugugugugugcgcgcgugugugcgcacgcgcgcaugcguguggacacacagcccagaaggaggccuggauggcgugcuguguucuagcccacucauuagcugcuguugucaguauggcucccaggccuuccuggguuggaguccacaugcuauagaaaagggaacucccugugauuuccccaagaggcaaaugacgcaccagucaucaucagggaggcuuaagucucucuccaucuuaaagaaaagggggagcucggguuugaagguugcgauucugugguaagaagagggguaggaggccaugguugguaucguucucauucuuuaggacucuguuacuagcaaaugacagaaacacacuucgguuuaagaacaacaaaaguggagaaucagucauguggguaaagagggcccaggccagacgucucucuggucucugucucuccugagcgcccgcuuuucugucaguuucugugcuucuccuaccauggcugcuucauguggggugggagagggggccugucgaccacucuccgcauaacuaugagacccagcuccagaagagaccagcagggucuccaaacgggcagguucugacgggcccggcuuggacucacuguucccuccaguccugcggguuuugacugaggguuggguccuguccauucugugcagucccacagcucugugugcacccugcaggcaggggcaggcagcucccuuggaaagggaaucccaugagucaggcuggagcccagaaggagccugucacucagaggccugauaagcacagugaauguucccuccuucaggagaagcagagacuucagugugguggccuggaaaggagaggggucuccgcugaaacacaucuacauguguuauucuagggagggggucaggaggccaucaggcagggcgauggcccggggccccagggaguggacccagacaucucccuggcccccgucuucagccggagucaugagcuggugguuguggaguguuagaaaccacacagguuuggggcagcugucacucaccagcuguguguccuugagcaccugugaaauggggacaguggaugcugucucaggacaugcugggaauacugggugaggggcuaacguguaguaacccaauaguagcuguagcaggaaacagcugacacaaugucgcacguccugccugacaggcccuaagugcucuacguacauuaacucacuuaauccucaugacuuuccugugagguagguccuaguaucacucccaucuuacagacaaggaacuggaagcacagagagguuaaguaaugugcccgaggucacacagcugguaagcugcagagccaggauucaaaccaacauacaagccaggcugcccagccuguccucuauggucuuacugucccuggcgugguuguccgauucauccuuguuguuccuaccuuuuccuaguuguuuucagacauuccaccauccccucuaggaccaggguuucguauguccacuuggaucucucuugcuuuuuacccauuuuuuucaguuguugucaucucgcuuccggcugaacucugaauaaagcaggccucgguccacauuuuaacccaaccauuuacuguguggccucggaccagccaguaccccucucugaugcucaguuuucugauccauggggaugccccuuugugugagcccuacucaucaccacugccacugucauugugcuugcccgggcuguggagaagagcugaugcccucgagccugggaguggcuggagggugugucucugugucaggggccucuguugcugggauuaaggcagcagcguagcccccacccuucuucccgagugcuggugaggcugcuggaacaagcacaugguugguuguauucucugccccugcaggggguuggcacugaugaagccugccugauugagauccucgcuucccgcagcaaugagcacauccgagaauuaaacagagccuacaaagcaggugaggccgcucccucugcccucugcccucugcccucugcagaucccugugcucuuggggcuguggccucauucucuccuagggccuuuuacuccuuccuggccuucuuaucaacccaucuucugccacccccaauacuuugggcuuugacccaagacccagcccuuccuucuguuuauacauggugcaaaugacuaauguaagggagaggcagggaaaaccuggaugugguuugggccaaggcugacuagaggccaggucagccuggaggucacaggcuuguauaucccuggagggccauaugggcuauuuguucucuugagcccgagccaagaccuccagccuuuuucuccccaguacccacuuuugauaguguuuugcaaugggcagcuccauaaagagagcuacaggauggaccuuccuugcuucucccuuucagaauucaaaaagacccuggaagaggccauucgaagcgacacaucagggcacuuccagcggcuccucaucucucucucucagguacuuuucccacgacagggcucggggcccccaagccauggaagucaaagagaugggauccccgcaaugaggaaagggaaaauaaauggggaaggagugggcaugaccauacaccugcuuccuuucagggaaaccgugaugaaagcacaaacguggacaugucacucgcccagagagaugcccaggugagugugauggccaagccccuggacuuccuaaagcagggaugcaccccgcuuucuugcuuccugagagagguacccuaggguggaaagaacaauagauaagcaguggguugcagaugcugugaguuucagacgcgcugaacuguucaacuguaugaccuagaacagguaaucugaccuccagggcuucagcuuccccaccuauaggagggaacaugugagauaauuaguauuucgauaguugauagaucaugguuuuggacgugggauuuugugugacagcguacuuuccccauguuuaguugcacauagcauuauguuugcaaaggggcaaaauuugcacuugcuuauuaaguuuuugaggauuugagccuagaaaccagcugccacauuaguugagcacccuuagaauucugucguugucccucuugugaguugcagacaaaaggggaaaaguccaagcaaaguccaggcaucugagcuacucucucgaaaaguuuggguuucccacuaaugaauuucaaccguaguauuauggcagggcagagccauuacuuccuggugggguggaguuggccauaccucucugucucccuucacugcucuugucauccacggcagggcauucaccaggagcugccaguggucuaaauuaucucuaccaucugcgggauuggaaugagaccucaaggaaugcccccuuguuagggcuggaggagagcuacuccucuggucugguccuuuugcugguccuccuuuuccggaggaggaaacugaggcucaaaaagguugagcacuguucccaacugaaagcuagaagcagagcccggacaagggccuauacuccuggcucggucuucugugcccagucagcacuugccucugcccuggucucagaccugcugcuccugcagggucugccuuauucagugucucucuggcugguaacauccauucccauucugggagucagggcuggacacgccuggggcucagggcucuggcuuuugcuccagcgagaguuuugcaugccacuuuuagcggggcaaaaauugucucaugcucugccuucucaguccagagcugcuuuggccucaucuugaccugugggaucucagccccugauugcugcuuucugcucuuuuucagggcugcuaccugaggccuagcaggcacuuuagaggccaucuaguucagagguugcaaauuggcaaauacuuuaggcucaaaccuucagaaguuuaccaggcucuccugggugaccugggccuggggucuggguguggccugugccacaugugcgucuuccucucucuccaggagcuguaugcggccggggagaaccgccugggaacagacgaguccaaguucaaugcgguucugugcucccggagccgggcccaccugguagcagguaaggcaggcuggggucccucagaggccaguuagaugagggcagucaggggauuguggggaaacaaagcuaugggaacacuuggucguuccucccugcguggggcuuucgccuccucaaaagagcccccuggugggaauuuaaaagacacugucagaggguuuccugaguucuggcaaacauccaguucuggagguucuaccgguguagaaaccuggugucuuuguacgugggaauguggaacgucagaguugggaggguccuucgggagcacccaauccaguguuuuccaaagccuggcauaagaaacagucauaacaauaaaacugggugccauucauuuacucauucauucaacagauguaaaucgcgcucccgcaugggucagucugucaggugguggagcagguguggggccacgguggggggcagggcacugcagaguguguuccaugggcugcacuuucucauuuggggagacagacaguaaacaacaaugaaauaaaaucuguaucagaugggaaauccuguagaggaaaaucaagcuggaaacagguagggagugaugguaggguccaccgggaggugcuugggccaguccccacugaggucgugacauuugauuuaaaaaccuaaagggagaugcaggggcagaggccugccuggggcucccagcacgacugagaacagugaagggggaccauguggagcagguggagugagcaagaggagugggaggugagggcagagaggggagagggcccugcugaugacuucccggagcuggguauuuauccugagcaaaagaggaagccaguggagggcccugagcagaggaggcugugcagaaucccuggcuguggugccgagaauggagugaagggugcaaggccaagcagcgaagccugucgggaggcugcugcagggacccggggaggaauggugguaauaggggcuuguggugaggaggugucagguuccggccauguuugcugaugaauuggacacgugacgugugggagagagaggguucgaggauuauacaggguuucuuuaggccaagcagugggagaauggcccucaacugagacagggggacuguagguggagcuggcuuuaggugccuguaggguggagcugcagggaggcugcuggguugcugaguguggaggucaggagaggucuggccugguuguggaagguaagggagcuauggguaguugaaguuaucugaggcucugggacugcaggagguccccucaggagggagacuguggggagcccaccggugugaggagacuaagaaggagcagcuagggagggaggaggacgcagaggaaggggguccuggaggccagugugagguggcaggcaaggacugaggauggugaccacacggagcaacuggugggcuguggccagggcugcuccagugggcagugagggugaaaacccagcgaccgcucugugcugcacacagagacaggcgcuguggcucuccccauucgcagcugugaaagcaggcacagggugguagaggaaguaggggugcacagcuaguaacagcugagcugggauuugaacccagaccacccgaccccagagcacacuuuuuaaccucugcacuauccuguaauggagccugagugaaagcauuuucaucuuaaucauuauuucuuuuaaugaguacagaacauguaaguagugcaucaagcccauggcuucacaaacauuauuacuuaggagaaaagaguagcugauuggaagaagauauuaauugagacagauacacacagagcagaaaucacaacuuuaaaaugcaaaugguagcugagacucaggcuggggaaggagaguuuuauguccugggucagaacuggagucaggaccaaggucuccaucaugccaccugucucucuaggagccagccauccacuccugugggugcuuagcguguccuaggucgaggugagcagcaagaagccaggcuggcuggggcaggcugggccucagcucacaggcaggcugaggaagacagauggaugcaugaauaaagccaaggaauggcagagacuggagguguggaggauuugagaagaggggacacugucuuggaguacaugggagugggcccuggagggguauuaaggugcgauuugguuaagcagauuggcaguccugagaaagggaccacacagggagggacaucagguggugcauguaacuugugacgaagacucugacuuccuugagcgcuagcaggccuggggacgugcagggugugggagcagaguggcaggugggagauuuuggggcagaggccaccucaugugaguccucuguuagucugcucaugcugccaugacaaaauaccacagacuggguggcuuaagcagcagauacucauuuuguuacaguuuugaaggccagauauccaagaguggggugccgguuucucccguggccucuucgugacaaucacugugcucacauggucuuuccucugcaugugcacaucccugggaucucuguguguguccuaaucuucucuucuucuaaggagaccaggcgaauuggauuaggguacacccuagcagcauguuuuaacuuaauuaccucuuuaaagaucuuaucuccaaacacgguuauauucugaaguccugggaguugggacuuccacauaugaacuuuggggagacacauuucaguucauaauauaagccucugucauccccauaguuuucaaugaguaccagagaaugacaggccgggacauugagaagagcaucugccgggagauguccggggaccuggaggagggcaugcuggccguggguaagugucucagguuugccgcccaccugccaggggcuaacguguaucgugaguguucaggcugcucgccuguccuccagcugaugggugacaccgugaagggaccacaggauccaagaucgcucagcccagaguguccagaugcugggaagucaugcugcuucccgguucccugugcaguugaaccccuagcuguccuggaggugucuuguguguguuugcggugcagcucuggaguagggaacugcaguguggguauuagugggagggcauccaacugcgcucccggaggaguaugacucauauccugccacguuuccucuaaaaauacaucccugcaggcaguugucagauguuugugauggaaacacguggaaagauuuuuacuugcagcagcgaaacaggcccaugcugaggaaagcuggcuuggcuccaggaugguggugugccucuuacauugcccauguccucuagcagggcccucccacugugcagaguugggucccugcccugaggcccucacaaccccucuuucuacucacuugggaaaaucagucugccccuuuuuucauuaugcuuuuuuuggagcuuucuggaugggagagauggaaaauccucauuucccugccugucccccauaguaggucucauggccugggaagccuagggagaugcacauuccacucagccacgguuucuccaugacggucauggccucuccagucugccccuccugccugagcagcagcacaguuccucaucaccauccacauugcuucccuguguagcuccuagccccacuaagacccccgccccucugacucuugguccuuucaccgcagugguugccaggaaagaggguggguugguuuccaggcuuugcguguuucuguuccaaauagcuggagccaagaucaugggauaguugagccuggaacagaaggaggaggagaaaagauggaugcagugauggguuugacaucugggccucuaagaggacacuuguagacuccaugcccugcuugggcugagaauuuucugcagaucugguuaugccgaguuucucucuucuagugaaaugucucaagaauaccccagccuucuuugcggagaggcucaacaaggccaugaggguauguaacuuccaugugcagguugcgauggaaccuuagccucgccugugccugggaccaagggcugagggcagaaggccuggggagagcuaaaucucagcugagaguuccgaggaccuggguagggaggggacuggagggcccagggcaggugggaaggugaggaggccuggugcucaugcucuuggguggacucucuuuagggggcaggaacaaaggaccggacccugauucgcaucauggugucucgcagcgagaccgaccuccuggacaucagaucagaguauaagcggauguacggcaagucgcuguaccacgacaucucgguacgggccugcugcaggccaacugggcucccuuuuggcaucucagucaccuguggaaccucccuccuuggaguggccauaugcuuggccucugugcugugugugggcaucuugauuauggaccucggacuuguucauccccuugcccuuaaacagauuauaaauuucugagggcagguggaucaugaccuugcugucgcccccaccuugcaucccccagcagcaucagagaacacucgggaccuccccaaccuugaccgugaccuucagcguuccgaucaccgugugauuccuugaucugucagugagaacucaugucccaaaggcucuguggagcucugcugucacucccugacaaagcacuuccugcacucagcuuuauggcguaggccacauaguaaggccguucagagcgagggcccugggggucacgccacuuggaguccagcuuuucuacuugcuaacugugugaccuugaauggcucccuuaaaucucccugaaccccagcuccauugucuuuaagaugagaaaauaaucguuccuuccugggaauguugugaguauugagugaggcagugcaggucaagugucuauuaaacacuagccacaguuguaucgcuguguggcagagccagucugacaaaauacauucucagcuguguggucuaacgcucaaauucugaacucacaugagccuugcaauugcaccauggggaccacguccucccaccuuagacucaguagcauuugaugauggugggcaugucaucacaggaaacucacuguguuuccuuggcuguaugaaugaagcuguuguuagagaauuagugauucuaggcugggcacaguggcucacgccuguaaucccagcacuuugggaggcugaggcagguggaucauuugaggucaggaguucgagaccagccuggccaacaagguaaaacccugucucuacuaaaaauacaaaauuagcugggcuugccuguaaucccagcuaauuagguaggcugcggcaggagaauugcuugaacccgggagacagagguugcagugagcugggaucacgccauuccacuucagucuuggugacagagugagacuucgucucaaaaaaaaaaagagaguuaauaauucauuacagaguaucuccugcaugccagcaagcuauggacaucuggaagaagccacaugccuugcccucaaguugcuuaggguggaaggaaaugauuagaaaugagccaagccgagccugcacucuuagaguaaguguaguggccucagacagaggagagaucccugggaccugggcagucugagccuuccacuggacagucaugugugaggagauugcauuuccugagcaggacacuguguugcguuacauugguaaccccaauuuaaggcagcauaaaugcacugggaaaacagcaauauugguuagcccugggaagugguuuuuaggaugauuauaauuuuuuuuuguggguauucauuugauguggauagcuggggugagugcugcuuuccgucuucugaugggggccuggagaaggcugaacugcauuuuuuaaggucugugacgccugcugcaggaccugcagugggagaaaauuccccaggguggggcuuucucccuauaagggugcucagggcugaauaucaggacccagaaggcugaaagugacugucccucccuuaacggaugucuuccuuguuucuguggccagggagauacuucaggggauuaccggaagauucugcugaagaucugugguggcaaugacugaacagugacugguggcucacuucugcccaccugccggcaacaccagugccaggaaaaggccaaaagaaugucuguuucuaacaaauccacaaauagccccgagauucaccguccuagagcuuaggccugucuuccaccccuccugacccguauagugugccacaggaccugggucggucuagaacucucucaggaugccuuuucuaccccaucccucacagccucuugcugcuaaaauagauguuucauuuuucugacucaugcaaucauuccccuuugccuguggcuaagacuuggcuucauuucgucauguaauuguauauuuuuauuuggaggcauauuuucuuuucuuacagucauugccagacagaggcauacaagucuguuugcugcauacacauuucuggugagggcgacugggugggugaagcaccguguccucgcugaggagagaaagggaggcgugccugagaagguagccugugcaucuggugagugugucacgagcuuuguuacugccaaacucacuccuuuuuagaaaaaacaaaaaaaaagggccagaaagucauuccuuccaucuuccuugcagaaaccacgagaacaaagccaguucccugucagugacagggcuucuuguaauuugugguaugugccuuaaaccugaaugucuguagccaaaacuuguuuccacauuaagagucagccagcucuggaauggucuggaaauguc

SEQ ID NO: 192475 - RNA, 67636 nt, Homo sapiens
cugcgcggaggcaagcgcgcucugcggcgcgguccgcuguggaggcggcgcgaacggucagggggcggccgauggcuuugaggggcccugcgggcuuggggcccggcucucgaaggccguuggacgaagcgguggcaggggccgagggccgcgaggcgccggcccuuguggcggcgggaggcgcgccagaggacgaugaagaggacgauggccguggccggggccugcugcgcugggacagcuucuccgccuggcugcacugcguguguguggugggcuucgaccuggagcugggccaggccguggaggugaggcccggccccgcccuuucucggcgcuccuccccugcgccggggcggcugcagcaaagccagcggcccgcgggcugaccggccaggacccuguccgcggcgcauccgggcguggccagucuccccucccgcgcucuuucgggcugcgguccuacggcacuucccgugggaggaucuugggcugcggcuaggggugaaaaguucucucuaggccccuccuaaauacuuguugauguucauccuguucuuucuuuauuucuuuuaaacgcagagucacagaauuaacuaaaaggguuaguagcacccacccggagaagcccgcaggcaggauguuuguuugguacuuuuucaagaacaaugcccauaacagaugaugaacucuaguagccgaacuugcacaaccaaguuuuaaggcucagauuguuuuagucauuugcaguaacuguuugagcguuucccucagccugagucgaaaugcuuaucucagcacgcauuuucucccuuuccuccuuuugugccucauuucuguuuuuuuuuuuuuuuuuuuuugagacggaguuuuugcucuuguugcucaggcuggagugcaauggcgcgaucuuggcucaccgcaaccucugccucccggauucaggcaauucuccugccucagccucccgaguagcugggguuacaggcaugcgaccaugcccggcuaauuuuguauuuuuaauagagacgggguuucuccauuuugguaaggcuggucucgaacucccgacucagguggucugcccgccuaggccuuccaaaguggugggauuacaugcgugagccaccgugcccggccucauuucuguuauuuuuuuuuauguugccucuggaacaguuggugugaaacuacugucaagaugaauauagggaacaucauuugcuugucaaucagucaacuuuuccauucuuauguauggccccuuaccgaaaggcuuuagaaacaucuauucuugacguuguugaaggucuuuuuagcauaaggaauugcuugcuuucauguguccaaggaaauuguuaucagaagggcguuuguuuagacguuuugguuuugguuuuuuuuuuuuuuuuuuuuuuuugguauuggugacagauuucgauuucauuaauacuguaguggccugguugacuaagaaaauuggcuagggguaguuuucuuaaugcgaagcuacugcuuucguauucggccugccuucuggauguuuuauuauaacacaguucagcgacauuaaguuuccacuaagaaccaggcauuauguuaguuguggagcauacaaauaggaugugcucuaaucuguauuuguagauugaggcaauaauuuagaggagaaccaagaauuaaucauaguagcugauaaggccaaaugcagugccuggcaccuaguggcauucuauaaauacuuuugauagaauaggugaauaugugagcaauucuuuaucuuauuaaaguaagaaaaacaguucccaaagauuuugaguaagagauuuauaagccauuuauuauucaccuugccauguuaaccugaaguuauauguacagcaagauacaauuuaaccagaaagcauaagaauggguuguuguaguugauuguguuuuuaaauagcuaaaggagauucuuuuggauucucauuauuugggacauucuuuauaacgugaauauguuuuuugaccaaauaaacagaaaauauauuugagaugcugcaaaaaugugaauuauuaaaggacuuauuuugaauuucauuuuccauaguguaugccacuguauagaguuuuuucuaggucaggaguucuuaaccuuuugcuuccuggaucuuuuaaaaauaugaacauugugaauuuuccacuaggaaaaggcugaguaagaugaaaucauguaugugguuccauauaugugguuuccagcuauuuaagacauaaaccuaguagggcuucagaaaauggcuagaguucagaaccagggaaaccucuugguuuugcucuuuuuuugugugcagaucuuguuuauauuucauguucccugcaaacugccuucuuccccuucucugauuuuuuuuuuuuuuuuuaaagacagagucuaacuuugucagccaggcuggagugcagugguguaauuucggcucacugcaaccuccaccucccagguucaagugauucuccugccucagccugccaaguagcugggacuacaggugcaugucaccaugcccagcuaauuuuuguuuuuugagagagagagucuugcucuguugcccaggcuggagugcaguggggcaaucucgucucccugcaagcuccgccucccugcaagcuccgccucccagguucacgccauucuccugccucagccucccaaguugcugggacuacaggcacccgcaccacgcccggcuaauuuuuuguauuuuuaauagagacgggguuucaccguguuagccaggauggucucgaucuccugacagugugaucugcccaccucagccucccaaagugcugggauuacaggcaugagccaccgcgccuggccugcccagcuaauuuuguuuuuuuuguuuuuuuguuuuuuuuaguagagacaggguuucaccauguuggccaggcuggucuugaacuccugaccucaagugauacaccugccucagccucccaaagugcugggauuacaggcgugagccaccgcaccugacuuuuuuuuuuuuuuuuccuuagagacauggucugccucagauuggagugcaguggcaugaucauaacucacuacaaccucgaacuccuaaacucgagggauccuccugaguaucuaugaauacagacaugcaccacuacacccggcuauuuuuaauuuuuuuuguggggacagggucuugcuauguugcccaggcuggucucaaacuuguagccucaaacuguccugcugccucugucuuccaaagugcugggauuauagguguugagccaccaugcccagcccuucucugaucuuuaaggugagaagcuaacguuuuuagccacuucagugaaaaagagugaaucuuuaacucacuuccaaagccagaggaagauaaucuggccugguuuggggcagguuccuacucugauacaauuggcuaaagcccugaguagaagggggagugguucaccuugcauaaaaugucuuuuaaggcccuguccuaagugaaggggguuaaggaggucuuugagcuaggaagaaacugaacaagguguugacugcagggggugugcugagcuucuuuuccccugaaguggcucuggaggcauuaccacagaaucaaaguguccucuggaacaagguuugaaaccuccuggguuugauauacuguaccucacuuuuagcuuugaaauuaccaauuauuuaguaaagccuuaauuauccgaauacagaauuaccuuauuuauucaaguuuuuuuuuuuuuucugagugaauaauaacauacucauugcugaaaacuuggcaaguaaagaaaucauaaacacuaggccgggcauggcggcucaugccuguaauuccagcacuuugggaggccgaggcgggcagaucacgaggucaagagaucgagaccacccuggccaacacggugaaaccccgucucuacuaaaaauacaaaaaucagcugggcgcaguggcauacaccuguagucccagcuacucgggagggugaggcaggagaaucgcuugaaccugggagguggagguugcaguaagaucgggccacugcacuccagccuggcgacacagcaagacuuugucucaaaaaaaaagaaaaauuauaaacacuagaaaauaucacucuuaauucuacuaagaggcaacugcuauuaauauucggcauuuuuguuaauacuuuuuuucuuuauauaauuuuguaucugucaaggauuaacuugauuguuaggaacagaaaccucaaauaaacuuaaguaaagggacagugauuguaaggauuccaggcagucuuuuggaauccaagugugugggaagcaaggaugaaccugugggauuuggaaagccccaggccuuugucucuggagcuguguguuuuuuuuugucuuuggucuuugcaugucuguucuuuucuccaugcugaagcugguuugugcugcaguggccucaguuucugcucccccguuacucugcuugacuuuggguuuccaugguacuaauuuuagccaaacucuuuuucuggaaugaggcugaagcuuaauauuggaguaucugauuggcucagcaugggacaggugucccauuuuguucacuugugguuaggagacaagguuucgcuagcaguagcagucacuuaggcucaccccugcaauaggagggacacuuccaaagcauagucugggcagcagucuccuaaacaugucuacugugagucugcuuuuauucauaaauauucucauaaacaguuuguaagaugauuagacucuuaauaagccgagugugguggcucaugccuguaauccaagcacuuugggaggcugaggcgcguggaucacuugaggucaggaguucgagaccgccguagccaacaugguaaaaccccaucucuaauaaaaaaauacaaaaauaggcagcuugguggcacauuccuguaaucccagcuacucgggaggcugaggcaggagaaucgcuugaacccgggaggcagagguugcagugaacugagaucauaccacuguaguccugccugggcaacagaguaagacuuugucucaaaaaaaaaacaaacccaaaaaacaaaaaacucuucauaaauauaauuuuacaaagcagauguucuuuucuuuuuuuuuuuuuugagguggucuuacucugucacccaggcuggagugcagugaugcaaucauggcuuacugaagccuugaacucucggcucaggugauccuucugucucagcuucccugguagcugauacugcaggcauaugcuuaugcaccaggcuaauuuuuaaauuuuuuguagagauggggucuugcuuuguuguccaggcuggucucaaauuccuggcuucaagggauccucgugccuccaccuccuaaagugcuaggauuacagacaugagcgaccacaccuggcugucauccuauccuuugaaacuuugaagccagguauugacuuuucucuagcuaugaaagucuuagagggcauagucuuccaacagaaggcuauuucaucuacaaugaaaauccguuauuuaguguagccaccuucaucuuuucucuuagauuuucuggauaacuugcugcagcucucuaucaguccuugcugcuucaccuugcacuuuuauguuauggagacagcuucuuuccuuaaaccucaugaaccaacuccugcuagcuuccaacuuuucuucugcggauucaucaccucucucagccguaacagaauugaaaagaguugcgcucuugcucugaauuaggcuuuggcuuagggaauguucuagcugguuugcucuucuauccagaccacucagacuuucuccacauuagcaguaaggcuguuucacuuucuuaucauugauguguucacuggaguagcauuuuuaauuuccuucaagaacuuuuccuuuggcuggguguggugucucaggccuguauucucagcgcuuugggaggcugaggcaggaggauuccuugagcccaggaguucaagaccagacugggcaacguggugagacccuguugcauagaaaaaaagaaagaaaaaaagaacuuuuccuuugcauucacaaguuggcuguuugguccaagaggccuagcuuuuggccugucucagcuuuugacaugcuuuccucauuaaacuuaaaucauuucuagcuuuugauuuaaagugagagaugugugacucuuccuuuuacuugaacacuuagaggccauuauagaguuauucauugccccaguugcaaauauuguugugucuuacggaauagggaggccugaggagagggagagagaugggguaauggcucgucaguggagcugucagaacacauguauuuauugauuaaauuugccaucuuauaugggcaugguuuguggugcccccaaacaauuacaauaguaacaucaaagauaacuuaucacagaccacuguaacagauacaauaguaacaaaaaaguuugaaauauugugagaauuaccaaaguguaacacagagacacaaagugaacacauuguuggaaaaaugaugcugauagacuugcuuaauguaggcuugccacaaaccuguaauuuguagaaacugguaacugcaaagcacaauaaaaugaugcacaauaaaacaagguaugccuauauuaauaaaaggagaaggaagaaugguauuggaaggcaacaagcauuuacugccuuaccugagagcaguuauaaucuuauguaaucaaagauuuauuuugaaagauuucuaagcuuggguuuuaugauauaaacuuuaguaacuuugagcuguuugagagccaaggguauaugugccugaaaauucuacaccauuauguaacuuugaaauaaaggauuauguucuguuuuaccugggauauggaaauaucuguuaaugcuuauugaaaaugaggcuaaacauuuauaucuugguaaauuuaggcuauuuuuguauuauugggauucuauuuauuuuguucuucuuaucauaagaaucaucuggggcauuuguuacauaugaggauucuggggcucacccaucugcuuaaucagaaucaguuccagaggaucauuauguguaggcauguuuggaguauguuuuuuaauuuucucuuuauauaaacuuuucuguuuuucuuguaaaccagcuguugucaaaauguggucugaggacuucugggcaucucugagaccguuucaggggauuuauaggauguuuucaaacuauguauggcuuuucuucauguucuucaaccagaacaacauauugcaauagaaugaacauagaaugauucugccaagagcaaacauuaaagaaaaacaaauuuuuuuuuaaaaaaaaagaaugaaugcugaagcagauaugagaaucuaguuauuucuguuaaaucagacauuaaagauauuugcaaacauguaaacaaugccaucuuaguaagguuuuuguuuuguuuaggaauacagguuguguguuccuaaucuaaacauucaaaaucugagacgcuccaaaaccugaaacuuucugaguacugacaugaugcuuuuuaaaggaaaugcucauuggagcauuuuggauuucagguuuuuggauuugggauguccaacugaguaaguauaauucaaauauucuagaaucugaaaagaucugagauccaaaacacuucugaucccaccaagcauuuuggauaaggaauacucaaccugaauauaguuacuuuucauaaaaauugaauauguuaaugaguaauagguuauuauuuuaaaauaaauaaacaauuuuuuuuaaugauacuuuuaguuucuacaguggugaauguugauagauauaacucauauaaacaagaauucuaggcuggacgugguggcucacgccuguaaucccagcacuuugggaggcagaggcaggcagaucugcugaggucaggaguucgagacuagcuuggccaacguggugaaacccaucucuacuaaaaauacaaaaaaaaaaaaaaauuagccaggcaugguggcgcauaccuguaaucccagcuacucuggaggcugaggcaggaggaucacuugaaccagggaggcggagguugcagugagccgagacugugccauugcacuccaggugugugccaccaugccugauuaaauuguuuuauuuuuguguugcccagugugaucuugaacuccuggacucaagggaaccuccugccuccaccucccaaaguguugagaucccaggcaugagccauuguacccagccucauuuauuccuuuccgucacuaauuauuaaguaauauuuggacuuuauuuauuuauuugagacagggucaugcugugucaccaggcuacagugcacugcagccuggaccucccaggcucaagcaauucucucaccucagccugucaaguagcuggacuacagguguguaccaacaugccuggcuacuuuuuuguuuuuuuguagaaacaggguuuugcuguguugcccagacuggucuugaacuccuggccucaagugaucugccugccucagccucccacaguccaccugccuuagccuuccaaagugcugggauuauaggcaugagccaccaugccuggcuuuagacucuuuucuugaaacagagucucgcuuugucacccaggcuagagugcaguggcacgaucucagcucaccgcaaccucugauucccaaguuccagcgauucuccugccucagccuccuaaguagcugggauuacaggcacgugccaccgcacccagcuaauuuuuguauuuuuaguagagacgacgggguuucaccauguuggucaggccggucucaaacuccugaccucgugaucugcccaccuuggccucccaaggugcugggauuacaggcaugggccaccgugccuggcccauaaacucuuuuuuuuuuuuuuuuuuugagacggagucucacucugucacccaggcuggagugcaguggcacaaucuuggcucgcugcaaccuccaccuucuggguucaagcaauucucugccucagccuccugaguagcugggauuacaggugcccaccaccacaccgggcuaauuuuuguauuuuuaguagagaugggguuucaccaucuuggcuagacuggucuugaacuccugaccuugugauccacccgcugcggccucccaaagugcugaaauuacaggcaugagcuaaacacuuuuuaaauaagggaacuggaacuuaaagagguaacuugccccauaucacuugcuuaauaagccaggauuugaacccugguccuuuugauucugaagccuaauuuccccccacuauacuguguuguuuacuauuuagggaaacugaagcaaagaagaugugaaaugcuagcgguagcuugaacuaaaauucuuaaauucuugguaguaauaguuuaccucauuucucaaaguguuccuguuuacaugcuaauacucaguguaauaauaguacccagggcuauuuucugaguuguaugaacugcuuuuagcauuuuugugauccuuuaguuggcaaaaugcuuuaccguccuguggaaugcacaguagauacuugcuucuguuuggacaaaagaccagcgugaccuaugucaaugacauaaaguuggauuuccugaagguaggguuucuaacugauaauaguuuauagccaugggcagaugaagugagaugauaauaguucucauuucuaguguauugugaggauuaauugauacaauacagugccuggcacaaggaaaacacuugauaaaguuagcaauuguaauuauuuauugaguuuuucugaaauaaugaaauaauuacucuuuuggucuaguuuauuugaauucuaucuguauuacucauuuagugaauuccuaccuaaccuuaagcguccuuuguaaguaauacaggaucaguaugaggguagcaucauuaaauuuuuguugguaccuauuauaauaggagcacugggaccauuugcauaggccauaauaaguaccuaacaugcacaaaggauucuauuauguuaaucaguagaugaagacaugagaaucccugcucuccagaauuuaacugaagagacaaguaagagcauauagucggccaggugugcuggcucaugccuguagucccagcacuuugggaggcugagguggguggaucacuugaggucaggaguccgagaccagccuggccaacauggcgaaacuccgucucuacugaaaauacaaaaaaauuagccgggcgggauguugcacaccuguaaucccaguuacuugaguggcugaggcagcagaaucgcuugaacuugggaguuggagguugcagugagcugagaucaugccacugcucuccagccugggugacaaagccagacuccaucucaaaaacaaaacaaaacaaaaaaaaccauauagucagugguccagagacuaagugaaaauuucugguggaaggugaaaauugauuugaaccuuaaggguugcauaauuuaaaauuucagcuuauauaauuaagaaauuauacacaauauuuauugaggaaaaauuacaaaaagaggcaauagaaaucacuuauuuccccugcuggauggaauuugauaggcgcauaaauggugaaucaguucuuaagcaugagcaagggaagaagcaggaaaguucaaagcaucuuuagaauuaaugaauagaucauguacugaaauacuaugaucuucaagaucuuaaggaaaaaagcaguguguaaagcagugagaacagaacagaauauaauuuuuuuuuuuuuuuuuuuuuuuuuuuuugagacggagucucacucuuguugcccaggcuggagugcaauggugcaaucuuggcucaccaaaaccuccgccugccggguucaagcgauucuccugcuucagcuucccgcagaauauaauuuauguuagaaaaaguacauacauaauuuuucuuugaaagauacauaggaaaugguuuaacaaugguuauugaaggaagaaaaccucaagcucaaugggagagagacuaugauuuuaugccuuuuuaugguuugaauuauugugucuauguuuccauuuuuaaaaauucagguauucacauauaaaauucacacuucuaaaguguauaauucagugguuuugagguuuucacaggaugugcaacuaacaccucuaucuaauugcaggacauuuucuucaccccaaaaagaaaccacauacccauuccacuuuuucccuggcaucuagcagccacuaauaagcuucugucuguaugcuuuucaugggaguggaaucauauacguucauccaugucauaguauguauauguacuuuauuccuuuuuaugguugaauaauauaccauuguauggauauaucacauuuuguuuauucauuauuuaaugaaaauuuggauuguuucuuucuuuuuucuuucuuucuuucuuuuuuuuuuuuuuuuaacagggucuugcucuguugccuaggcuggagcacaauggcaugaucauagcucacugcagcauugaccuccugggcucaagcaacccuccugccucagccuccugaguagcugggacuacaagugccugccacuaugccugccuaauuuuuuuuuuugaggcagagucuugcucugucacccaggcuggagugcaguggcgugaucucggcucacugcaagcucugccuccuggguucaugccauucuccugccuuagccucccgaguagcugggacuacaggugcccgccaccacgccuggcuaauuuuuauguuuuuaguagagacgggguuucacuguguuagccaggauggugucgaucuccugaccucgugaucugccugccuuagccucccaaagugcugggauuacaggugugagccaccguggccuggcuaauuuuuaaacuuuuuugaggagacagagucucacuauguuguccaggcuuguuuuuacuuuuuggcuauuaugaauaaugcuaauaugaaaauuuguguacgaguuuuugugugaacauguguuuucacuuuucuuggauauauaccuagcauugaaauugcagggcuauacuguaacucuauguuguaacuucuugagaaacuuccauaacuguuuuccacuacugauauaugaggguucuaaggguucuaauuucucugcauccuuaucaacucuuguuauugucucuccuuuugauuacagcuguccuaguagguaugagccaugucuuauuguaauuuuauuugcauuucccuaauaacuaaugcuaaacaguguuuuuucagugcuuauuggccauuuucauuuuuauuuuuuggagaaguaucuauuaacauuugugcccauuugaaaauuggguuauuugucuuuuuauuguuauauuuuaagaguucuuuauguauuuuauauacuagacccuuauuaguuauauuaauugugucuuagccuguucaggcuucucacaaaauaccacaaacugggcagcuuauaaacaauaucuguuuauuucucauagcucuggaggcucacaaguccaagaucaagguacuggcugauaugggguuuggugaggguacucuuucugauucauagauggcaccuucuggcagugucuuugcaugguggagagcuagcucucgggucucuuugauaagagcauuaaucucaaucaugagggcucugcccucacgacuugaucgccucccaaagguuucaccuccuaauaccgcuaucaccuugggguuuuuguuguuauugaagcaagguuuuaaauuuugaugauauccaauuuauuuauguuuccuuuuguuguuugugcuuuuggugucaugucuaagaaaacauugccuaauucaagguugugaagauguauuacuguuuucuuccaagaguuauauagauuuagcucuuacauuuaggccuuugauccacuuugaauugacuauuguauaugcugugaauuagagcuguuauuuuuuuaaacuuuauuuugagauuagguaagaguuauaaaaguaacuuacuccaccugaaguuaacuuuugugcuucaaagaacauacaguccauuguucccacugcugcugcugcucuucuaacaguucuaguuucucacaaauuucuguccauaauccugcucagcacccuguaccaucucuauaucucgcuuuuccucccgagcugcuguuaggcugucuguugcauuuguaauuccuauaguuccucaccaguaguggcugagcucccgccuucccagccuguauuuuugacucauucaagguuaaaaauucuccagcagcuucuuuaauguagcccacaauccccuacauagucuucucucuccuuacuucuucaggcucaccuugccccacuucaucagugagcaacaauggaccauugauguggaagguacacccucauguuauggaagcagaaacugaggcauagacuggcuaaugauuucccacaaggacacaucuaauuaggaccaaaacaugguuuugguaccaguacuguacuuuccauccuuccccacugccucuuaagaguuugaagaugcagagcuguauucauuuauuuuugcccaaagucaaggugaguaaaugugaacuuuaaagaaaauuugggcuuuaaagaaaaaauugaagugaagaagagaugauaggaagaagcugaagauuuggcuuaggaugguggaauaagaaguaacaacaacaaugaaaaagaaagaaggcaaaaugcuaauauuuugucuguugccuucugugagggcaggugggaauaucuaguuaacuguguuuccuaaaagcuagaaagauaaaagaauaggaugugugcauaugguaaccauaccagugcauccuguuuucagauauuugccuugucuucccacaaaccaucuguauuagucugcuauggcuacuauaacaaaauaccaaaagacuggguaucauuuuguuuuguuuuguuuuuguuuugagacagggucucacucugucguccaggguggagugcgguagcaccaucugggcucacugcaaccuccaccuucuggauucaagccauacuugugccucagcuuccugaguagcugugauuacaggugugugccaccaugcccagcuaauuuuuguaauuuuagcagagacaggguuuugccauguuggccagacuggucacuccuggccucaaguaaucuaccugccuuggucucccaaagugcuggcauuacuggcaaaagccaucacaccuggccugcaugucuuaaauaacagaaaucuauuucucuugguucuggaggcuggggaaaguuuaaaaugaaguugcuuaccaauuuuguuccuggugaggguccucuuccuggcuugcagauggcuguguucuugcuauguccucacaugguagagagaaagagagagagaucucuuguguuuccucuuauaagggcacaagugccaucaugugagcucuacacucaugaccuaauuaccucccaaaggcccugucucuaaauaugauuggagguuagagcuuuaacgugaauuuuugggggauucaguccauagcaccaucuaacuggacuagauaucucuggauuugagccccaacuguauuucuuaucuccccaauugccuggaaaaaaaaaucuuaucuuaaacuauuuuuguucucuuuguagaaaccaaccaccauuuuaugcccccucugagggcaguucagugugugagguacucuuuaugggucuugaagaacguguuucucagaagaaaauaguagcuguuuaucaaggcauuuaugugcugggagaaucuccuauugauuucugauaagcuguagagauaucuuuguugaaauuuaaacaucuauauucuauaaaucuauauuuauccuggaaaaaguaucaggagaaauuauccuaugaaugccaaaagaauuugguauuuagucuaaguggauuauaacagaaaguucuuuuuuuuaaaaaagaaucauuuccuuuaggaauggcuaaauaagauguauuggacugguuuaaugagauauugugaugaguuagugauuuugacaaaaauggcugaguaguucagcauuuagaugguuggauauuaaagaugauauaacaacuuacaaagaaugggauauaacuaacccuuaccaagugcuucuauuuaggaacugagaaggauuauauuaaucccagcugauaggggaaagagucaaacuucccauaaaugcagucugauacaaagccaggaagaauguugagaucuaaugaauuaagauacaguagugcuuucugccaucaaggaaaaaaagcaaccaugauucuuucuguuaaaagugacaggaaggccggauguaguggccuauaaucccagcaauuugggaggugggaggcaggaggaucauuugaggccaggaguuugagaccagccugggcaacauggcaagacuccauaucuacagaaaauuuaaaaauuagccaggugugguggugcaugucuguagucccagcuacugaggaggcuaaggugagaggauugcuugagcccuggaagucgaggcuggggugagccacaguugugccacuguacucuagccuuggugacagaaugagacucuggagacucugucucaaaaaaaaaaaaaaaaaaaaaaaaaggacaacaaaguuagcccaaacuggcauaagaaaacaaaguuuauugauucauguuauugcaaaguucacagguaagccugacucaaggcacaauugaauuuauaguugaaauaauguaaggacuugguuucuguccaucuuccugcugucuuucacuguagagaauugauuaaaaugauaggccauaggaauagaagguaccauuagagccuuacauaucaaugggaaauaguuuuuuguuuguuuggagcaaauaguguugggaaaguugacgauuuaaaaaauaacaguuugaggcugggcacgguggcucaugccuguaauucuaacacuuugggaggccaaggcggguggaucacuugaggucaggcacucaagaccagccuagccaacauggugaaacccugucucuacuaaaaauacaagaauuaacugggcaugguggugcacaccuguaaucccagcuacuuggguggcugaggcacaagaaucgcuugaaccugggagguggagguugcagugagcugagaucacaccauugcacuccagccugggugacagagcgagacucugucucaaaaaaauaaaaaauaaauaaaaauaaaaaauagcaguuugagcuauagcucagaauuaaagaaaaagcccauaaaauguuagaagaaaaucuacaaaaacuuaauucauuguuuucuaaguuucagucauuccuugucauauuauuuguacuauuaauauuuuucuuuaacuggauucuucacaucccucugccccuuuuuuuuacuuagcuauaucuuaagcauuuguauccaugauauauugauuuugaguguuaggucuuuuuuccuaauacacauuaaauuaaguacaguacauauaacuauuaaaauuuuagaagggcucugcgccauauaacaucuccacuggcaugugugccaugcuuuuggaaacaaggauuuaacuguuaaaagauuagagaaggauuuuuucuaagacaucuuguaacagcaagagaaggccuuuuuuuuuuuuuuuuuuuuuuuaaauaaucuuauucuuuugccaggcugaagggcaguggugugauuucagcucacugcaaccucugccucccagguucaagccauucuugugccucagccuccugaguagcugggauuacaagugcccaccaccaugccuggcuaaguuuuuuguauuuuuaguagagacaugguuucgccauguuagccaggcugaucucgaacuccuggccucaagugaccugcccaccccggccucccaaaguguuaggauuacagguaugagccauggcaccuggccaagaaggacuuuuuuuuuugagagagagagggucucacccugucauccaggcuggaguggaguggcaugaucuuggcucgcugcagccuuuaugugcuuggggggccugacucuccuaagacagccauuaguaccaccagguggccuuugaggcaccuccgguauaauguuugaaaaucacuggccuuugauaauugguggcaugagagaggcauuacuaccaaugcacacaagaugccuucugugacuaauguauagugccaguugacuagucaagcacugaguguguaauuuuugucacuuugauaaauguuauguucaucuccuaaggaggucagguugguuauaacauagaguuugguuggcuuguagagugugugcccuuggguguguuguuuacuauuguuuguucugcugguagcugaucugaccuagcccugcuuccuugcaggggcuguggggcaggaguuucaucagaaggugguuguggucacugcagacacuaaaauaaccuaagaaaaugcauaaugauccuuuaaagggaccagagagaauuaggauagccuuuauuguggagaugguccuugagguuucuuaaacugcagauaauuauuuuuccguuucauuuuucuuuuacuaauaacuaaguaguuaggauguguauuacuuguuggagucaguugaaaaauauuauuuacugaaguagacgccagcugaagauuauuuucucuuuagauuauaggcuaccaaagaagacucaguaagcuuugaguuauuagucaauugguaaaugguucuugauaacuuaaugauuuuaccaaucuuuuggagauaacuuuaaaccaaaaacuuuuuuuaccuaauguaaauauuacucaaugcucccagcuuucccccuuguuucauuauuaaaguuugugaacuguuucuuuuuguuuugcuuuuugucuuuuaacuuuuauuuuagguuucuggguacauguaaaaguuuguuacauaaacauguacauaaacucaugucucagggguuuguugugcagauuauuucaucacccagguguuaagcccaguauccaauaguuaucuuuucugcuccucucccuccucccacccuccaccaucaaguagaccccagugucuguuguuuccuucuuuguguucauaaggucucauuauuuagcuccucccacuuauaagagacaauaugcaguauuugguuuucaguuccugcauuaguuagcugaggauaauagccuccagcuucauccguguucccauaaaagacaugaucccauucuuuuuuuauggcugcauaguauuucgugguauauauguaccacauuuucuuuauccagucucucauugaugggcauuuaauuugauuuaauggcuuugcuauugugaauagugcugcagaacuaguuauuuauuuauuuuaucuuauuuauuuauuuuuugagauaagagucuugcucuguagcccaggcuggagugcaguggcacgaucuugggcccacugcuaccuccaccucacagguccagguucaagcaauucuccugcuucagccuccggaguagcugggauuacaggcauguaccaccauguucagcuaauuuuuguauuuuuaguagagaugggguuuuaccuuguuggccaggcuggucuugaacuccugaccuugugauccaccugccucggccucccaauuucuuuuuuuuuuuugagacggggucuugcucugucacccaggcuggagugcaguggcgcgaucuuggcucgcugcaaccuccaccucccagguucacgccauucuccugccucagcuuccccagcagcugggacuacaggcacacgccaccacgcccagcuaauuuuuuuguauuuuuaguagagacgggguuucaccguauggucucgaucuccugcccucgugauccucccaccucagccucccaaagugcugggauuacaggcgugagccacugcacccggccggcuucccaguauuuuuaaaaaaauauucuugacugggcacgguggcucacgccugaaaucccagcacuuugggaggccaaggcagguggaucaccugaggucaggauuucgagaccacccugaccaacauggugaaauccucaucucuacuaaaaauacaaaauuggcugggugugguggcacaugccuguaauuccagcuacucaggaggcugaggcaggagauuugcuugaacccgggaggggaagaaucacuugaaccugggagguggagguuacaguaagccaagaucacaccauugcacucaagccugggcaacaagagugaaacuccuucucaaaaacaaaaacaaaaaaagcacaaaaaaaacuucauuauuguggauauauaauaguugcacauauauaugggguacaugugauauuuugaugcagacaugcaauguauaaugaucaaauagaguuauugggauauccaucacuucaagcauuuaucauuucuuuguguugggaacauuccaguucuacucuuuagugauuuugaaauacacaauaaauuauuuuuaacugugguuguccuauugugcuaccaaacacuagaucuuauuccuucuaucuaauuguauuuuuguagcccuuaaccguucuuuauuccccccucucaaacucuuacuacucuucccagccucugguaacuuaccaucauuauucuauuuucuaucucugugaguuccucuuuuuagcccuuacauaugagugagaacaugugauauuugucuuucugugccuggcuuauuucacuuaacaguucuacccaugcuguugcaaaugacaggauuucauuauuuuuuuuuuuucuuuuucuuucuuuuuuuuuuuuuuuuuuugauacgaaaugucauucugucgcccaggcuggagugcaguggcguaaucucagcucacugcaaccuccgucuccuggguucaagugauucucaugucucaggcucccgaguagcugggauuacaagcaugagccaccacacccagcuaauuuuuguauuuuaguagagaugggguuucaucauguugaccaggcugguauugaacucugcacgucucagccucccaaagugcugagauuacaggugugagccaauaugccuggccuggauuucauuuuuuuaauggcugaauaauaucccauuauguauauguacugcauuuucuuuauccgugcaucugugaacuauuucugaaagugauuugaccauaaccaacuacuauuuuagacuaauguuauauauauauauuuuuuuguuuguuuguuugauuugagacggggucuugcucugucacccaggcuggagugcaguggcaugaucucggcuuacuacgaucucugucucccggguucaagugauccuccugccucagccucccgaguaggugggacuacaggugcaugccaccacaccuggcuaauuuuuguaauuuuaguagagacgggguuucggcauguuggccagguuggucuuaaacaccugaccucaagugauccgccugccuugggcucccaaagugcugggauuaccagcgugagccaccgugccuggccuauaauauguuuauaacuaauguuuauaauauguuuaacaaaauuuaacucuuuucuuccagguaauuuauccucagcauuccaaacuuacugacagagaaguaaguaaaaauacugcucuguauaguuuacuguuauauuucuguuuguuuuuauugauuauguaugugucagcauacaucacuuuuguuuucuuuuucagaaaaccaauauuugcuauuugucuuuuccagauucaaauucagguaacuguuuuucauacaguguuucuguuuaauuuuauacuaagaauacugguuauacuguuaauguaugaaaauugauugaaauagcauauuagauugcaaacagaucaaugauuuuuauuccuauuuuaaugaugccuagucaugucaucguugauuuuaguagcuucaacucuuaaaauaacuguuauggugugaugagguaaaccaucaaggaacaauaaacucuuaaaauagugaagagguugaaaaucagcgacauugguauauuugggauucguggaguauguauuaaauaguuuauauaguauguaguuuacuuucaguucagaauuugggagcuuaccaggaacucuguaaaagcagugaaccuaaaaaaagccaggauaaauuugguuaggaagcaaggccauaaguuacgugcaguaguuuauauggguuaauauagguaaagccuuggcguagugcuugguguauagaaaaaaacauacaagggucuguuuauuguugagcuugguuuuguuagucucuuucaagcucuuccuuuugugugguccuaaucguugacauccuucagguuaccucuuguguuucacuuucaaacuagcuuuucuuggcuuauagugaccaaaacauuuagcuucucaggccacacacaguuauaacccuauagcagagacagucuaguuuucuuuccuuuugugguuacuuccuuuuuuuuuuuuugagauggagucucgcucugucacccaggcuggagugcagugacgcgaucucagcucacugcaagcuccgccucccggguucacaccauucucucaccucagccucccgaguagcugggaccacaggcgccugccaccagucccggcuaauuuuuuguuuuuguauuuuuaguagagacgggguuucaccauguuagccaggauggucucgaucucuugaccucgugaucugcccaccucggccucccaaaguccugggauuacaggcgugagccaccacacccggccgguuacuucuaauauugugcuaguuaguucauuuaaucugauuugagagauuugacaguuaaacaaaauuuuuuuuagcauuuucuccuuucuguauaaaugcuuccagaauuuuuuuccuauccauuuggaacucagcuuuggugaacuauaugaaagaaaagugguaucuugguaaauuagauacugccuuuuagagaucccaguaagggguuuuuucugaccuggaauuauuuugguguuuuugacccauuuaugaaauaaugaugcagaggucuuguaggaauguaucuucauuucaguuaacauuuuucuuauaaaaucuguacauacacuucuuauauacugugauggguuagauuuccaggucucagaguaagcugaguuguauggauugcagaaugaacugacuuucugcauggaaucccagugaauuaugcuggaugcucuucucuuucagaucauagcugguugucauggcuccucucucuuuuucacuucucuauaugagcaugaaggggaucagaauauaccacccccaaauauaccacuuuggcuuaagaauuauuuugaguugaaggcaacugagaaacagcagaugcaaaaagagcccuuuacccucccccuauaugccuaaaagcaggacauacauuuccuuuugugaaggugucaccccuucccuuucccauaccaggaagaggagaaaauucugaaucaccagagaaaacucuuuaucacuggagaugguaccagcuuaauucugcauaaauaagccuugcuaaaauaacccuuaucuuucauuaguuuuacccauauguuuaccuucccacagauuaccaccccuagaaguccaaauccuuuuuccuuugucugcauuuuaguuucuuuuguuaaaaugguaucuaagcucccaaguuuaaccaccucuuuggguuuuuacuuuuuuucucugaagccuuuguaugcauucgaacuaaaucuuuucucguuaaucuguugucuguuuauuucacaggccccaguuagugaaccuaagaugguagaggaaaagucccccgcaugcauacaucaaggcuaagaaguuaauucugugguguuuagauagccuauaucuaguuuuauagccucugcaugugucauuaucaaaaaaauuuuuaaguacuuuuggcuuaugaaugaccuacagauuuuuuuuuucuuuuuucuuuuuuuuuuuuuuuuuugagauggaguuuugcucugucacccaggcuggagugcaguggcacgaucgcagcucacugcaaccuccgccucccaguucaagugauucuccugccucagccucccaaguagcugggacaccuuugccugccaccaugccuggcuaauuuuuguauguuuaguagagaugggguuucacuguguuggccaggcuggucaugaacucccgaccucaagugauucgccugccucaggcuuccaaagugcugggauuacaggugugaaccacugcacccggcugauuuuuuuucuuuucuuuuuuuuugagauggagucucgcucuguugcccaggcuggagcgcaguggcgcgaucuccacucacugcaagcucugccucccggguucacgccauucuccugccucagccucccgaguagcugggacuacaggugcccaccaccacgccuggcuaauuuuuugcauuuuuaguagagaugggguuucacuguguuagccaggauggucuugaucuccugaccuugugauccgcucaccuccgccucccaaagugcugagauuagaggugugagcuaccacgccugacugauuuuuuucucauagauauuauuuaaugcuuuuuuuaugugcugcacaucaaaugaagugugguucuugugacuugaaguaugguugguacaaggaaaaucuacaaaagaccugaaagcaggcacuuugcugucuuaacagaucaucauuguccuagguagcaagagacuauauguuuuguaaauauuugaaauugcuauuuucaguuguaguuauccauacaguuugguuuuuuuauguguuuauuaaaugaaaauuggaggccgggugcaguugcucacaccuguaaucucaggacuuugggaggcugaggcggacagauaacuugagaucaggaauucgagaccagccuggccaacauggugaaaccccaucucuacugaauauacaaaauuagcugggcgugguggugugugcccguagucccagcuacucaggaggcugaggcaggagaaucucuugaaucagggaugcugagguugcagugagccgagauugugccacugcacuccaggcugggcgacggagugagacuccaucucaagaaaaaaaaggauuacuguaccaacuuugaaaugaauuuguuauuucccaggauaaccuuuaauugcuguagaagaaaguccagacacaguagagcagucuuuaggaaagagacauaaaucaagccuuuauuuccauuguauacccacuuaaacagcauguuagacuggaugaaaaaaugacacagauaaaaaugcuuuugagauuggaaucguuugcccuuccccgccccuccgccaccuuagauucuccugacuuuaaaaaagcuuuguuugguugguuuuuuagguuucaguuuuuuguuucauuugaauggcuuuuaucuuuaggagccuaaguuuaaagagggccuucccucugauaaauauuuguccaguguuuuuuuccuuaucauuuaccauuaacaucaucuggauguagguguuccugaggcuuaagcugugaugagugcccaaggacagaagucacuguauuuuaaacauguccagagaaaaaaacucagcauuaguagagagaguuugaagcaaugaugaaucugagggaaacauuaauccuccuuguucuggauggacuugacaugcagacaauauucgucucaacacauuucuucuuuguagacagcagggacaucaucaugugcuuuacacuucccaguugcuaaagcagcacuucucauaccguguugaagggccaguugggguuuuuaauauuuccagucaguuauggaccaauauuuuugaaaaacaauuuaauugaauuguuagaaaaauaaaaugaaaugaggaaaaaaaagaaauguaaaauaaaagucuaauuuuuuuuuuugagauagggucuugcucuguugcccaggcuggagguaguggugugaucucggcucacugcaaccucugccuacuguguucaagaaauucuccugccucagccuccugaguagcugggauuacaggugccugccaccgcauccggcuaauuuuuauauuuuuaguagagaugggguuucaccguguuggccaggcuggucucaaacuccugaccucaggagauccaccugccuuggccuucugaagugcugggauuacgggcgugagccacugugucuggucuaaaaguccaaauuuauuacagcaauaucaaguugcuaugaaaguuucuaaauauauauucucaacuugcauauuuauuugguuauggaacaguaacaagaguuuauggacuggcgucagucuauggaauaaauugugagaagcucuggucuaaaauacuguuucucagcaaccuagcuuaaccacccuaaucacagagagagugacuauauaagcugagggucaagggagggggcuggcucuugaagcuucacguuuugucuuagucuuaggcauuuugauccacucuguagcuauguuuguacaaauauaaaaauaacauuuuaaggccaggugugguggcucucgccuguaaucccagcacuuugggaggcugacgugggaggaucacuugagcccaggaguucaagaccagccugggcaacauagcaagaccccaucucuagugaaauuuuuuuuaaaaaggccaggcacaguggcuuacgccuguaauccuagcacuuugggaggcagaucaccugagaucaggagugugagaccaaccuggccaacauggugaaaccccaucucuacuaaaaauacaaaaaauuggccaggcgugguggcacgcaccuguaaucccagcuacucaggaggcugaggcaggauaaucucuugaacccgagcagugaagguugcagugagccuagaucccgccacugcacuccagccugggcaacagagcgagacucugucucaaaaaaauaaaauuauguaaguuaauucuuauaacuacguuuguaaaagaaaaagucaauuuccauuaaaauuuuucuauuuuucagugaaucaucagaaagcuauggugcucauagcauaacuuuuauaucuuuuuggaucuuguagaucuuuaguuuucuuagugaucguauuggguaagaugcuuggaauucaguacagucauaggucaaauuggggaauuuuauuuuagugucuuugaguguuacugcuggaagugacuuuagagauuaucuaauaguacuccuugauuuuguugacaaggaaauugaggugaaucuuuccuccaaauguaaccacuauccuuucuuauaacaauacuuuucuuuuuuuuauacuuuuaucacccagccaugcaucccuaagcacgacaguuuaguuuuuccugcuuucaaaacauuuuauaaaaguggauuugaacaauauguguuauuuuguguuuggcaucuuuugcucauuauuauguuugugagucaacauuauaugcagauauauuccaaaaauguuuaauuacaugagggauauggaauaggaaaaauaguaaagagacuuaggaguuaagaugcauguuuuacuucuggcuuugccucuaaccagcaaggauggcuuugagcaagucacuggaacucuuaggauuuucuuuuuuuccuccaaaacaugacagaauggguuaaaaugauugauaggauuuuuuucagcucuaaaauugaugaaacuggauaaauguuauacuaagcuauccuuaauuuauuucauuuuuauuuucauuagguugucuuggagauacccaguuuuguuuuagauuucgacagucuucugggaggagggugucgcugcauugucuccuggaucaauuugacaaagauuuaccaguuuacuuaaagguuggaaaaguagucauaggaaaauguccaugugagaggaaacuuuagaacucauuuauucaguuaccgcugacaccauucagaaauauuuugcuuuuguuuugcuacuauauuauauagcugaauuuccaaagugagucuuauucauaaggauucagcaucugaaugaaagggacuuuauacaguuacuauguuugaaacauaaugucacugugauuuauaaaaauggauuagaauguugagguaauuuucuuucauuuguuaauaaauucuugaauuagaugugggaguggaguuguacuguacaguaacuaucaucuagaguugagguagucauacuugauaacauaguugucucuuuuugauuuuugaaugagccuuguuuuaguuauuauuuauuuaaaacauuuuaauaauucagaugaccuuacagccuagauuuuuuuuuaaguacaugaggaacguuuucaucuggaugcccuaucagcacauccagugugacuuugacauaauuugccugauaacaguuuuuacaguuuaccucccugguuccacuaauggcagagauacuaccugugaaaugucucuuagagccaucuccuccuugcugucacuacuaauauauucuuccaaccaaugauaauaauagcuguuauuuguuagggcuuuguauguucuagauacuguauuaauaagcauauaucaucuaauuaauccucccuacagugcuccaagagagauccuuuuguagaugagggaauugagggcuauugagcauaagaaacuuacccaaggucaucccaccucuuguuuuauuccagcacaauauaccuuauacaguguugccagcuaaaguguacauauauauuauauaaguaaaaucuaaaaugacuacaaauuguuuaacgaguaaagagguauaguacuacuuccuuguccucacuuuuuggaccuuccaaaauaagaacuucaucaucaaaguuucacccucaucuccuuucuaugugugccauauaugugccguauuuuaaucaaacugaacuaugugcuuuuuccugagauagcauguauuuuucugucuuuuguguuuuuacugaaacuccuagcccuuucaacuuggaaugccuuugucuuuguuuaagucauauucauccuucaauucccaauucaaaaacagcugccuccaugaaaucuuuacuuuuuccccuuggcuuuccuguaacacuuuguguuuuuucaugguacccauccuccuauuacaauaauauucauuuuucuacuucuuuuuucugagauggagucuugcucugucaccaggcuggagugcaguggcgugaucucagcucacugcaaccucugccuccuggguucaagcgauucuccugccucagccuccugaguaguugggauuacaggcacgugccaccacacccagcuaauuuuuguauuuuuaguagagacagggauucaccauguuggccaggauggucuugaucuccugaccucaugauccgcccaccuuggccucccaaacugcugggauuacaggcaugagccacugcaccuggccucauuuuucuccuuucuuaucccuccuaaaucaugauauccuugaggaagaacugugucuuaugcaucuuuuuaucuucucuaacacaucacccuguucaaaguagguggucaauauauauuuguuuaaggaauaauaaucaaauaaggaacugagccaaaguuuacuccauuaagauguaaaugcuucuuaaauuuuuggaaugcaauuaccuuucagauuguauguugauaaacauuguuaugcuucauuauuauuggguuaacguguaacugacuauauaagauucacauugucauuuaacuccuuuuauuuucucucuugaaauuguauguuaggauaccucauuuuguuuuaagauugaucccuuauccuugacaaucucaaaauuguagguagaauuuuguagaaacuaaauaaaacauuggagaaaacagaauuugauuuuuuuuuaacuucagucaccuaguauagauacgaauaaagaauguaagcugaguaaguuauagggggaaaauuugacuuuaguacuuagauuguaauuaguacuuugccaucuuugggcaaguuaggaggguuuuuuuguuuuaauuuuaagcuuuuacacacaucauauggaccaugucaagaguuagaagguucugaucuggcuguugcugucaugauuauuguuuguugcuggaaaagcguaacuagcucuucguguauaucucaugucuugauuuggguuuauaaaggagccugauguuaauauuaaaagauauagauauggauauagauauagauacauauauauguacccccccacacacacuuacuugucacuuucuucuuagaaggauccugcuuauuuuuauggauauguguauuuccgacaaguucgagauaaaacucuaaaaagaggcuacuuucagaagguaauugucauacacacuaauaaaaaaaguauuuuuuauuuugugauuagaaaaauagaaaguguuagauuuaagagucuuuaaagucuuugguauuuuaucuuuaaacaugcuauauauauguguguguguguguguauauauauauuuuuuuuuuuuuuuuuuuuuuuuugagguggagucucgcucugucacccaggcuggagugcagaggcacgaucucggcugacugcaaccucugccuccuggguucaagcaauucugugccuccgucucccaaguagcugggauuacaggugcccgcccgacgccuggcuaauuuuuuguauuuuuaguagagacggaguuucaccaucuuggccaggcuggucuugaacucuugaccuugugauccacaugccucagcuucccagagugcuggaauuacaggugugagcuacugcaccuggcuuauauauagauuuuuuuuuuuuuuuuuuuuuuugauauggaguuuugcucuugucgcccaggcuggaguucaguggugugaucucggcucacugcaacuucugccucccagguucaaguagcugggaguacagguacuguauucccgaguagcugggauuacaggcaccucacaaguagcuggcauuacaggugugcacuaccaugcccagcuaauuuuuguauuuuuaauagagacggggucucaccauguuggccaggcuggucucgaacuccugacuucaggugauccacccaccucgacuucccaaagugcugggauuacaggcaugagccaccgugccuggccuuggguuuauauuuuaucuuuuuuuuauuauuauuauauuauagacaccugucucuauauguuuaaccucuauugaauuuuugcucucugugcuagauuccugacaguaaguuacaguuauugcacaggauucugucaaaagccagaggaguccacuuaaguuuuacauuuuagaauaagggaaggaauaaacagauuguaauauuguugcaacuaauaaacgccugaacuauuauauuuuuuuuaagagccaguaaauaaacuuuagcaacaucuuagccauuauuguuucuauuccaaauguacaauucuuuuuguuucuuaaaaagaaucagguaggucacaguggcuuacacuuguaaucccaacacuucgggaggacaaggugggcagauugcuuaagucuaggaguuugagaccagccugggcaacauggcaaaacgcuaucucuaccaaaaauccacccugacccccaaaaaauagccagacuugauggcauacaccuguagucccagcuacucaggaggcugaggucggaggaucaccugagcccaugagguugaggcagcagugagccaugaucacaccauugcacugcagccugggugacagagugagaccuugucucaaaaaaaaaaaaaaaaaaaaaaagaaaaaagaaaagaaagaaacaaaaauaaagaaaauaaucuuuccuauuuaaucccagcuagcaagacauaccuuucccuuuuguacucagaauuugcccugacugcuaauugguguuagaaagauaaaaagugguuuuuaagaaaaaaaaaaaauguuuaaaaauugggauaauuuguaucugaaaugaucaaaccauaagguuacaauuuccaacuauguggcuaugacaguugaacuguaaaauauaacucauaagucuuuuggaaaaguaucaaaauuuacucuuucuuuaauagggaaaguucauauggcuaauuccugauauugcuauuguaaggauaacaggagcuagacuuuugaaguuacucaugacauuaguuuguugauaggaaauucuuuuuuugaagagcaggaaaaucuguuacaugccauuaugcucuuaaaguguagcaauaagguuaaacuuuuuguguucugcagcuaugguuuuguuuccuuuuaacuauccacuguaaaagccuuuuuauuuuaaaauccacacuuuuugcugaauuuagcuuguuaguaauugauuaugcaagaaaugaaugacaaagcaauuuuuaaaacauuguuuuuguuuuuuccucaguccuugguuuugaucagcaaacuaccuuauauucauuuuuuucacacugugcucaaacagauagcaccagaguauuuugaaaagaaugaaccuuauuuggaagcagguaaguuuaacauauaccuuuaugcaggaguuuuaaaauuuuuacuggaaauaagugauaaaaaugaaguugauuuauaacaauuuauaaaaauucagguaggaacuuaaggaauauaugauaggagaaagguauaaaacuauuuuucuggcaucuguaccugcagauauccaaaacugucuuuuguuaucuccuuuaacuacuuugaugaugccuguuauuauuagaauaauaauaaaugaauaucgaguugacaguucuaauacucagaguacuauugaaaaauccuuaugucacuugcuacagauggaaggccuuugccaguugaugugcuuuuguagcuaauuaguaguaauaaaugaauacaaaaacucccuuuaauacuuaggauauaaauuaaccaauuuauauccuagaacauguguauuucugagugaaauauaaaauguuuucaucacuuugacuuuucuuuugccuuuuaucucucauucuuccagguauauuuuuucugcuguauggaaaguaguguucuuauuucuaaugccucauuuuuaauacuuugauauuuucacuuauucuaagaaaauauuuuauuauauuuuucagcuuguaaugauguugaucgauggccugccccagugccagggaaaacauuacaccugccaaucaugggggugguaaugaagguaauaucuuauaucucaauugucuccuuuuuauuuuuauuuuuauuuuuuugagacagggucuugugcugucacccaggcuggaguacaguggcaugaucacagcucacugcagccucaacuuuccgggcucaagcaauccucccacuucagccccacaaguagccaggaccacaggcaugcaccaacacaccuggcuaauuuuuaaacuuuuuguagacagaaucuugccauguuuccuaggcuaauugugaucuuuuuaaagaacuuuuggacaggcgugguggcucacaccugugaucacaccugugagcacuuugggaggccgaggcggguggaucccuugagcccaaguguugaagaccacccugggcaacauggugaaaccuugucucuacaaaaaauaaaaaaauuaacggggcaugguggugcacaccuguaguccuagguacuugggauauugcuugagccugggaaguugagacugcagugagccagguuugcaucacugcauuccagccugcaggacaaaagcgagacccugucucaaaaaaaaaaaaaaagaacuuuguaggaagcucacacaugggcuuugcuuuuuuaaccuucuauuaauauuaaucauguuauugcuuucccuuguuugucauugaugugaggcauuauagagauauugcaauacauuuugcuuccuagaaccauuagucacacaacuucaggcaccucugaucucauggcauccuguagaguuugcagaagagugucauuuguauguaauacauguauauguaaaugcuaccuccuggaguucugcaauuccauggcccugccagugccuccagagaugagugauaugcagaaacagauuacuugguagaauugaguaugaauuaauaaaaauuaagagaaauugggaaagccauugguucuuaguccuaagugauguucuuaacacgugaugucagaccacacauguucaucccaggguuuuguucucuguuagauuuuucuuuuaaaugaauuagcauuuugcucucagacuuuguauagguuguacccuaagugcuuugcaagucacugucgaguaggacuuauuuuugacaauguucucucucugcauuuggccauuuuuguaggaucuguauuguguuuuuccuugggaaaucaucaaaaguaauacugauaguucuggauugaguguucucauuguuuccugugagauuuauccaaaaauuuggcaagcuugagaggguguguuuggguguguguauauuaaugaagcaaagauuugaacaauaaacaggaagcaguaugaagcugauguccauuuuguuuuucaacauacuugcuucucagggaguuagugauuacuguguguguguggguauggagaccuugauuuacuuacuuucugcugugacuaaaaauaaauaugaccuuaguuuuuaacucugacauagauaauuuuguuuuuguagcuuuuuuggcauuacugaccauaccuuuuuagcagcaggauacagcacuucucauccuccauucuuuuauaaccaaaaauaauuuccugucuuucuuuuagguacggauucccacaugucaugacaagccugggacaacucaaauagugcaguuaacucagcagguagugugguacuaugguagaaugauccagcacauauauagucucuuuaacagaauuuuuaaacuagcaaaugcagaguuucuugaguuuauuacauauuucugaauauuacugaaaugucccauuaaauaauuuuuaaugaauugguaauauauuuucuaauguuucuuagggucuuuuuucuuguuauuucuccaguagagacuggagaacucagaauuuauauuuuaauugugaggaaaaggggaaagugaauuuuuuucaauaagcuuugauucuggcagaaccucuuaggagagugaccagcagacuucugauuuuagaaaacucaguuaaaaggauucuguaguuacaauugcccuuuauuuuuccaaaagcaccaucuguucaugggugggguugaaguuuucauuugaaauguuuuaacugguguacauuuuuuuguuguacuuuguucuuugaauugaauaaaaaacagauagcaguaggaaaacuaguauuucuguuacauaucaaccaguauuaaugggaguauuucauacaguugcaaauuaaucugauuuacuauuggauuaauuuuuucuuaaacaaggacagggucucccucugucucccaggcuggaguacgguggcacaaucguaguucaugcagccuccaauuccugggcugaagugauucucccaccucagccuccuaaguagcuaggacuacggugcaugccaccaugccuggcuaauuuuuaauauuuuuuguagggaugggauuucacucuguuacccaggcuggucucgaacuccuggcaucaagugauccuccuuccuggauucccaaagugcuaggauuacaggcaugagcuugggauuaauucuuuuuuuuuuuuugagauggagucucgcucugucaccuaggcugcagugcaguggugcaaucucggcucacugcaagcuucaccucccggguucacgccauucuccugccucagccucccgaguagcugggacuacaggcgccugcccccaugccuggcuaauuuuuuguauuuuuaguagagaugggauuucaccguguuagccaggauggucucgauauccugaccuugugauccgcccgccuuguccuaccaaagugcugggauuacaggcaugagcugucaugccuggccgggauuaauucuuuauccauguuaucugcauuauuuuugauuuucugcuauauuagggaauauugguaagacccauucccucucuggcuguuccuaaaggaagagaaucuuaaaaguuagacagggcagcauggcuuauugaucaugagauagauauauuuuaaaauuuuccauaaauuuuggugauaccuucuuuuauuuuucuuuucuaucucucagguggacacaaauauaucuguuauuuuaccuacuguucaugagguggauauuuucagguaaagaauaaaaaauuuuauuaacugacuuccuuuugcuuugugguggugguguuaauuuauuuaaaaaaugaauauuauauaggauguggaaaaaauuggaagaaaauaguuauguuuuacauguuauaaaucaaugguucaucccuggguacauguuauaagcuuugacaauuagggaaauuuaaauauagaauauguauuauauguaaaaauauuuuuguuugguuuagugugagaauuauauuguaauaauguuagaaaacaugcuuuuuuaaaaaagagaugcauuuuauuugggagugaaaugucaugauguuuguguucuauuuuaaaauacuucaguaagaaaaaauagaugacgugaaaaauggcaaauauuaaucauuaaaucugagugauauguauaugauguuucucacacuguuguuuuuacuuuucuguauguuugaaaaaugucaacauggaaaaugaaaaaacaaaaaagagauacuguuagcacuuagaaaagaaauagaggaaaaauaaaaaguaauguuugugccuuuacccagagcagcuaaaucuuuggauugguacccaaguucuaguuccccagguaguucugauguauaggccagcuugaaaaaccacugcuauaaaugagcaguuacgaaaugcucaaaaagucaugaaagacuuaaaauggauuuuuuuggugggaucuuuuuucuuuuauuuuugagacagagucucacucuauugccuaggcuggagugcacugcugcagucuuggcucacagcagccuccaccucccagguucaagcgauucuccugccucagccacccaaguagcugggacuacaggugcacaccaccaugucuggcuacauuuuuguauuuuuaguagagaugggguuucaccauguuguccaggcuggucucgaacuccugaccucaagugauccaccugccuugcccucccagagugcugggauuacaggugugagccacugcgccuggcugaccuuuuuguuuguuuuuuaugacuuguaaacuacauggaauacugcuucaaaagauugguuaguuuaaaaaaaaaaaagauugguuaguuuuauauguugcucuagcacaguacagucauccuauuucuagguauuuauucaauaaaaaugaaaaugugucuacaugaagaccuguaugcaaaugucuauauaguagcuuuauucauaacaguauaaaacuauacacaaccgaaguauccaucaacugguaaauggacaaacaaaauguaauacaugaaugcacauggaauacuauucagcaguuaaaaaaaagaaggaacaguugauacaugcaacaaugugaaagacuuccaaaagcauuaugcuaagugaaaguuuccagauaauuuaaagauacugaaugauuccauuuauaugauguucuggaaaagauaaaacuauagggacagaaaucagaucagugguuaccuggggcugggggaggaaaucuacuacauaagggcugcgggcauuucgugaggugauggaacuauucuagaucuuugguaaggguaaauuuuacugcauauaaauuauaaaugugacuuuuaaaacaaauuaauuuucuuaaaaaguacauguuauggcauuauuaggaugaaaagagggaguguccccaaaaugaauaaauauuacaggcaaaauauacuaagaagaauguguacauuucucguuuugauacuugacucauuaaggaauaauuugcagaauuggcauaaauuaauauagaguucaauuauuggacauuuuuucuuuugaacuucuggguaugagucuuacgcuuuauuguuuguuacugauuaucuuagcuuuugugguaaucuugcauaucccauaucugaaauggucagaaucagaaguguuuuggauuuuggacuuuuuugcauuuggggauuuuugcauauacauaaugagauaucuuggggaugggcccaaguuuaaacacaagggucacuuaugcuucauauacaccuuauacacauagccugaacguaauuuaaaaaaauauuuuuaaugauuuugugcaugcaacuaaauuuugauugcauuuugacuuugacuuaccuugaggucauaaguagaauuuuccacuuguggcaucaugucaaugcucaaaaccuuuuggauuugggaacauuuuguaauguagauuuucacauuagggaugcucaacccuuaguuaauuacccccaucacuaacaccuuugauuagcacaugucuugucuccuggauaugaauuacauaauauuguuuuaagaguggggcaaguaaguuuguuguuuuuaaauucuuguuucccgccagaugcaguggcucacgccuguaaucccagcacuuugggaggccgaggcgggcggaucaugaggucaggauuuugagaccagccugaccaacauggugaaaccccgucucuacuaaaaauacaaaaacuagcugggcaugguggcgggccgccuguaaucucagcuacucaggaggcugaggcaggagaauugcuugaacccaggagacggagguugcagugagcugagaucgugccacugcacuccagccugggcaacagaaugagacuccaucucaaaaaaaaaaaaaaauucuuguuuuccaagagaugagaaaaccaaauuuugaaaaauaaucucacacagugauaguauuauaucaagcauuuaauaucuaaugauuagauuaaugcuuuauuugugacugugcuuuuuguuucuguagagcuuacauuucacguuuauuagugugaaugaaaguuuacauauuuauccaguuauauugaaggugauagauuuacaccaagacugagcuugaaagcaaaguaaagagaccuagaaaggcauuugaauuugaguagcagagauacaguugaguguaggcgcuccuuucacuaggucaaggucuauuccauggaccacgccuuugguuucagcuuucuugaucacagaaauaguuuccucauucuguuuuugaggugagauuagaauugaagggcaguuuucuguugaaagaaauagacauuuucuugccuuagagucagggacauuuuacuugaugauauuugcuauuuguuccuaguacaaugagagacacaucaguuaucaccuccugccaccugcuucucuccccuguucccuauugugacuugagaaacaaguuauuuuggcuuucuaccgcauuggcugaguagacaacaguuauagcuguuucuauguuucagagauugagaaagccugucaccacauaaaauguaucugaugcuaucugacacauguugauuuccuuuggguuuagguuucagauuauaauaacauacuauaucuuucucaaaagguugaaaccacuguuuaauucuuagaagugaauuucuggcugggcacgguggcucacaccuguaaucccggcacuuugggaggccaaggcagguggaucacgaggucaggagaucgagaccauccuggcuaacacggugaaaccccgucucuacuaaaaauacaaaaaaaaaaaaaauuagccgggcgugguggcgggcaccuguggucccagcuacuugggaggcugaggcaagagaauggugugaacccgggagguggagcuugcagugagcugagaucgugccacugcacuccagccugggugacagagugagacuccaucucaaaaaaaaaaaaaaaaaaaaaaaagugaauuucuaauuauuuucccaaggcauggcuguuuugguggugggagcuuagcauaaaggcaugauacgccagaaugggaauauaaaugugguacuaaaaaaaaaaaacccagugauuuccuuacagaccuucauuucaguaauccuauacugcaguuaauuuggagcacgcuaccuuuuuuuuuuuuuuuuuuuagauggagucucgcucugucgcccaggccggagugcaguggugcgaucucggcucacugcaaccuccgccuccuggguucaagcaauucuccugccucagccucccgaguagcugggacuacaggcuugugccacuacauccggcuaauuuuuuuuauuuuuaguagagacgggguuucaccguuguuagccaggauggucucgaucuccugaccucacgaucugcccgccucagccucccaaagugcugggauuacaggcgugagccaccgcgcccggccuacuacuaauauuuuuuaguucgagagaaguuuccuuuccugaauauuaaaaacuuaccucccacccaaaaaaacaacuuugauaacauauuaucaguauaauacaaagcuuucaaagaaugauuuaucuuguaacuauacuuccuaucuucuaugugugcccuuugcuaauaauauauuaauauacuugaaagacaauaauuugcaacuuggugccuuaaaggaaucccacuauuaaagucaguuggugagauguuuucauguaggccuuuuucauuuuuccuuugcuuauuuuuacaaaccaacagaaaaguaguaaguacaauacagaagacuuuuuucccaaaccauuugguaguaagcuggcgacuuggugcccugucaucucuuaauacuuuagagucuauuuccuacaaacaaguauacaacgcaaccaucaaaauugguaaaaucaacauugauaaguuaauaucaucuaauacuaagaccaguucaaauguuaccaguuguuacaauaaugucuaguugagaaucaucuguugcauguagcugucacaucucauuagucaucuucagucuagaauaguucuuuagucucugacuuucaugauccugauauuuugcagauuacaggacaguuauuuugcagaaacuccucaguuuaggauugucugguauuuacuccugauuagauugaggcucugcaucugucaggagguggcauauaaguugagcuugacuuguuauugaugauguucaguuugauaacuugauuaaugugguauccuccaagcuucuccacugauaaguuaauuguuuuuucuuuuguaauuagguauuuuugggggagauauuugaaacuauauauguuauuuauugauguguaacaaauuaucccaauacuuaggcuuaaaagaacaaacauuauuucacacaguuucugagggcuggaaaucugggagcugcuuagguggguaguucuggcucagaguuuuuuaugugguugcagucaaguuguuaucugugguuucagucaguuggacauaggagucuggagagucugcuucccuacaaggcuuacucgcacagcuuggcuggagaucgcaguucucuguggcuguuguuaggaggucucagcccuagccuuauggacuucuccauagggcugccuaauguucucacaacauggcagcuaacuuuucccagagcaagcacugagagaaggcugaagccacagugucccguaugacucagccuucaaaguuguacauugucauuucuaccguauucuguuaauuacaaucaaaccaguaauccaguccgcgcucaagaacgggagaauuaggcuccauguuuugaaaggacugucaaagaauuuguggacagauguuauuuauuuauuuauuuuuauuuuuauuuuauuauuuuuguagagagggugucuugcuauguuacccaggccagucuuaaacucuugccucaagugauccucccaccuagguguugggguuacaggagugagccaccaugcacagccuggacauauuuuaaaucaccacacuauuuuuauauaucuguuuggacucugauuucuuguuuuauucaauagauucuaauccauuauuaccuauuuugauauucaaauugucccaguuuagccagugagaacuuaguacaggguggcuucuauguucuuuugccauaucucugucauucuuugaacacugucuugcuuucuggugugagauauuccggguuuaucuuuuuuuuuuuugguaauuaaauaaacugguuuguaauuaucauaucauacaauauucaaccuuuuaaaguacaauucacuaguuuuuuaauauauucacaaaguugugcaaccaucacugcuaauuccagaacauuuucaucaccucaaaacauaacccuguaccuauuagcaguucccauucccucuucuucccagccccuugccauuacuaauuuacuuucugucucuauggacuugccuguuuuggacauuacauuuaacuagaaucauacaaaaugugaccuuuugugucugucuuccuucacccagaauaauguuuauaagguucaucugugcaguaucaugaaucaguacagaugcuccuagacuuauaaggggguuauguccuguuaaacccauuguaaguuugcaaauuguaaguugaaagugcguuuuugauauuuucaguuuacaaugggcuuaucuggagguaagucugucauauguugaggagcauacugaaugcguacugcuuuugcaacaucauaaaguuaaaaauuguaagucgacccauuguaacauggggacugucuguacuucauuuuuuuaaugguugaauaauauuccauguggaugggccaggugcaguggcucacgccuguaauccaagcacuuugggaggccaagguggucagaucaucugagaucgggaguucgagaccagucugacuggcauggagaaaccccaucucuacuaaaaauacaaaacuagccgggugugguggcacaugccuguaaucccagcuacucuggaugcugaggcaggagaaucucuugaaucugggaggcggagguuguggugagccaagaucgcgccauugcacuccagucugggcaacaagagcaaaacuccaucucaaaaaaaaaaaaaaaauuccauguggauauacuacauuuugucuauccauucaccuuuugaugcagguuuggaugguuuacacuuuugguuauuaugaauaaugcuacuguccacauuuguguauacgucuuuguguggacauguuuuccauucucuuggguuccagaucaucuuguauuuucucuucccaagcccuagaaccagccauuucucuaaaaagccuuuguucuuuuuagcagagaauaagauuuagaagacaagaucugggcacuuggugugcuuauugauauugagauaucauugcuuuuagacccucucaaguggacaaagcuaggauguguguguguguauguauguguguguguguguguguguguguauguaaaugcauguauauauacacacucauauauuaaauuauuuuuuauuaacugauuuaaucaauaccucuguuaguaaucaaugcugcaucucugcugcaacuuuuuuuuuuuuagguuuuuuguuuauuucaaaagguuuuuggggaauaggugguguuugguugcaugaauaaguucuuuagugaugauuucugagauuuugauauacccaucacacgaggaauguacacuguacccaauauguagucuuuuuaucccucacccccucccucccuuuccccacugaguucccaaaguucauaguaucauucuuaugucuuugcauccucauagcuuagcucccacuuaugagugagaacauaugauguuugguuuuccauuccuaaguuacuuuagaauaauggucuccaauuccaucuagggcgcucugaaugccuuuauuucauuccuuuuuauggcugaguaguauuccacgguguguguguguguguguguauauauauacagagagucagagcccaaaaaggggaagauggcacccacuuggagacguggucuagugggauagaguaaccugaaugagacaggaggguauccauggggguggggguggggggucaauccaacaaggagaaucagagagugagcaggguaaggaggguauccaugcagaagggaagccagguguagaaugucagggcccaggggagaugagaaaaguauuagcaugggggacaaauauauauauacacacauacaacuauauauauauauauuuuuuuuuuuucacucauugauugaugggcauuugggcuuguuccauauuuuugcaauugugcauugugcugcuauaaacaugcaugugcaagaaucuuuuuuuuuuuuuuaugacuuccuuuccucuggguagauacccaguagugggauugcuggaucaaaugguagaucuacuuuuaguucuuuaaggaaucucuguacgguuuuccauagugguuguacuaguuuacauuucuaccaacaguguaaaaguauucccuuuucaccacauccacaccaacauuuauuauuuuuugauuuuuugauuauggcuauucuugcaggagugagguacuagugcauuguggguuugauuugcauuucccugauaauuagugauguuaagcauuuuuuaauguuuguuggcaauuuguauaucuucuuuugagaauugucuauucauguccuuagcccacuuuuugaugggauuguuuauuuuguucuugcugauuuaaguuccuuauagauucuggauauuuguccuuuguuuggauguauagauugugaagauuuucuccuauucugugaguugucuguuuacucugcugauuauuucuuuugcuguacagaagcaaaauaagucccaucuauuuaucuuuguuuuguugcauuugcuuuuggguucuuggucaugaagucuuugccuagguuuaugccuggauggguuuuuuccaauguuaucuucuagaaauuuuaugauuucaggucuuagauuuaaguuuuugauuaaucuugaguuuguuuuuguaaaggaugagagaugaggauccaguuucauucuucuacauguggcuugccaauuaucucagcaccauuuguuaaauagggugucuuuuccccacuuuauguuuuuguuugcuuuguugaagaucaguugacuguaagcauuuggcuuuaucucuggguucucuguucuguuccauuggucuauaugccuauuuuuauaccaguaccaugcuguuuugaugacuauggcuuuacaguguaguuugaaggcagauaauguauugcuuccagauuuguucuuuuugcuuagucuuacuuuagcuaugcaggcucuuuuuugguuccauaugaauuuuaggauuguuuuuucuaguucugugacgaaugaugggaacaagcaguguaaggagggcauugaugggaauugcguugaauuuguagauugcuuuuggcaguauggucauuuuuacaauauugacucuacccauccaugagcauaggauguguuuccauuuguuugugucgucugugauuuuuuucagcaguguuuugucauuuucccuguagaggucuuucaccuccuugaguaaguauauuccuuaguauuuuauguauugcagcuauuguaaaagggguugauuugauucucagcuugguugcuguugguguauaggagagcuacugauuuguguacauuaauuuuguauucggaaacuuugcugaauucauuuaccaguucuaggagguuuuuggaugaguuuuuaagguuuucuagguauaugaugucaucagcaaacagugacaguuuaaauuccucauuaccaauuugcaugcucuuuauuucuuucucuucucugauugcucuggcuaggacucugcugcaacuuugucccccaagcuaauaguuuucucauccccacugggcccugacauucuacaccuggcuucccuucugcauggauacccuccuuacccugcucacucucugauucuucuuguuggauugaccccccacccccacccccauggauacccuccugucucauucagguuacucugucccacuagaccacaucuccaggugggugccaucuuccccuuuuugggcucugacucucaacaccaggucaagccucacaugagugcucuccuuacccugcuugugugcuuacccuacuccaggguacuucuccauggagauacccucauuucucugcucugacaccuuaugccagguggucccacauugugacaaccuccucaacucauucugucuuugaugcuacucaucaggcuaccugucugugcuuccugggcucugugaacugaaaccaaauaauccccacacauguauacauugcucaccacauuugggcuccagcaguuccacaguaggccacuaucugcauguagauguccaccuuaccuuacauaagcucugacacgccucccuggucaauacggcucucuuucccucauggcagagauaccuaccauguucugcuuuaggacugaguuguuuaggaagggaagaggaagagcuccuuugccuuacccaugagcuguuuuuuuguuguuguuuguuucuuuuguggcacuuaucuuguuuuugaauaguuaaaauuaacuccccuaauuuccaucucauaauuuguugcauauuuuugcacuuaauuguuguuugauuuuucuuuucuuuuuuauuugcaugugugucuuuucaacugaguggauugguugugauuuucauaaauagauaagauuuuccccccuaaucuacuaggaaaauuuuuuaccaagccaggaggaaauuccuaaauaagugaaaguuaccaagugucuuaggccugguaacauacuagcagaguugugucccaacaggccuccacccaauuccagggcugcuguaaaaauacucagcacuucuguagagggaguaucugcccaggaguuucgcucuuguucagcauuagcacucccccuugugauuugucaucauucuuuaaugucagaaguauuggguuuuaaguuaaguauauccaauaagugcccuuggaaaauuaauuuuucuuauuuccuuaaaaauauuuaggauugaaauucaaaguaucaaagcaauauugauaaaauagaucgaucauaugguacaacaauuugagaauuauaugcuuuuauugucaguuauucugugugucaauauauuacauuuaauuuuguaaaaauuaggaugagucaaauugauagauauuuuuauguggauaaaagggacuuaugucucuauacaucaccauauucuaaaugaauuuguguaucagaucaggauacaaauagcaggaagaauuuauaucaauguggaguuuuuagaaagauuauguaggaauuuuaaaaacaggauuggcuacauuaaaaaguauuucuacugugcaucaccuuucagguguuucugcccaguuuuccuucauagucagaugcucugggagcuggugcuguugggggagccccuugugguuauggcgccaucaccaucggaaucaucagagacuguauuggcacuuguuaagugagucuauuugguuacuauuucuggguuuuuuuuuuggaugcugcaguacuuaaccuguuggugauauuugcagcacuucccaccugucguauuuuuccccacccauuauugcauugauccaugcaaaaacccuaucagaagguaaugcuuauuauagcaccauuuuauggaugagaaaauugauucaggcucccugagggcuggaaccaugccuuuguuguucugaguggcaggcacauugauucauuacaugaaguuguuccuugauaaauauuacuugugugaaugaucaguguagagucaaaggcacauagcuagugaacaguagagccagaauuucaccgcaucuucugccccaaacccaguguguucuuucaguaugccauuucacauuacauauaucugucuuucuaauucugugaaaugaguuuaccauuuauuaaaauaaacaaaguaucccuuuguguguauaccguuuguauagauguuuucuaguuauagauuaggaccuuuaauuucuguguccuuuauuuuacauguucuuccugcuccacagcuguauuucuccauuaaaguacuucagugauuuccgaccuuauuucacuauucaugauagugaauucaaagaauauacuacccguacccaagcuccguaaguaaaaauaacuucuauugaccagguauuaccuuuauaaccaaaauuguguagaauuauuuuugguaauaaaagcuuauaggcagaaugaucuuauaaaaggaaaguuugaggagcugcuggaaauaauuuuagauuuuaagaguuaguaccuuauuugagcgauuuuauguauuuauuuuuauuuauuuauuuuugagacagagguuugcucugucgcccaggcuggagugcaguggcaugaucucggcucacugcaaccucugccuccuggguucaagagagucuccugccucagccuccugaguagcugggauuacaggcaugcgccaccacgcccggcuaauuuuuguauuuuuaguagagacaggguuucaccauguugaucaggcugaucucgaauuccugacuuugugaucugccugccucagccucacaaagugcugggauuacaggugugagccaccacacccggcccacgugauuuuauuuauuaauggaagcuauauugucauuaauagcgacuggguuguacuuucaguuguacuucuuuaugaaaaaucuuuucaaucuguaaaaagaaaaaauaaucuuacccuuucccuuuuagcucuugcucuaucgcucaccuucuuuuuacagcuagauuucuaaagcaacaacaaaaaucugcauguacgaucuccacuuccugauuuucugguugcuucuagucaacugcggauugacuucuucauauucacugaauuuguucuugccagaucaucaauacccuucucacuguuucacccagugggcauaucauugcccuguuuuuccuuuucuuucugucuuucccccuccccuccccuccccaccccuccccuccccaccccuccccuccccuccucaccccuccccuccccuccccaccccuccccucccuuccccuccucuccccuccucuccccuccccuccccuccccucccuucccuguugcccaggcuggucugccaccucuucuuucuuguaacauuuacacuuuuaaccuuaaaaauauuuuaaucaccagccagucgugauggcccaugccuguaaucccagcacuuugguaggcugaggcgggcagaucacuuaaguccaggaguuagagaccagccugggcaacauggcaaaacccugucuccacaaaaaaaauacaaaaauuagcuggaugugguggcaugcaucuguagucccagcuacucaugaggcugaggugggaggauggcuugagccuaggaggcagagguugcagugaacucagaucgugccacuggacuccagcccuggggaacagagugagacccugucucaaaaaaaauuuuuuuguaaaucucuaauacuguucucuccugggcugucuuguggugcaucccaaucuucuuugcagacuucuuuucucuacgaaucccuuaaauguugguguucgcuagguauuguguucugaguucugauuucagacugauaguuuuuuuuuuuuuuuuuugagauggagucuggcacugucauccaggagggagugcaauggcgccaucuugguuuacugcaaccuccgccucccggguucacgagauucuccugcuuuagccucccaaguagcugggauuacaggugcacacuaucacacccagcuaauuuuuuguauuuuuaguagagacaggguuucacuauauuggccagacuggucuugaacuccugaccucgugaucugcccaccuuggcuucccaaaaguguugggauuacaggcaugagccaccacgccuggcccagacugauaauuauuucuguacaguuuuuuuuuuuuuuuugagacagagucucgcucuguugccugggcuggagugcaguggcaugaccucagcucacugcaaacuucaccuccuggguucaagugauucuccuaccucagccucccaaguagcugggauuacaggcaugcaccaccacacccagcuaauuuuuguauuuuuaguggagaugggguuucaucauguuggccagacuggcucgaacuccugaccucaagugauccacccgccucagccucccaaagugcugggauuacagacgugagccaccgugccuggcccuuucuguacagucuuaucuguacccauggcuucuguuaauaccccauguuaaugacugaaauauaucuuucuagccaauaucucugugagguccagaccuauauaaccaggcguguguguguguuguggggggagggggauguuuuaagcacauugccccauagaagauagaagucuuaauggcaucugaaacuaaacaugugcaaacugaauuauuuuugucucccucuuuucuccccuaaucucauaccucuucuuucuuuucauggauggcauuaguuuucacuuaguucucaaaaccuugucauaaauuucuccuuuguaacaugccccacauuaaauuuuaccaaauucugucaguuugauauccuaaaauaucucugauuacauuucuuaucuucuuucuauugcucccuuuccagucuuacugccucucauguuuugcauauccaaauuugcuuuucccucaaccccuucucuccucauaagauaacuuccaaauuucuuccagagugaucuuucuuuuuuuuuuuuuuuugagaugaagucucgcucuugucccccaaguuggagugugauggcgcgaucuuggcucacugcaaccuccaccuccuggguucaagugauucuccugccucagccuccccaguagcugggauuacaggcgccugccaccacaccuggcuaauuuuuguauuuuuaguagagaugggguuucaccguguuggccagguuggucucgaacuccugaccucaggugaucugcccaccucggccuucccaaagggcugggauuacaggcgugagccaccgcgccuggccgauugaucuuucuaauaagugcuuuuucuuucaugcggcauuccuccacuugguuaucugguaguuucccuuugccuguaagauaacaucuaaacuucuuagcauacuaacauggcucuaaugaucgggcaacaauauucucauuucugacuauucauccuuucugcuuuugcuccaggaaugcuaaacucuguguaguucuacagacaggccauaaugucacuucauugcuuugcacauaguuuguucugcaucacucuucccucucucauccacuuggcaaaaaacgcccacucaucuuucacgucuuccuguaaauauuaccuccuuggugaggcuguccuuuaauccccugguagacauagguucuccuuugugauuauuaugcuuuuuuuuuuuuuuuuuuuuugagacagagucucacucugcugcccaggcuggagugcagugaugcaaucucagcucacugcaaccuccgccuccugguuucaagcaauucuccugccucagccuccugaguagcugggauuacaggugcccaccaguacgcccagcuaauuuuuuguaauuuuaguagagaugggguuucaccauguuggccagguuggccucgaacuccuaaccucgugaucugcccgccucagccuccgaaagugcugggauuacaggcgugaaucaccgcgcucggcuaauuguugugcauuuuaaaccaccuucacugucuucuaauuuuggcaucauaacuggguguguauaucuuucuuccugugugcugcuggaaggaccguguccuuucgucuuuuuaugucuaguguaaaacguguugccuggcauguaguugauauguaauguguugaauaaaggaaaaaucaaucuguguauuguucauugaaaaaaaaaguaaacuauucuucacugauuuagcauucaucuuuuucucaccuuuuuuauuuuguuuuguuuuguuuuuuauaggcccucaguuauauuaggaguaaccaacccuuuuuuugcuaagacacuccagcacuggccacacauuauucgaauaggagaccuuaaaccuacagguaaaguauaaacuugguguucuguuucuagugugcaguguugcugaacagguuucuuucuuuucauccuugauuauuuuuuauguugauggcagcuuucuucaaggccuuuggagaaggguauaauuuccugcuaauuucccacuaaaauaugcaggcucuuauaauauguauaaucugucauguccuccuaccaaaaaauauacuuauaguguuauauuauuauagaauaauaauauaacacuuauagaauuauaguaaaaugaagucuuaaaaauguuagcuuuauauauauuaaauauauacuuaaauauauauuuuaauauaauauauugaauauaaauauauauuuaaauauauaauauuuaaauauauauuuuaauauaacauugaauauaaauauauaauauauauuuaaauauuuaaauauauauuuuuauuacuuaaauauuuaaauauauauaaauauauauuuaaauauacuauauauauauuuaaaagcccaauaaaacagaacuuucuauauauauagaagcccaauaaaacagaacuuuccaauacugcuugaguaaaaccuuauagaaaacuagaauuauucccaacuuaucacaaaauacacagcuaggucucaaaacaaguauaugucccuguagcacagguuauugauuuagggagcgguucaaagugucuuuucauauggaaaagacauacaguaccuuguucaugguaggaguuuaacagauguuuaaguauaugaauucugagguuggaaguuuuguuaaccuagaugacaacuaaaugguacauuaauuaaggacaugagucuugcguaugagaagauaugagaaaauuuuuuaaaucuuaauuuaaucuugacauuuauuucaugguuugggcguaguaauuuagacuguuuuauuaauuguaauguagcggacuacugacuauuuucuccuuccaauggaagacaucucuccgacaugacaauggacauucaugaauuuuccacugaaauaguugggauuauaaaguuauuuucuaauaacuuuauaauguacuacauuuaucuauuuaugugacagagucucacucuguugcccaggcuggaguacaguggcacuaucucggcucucccagguucaaguguuucuccugccucagccucccaaguagcugggauuacaggcacccaccuccuugcccggcuaauuuuuguauuuuuaauagagacgggguuuugccauguuggcaaggcuggucucaaacuccugagcucaggugaucugcccaccuuggccucccaaagugcugggauuacaggugugagccaccacucccugccacuaccuuuuuuguuuuuuguuuuuuuuuguuuuuuuuuuuugagacagagucucacucugucacccaggcuggagugcaguggcaugaucucggcucacugcaaucucugcuucacggguucaggagauucuccugccucagccucccaaggagcugggauuacaggcgcccaccaccacgccuggcuaauuuuuguauuuuuaguagagacgggguuucaccauguuggccaguuuggucucaaacuccagaccuccagaccgcccaccucggcuucccaaagugcugggauuacaggcugagccacugcgccuggccagcaaccacuacuuuuaaaacuuguuccuuuuguuauacauagauauauuuaaaacaugacuuaaucaucugauuuuacaagauauuccuucugguauauacauauaucuaaauggaaguauuagaaucaaggauaacauuuuaaauaguacuguuuacaaauucuggacucggucuuacugaaauuuuuagaagccuuaugaaauagaggaaaaagcaaagggcuucaucuuggcaaucagaacugugugcuaauaggcugaauagcaucuuuaagccucaaauuuuuugucugcuaggaggauuaaacacagugccugaugcaugguacucuguaaauggcaugguccccugccauucuguuacuguucugucugaguauuaaugauaauacagagaacaacaguugcuagagucuuggauaugagaugauaugauaaauuuuuuuaaaucuuaauuuaaucuugacauuuucaugguuugggccuacuaauuuagacuauuaauuauaauguaguagacuacugauuguuuucucuuuccaguggaagaagucucucugcuagauguagguagauaacuuuugcacaaaaucauugguagagcagcaugaauugauaaaucuguuuaagaaaucaccaaacuguuugccaaaguggcccaucaguuuacauucuuaccagcaauguaugaggguuccuauuucuuaacaucucugccaacauuugauguugucauuuucauuauggccauucuagaauguuugaaauggugauguuaauuugcuuuucucuaaugacuaaugauggugagcacuuuuucaucuacuuccuuucauucauauaucuuuggugaaaugucuauuuaaauauuuugucuuuuugugugugugugugauagggucuugugcuguugcucaggcuggagugcauuggcacaaucauagcucacuguaaccuugaacuccugggcccaagugauccuucugccucagccucccgaguagcugggaguacaggugcacgccaccacgccuggcuaauuuuuuauuuuuucuguagagacaggaucuugcaauguugcugguccuaaacuccugugcucaagcaguccuccugccuuggccucccaaaguguugggauuacaggugggagccaccacaccuggccuguuauuuuucauuuuuuuugauaguaaccauccuaaugggcaugaguuaguauuuuauuguggguuucauuuucauuucccucaugaucggugauauugaguaucuuuccauuguuuauuggccauuuuauuuauuuauuuauuuaguuauuuauuuauuuuugaaacggagucucacccuguugccuggcuggagugcaguggcgcaaucuuggcucacugcaaccuccaccucccggguucaagcaauucuccugccuuagcuccccgagucgcugagauuacaggcaugcaccaccacacccagcuaauuuuuguauuuuuaguagagacagggauucaccauguuggccaggcuggucucgaacuccugaccucaggugauccacccgccuuggccucccaaagugcugcaauuguaggcgugagccaccacacccagccuguuuauuggccauuuauauauuuucuuuggagaaaugucuauucaaguccuuugcccacuuuuaauagaguuguuugaauggguuuuuuuuuuuuaguuauaggaauucuuuauauauucugaauaguaauccuuauuagauauaugcuuugugaauauuuucuucuauuuuguauugucuuuuugcucucuugaugguguccuuugaugcacagaaguuuauuuuauuuauuuauuuuuugagauggagucuuggucugucuuccaggcuggaguacgguggcaugaucuuggcucacugcaaccuucgccuccuggguucaagugauucuccugucucagccuccccaguagcugggauuacaggugugcgccaccacacucagcugauuuuuguauuuuuaguagagaugggguuucaccauguuggccaggcuggucucgaauuccugaccucgugauccacucaccucagccucccaaagugcugggguuacaagcgugagccacugugcccggccugugcacaggaguuuauaauuuaauagucuuauuuauuuauuuuuuuuguuuucuucuguucuuuuucuucugcuuuuuuuuuuuuugaagucuuauuuauuuuuucuuuguauugcuuguauauuuggugucauagucaugaaaucucauauaucuuuuaauuuaugagugguuuauaucuuggaguauuuuucugcuuguugaguuaaaaaacacccaggcccacugcaaaugcugcacaaguugugcaacacagcccugcucaggauucuggcuuugaaaccugagauagacugugaguucuacaaggaaaaaaaaaaucuggcagggucaguaaaauuagagaaaaaaacaucuucuuuagaaccaagagggaaggcacagcagaauuaagauuuugcucuccuguguccugaaacuuuaccagaaacauauauuuaguguuaaccuugcagaaggaucauuccuccugauauaaagggauugcuuuuucuggauuguaccuaguuuuagugcacccacauccuugacaagauguuccucugugucuaguuaugacagagcuaacaaccugucuuaauagggcacucauuaaucagaaugaaugauggcaguaaccagcugguucuggugcauaccagguaaauaucaaguucugcccaugcuuuaguuucuucaucugugaaaugggcaucauaaauaaacucuuauugugaagauuaaaugugauaauuugugcaguauucuuggaccagagacuggcacggaggacaucuucaguaaaugguggcuauuauuguccuuaccauuaucugcaacucuuugagcaacauguucaugcuucuguauuuaacuuuuuacucaaaaggccuuuucuccuuccuauggauaacuuuuuuuuuuuuuuuuuuuuuuugagacagagucucgcucugucacccaggcuggaguguagugacacaaucucggcuuacugcagccucugccuucuggguucaagugauucuccugugucagccucccgaguagcugggacuacaggcgugugccaccaugcccagcuaauuuuuguauuuuuaguggagacagggcuuccccauguuggccaggauggucuggaacuccugaccucaggugauccacccgccucagcuuuccaaagugcugagauuacaggcgugagccaccacgcccggccaacuuuuuaucucucuuacaaguuggcuuaacuguuaccuccuuuaggaauccucaauaauuuucuuacucuucuuuggccaggacacucuucugugucuccguaguaucuuguucauaauucuaucccagcaccuuucccuccauauugucauuucucuguaucauauuuugcuguuagacuguggcucauugauacggguaauuagcuguuuuguuccuguauugccaguaucuugcauuuacuuaauauuuacugaaucaaugaaaaaauaagucuguguauccaugauacugcuuuuuuaacaaguaucuguuuaaaauuauuacugggacaguugacacauuuggaguauagacuaauuuucuuuuaaucucuuucacucuuuccuuuauagacuguauuacuuggcagcuucucugcaaaacugaaauuacaauuaacccuugaacaauacagggauuaggaaugccaacuuccuguguaguagaaaaucuguguauaccuuuaacuccuccauaacuuaaguucuaacagccuacuguugaucagagccuuagcaauaacauaaacagucaauuaacacacauuuuguauguuuuauguauuauauauuguauccuuauaauaaaguaagcuaggggaaauaaaauguuacuaagaaaaucaugaggaagauaaaauauauauugacuguucauuaaguggaaguggaucaucauaaaagucuucauccucauagccuucacacugaguagguugaagaggaagaggagggaauggucuugcuaacucagggguggcagaggcaggaaaaaaaaucauguauaagugaauaugcacaguuuaaacccaugcuguucaauguucaacuguacuucaaaguaaaaaguuuauagaaauagcuguuuuaucauaauacauacucuuaaaauuuuuuagcaauauaagauugcaaaggaaaauguuccuuguucuuaaaaucucacccccagauauaccacaauuagcaguuugaucuauguaacuauuuaaacaaaggcauuuugugaauuuagaggcuucaauuauauuauaaucucuauaauaauauaaucucuagauugucuuucaguucuuagguucuuuuaacccuuaugcagagaagagggaggguggagaaaaucuuugaaauuagguuuguucaugacacuuuuaaguguaucuugagguauuuuucugucuguuauaaggguuguuuagguguuagcuuucuuugacccuaagaccagggccugcauauacuacacaagcuauucaacauagcagccugcucaggaguccuguccaucuguggcucagaccugugguugcugcacacaccaucaccacuugcuggcaguguaaguuucuauaauggaaaagcugaauuugaggaggcaucaaaaacaaaacaaaacaaaacaaaacaaaaccccacaaacccuugaagacuacaucugcauagucauuuaagaauugcucucuauuccauuuauacuuaaaggguauuuuauuccuauucagcaucuaaauuuucaguuuuauguauuuggcauauagauuuuaaauuacagguugagugacaaaaagggaaaaauuuaaguaaugauagauauuaaugaaagaucaaauauccauuuuauauaauuuacaugaauuauuucuguacuguuguaguaauccaguauucuuguuauccaguuuuaaaauaccaagaaugaacccuuaacauauuaauagauguuaagaauccuuucauuauaacauacuuaaguaauaaacagauuauaaaucuuauaaaguuccaauuuuguaauauguaugauuagaauaauuauaaaaaucuuuaugcugcuuccuucaggugaaauuccuaagcagguuaaagugaaaaaacugaagaaucuaaagacucuggauuccaaaccugguauugacuuuuauugauuuuuaaauauauauuuauaugguacuuggguuuuuuuguuuaccuucuuuucuuugcucuuaggaguuuauacuucauauaagccauauuuaaauagagaugaagagaucauaaaacaauuacagaagguaauuaguugcucauauuauuaauuuaaauuuccuuguucagguauguaauauccaguuacgcaauauguccuuuauguauacuaaugugaaauaggaucucuccuuuuuuuuuuuuuuuuugggagacagagucucacucuaucacccaggcuggagugcagugaugugaucucagcucacugcaaccuccaccucccggguucaagugauucucaugccucagccuccugagcagcuggaauuacaggugugcaccaucaugccuggcuaauuucuguguuuuuaguagagacgggguuucaccauguuggccaggcuggucucgaacuccuggccuuaagugauacgcccaccucggucucccaaaguccugggauuacaggcgucagccaccgugcccugccagggucucuuuuuugauucaaaguuuuaugaaaaucaggagacuaaguuagcaacaguaugggcaugaauuuggggcuguagcuacacaugagugucagucuuucuagaaacuuggaaauuauagugaaaaagccauagauucuaccaugauagcaucuaacaguaggggacuguuaccauuuuuuuuaauguaaauaguauaguauagcaaauauaaaauaaagauugucuuuauagugaacucacuuuuuuuuuuuugagauggaguuucgcucuuguugcccaggcuggagugcaauagcacaaucucggcucacugcagccuccaccuccccagguucaagcaauucuucugucucagccuuccaaguagcugggauuacaggugcccgccaccacacccagcuaauuuuuguauuuuuuaguagagacgggguuucaccaugauggccaggcugguccugagccccugaccucagguaauccacccaccucaccuucccaaaguguugggauuacagacgugagccacggugcccagccgugaacucacauuuucacaguaugggaugaacaguauucccuaagcuaagaacucuuauguuuugcuccgguaaagauuauuuucacaggauauugcacaaugaacuucacauuaaauuacuucaaggugaaguucuaguuuuuuaaauaucaaguauaaauguauauuuacauagcaauugaaucugauaguuauccauuguuuuauauuccaacacuagaauacagauucucauuauuuccucuuuuaaggguguacaacagaaacguccuucugaggcucaaaguguuauucuucgacgcuauuuuuuggaacugacacaaaguuucaucauuccauuaguaaguuaauaaauaaauuuuugcauaauuuaaugauuuggugaaggguauauaaauguuuuucccgcccuccaaaaccauaucuuaaguuguguguuuugccagccugguauauuuagugauuaaaaauaaaccccuuugcaagagaccuggauuaucuguucuaguguuaacuguucaacuuugguaagucacucccucucucugacccucaauuuucucaccugugaaauauggcugauuccacuuuccuaaguaccuuuucaagacuguugugaaucuuaaaugauauacuuuauaugaaauguuauguaguuacuacauuuuucaccuuaaaagaagauuauaguagagcuucuuucugauacuuaucuugaauacaauuugauauaaugucuaugaggcuguagcucuaugauaacagggacuauaucugucuugcuuguuauuaauucgucagacuggcauaugguagcacucaaauauuuauggaauaaaugacuagacaaugugguuauuguaagaaauucagaaggaugucauauuaaaguauagggaguaccaugauguggcccugcucuggaaacugcaucauagagaaacuuuuugcaguuauuaauauaaaguaauauaucuaugaacauuauauagggcauccuggagaucuuugcuguuauauuuuagaaagaaauauuauuucuuggucuuugggugucaaguuauuuauuccauuaaaucuauuuguuugaauaaauaaacuuuacuguagugcuuaugagcauggacuaggcugggcacaguggcucaggccugccacuuugggaggcgaagguaagaggauugcuuaaggccaggacuuugagacuacaguaggcugugauugcacgacugcacuccauccugggcaacagcaagacucucuuaaaaaaaaaaagagcauggacugggcgugguggcucacgucuguaaucccagcacuuuuggagacugaggcgggcagaucacgaggucaggagaucgagaccauccuggcuaacacggugaaaccccgucucgucucuacuaaaaauacaaaaaauuggccaggcaugguggcacgcaccuguagucccagcugcucuagaggcugaggcaggagaaucacuugaacccgggaggcggagguugcagugagcugagaucgcgccacugcacucagccugggcgaaagagugagacuccgucucaaaaaaaaaaaaaaaaaggccgggcgcgguggcucacgccuguaaucccagcacuuugggaggccgaggcgggcggaucacgaggucaggagaucaagaccauccuggcuaacacggugaaaccccgucucuacuaaaaauacaaaaaauuagccgggcgugguggugggcgccuguaaucccagcuacucgggaggcugaggcaggagaauggcaugaacccaagaggcagagcuugcagugagccgggauagcgccacugcaguccagcuugggcgaaagagugagacuccgucucaaaaaaaaaaaaaaaaaaaaaaaagagagcagagaccaaagucaaguagaccucauuucaagucuaaauuguauuaccuuggucagguuauuuagccuuuugaagaagccucaguuuccuaauaauaccuaccacauaggaucauuccaaggauuacaagagaucaugcauguaaaauguugagugcauuaucuggccuauaguugcucaguaagguuaacuauuaucguuaaaaaauggaccgcguuguugggcgcgguaguucacgccuguaaucccagcacuuugggaggcugaggcagguggaucaugaggucaggaguucgagaccagccugaccaacaugguaaaaccccaucucuacuaaaaauacaaaauuagccaggcgugguggcgcacgccuguaaucccagcugcuugggagacugaggcgggagaaucgcuugaacccggggggcagagguuguagugagccgagaucaugccauugcacuccagccugcgcaacagaacaaggcucugucucaaaaaagaaaaaauguaguccccuugguuuaucuaagauuuaguugaauuuuuauuugaaaucugacuucccaagucagucuaaauuuagcuauaucucuuguggggagugauggaguuguugcuguccauugaaagggcauaugauuaaaaacuuaaaagacccauuccuuuuaaguaggucuguuuaaauauuuuugaagacacuccuuuuauuaacuuuuuucuugguuuuaggaaagauauguggcaagcuugaugccuuugcagaaaaguauuuccccauggaagguaugaauauauucaaaucuauuuggguccucuaacuguaauuaacuucugugaacauauccacuccuaauuucuaaauauuauauguccuguuuucuagaguccaccucaauuaagacaguuucuuccagaagaauuuaugaaaacacuugagaaaacaggaccucagcuaaccucuagaauaaaaggcgauuggauuggacuuuaccgguuagucuuuuuucccuguuuuacacccaugugucgugcuuuauuuaaaagcaaaacaaaaagcuaaacuuaagcuuauucuuuuuaaaaaauucuacuaaaguuugacaugguucucugacuaggaaagguauugaggaaaggaaauaaguuauaaucaaacuuuacuuuuuuaaaauguauuuuuauaggcauuuccuaaagucuccaaauuuugauggcugguuuaagacccggaggaaggaaaugacccaaaaauuggaggcacuccaucuagaagcucuuugugaagagguucgaaaacuguguguuuguguaaugauuaacaacuguugaaaauaaagauaauuaugcuuagaaguugaagauuguacccuuuauccacucuuuauaaauaguaaugaugacuaacuuuucuagaucaugugcuaugugccaaggacauuauaggggcuuuauauagauaaucucuuuuaaucuuuacaaugauucuuugagguagguguguuaugaacugcaucaugggaaacuuuuggcuuagaaguuaaaugacuugccucagaucacaucccugcuaaguaguggagccaacagugugcuggaguccacuugcauuggcucacaagagccaaaugugcacaucucuucucagcucuguauucaguaaccucagguuggcagcuugaaauagccuacagugggaguacuacaccacagaaauuggcaaaugcuacaaaccagagaccucuuuuggagaaccacuuguuaaauauuuaccagcacauuacuggguagaguaaggauucuaauccaagaagccuaacuccacaucuuuuucuguaugauguauuuaccuuuuuuaguuaguauuaacacuuuuagaaauguggacuggccgggugcaguggcucacgccuguaaucccagcacuuugggaggcugagguggguggaucacgaggucaggagauggagaccauccuggcuaacacggugaaaccccaucucuacugaaaauacaaaaaaaaaaaaaaaaauuagccgggcgugguggcaggcgccuguagucccagcuacucgggaggcugaggcaggagaauggcgugaacccgggaggcggagcuugcagugagcugagaucgcgccacugugcuccagccugggcgacagagcgagacuccgucucaaaaaaaaaaaaaaaaaaaaaagcggacugauuuuuuuuuuauguucuguauuaccagccuauuuuaaauuaaacuacuugugaaaauaaaaggaauagucucacuuucauuuauauuuagcuuuaaaugugaggugugcuaaccucaguguuaacuuucuacucauaaacucccagucacuguggcuuugagaaaaggaauaugaugaaugcaccugcaacauaagcccaggaagagcauauccgaaaacacgaaguguacauccaguaguaaauucauguucaguucucuugauuuguuaacuaauguuccuuauaaauuagucacuacuuaguggaaguggggguuacuguuacaguuugagcugcaauuuuguuuuucuugcuugaucuaaaaaagccaccucaguacauuuuguuuuacuuccaaauaugagacaauuauucuggcuaaugcagaaaauuaucuaacaguuauuagaauauuaugagaauuauucuugcacuauaaugcuauaucuggguuaaauacuuuguucuccuuuuccuucuugucuuuccuucacaguagccuuaccuauugaaauagagagguuugaauauuauuuugagaacuuacugauuugggacuuuauuuauucuaggacuuacuucucuggauccagaaacacacagaaguagaaacaguagaccuugucuugaagcugaaaaauaagcugguauguagccaaaacagccaaagauuaaauugacuuuucuuugaagacauuguccucucaugugagcugacaacccaugauaguucgcagaaguaacuuuuuaaaugagagggcuugaaauuggucaauugaugguagauacugcugaaaauacuuggucacugaaacagaccauaaugaugccauauuauucuaacguuauguauauagaaucuaauaagcucuauaaaaacauugucacuuauauuucuagguauuauuaugaauuuacauagaagccuuuuauugagcucaauaacgaauuguuuaaauagaaugcuccuugcuuuuuuaguuucuguaauuucuggucuaagacugaaaguaucuaauuguuagaccuuuaaaaugguuuauuuagagaauguaauguauuaauacagauucugaggauaauuuaaauguuaugaaauguuccuuauguaguugcaggcugaucgagagcacuuaccugugaaaccugacacuauggaaaaguuacggacacacauagaugccauuaucuuagcauugccagaggacuugcaaggcauacugcucaaaacgggcaugacaugauauuugccaagauuuuccagccaaaaaggauuaugcaucaugaagcauacugacauuucaaccagacgcacaaaggagaucucucaguggcagcggaguggaaaauugccaugaaugcuaguuacaggguagaaagacuguauuguauaaacagaccuuuuuagugcauuacuuuuuaaaguggauaucuguggugguuccacuuuaauacugaaacaccgaaaggcauuucuauauuuuuaaucauguucuaaagugcucuuaugagagacuugugggccaucaguauuagugauuucauacugcagugcuggcauugcagauauuuuuuuaaauuggugcugcuuugcccaaucauguuaaaacucagggggauauaaaaauaacauucacacuggcuaucuucuuaagaacagaaagacugaacuguccuaugguuagaaggaauugaugcuuauguagugccuucuguuguccuacauguuucacaguucagcugcuagucuugaagcuuuuccuuagcuucauuaugauacguaauuuuauaagguauucuguugagugaucauuguuuaaaaaaaaaguuucuugcuacccauuguguuuauuaauagacaugauggguuuuuuucaguugucauauagauuuucauuauuuucccuuccauuuucaaaauuuaauguuaccaguuucuccaaagacaagaaggcaucuaguauuaaugauggaagaguuuauuuucucuuacccuuuacuaauuuaaacauuaggcugggugugguggcucacgccuguaauccuagcacuuugggaggccaagguggacaggucacuuaaggucgagaguccaagaccagccuggccaacauggugaaaccccgucucuaguaaaaauacaaaaauuagccaggcaugguggcacgcgccuguaaucccagcuacuugggaggcugagaugugagaaucacuugaaccugggaggcggagguugcagugagcugagauuacaccccuggacuccagcuugggugacacagugagacugugucucaacaaaaauaaaaaauuaaauaaauacuaauuuaaauauuauuaaauguuuaaacuaaugaacuuggcugcuuuucaaagacauuuuaauuauaaaucucauaaucagcuauuuuuuuaaacugaacuauucuuauuucaaaggcauucaugaguuuuuuaugugauacuuauuugagugaugauaagauugauuucuggcauuauuuguuugguagcguuuuauuuuucccaacauuaauguuucuuaaaacacuuuuccuacuauuguuugacaugggaacuuucgccugagucacugucaugguuagcuuuuguuguuguuguuuuuguuucuguuuuguuuaaacaauacuaccuugccaaaaauagaagaaugugauuugguagaguaggguuguuugguuuguguuugaauaagaguauccuacagaagccacuuuuuuuuuuuuugagauggaguuuugcucuuguugcccaggcuggagugcaauggcgcaaucucggcugacugcaaccuccaccucccgggugcaagugauuguccugccucagccuccugaguagcugggauuacagguaugugccaccacgccuggcuaauuuuguauuuuuaguagagaugggguuucuccauguuggucaggcuggucucaaacucccgaccucaggugauccgcccgccucggccucccaaagugcugggauuacaggugugagccaccgcaccuggccagaagccacuaacuaaaauaggcacacaugacacagcaugugguuaauagcugugucuugaauuauccucuaaauaaccaaauuuaguuguauguauuuguaaaggauauggcuucagaagcuaucuuuuguucucugucgauauaacucuuaagggcauuccugacccaagaaagacuccuugcguuuguaacuguggucuaauacccaaaugugcccuguucuuauggauacagucucuugaagcauaccucaaagucauagagagaauauggcauuugaaagaaaucguuugccuuggaucauaugaguuauuuugugaaacaacagcugacuuuucagaaaaggagcaacuacuuuuauaugcuaaaaguauuucauaacuuucugggaaaccuuauuuagguauaaauggucaucuuauuauuuuucaaaaagguauauuuuaauaauuguacaauuuauauacaguuugugaccagaauuuguaaguuguuggugucauaucaaggaucuuuuaaauuaugccacuacaggauguaucauuucaagucuauuuugcacagcuaaacaguagcaaaagaugccaauuagcaugauaauggugucuucauuuuuacuguauuuaacugaaaccuaacacauguugaaaaccauaucauaccuaguuuaucucuuaauuucaaacuauguacuuguaaaaaugauguaaauuugcacugggaaccugggaaagagugacugauaauuuuuggugcgugauuuuuagauuugucuuuuuuuuuuuaagaagaauuuguuacuauguaaacccugacauuaaauguuuuaucucuaccagcaucaggaggaaucacugcuuuaaggguauuauguaaugccuagugccuucuauuuacagugaaaaagagguuuugugaaggcauuuauggucauuaccaaaaacuaaauuaaaggccuuggauuuuaaagca

SEQ ID NO: 192476 - RNA, 26126 nt, Homo sapiens
gcgcaccggaagcgcagggggauggggcggcggugacgcgauucuguccgcguuggaggggccgggccgcugcuggagucgccgcggccgccgcgugacguggcacagccagagccuaaaggcuagagccggagcugccgcgccagucgccuagcagguccucuaccggcuuauuccugugccggaucuucaucggcacaggggccacugagacguuucugccucccucuuucuuccuccgcucuuucucuucccucucguuuaguuugccugggagcuugaaaggagaaagcacggggucgccccaaaccccuucugcuucugcccaucacaagugccacuaccgccaugggccucacuaucuccucccucuucucccgacuauuuggcaagaagcagaugcgcauuuugaugggugagugaggggcugcgagucaggcgggaccugggaaaggcagggucuccacaauugggguggccucugggccuguuuuuuuccuccgcccgcuguggugggggaggggcgccgggucgggggucggaaggaauucuuaagggggaacaauggagcggagggugagcgaucccccccgcccccgaucugucgccagacgagacagggacagggcuucgggcaagauuucuuucuggacucggcuuuuucuccuugaucuuauugaaagcuggacaacauugggcagagauguggggaaagccaacucugggaagcaaacacuuggcgaggcccuuucugggggugcgaucugcauaccuucuugcccggguguggacagcggucaggagggaggcagagcaacuccagccuuuucccuccccuucugcguuucguguacagucccugcauacuccauugguauguaagccagcggccacccggagccuggagccgcccggggcaggaaguugcgguggccagggagcacccaagguuuccgaagagucuggaguccuucagcgcucacuuugcuaaacuuggccuugcgcuggauuccguuucaaguuuuucgcuccuuguuaaucucauucuccgaaaacugagcuuaucuucuauuucuuugacuauuuucaaaaacuuuaaauguguuugguuuauucuccuagguuuuuaagcuuauuuuuaggcggucuaaggucuaaugcaaaaaaauuuuagaaacgaauuuuuaaaaaauaccugauaaauuuucaaguaacugaacaucaugacgcugaauuuuaugguagucuuguuaaauaguaacuacaauuuuuuuaaaauuucuuuuuagaaaguugacuuuuuaaaaacuacuuuuuagggggcguguuuuugcucagcugagggagaagggcugucaguuggcugaaguaagcaaccgcucccgguuacuguaagcagucuacaucacagcugagcuccauggacuagaauaacgcugaaagaagccccucuaacuuugaacguugaaacuuguugguucauuagcuuguuuucuaccggaggagguuuuauuuuucucuuccuuuuuuuuuuuugcagacggaguuuugcucuugucacccaggcuggagugcaguggcgcaaucucggcucacugcaaccuccaccucccggguucaagagauucuccugccucagccucccgaguagcugggauuacaggcaugcaacaccacgccuggcuaauuuuuuguauuauuaguagagacggggguuucaccacguuggccagucuggucucgaacuccucaccucaggugauccacccacccaggcuucccagagugcugggauuacaggcgugagccaccgcgcccggccggagguuuuauuuuagagcuguacuaccaucaaaacuugcaaacacaagcuucuguaauauuucaagguauauaaagaguaacaguauauacauuggcucauguuuauuuuccucuuagcguacuuacacuuugugaaucaauuguuuaugagucauucauaaaguauuuuuucuuucaaaguuucuuagauuuccuuugucaagaggacagaauuauuuuaggagggcaagcauauuuaaguuuucaguggcugaaaguuggcagucugaaaaaggaucggaaguuaaugggaggacuucggacugugauaaaugaauuuccagucuguucguuaaagagauuuaacaauauaugguuauguuccagaacacauaguauauuggucuuuuuacuuaagauuuauuguaaaugaauugcuauuuuucaauuccuuagucuuuugugauugaugaaaguaucagaggggcaaggaauauagaaguaugcuaccagcauuuucauauauuuacuauauugggaggcauuucccuccaccccaaaaaaugauucgaagaaaaugggagagaaaaaauauuuaaguuucugcauuuguguggaggauuuaggaguuacuuguuuuuaauguuuuauuacucaggcaugcuaucguuuugcacuuuaauuuugggauaaucaguuuuccuugacuaaaaaacacuucagucacaagaucgacauuuaugguaacucaucaaaggaaguaucaacguacgagggagauaugugcaugaacagggaaaaaggugguuuggaaguuugauaauucuuacauuuuucugucuggcuuuaugagugacugacagcaaaaauaauagaucacuuuuaaagugucugccccauucaacuguuggaauuauuaauguuuuacauuagugugcuucguuuuucuuuauaaagcuuagauaagauucaugcccuccugagucaguguuuuauucagacuuuaccauuuuaaaguauaaaggagauagcaguuagcugaugugucagguuugccaaacuacuauggagaaguuuuaaauuuaauucguacaccugcuguucuucaaaaguucaaguaacuuuaaaagauauuggaaguuagcuuguaguuaacuguaauuaaaaaaccaacacaguguaucaaauuuaacaucaucugaacuauugauugacagaaauuauguacuaguuauaaggguaaguuaugcaagugaugauauugcccauacugcucgaguuaggaagcaauagcuucuggccaggugugguggcucacgccuauuaucccagcacuuugggaggccagguugggaggaucacauugaggccagccuggucaacauagcaagaccccguaucuauuugaaaaaaauaaaaauaaagcaauagcgucuguauuuuauuuuguuuauuuuuuuugagauggaguuucacucuugucucccaggccagagugcaauggcaugaucuaggcucacugcaaccucugccuccucaguagcugggauuacaagcgcccgccaccaagcccagcuaauguuuguauuuuuaguagagacgggguuucaccauguuggccaggcuagucucgaacuccugaccucaggugauccaccugccuuggccucccaaagugcuaggauuacaagcaugagccaucacacccagccagcuucuguauuuuguauauauuuuuuaaauaauuauguuuuuuuuccuuuugaguagcugagacaacaaggacaugccauuagaccugccuggcuaauuuuugacauuuuuuguagcaagaaggucucacuaucuugccuguucuugggcugaagcgaucccgcccaccucggccucgaaaagugcuaggguuacagggcgagccacugagccuggcugcauuguccuauuuuaagucugguuucuguaucuugauccaugauaagauguaauguuguuaagugaauccuuaaauuauguauauauccaaaaauacuaauguguucugcagaggaauuacuaauucugaucucuuuacuuugaacuuuccaguucuugccuguugaaaagcugaaaaaguguuacuuuuaaaaaguuugcugauaucaguguaguguaguaugccaguguaguucuguauugucuugaaugugacugugguuuugggggucuagagauguucaggagaaaggauccuauauuugucacuuuaaaaaauauuaccaagcuaaagagugguguuuuauauuuguuucuuagcauauuuuguaaauccaucuauuuauguaauuuuuuuauguuuuuccucuugauucuaaaaguaguauguguuccuucuguuacauuuagaaaacagguaaaagaauaaagugauaauuaccuaucuguaauuccacuauucugucauauuuacucucagccuuauuuuuauuuuuauuuuuugagacaggguuuugcucugucacccauacucuggggcacauacagguggcaugaucauagcucacuguagccuugaacuccuggauucaagcaaucccuccugccuuaggcucuggaguagcuaggacuacaggcgccacuaugcccggcuaauuuuuaaauuauuuuguagagaaugggggucuugcucuguugcccagcugaucucaaacuccugggcucaagagguccuccugccucgaccucccaaagugcuaggaugacagguguaagccaccacaccugguacacgcucagccuuuuaagaggaaguuuuuguuccucuaaaauuguaguugugauguuuaguuuuguguccucucuuuuugauuuagcuuauuacaagcauuuucucagguuauugguugaacauauaacugccagccuuuaaaaaaacaggcucuucugauuaugugaauauaggaaacagaaaaggcaaaaauccuguuucaugccacuggcugauagguacagccauccuuagaugcacccuuuugcauuauuauaguagugcaauaggcugucggaaacuuugauaauuugcugcuaauuaacugauaaaaauguagauguuucucauccguguguagaagcagaaccuaaguucacauuuuuccguauaacugguggccugaguuucaguuugguuggucaagcaucugaugaauuugauaaaaaauauuugagauggagucucacugugucacccaggcucgaguacaguggugcaaucucaggucacugcaaccuccgccuccuggguucaagcaauccuucugccucagucucuccaguagcugggauuacaggcccccucccaccaugcccggcuaauuuucauauuuguaguagagaggguuucaccauauuggucaagcuggucucaaacuccugaccucaggugauccaccugccucauucucccaaagugcugcgauuacaggcaugagucaccgugccuggccaaaauauuaagauacaguauguccaccagaaaaaccuaaaggcaggauggcagcauguaaauaguauuugaggucucuggcaucagaacuagguuuuuugguuuuggcuuuuuagaaaauuuuuuaauaaaaaaaucaagauauaauacauagaccauaaaguuuacccuguuaaaguguacaguuccguggguuuuaguauauguauucaaaguuguguaaccaucaccauugucuaauuccagaauuuuucaucaucccucaaagaaaccugauacccauuaguaauaauucccauuccccuuucuucccagcccguaaucuguuuucuguuucuauggguuaaucuauuccggacacuucauuuaauggaaucaugauuuauggccucuuugucuggcuuuuuucacuuggcaugauguugucaaaguucauucauaauggccgggcgcgguggcucacgccuguaaucccagcacuuugggaggcugaggcgggcagaucacgaggucaggaguucgagaccagccuggacaacauagugaaaccccaucuauacucaaaauacaaaaauuagccgggugugguggcagauaccuguagucccagcaacucaggaggccgaggcacgagaaucccuugaacccgggagguggagguugcagugagcugagaucgugccauugcacuccagccuaggugacagagugagacucugucucaaaaaaaaaaaaagaaaagaaaagagaagaaaaaaguucauucauauuauagcguauauuaguacuucauucuuuuuuuuuuccuuuucauuaaauucacauaagcaccucauuucuuuugauggccaaauaguaauuacauuguauggauaaaccacauuuuauuuauccauucaucagaugauaaaaauuagguuguuuucacuuucuagcucuucaacauucaugaacaaguuuuugugugggcauguguuuuaaauucucugauaaauacuuaggagcggaauugugucaugguaaccgucuugaacauuuugaggaccugacaaacauuuccauuuuacauccucguuuacauccccacuagcaauauaugaggguucuaauuuuucugcaagacucagguuuuuaaauaucuguucuucuguuucugugacugugggggacauuucuggacauuaaaugucucaucugaaaaaugaaagguuauugugagaauuaaaguccaaaaauguauagaaucaccuacuaugcuuagaaugcaguaaauauucaauuuuaaauuauuauuuuaaacuauuacgcagccugggcaccauaccauggcaagaccucaucucuacaaaaaaauuuuaaaaauuagcugggcaugguggcgugccccuguagacccagcuacuagggaggcugaggugggaggauugcuggagcccaggaguuugaggcuacagugagccauguuugcaccacugcacuccaggcugggugacagaucgagacccugucucaaaaaacaaauguauauauauguacacacacacacuuauaauuaugaagguauauuucaaacuuguagauaauuugaaagauaaaggaaaacaugaaaaaucuuuuuauccaucugaaaauacucuuuugucuuuccagucuuacuccuuucugcaauauuuuuuucucccucaaaguugagaucauuggaucuaacuuuuuucuuuuuuugagacggagucuugcuuuguugccuaggcuagagugcaguggcgcaaucucggcucacuacagacuccgccucccggguucaagcgauucuccugccucagccucccaaguagcugggauuacaggcacccgccacugcgcccggcuaauuuuuguauuuuuuaguagagacaggguuucaccaucuuggccaggcuggucucaaacuccugaccucaugauccauccaccucagccucccaaagugcugggauuacaggugugagccacugcacccggccucaauuuuucaucacuaauuaugauacuagcuguagguuuuuuauagauguucuuuuuuuguuuuuuguuuuauuuauuuauuuauuuauuuauuuauuuauuuauuuauuuauugagacagagucuuggucuguugcccaggcuggagugcaguggcaugaucucgacucacugcgccuccaccucccggguucaagcaauucuccugccucagccucccgaguagcugggauuacaggcgcccgccaccaugccuggcuaauuuuuguauuuuuaguagagaugggguuucaccauguuggccaggcugguuucaaacuccuggccucaugauccacccuccucggccuccuaaagugcugggauuucaggugugagccaccgugcccggcuggaucuaacuuuuuaaauuuaaaauguaaguauuucuugcugccauaauuaugggcaaagguuuguuuuuuuggguuuuuuguuuguuuuuuugagacggagucucgcuuuguugcccaggcuggagugccguggcgcgguaugggcucacuguaaccuccaccucccggguucaagcgauucuccugccucagccucccaaguagcuggguuuacaggcgccagccaccacgccuagcuaauuuuuguauuuuuaguagagacuggguuucaccacguuggccaggcuggucgcgaacugcugaccucgugauccacccacuucagccucccaaagugcugggauuacaggugugagccacggggcccggccuuguuuguuugagacaggaucuugcucuguugcuuacgcugaauugcaguggugugaucauggcucgcugcagccuugauccccugggcucaagggauccuccugccucagccucccacguagcugggaauauagaugggcaccacccugccuaauuuuuguuuguuuugagacagggucucaauucuguugcccaggcugaagcacaguggugcgaucacagcucacugcagccuugaccuccuggggucaagugauccucccaucucagccucacccaguagcugggacuacaggcaugugccaucacaaccggcuaauuuuuuuuuuuuuuugagacggaguuuugcuccuguugcccagguuggaguguaauggcgcgaucucagcucacugcgaccuccgccucucagguucaagcaauucuccugccucagccucccgaguagcugggauuacaggcaugugccacuacacccagcuaauuuuguauuuuuaguagagacgggcuuucuccauguuggucaggcuggucucuaauuccugacuucaggugauccaccugccuuggcuucccaaagugcugggauuacaggugugagccacugugccucacucacaccuggcuaauuuuuguauuuuuuguagugacaggguuuugccauguuguccaggcuggucacaaacuccugagcucaggucauccaccugccucagccucccaacaugcugggauuacaggugugaguagagacgggcuuucuccauguuggucaggcuggucucugacuccugacuucaggugauccacccgccuuggcuucccaaagugcugggauuacaggugugagccacugugccccacucacaccuggcuaauuuuuguauuuuuuguagugacaggguuuugccauguuguccaggcuggucacaaacuccugagcucaggucauccaccugccucagccucccaacaugcugggauuacaggugugagccaccaugcacagcuucccagcuaauuuacuuuuucuucuuuaaagauggaucucgcuauguugaccaggcugguuucaaacuccugggcucaagcgauccgccugccucagccucccaaagugcuaggauuacaggugugagugacugccuggccagcaaagauuucugagguaguuuuccugcuauaguaacacuuuggucaaagugcaggucuaguuaaggagaacaaguauuccaguacaucuuuaaauacaguugcuuguuucuggacacggaggggagggagaccauugcugggcuauacagauuagucuuaucuuggcuaguugaaaauugguaauaguuuucauuuuguggagaaauuucauugccaaauauugcaacauuaaggaaauacauaagaaaugacugaaguggcucaaaauuguuggaccaauauguuuuugaguaaagaacuauaaguuuuaagugaugacuguauauguuuaauucgugcauuaaagcuuauaaauaccuuuuucaaaaacucuuaauuugcauuuauacagcauuguuauuuuugauacaacugcauaagauacauucuguguugcugugagccauuaaacuguugucuuguaauuuauauuuagaaaauaauuuguggauacuuaaaagucauuaugggcgcauuauuuuuuccccuugaauucuggggugaccuagaaaugguugcaugauuuuguaaacacuucccuuuuuaaaaaaguaaaaugaguauguaaaauauuauauauuuaaagcccucaagcagucgucuucaaaaagauacaucaggaaauguaaacagcccaacauuuuaauuaaaaaaaaucugcuuggacaauuuuuuuucucuuuucauaaaaguaauacaugauuuuuggguaaaaaaaaauuccuaucaguagaggagcaaggaaaauaauuauucauacaguauucauacaagcacauauaaaaccuauuaaaagaaaacuuggauuaccuacaugcuuuuguauaauuuaaaaugauauagucaugauuugucuuggauuucuucaauucuuuucuuugucaguauuuuuggauuuacuuuuuuuuuuuuuuuuuuuuuuugagacugaguuccgcucuuguuguccaggcuguagugcaauggcacgaucucggcucacugcaacauccgccuccuggguucaagcgagucuccugccucagccuccagaguaucugggauuauaggcauaugccaccacauccagcuaguuucuguauuuuuaguagagacgggauuuuaccauguuggccaggcuggucucaaacuccuggccucaggugauucgcccaccucagccucccaaaguacugugauuacaggcaugagccacagcgccaggccuuaccuuguuuuuaaaugacaaucugagguccaguuggaccuccggugauaacuggcagguaccauaguuuugugugugugcguguguguguguguuucuuaaucagcgucucaguuucaauucugacuuggcuuaaucauauuugaacuuaaagguuaauuuugguuaacuuaaaaaucugaugcuuucaagagacagcuuuguuggaccauuuaaagauccaguuguuuuuugccaccccccuuuguuuuauaucuuguuacuaaagaugccaaacuuuaauguagcuccuuuuuauguauuuuuuagaauuauguuuucugauuuuuuugauaauguuccaugcucaaaaaauaaaacacuuguauaacaguugguuuuuauuauuaugcucaugaaugagggcuugaugugggcugaucacacugacuaguaguugggaaggaauaaaccuguauccgaguacgaaguggggaacaggguuuuacaggacaaaggaauaaaaggcuugagucuccaaaaagaacuuaaaguuauucuugguaggguacagaguagaaaggguuguuaagaggguagaaggaaucagaauugccuguagccuucgcuucuguuuuggacuaacugauaaaagauagacuuacuugcauaggaauguaaauuagauaagugagauaauuucagcucuuuuuuaacuuacuagcauugcuuuuaugugcuaagucaugcuuugauuuaaauauuaagaaaguguccuugcuuaaaucaauacuugauugaaucgauacaaaaaucugugauaagauaaacccaggcggccagauaugauauccuaagaacaaugauagauucaaugagguuauuagauguugaucuuucauuuaugagggcuuuagcaaacacugcagaauauucagguuuugagagauucauacuuacaagcauuuaauuuguucuucacugucacccuacaaggagguauagccucuuguucuaguguggauuuuuuuucacaagcaaacacauuccucccuacuuguacuucugccucaacugaaucauuuuaagaauuuaggccggacacagugguucacaucuguaaucacagcacuuugagaggcugaggcgggcagaucacccgaggucaggaguucaagaccagccuggccaacauggugaaaccccgucucuacuaaaaauacaaauuagcuggggugugguggcacgcaccuguaaucccaguuacuccggaagcugagguaggagaaucgcuugaaccugggagauggagguugcagugagcugauauugcaccauugcacuucagccugggugacagagugauacucugucucaaaaaaaaaaaaaaagaauuuagauauuacuuauauuguagaugaaugugauagggucuuuuauuauuauacuuuaaguucuaggguacaugugcacaaugugcagguuuguuacauauguauacaugugccauguuggugugcugcacccauuaacucguuguuuacauuagguaaugugauagggccauuuuuauaacagguuaaucagacuuugguuuucauuuuggcacauuuaauguugaaauggauuuaagcagggguaaaauuggcuucaucuuccuuuauuaucauuauaaggucacuaggacauaguuacauuaaguucauuagaacauaguuauaccacuaggacauacuuauaccaguguauuuuuuaccccuuagcaucaaaaucuguuacccaaauuuuacucuguaaauaagagaaaauauuuuuacaaaucuuaagaauucuuuauucacuuacauguugucugaaucaacuucuaauuuguguuuuuaaaaaugguaguauggcugggcacgguggcucacgcuuguaaucccagcacauuggcaggcccaggcuggcagaucacuugaggccaggaguuugagaccagccuggccaacauggugaaaccccgucucuacuaaaaauacaaaaauuagccgggcgugguggugggcgccuguagucccagcuacuugggaggcugaggcaggagaauugcucgaacccgggagguggagguuacagugagcugagaucaugccacuucacucccgccuggacaacagagcgagaauacguccccccgcuccccugccccuccaccccccaaaaaaugcugguaguucauagaauuuaauuggaagagaucuuagaugaucugauccagucccuuuauuuauggcuaauuucucuggucucaguguccuaaagucacucaacuaguuugucgcaaagcuagagauuagagccuaagucagcuacauacuuguuaccuuuuacuaguacaugcugucucucuuggucuagaaagcagaauggaaaggcuuucuguaggaaguguugccuuugggaaucagaaauaaggucauuucauuucuaacucauuuagaaguugucuugaacagucaacuucuaguuuugaacuauaaauuuauuguaaaauuauuucuuggagugugcuuuuggucuggauuuuaaaucuauaaugucuucuucuaguuggauuggaugcugcuggcaagacaaccauucuguauaaacugaaguuaggggagauagucaccaccauuccuaccauugguaagaaaguuuacagaugacuuuauaucaugauauguuguaaagugaaauauauacagucuaguuuugagauugucuuuuuguuaagcauguugauuaucuuagaaguacuuuuaaaacaggccgggugugguggcucaugccuguaaucccagcacuuugggaggccgaggcggguggauugcuugagcccaggaguucaagaccagccugcauaacauaaugaggccuugucucuguugauguuuaggcuuaaauauauuuuuuaaaaauaaaaagaaguacuuuaaaaacacuauucuaagaaaauuccacaauaaaagguuuuauuuucuuaaugacgcugcacagcggucauuuuuguuuuucuuuguagguuuuaauguggaaacaguagaauauaagaacauuuguuucacaguaugggauguugguggucaagauagaauuaggccucucuggaagcauuacuuccagaauacccagguaagggauacuguauguuuuuauaacuuuucuuuguggguuucaugcucuaaaguuuuuauuaguaucuaguauuuacuuggauauugguguuuacuaugaguuggcauuugucuuaucaccacuuccacauucuucaguggacucucacuuaggccuugaaggcuaacuuauauaggguggaagaguuguaaagcaauugcgguaaguguuuggaagauggggugggugcugguguaguucacaagaaugaauuaggucucuuauccguaguucuuugcuuuccaucuuaguuuagaaaguaaggucuguauaaacugucauuguaguuucugaugaauguaagacaauugauaguccuuuguuuagcccaguuacuuguuuacuuuauuaaauacaguaaagucaguucgcugcauugauuuguaagauauuuuuauauugccacauaguauguauauauaauacuggcauggaagagacuuuagugauccuguagaacaggaguucucaaauuuggggguggcacguaagaaucacauggggaccuuugaaaaucccaagaccuggaucauccccuagaugacuugaaucagaauaucaggggauauaauccagguacaguaguguuucuuaaacuuuaauaugcauaucaaucaccuggguauuuguuaaaaauacacauugaguccauagguccuagcuaaggccugagauucuguauuucuagcaaguucucggguugugcugauacuacuggucugguaucuuacagcacagcacuauugacauuuugggcuggguuauucuuuguuguuggguauggggagggcucucuaugcauuguagguuguuuaguggcauccuuguccucuacccacuagauggcaauagcagcugcccucaaguagcagccaaaaaucucuccacaccugcaaaauauccccugggggcaaaauugcucccugcugagaaccacuguucuaaucuaacucucuuacauaugaggaaacugaaacuuggaaugacuuacccaagaugggagaguuuguucucacucuaccuuuguuuaaccuggucccaccucgauuguguuuucuaccacccaaggaauuucuugucaguuuuuuuuuauuacuuaauaauuuuuuuuaagugugauaucacugccacuuuauauuuuuaagacuugcaaugucaucuuguuaucagccucuuaaaacauugcauacaagugggguuuauugccaucagguggcagugaauacccuaggugaguggcugggacaaccagguuuacauaguaugucauauuaaauaagugguauacuuuuuuauuuaaaaacgagaauguuuaggccaggcacgguggcucaugccugugaucccagcacuuugggaggcugaggcgggcggaucacgaggucaggaguucaagaccagccugaccaacacagugaaaccccgucuuuacuaaaaauacaaaaauuagccgggcgugguggcgcgcaccugugaucccagcuacucaggaggcugaggcaggagaaucacuugaacccgggagguggagguugugaugagccgagaucacaccauugcacuccagcaugggugacaaagcgagacucugucucaaaaaaaaaaaaauaguagaauguuuauggucaucaauauagcugugacuagaaaagauacuugauacagaggcacaugcuuuaaaaagcuuccuuauggaaaauguuaaauacaaggugaacauuccuuauccgaaauucuugggaccagaaaccacuguuucugaucucagaauuuuggggguuuuggaauauuugcauuguacccaguugagcauucuaaauccagaaauccaaaauccgauauacuccagggaguuuuuucuuuguuauguuggugcucgggaaguuuuggauuuggauuuuuggauuaaggaaacucaaucuguacaccuacaaauagaauagcauaauaaacucacauguauguauuaugcagcuucaguuacuaggauauaagcagugcuguguuguuucauacucaucucuaaugugcucuacccucuagacaguuuguuuauuuuuuuugagauggaguucucguccugucacccaggcuauggcgcaaucuuggcucacugcaaccucugccuccuggguucaagcgauucuccugccucagccucccaaguagcugggacuucaggcaugcgccaccacaccuggcuaauuuuguauuuuuaguagagacgggguuucaccauguuagccaggcuggucucgaucuccugaccucaugugauccaccugccugggcuucccaaagugcugggauuacaggcaugagcuacugcgcuuggccaauauauuuugaaagaguuagauaugaaguaaaaccuugcuaauccuuaagccuaauaauucuugaccaaggguaacccuggguuuaucccuagauuuguuuagaaugcuuuguaauuuacuuugcauucuuaauuugaaauuagacccaauucuggccucuuuggaccaucugagaauuaaaagucuaaguacugcuuccuagggaguucaugcuagcuggggaaagcuuuauguguuaccugauagaaucaaagcuaagcucuuagcuugcauucccagcauuacugaucaguucuccuagcuauaaaauuuaaaagaaacuauagcuuuaaccauguuucuaacuuauacuaacaaaccauggcacaguguguaguaaauuccucuuauaauuccaacuaauuugccauuguaaauaaguaaauauuuggcuuuucaaauaauuucauagcagcugggcuuaucuguagaauccuagcuuuucuucacucuugauucuaggcuguuccaggaagaaaauaauuagggauuaauaccuaaaauaauucuccuucucaauaaugucacuuugggacugauagcauuauuugcauuuuaaaacaaaggcugggugcaguggcuuaugccuguacucucagcacuuugggaggcugaggugggaggaucgcuugagcucaggaguuugaggccagccuggggaacauagugagacccugucuuuacauuuaaaaaaaaaaaaaaagaauaaaaaugggaaguuagcagucaaaauaaaauuaggucccuuuuaggggcauuaccucuuguaaaggguagguuucaggaccgggugcuauggcuuaugccugaaacaccaacacuuugggaggccaugauacgaggaucacuugaggccaguccaggcaacagagugaaacccugucucuacaaaaaaaaauuaaaaaaaaauuaccugggcaugguggcauacuccuguagucccagcuacuugagaggcugaggugggaggaucaccugagcacaggaguuggaggcugaagugagcuacaguugcgccucuguacuccagccugggggacaaaaggagaccuugccucuuuuuugaaaaaaagaagaaacaaaaaaauggaagguuugguucuaaaaaggaguagcuuuugaaauauggaaaggaggagacauauuugcuaaauaaaugcccaugauaagccaagaacaaugaucuuuuauaucucugugauugcauuuaaucuuuaacaagcuuaugaaguuaguauuuuuauuuuauuuagacgaggcauagucaaggauuagauaauauauauaacaaguaguauaagauuugaauuugagucugucuucccaccacacuauauuggcucccaaagcaucaaacauuauuuuuuguuuuugagauggggucucacucuguuacccaggcuagagugcaguggcaugaucauggcucacuguagcuucagucaaccuccugggcucaugugauccucccuucucagcuuccuaaguagcuaggacuauagacaugugccaccaugcccuacuaaaauuuuaauuuuuuucguagagacagggucuuacucugcccagggugaucuugaacuccugacuucaugugauccucccaccccagccucccaaaguggugggauuagaggugccaugccagccaaaaguuuucucaaaggauaggauauuuaaagugaugguuuuccaggugguauagaugcaguguaaaauaaaauuuaaaaauuaaguuaugguuuccaacagagauaaaggaaauggacuuacaauuugcuaaaacaaaggaaauugucauuuaauggauguaaaauaaguguuagaugcuccuggagagcccaguacugugguaauccugagagguaaacagaaaaugauguaggauggggcugggcgcgguggcucacaccuguaaucccagcacuuugggaggccaaagcaggcagaucaccugaggucaggaguucaagacuaaccuggccaacauaguaaaaucucaucucuacuaaaaauacaaaaauuagccagguguaauggugggcgccuguaaucucagcuacucaggaggcugaggcaggagaauuauuugaaacugggaggagggguuugcagugagcugagauggcaccacugcacuccagccugggugaaaaaaaagauauaguauaguccuuugcccuuaguggauguaaucuaguuccuuuuuuuuuuuuuuuuuuuugagauguaguuugcucuugucgcccaggcuggagugcaauggcgccaucucggcucacugcagccuccgccugccaaguagcugggauuacaggugugccaccaugcccggcuaauuuuuguauuuuuaguagagaugggguuucaccaggcugaucucgaacuccugaucucaggugauccaccugccucggccucccagaaugcugggauuacaggcgaaagccaccucaaccagccucguuacuuacauaaaucaguagugcaagacaaucuguuauaagugacaugaucaaaauugauacuuuaggagucaagguuuaucuuuuuuucuuuuuuauuauuuuuauuuuugcccccccccuuuucuagcugaaaauucuauacuuucccauuugaaaguucuuagaaaaacaguucaacuaguugcuuccuaauuccuuccauuuauuuuguaguauagaauucuaauaaugggccaggugccauggcucaugccuguaaucccaacacuuugggaggccaagauggguggaucacuugaguccaggaguucgagaccacaugggcaacguggugaaaccccaucucuacaaaaaauagaaaaauuagcuaggugugguggcacgcaccuguagucccagcuacuugggaggcugaggcgggaggaucauuugagcccagggggucaaggcugcagugagccaagauugugcuacugugcuccuaggcaacagaguugagacccugucugagaaaagaagcuaauauuuguaucucuaagaauugauaacuaccuuccuuuuuuuaaagaaugucuuacucgaucagguaaaucuugaauuuuucuuucuuuuuuuuuuuaagagauaggguuuugacauauuguccuggcuggucucaaacugcugggcuccagugauccuccugccuuggcuucccauagugcugggauuacaggagugagccacugcgcccagucuuggauuuuucuugcuaucauuuucuuaagaugucuuccugaucuagaguuggcaggcagcauucugaagcaaguuaauuuuuuccuuccaugaugaagcagauaaaaacuguaguguacacacucgcgcuaucccaccccccuuuuauuacucuguacaugccuuugagucaguaagcuaauucaguuaguaaauucaugggguuuuuuuguuuguuuuuugagauagggucucgcucugccacccaggcugcagugcaguggugcgauuucagcucccugcaaccuccgucucgggcucgugauuccucccaccucaucucccaaguagcugggacuaaaggcaugcaccaccacaccuggcuaauuuuuguauuuuuuuguagagaugaccuuucgccauguugcccaggcuggucucaaacuccugaguucaagcaauuucaggccugaucguuugccucagccucccaaagugcugggauuacaggaugagccaccaugccuggccaaauucacgauucuuuaggauccuugauuuguuauuuuucuuuuuguuccuacuuuguggcuauuuugguaccugcacuuaaaugugagagugcagagggaaggggaaaaauagauacaauuuauucuuaggguaguugagaaaaguaauuaauuggugaagaauaaaaauuuuuuagauuugaaauagcacuaauaaauuaaacuuacaaauaguucucaaaucagcuuuuagcauuacagccuuaaguucuuacuuuuaaagagacauuuucuuccuaaugucuaaccauugguaccauuuugcugccuacacuguuucauauagagagugucguuuaacuguuaaaauuuacugaaacaauuuuuccccagggucuuauuuuugugguagauagcaacgaucgugaaagaauucaggaaguagcagaugagcugcagaaaaugguaagaaauauacuuuaaauucaucauuuucaaggugugcuuuucuggauuaaacugguggugguuuaguacauuuugacuaugauuagauuacacaaauggauugggggggcuagaaauaaacuuaagaaacuauauuauccacagguucuuaauaauguacuucaaaaucucuuauagagcguuuuaaaaaacacauggaagaguagcuacuucaguaaguugggaggaaggcagagcaguguuguuuuuuuuuuuuuuagaaugccucauggguaaucuugaugccuaucucuggcugaggauaucugauuuagcucagucccuuacuuuacagauaucaaaucuauagugcuguagugguuuugacccuaggaaucuugguucagauguuuuguucccaaggucaucgguuccauuuucucuaugcugugccaauaauuacuucagaaauguuuuuuaauaguaaccauuuaaggauaaggaauuccuucugaaaguagagacaaauguuugguucacaguggcauuuugcagccuucccauagauuggauuaauguuuucauguguucauguuguuaaauguacuaaauggaggaagacugcugagaauccuugucaugauuuuaaacuuguagccauaaaauauuuacugaaaugaaaucuuaauucuuguucauuccuccuaagauuagagggcaguuuguaaaaccauugugccaguauauguguaacuaagucauuguuggauuuuugccugagucaaaugucaccagcuuucccucuucaaaaaaaaaaaaaaaaaaaaaagcuugguugagacauacuucacacacuauaaaugucauccuuuuuaaaugugcauaucaauggcuuuuagcauacauaguuguacaaccaucaucacaaucuaauacuagaaaauuuucaucacccucaaagaaaucuuggaccauuagcagucauucccauuuccuuccucucguacaccacacucccagccucugacagccacuaauuugucuuuauacagucaccuauucuggacauucauauaaaugaaaacauacaauguguucuuuugugacugauuuuuucacuuagcauaauuuuucaggguucgucuauauugcaucaugcaucaguacaacuucuguucuugguacuuuuuuuuuguauauuucaugauacugccaacacccagauaauuguguuauugucccacuguuguuggaaaggauagaaguccgaaaagaaucaucaucuaucuaaguacuucugcuacuaaguaccauaagaaccugccauaaacauuuuauucccacauguauuucuugcccuuaucaguccugacaauggguaaucaugaaggcugaaugaugagugauuugcuuuaauuuaaugggguguaggaugauugacuuggaaaacaguucugucuuauuugaaggcauaugauuguuugcucuggauuuaaaaacugaaggauaugagacuucaguuguaagagugaacuuugugucgagaaauuagguuaauguuuaauaauguauuuaaugcugaguaaaguauauauaggaagacauuuucaaaaauuggauuccgguugguaguuguuaaugccuuaccuuuuauuuccagcuucugguagaugaauugagagaugcagugcugcuacuuuuugcaaacaaacaggauuugccaaaugcuauggccaucagugaaaugacagauaaacuagggcuucagucucuucguaacagaacaguaaguauuuggagguugauauuaaccucuugacuauuaagacuuacuaggauaguuguguaagcuaauauucaguuuaaacauuuauuaucuccuuuggacaaauaaugagcacaucauuuauuuaaaaauaugguaauaaacuuuaaauaccuuauuugauuuuuguaaagaaacggaaaacuacuguagaauaggucuaaagauuauugauaguuucuuuuuucuuuuuuuuuuuuuuugaagggagagguggaaggaauggaaagaagauuauugauagucuuaauuuuaauuuuguaucuuuuaaguaacccuacagcaaauauuuugaaaucuggcuuucuuauuaaggguccaguaauguuuguuugcuuguuuuaaaaguggagauggggggcugggugcgguggcucaugccuguaaucccaacacuuugggaggccuaggugagcagaucaucugaggucgggaguuugagaccagccggaccaaccagggagaaacccugucucuacuaaaaauacaaaauuagccaggugugguugcgcaugccuguaaucccagcuacucaggaaggcugaggcaggagaaucacuugaacccaggagguggagguugcggugagucgcgaucgcgccacugcacuccagccugggcaacaagagcgaaacucggucucaaaaaaaaaguggagauggggggucucgcuuuguugcuaggcuggucuugaacuccuggacucaagcaauccucucacuaucucagccuaccaaagcgcugggauuccagccauggugcccagccuuguuugcuuguuaacauaacaguuuauggaggagaccagguaccacggcucacacccguaaucccaauacuuugggaacccaaggcaggaggauugcuugaggccaggaguuccaaaccagcccgggcaacaaagugaaacccuaucucuacaaaaauaaaaauuagcugggugugguggcaugugccuuuagucccagcuacuugggaggcugaggugggaggacuguuugaacccagaaguuggaggcugcagagagcugugauugugcccauugcaccccagccugggugacagagcaagacuguuucuuuaaaaaaaaaaaaaaaaauuuguacuucucuaaaauugcuuaucauugaucagugauucagugauggagauaaauuaucagaaacuuagugucauaggcuuuuuacaguaguuuugcauuaaccuguaaauaagggaaauacuguggcugugguaaaaaaugaaacaaacaacaaagaaccuauugcaggccgggugcaguggcucacgccuguaaucccagcacuuuaggaggcugagguggguggaucaugaggucaggaauucaagaccaacauggccaagaugaugaaaccccaucucuacuaaaaacuacaaaaaaauuaggugcaguggcaggcaucugcaagcccagcuacucuggaggcugaggcaggagaaucacuugaacccaggcagcagagguugcagugagccgagaucacgccacugcacuccagccugggugacagagcgagacuccgucucaaaacaaacaaacaaacaaaaaaaaacaaccuauugccuguuugagauaucucaggcugauuugaagaacauaaacugggccgggugugguggcucacaccuguaaucccagcacuuugggaggcgaaggugggcggaucacuugagaccaggaguucgagaccagccugggcaacaugguaaaacucugucucuacuaaaauuacaaaaauuagcuggucgugguggugcauguguguaaccccagcuacuugggaggcugaaggcacgagaaucucuugagccugugaggcggagguuguagugagccgagaucacgccacugcacuccagucugggcaagagugaguacucugccucaaaacaaucagucgaucaaucaauaaauaagcaagcaacacuaacuguaaaugauacaaguuuuccaugcugugaagguaugaauuugagccuuuccccagccuccuagguuacugagauuugguauucaaauaauuggcaacaugguauaccugcaguggccuugcaacauuaaacuggucaaaaaaauuaauaaaaguaaacuaugccuuaaauguaaauuguuuucuagguuuuuuuugauacuuucacacaguuacuagagauaagauucguugccauuuaaaagcaagaacguuuuggaaugcaugagacuaaagauggugaaauugucugaaaagcuugcccuuaaaauaucaacaaacccuacucuuucuuucuuucuuuuuuuuuuuuuugagauggagucuugcucugucacccaggcuggagugcuguggcacgaucucggcucacugcaagcucugccuucuggguucaugccauucuccugccucagccuccugaguagcugggacuacaggcgcccaccaccacgcccggcuaauuuuuuguauuuuuaguagagacaggguuucacugcguuagccaggaaggucucgaucuccugaccucaugauccauccgccucagccucccaaagugcugggauuacaggugugagccaccacgcccggccuaacaaacccuacucuuucaaaaauuugccucuucuacuuugaguuuaguuuuaugggaaacgagaguuauaaaaaccagauggguaguuuauuaguuacuaauuuccccaugauuucuuuuuucagauuaagugguagaaaguuuacuaaaagggaaccaaaaaccagcacugaaaagaaagcugaaugaggggggaaaaucuugucuaaauauaaugaauagguagaaguagcuugauugauugagacggagucucacucugucgcccaggcuggagugcaguggcacagccucggcucacugcaaccuccagaauagguagaaguggcuuuauuuuuaaaaaauaauuuaaucuaaaaaaguagagacaaagucucaccauguuacccaggcuggucucgaacuacuaagcucaagugauccucccaucuccgccucccaaagugcugggauuuauaggugugagccaccacgcccagccagaaguagcuuuaaauaugggagaguuuugugagaugcaagaggugugaaaagacucuuaaguuugauuaagaaaguuuaaacacugguguuauauauuaacuuuguuaaucaaguauuuucuugucuucucuuuacagugguauguucaagccacuugugcaacacaaggaacuggucuguaugaaggacuugacuggcugucaaaugagcuuucaaaacguuaaaugaaauuggauaucuaaccaaggacauguuugauaaaauuggucuaggcuuguuacaacaaaauuaguuuguaucuugguuauuaaacaguaucugggacugguuugggcagaauauuaaacuuauuuuguugccaauuauuguuuaccgaguauaauguugcuauuuagcaaugugcuugguuuuaaagaaauucuccuugggaaaaaaguauccucuuuuaauuuuacuucccauaagcguaaaugccuggacauagcucuugugcaaccuuuaaauaaauuguuuugaguguuuuuugagccccagacaaauaauguuuuaaaguuauccccuugcuacuuuacugauaccuuuaucauuccugagacaguuugcuaauuuaaaaauguagcauuccauuuguauuuauuucucucccuugccaaaaagauuuucuaauacugcuuguaccagccagagaaagauccaaaacacuacucagcucucuugcacugaggaaauuuuucccccuacauugacuccuggccuacaucagccaaacuuaaccuuggugggguuuggauuugauagccaauuaguucugugcugguugcaaagaauugauauuuagaugguuuuuaauacucagcagauugucuuccuuuauauugugucuuuuuuauguugcauguugcuuuuguuaucagccugauuuuuugcucaguauaugauaguucugcugauguuuuguuuauugggcagacauaucuucauuaagaguuuuuggaaaacucaucaaauucgaugaauacauuuucuucauaacccauuuggaauuauuccuaauaaaaugauaaaauacguaa

SEQ ID NO: 192477 - RNA, 46691 nt, Homo sapiens
gggcggcuggugggcggggcgagggccgcuggggccgcgaaguggggcggccgggugggcuacaagccgggucugggcugaggggcgcggcuucgcgguggaccccagcccggcaacgggaaggcgagcucuccuccaccguccaaaguaaacuuugccgcuccuuccgcggcgcucccgaguccucgccgccgccgggccgccgcaguccgcgaagagccguccugcgucagggccuccuucccugccccggcgcggggccacugcgccauggacgccacagcacuggagcgggacgcugugcaguucgcccgucuggcgguucagcgcgaccacgaaggccgcuacuccgaggcgguguuuuauuacaagguagggccgggcccggcgcuucggucggaguugcucagucggagugcggcccgggccugcggccgaggggcgggauccgggugcggaggcuagcggccccggcuuugcuuuucccucguccgccucccggcccuccucuuguugggagcggcaagcccgagugcagaggccgacgcugaggcugcggggaggcugggucgcggcuugcagccgccgcuccuccaccuguaguccugacuggcaaaugcccaccguugagccgcuuuggggggcagguguuagauauggguaguuaguagccaauucuugcugucacuugacucugauuuacagcuagcgggaaauggccugugauauauaucaaaauaaugcaugcucguuaaauaaacuuaaaaagaauaaaaaccaucuccugucauagcauuugacauacagucaugcguccuuagcgaugugauauuuucugagaaauguguucuuaggccauuuuguuguugugcgaacaccguagaaagcgcuuacacaagccugaaugguacagccuguuccacaccuaagcuguauggcauggccuguugcuccuagguuacaggccugcgcagcguguugcuguacucaguggugugugcaguuacaugcagugguaaguauuugugcaucuaaacauagaaaagguacaguaaacaugcagcauaaaagauaaaaaaaaaauacuacaccaguguggggcacuuacccacaaaaggagcuugcaggacuggaaguugcucugaguuggugaguaguggugagugaaugugaaggccugggacauucacugcucuacucuuguagacuuuauaagcaguguacccuuaggcuacgcuaaauuuuuuuaaucuuucuucaguaauaaacuaaccuuagcuuacgguaacccuuuuacuuuauaaacuucuaaauuuucuuaacuuuuuaacucuuuuguaauagcuuaaaacgaacuuauugugcaguuacacaaacauuuucuuuauaucuuuauuugguaaguuuuuuuguuucuuuuuuuuuuuuuauucuuuaguuaaaaacuaaggcacacguuagccuaggccuacaccucgucaggaucaucaauauuacugucuuccaccuccaaucuugucccacugggaggucuucaggagcaauaacaggaaugaaacugucgucuccuaugauaacaaugucucuugaaauaucuccugaaggacaugucagagacuguuuuauaguuaacuuuuuuuuauaaaaggaguauacuaacaguacauaguauagcauaguaaauacauaaaccaguaacauaguuguugauuaucaaguauuauguacucuacauuauugugugugguagacuuuuacaccacuggcaccccaguagguuuguuuacaucagcaucaccacaaacaugcgaguaaaguguugugcuaugacauuaugauggcuaugacaugaccaggcaauaggaauuuuucaacuccauuauaaucuuaggggaccacuaucauauauucagucuguuguugacugaaauguuauguggugugugacuauauuuuuguguuuuuuuaugcguauguguauaugcuuuuuuuuuuuuuuuacaaacugguuuauacuguuuuuaguaauagcugcacaguaguucauuauguggguguaccauauuuuuuuuuuuaagagacagcgucuugcccugucacucagccuggagugccguggcccacuaauaauagcucauugcagccucaaacugcaaagcucaagcaauccuccugccucagucucccaauuggugggacuacagguagacacaaccacacuuggcuaauuuuuuuuuuuuuuuuuuuuuuguguagaaauggagucucgcuguguugcccaggcugguuucgaacuccugggucaagcgaucuuccugccucagucucccaaaaugcuggaauuacaggcgugagccucugugccuguccaguguacuauaauuaauuuacagacucuugggcauucaguugauuuuguuuuuucaacaucauaaguaacgauguaguucauaucuuuauaacuaauucuuaugacuagugcaaauuuuugccugaauuuucuuugggauaaauuaccggggacagaauugauaaaucaaaggguaugagcuuccaugguccacucucuucucuccaauucugaggauuugcaaauauaccccucuagcucuagcuagauuuggagggagcuguguccucaugauagugucaccuuuucuuuuagaaagauuaucagacuuugauaauacuguacaauaguaguacuuuuuuucacaaauguaugugcugucaauaaagugugguuuguuucagauuaauauuuuguugcuuucauuuuauaaucuuuuuuccuuuuuuuuugagacggaguuuuguucuuguugcucaggcuggagugcaauagcacaaucucgacucgcugcaaccuccaccucguggguucaagugauucuccugccucagccuccugaguagcugggauuacaggcaugcaccaccacccccggcuaauuuuguauuuuuaguagagaccggguuucuccauguuggucaggcuggucucaaacucccgaccucaggugauccaccugccucggcuucccaaagugcugggauuauaggcaugagccaccgcccccagccuauuuuuuucuuuuuuuauugauagguaauguacauaguuucaggguacaugugauaauuuaauacauuaauauaauuuguaaagauaaaucagcauacuugggauagccaucaccuuaacuacuucacagcugaacugugcagcuuuuauuacugaauauuauucccuuaauauuuaugcuaggaacauuugaauuaaucuagcuauuuugaaauguacaaucaaauauuauaaacucuggucacccugugaucuaucuuaacaguaggucucauucuauuauaaucugcuuuauguuuagagaguuuuggugcauuucagaauccuuuuagacuuuuuugacaauuucacaaggcauuguuuaagagaaaaauuguguguguuuugugaaauagcuuugacaacagguuaaaauagugcuauauaaaaauagauuuuauuaaagcaaaagaaacugcuaugcacugccccuuguuuccuauagacuuacauacaugucaggaagaauuuuuuaucuuugagaaagccaaaaaaagugguuguacuucuagaaauuauuuauauaagcuucaucaguuuaguauuuaguguuuucugcccaguccuuucuauaagcuauuuauuucuugucaguuuugaauauaaaugaaaugaguaaaauaaaauugacaccagcaguuuuuuaaauuggcuuuauuuuauuuuucagagacagggucucauucugucacccaggcuggcgggcaguggugagaucauaacucacugcagccucaaacuccugggcuaaaacaaucuuccagccucagccuccugaguagcugggacuacaggugugcaccacaauaccuggcuaauuuuuuuuuuuuccagaaauggggauuucacuauguugcccaguuagucuugaacuccuggccucaagcaguccuccugccucagacuccuaaguaaaaaaaauagcuuuuuuuaaaaaguacaauaauuauuuggaaauuaauaaucacauacaagauaacugaaggggcaauauauguguauuauauacuuauauaauuuacauguaucaaaaacauuccguuuauuggauuuaaguguaguuacaauguauuuagauaaugaugguauguaagauauauuuaauguuuacauguaaaguuauacuuuccuccucugaaauaguuauagaaucuaaggaagucauaucuuuucuaucccacugccuuuaggcugaauuuucauuguagucaaaacuguacuuuuucauuccuuccuugcuuccuuccuuuuuuuuuuuuuuuuuggacaguaucuuacucugucacccaggcuggagugcaguggcccgaucacagcucacugcagccuccaccucccagggcucaggugauccucccgccucagccuccugaguagcugggacuacuuuguagagacaggguuucaccauguugcccaggcugaaaacugcacuuuucuuaauuuuguuagguucagugaaacaacuccugcucaaacaacuggauucaaaaagugauguucaguagauggcaucuuuggaaacaggcaugaugacccaugaaguguacacgcuuggguuacugcagagaaggugcuguuacuuguagaaaucugucuuugcuuuucuaggugguagcauugguaaccuuccuggaauggugaugaggagaauggaaacaccaccuucuagccauagcauaacuggucguggaaguuauggaauaacuggaagaagaauccagauuuucuuaaaauuaaaauaaguguaauuuauacaacuaaaaucugcuuuaaaaugugucauccuuugucaguauuuucuguggagaaaacuguuuuccuuuuacugugagauauuuaaccuguguaaucuccuguaaucuuuucuugauaauuuuauuuuagcaauuauuacucguuuuaaugcuuugaaggcucaauucauauuuuuuugcgugugaauuacuugcaaucaguucacauuuucaagguauauaauuuuaaaucugaucuauugcauaaggaaaaaggaaaacgaaacauguaaacugcagcuauucuaaagaaguguuuauaaucaguuccuuaugcgugaauucauaaauuuucaaugauauguuaaaauugagagagagccuggauagcuccuucgguagagcaucaucagacuuuuaaugugaggguccaggguucaaguuccuguuugggcguguccuguggcuuuuagcaccuaauucugacucuaucuuugaaaaagccaaaaaaaaaaaaguaugauuugggccaggugugguggcucaugccuguaaucccagcacuuugggaggccgaggugggcagaucacuugaggccaggaguucaagaccagccuggccaacauggcagaacccaaucucuacuaaaaauacaaaaauuaaccagguauggugguguacaccuauagucccagcuacucgggaggcugaggcccaagaaucacuugaaccuggggagguugagcugagcugagaucacaccacugcacuccagccugggugacagagcaaaacucugucucaaaaaagaaaaguaaaagaaaauugagaacauugaauacugaagaaaacauuggaagauuguauaacuacuuuaugaaaaaaauuacuauuaauaauaauuuaaagacauucuuguuuugucauucauggaaaccaauauugaaugagaaugugauaaagaaaauucaaguuguaauacaucuauuggauuccuuugaauucuuucauuuuuaggaagcugcacaagccuuaauuuaugcugagauggcaggaucaagccuagaaaauauucaagaaaaaauaacugaguaucuggaaagaguucaagcucuacauucagcagguuaguaaaggacuacuaaacuugucacucuauuuuuucuuuucucccaucaugucuuucccccauguuuguuucucuucuucauuuuuaucuuugaaucuugaugcucacucuguugcugcucauuccacuuuugguaaucaccucuuuaaaagucauuuagaaauaagucauagaucuuugaagaggaaccuuauagacaauauaguccaguuuccuaauuucccagagugcagagauggugaauuaccuauguucaaacaauuuaucauuggcaaaguuaggauuaggauucaguuaaagucugcuuuuaaaauaucugucacgucucuuccuuauaaaauuaagugacuguuccucuucaguguuuacagacuucagcaguagguucacagugucuucucuuucggugucuucuacuuucagaccuuugcuaaacucuuuaaaaccauaucuugggaaagugacauguaaacagagacuuggaacuacuuguauuuauuuuuguaaacagcacaacagguacaauaauagaaauauauagucuuaauggucacaguuuuguuagagguaacugauguugacauuguauuuacaaauacauugauuucuguagggauucuuuuuaacccucuuuuucuguugcugcaugauaaagcgccaagcagaagaauauuuauucucauggacuuuguguaacuuucuaccacucauuuugaguagauacgagcaauuacaagaacaucguugggauaaaguagauuuaaucauuggauuccuuguuaugacaguucccuuaaaaacaaggcgguuuacuuuuaauacagugcccagaaauugcauguauugaaaaguguacugccuguguuauuggaaccucacuugauacaaaguauugauucauguauucaaaauaucauauaaaauucaaaggaacuuucuuuucccagccaaguaaaugaaguucuuaaauuuaacugcccaauauuaggaacuuuguuucauaaccaguguuuucaaauaaaauuaucuuugaaguagggaagguagucuuucauguuuacuuccaugaucuccuuguuuuuucauagauaguuuucuucauuucaauaacuauguauugaauacauguuugggcucuaugguaaguacaggguaauagaugagugacaguccauguccucaggaggacuucaucagguguggagagagaacagugucaacauugcacuaucauggaaaccccuuucugaagcaugcuagacuaaauguuaaagcagaaugcucuagaaaggagagauuauauggugauauuauuccaggaguagaaucucuggcagccuaagguauauuuccaucuuucuuuuccauauguacacacagucaagcacauuuaugcccuagggucuugauuccaguaagauugcucuuuaaacccuugaaauccuugugacaauuggaaaaaauaaauaugaaucauuuuuuucuaaggaauuuuaaaaauuauucuuacuuuauauuaaauacagcuaagccuaaaaacuuacaugugauuuuugggaaauaaauucuaaacauugauauauaugugauauucaagcaucaaaugagacaccccaaucucuugaagaauaaagacuugccagugaaauagaguucaaaaaggauuuuuuuuuuuuuuuuuugagguggagucucguucugucuuccaggcuggagugcaguggcgcgaucucagcucacugccaaguuccgccuccgggguucacgccauucuccugcgucagccuccccaguagcugagacuacaggcgccugccaccacacccagcugauuuuuuauauuuuuaguagagacaggauuucaccauguuagccaggauggucucgaucuccugaccucgugauccacccgccucggccucccaaagugcugggauuacaggcgugagccaccaugccuggccuuaaaaaggauuuuuaaagcauaacauagcuuguuuuaccaacuucuuucugcuuuuguugaagaaauggaguauaaucucuagacaauuuaaaggauuuucuuauuuauuauuuuaagcagaaaaguccuuuuucaaauaaaaauccuguuaggaacccuaaguuuuaaaacaagauagucugcugacaguuaagagaauccugagagagaguugauuuugggguggggaaagguaacauaauuuaaaauuaaccaguauaggccggcacaguggcucaugccuguaaucccagcacuuugggaagcugaggcaggagaaucccuugaaucuaggaguucaagaucagccuaggcaacauagacuucaccccuacaaaaauugaaaaaauuugcugggcaugguggugugugccuguagucccagcuccucagagguugaggcaggaagauugcuugagcccaggagguugaggcugcacugacccgugauuacaccacugcccucagccuggaugacagaguaagacccugucucgaaaaauaaaaaguaaaauuaaccgucguaguacagaguucaagacuuggaauuaaaagaucccuguugagucucuacccuuucacuuguagcugugaaaucuuagacuagaucaaugggucucaguagaaagcaauuugccccccaggggacauuuggcaauuucuggagaaguuuuugguuuucacgcugcuggguggcaaggaauaugcuucugggauuuagcuggguagaggccaaggcuguugcuaaaaagucucccacaacaaagaauuauccagcccaaaaugucaauaaugccaggcugagaaacacugggcuagauauuucaacauuuuugagcuuugguaucuuuuucaucaauggaauuaguauauacuucagagaggcauuuaagaaggcuaaaguuuugaaaacaucagcacaaacugggcacaguggugagugccuguaguuccagccacuugggaggcuaaggcagaagggucacuugagcccaguaguuuaagaguuuaaggccagccugggcaaccuagugagaccguguauuuaaaaaaaaaccaaaaacacguaacuuuaaagaacuaacaaaaucucagacuuuucuuaaauagcaaguuuagcgagauacaauuuccauaucauaaaauucacccucuuaaaguauauaauucagguguuuuuagccuauucccagaguugugcagucauccccacuaucuaauuuuagaaaguuuucaucaccccaagagaaaccucuuacccauuagcagucaauccccauuccucccucccccuagccaccacuaaucuuguuguuucuauggauuugccuauuguggauauuucauacaaauggaaucauccaaaacauggcccuuuugccauguggcuucuuucacugaguuuaauguuugcaagauuuuuccauguuguagauuguaucaauacuucauugcuuuuuauggcugaguaauauuucauuguauugaugugcugcauuuuguuuauccguucauuaguuuuuggagacauuuggguuguuuacaccuuuuggcuguuauaaauaaugcaguuaagaacauucauguacacgcaguggcucaugccuguaaucccagcacuuugggaggccaaggcagacagaucacuugaggccagcaguuugagacuagccuggccaacagggugaaaccccgucucuacuaaaaauacaaaaauuagccaagcgugauggugcacacauguagucccagcuacuugggaggcugaggcacaagaauugcuugaaaacccaggaaguggagguugcagugagcugagaucgcaccacugcacuccaacuugggugacagggugagauucugucucaaaaaaaaaaaauucauguacagauuuuugcauagacauguuuucucaauucucuuggaauuccacccagaaguggaacugcugugucauaggauguagcuccauguuuaacuuuuugaggaacugccaaauuguuuuccagaguggcuacaucauuucacaguuccaucagcaguguaucuggguuccaaguccuucacauccuaacacuuguuauugucuuucugauuuuagccauccuagugggcauaaggugucaucucauugugguuguguuuugcauuuuuugauggcuaacguucagcaauuucuuaugugccauuugaccuuuugaaugccaucuuuggagaaaugucuguucagauccuuugcccauuuuuuaacuggguugucuuuauuguugaauuuuaagagaucuuuauauauucuggauacauguuucuuauagauacguauuuuuuuauuaaaaucaaaugaaaauauuauuucaaagagcaaugaaaauacauaacauauucuaggcucaggguaaauagaaaaagcaggaacuuuaucaucagagccuaguauauuacacaauuuugucugugcagaaaaaaaaguuuuaauugccuuaaaauagauuucuuaauauuuagcaauuuccaaguuuuuguuuugucuuuugagguagaggagcauaugaggagaaugccuguguuucaauuuuuaagugaagaaagugccagugggagagagaaauucagggaaagaauuuuuuaaauaaguaguguauuuuuuacuauucuuuaucucugaugucuauugugugguaaauaauugcagauuuuuuuucuuagaccuuaagauuaaaaagagaagggaggaaggcugggcaugguggcucacaccuguaaucccaucacuuugggaggcugaaacuggcagauugcuugagccugggaguucaagaccagccugggcaacauggcaaaaccccaucucuacaaaaaaaaaaaaagagagaaaaauuagccaggcauggugguacacuccuguagucccagcuacucaggaggcugaggugggagaaucucuugagcccgaggagguagaggcugcagucagcugugauugugccacugcacucuagccuggguaacagagcaagagccugucuaaaaaaaaaaaaagaagggaggaaauuuguccuuuuuuaaggauuuuuuuaaccuugcuaaguuuuuuaaaugaagaauacaggguuuugguaaaaaaugucuuaaauagugaaaauaguguguuuucuggcuguauuuagauaauacuccuucugcguauuuuuuuuucuauccuaguucagucaaagagugcugauccuuugaagucaaaacaucaguuggacuuagagcgugcucauuuccuuguuacacaagcuuuugaugaagaugaaaaagagaauguugaagaugcuauagaauuguacacagaagcuguggaucucugucugaaaacaguguguauagcuacaaauuacguuugaugaguuaugccaaaccauuucuucucuugcuagugaauuuuacauaacaccuugaauaaaagaauuuuaacagaauaaaaaaaauuauuuuaaauguaacaacuacuccucaauauaagaugaugaguagaaagcuaauaauggguuuuugcaucuuauuaaaauuuugaaaguauugagucuuaaauuacaagaacuauuuuuaacauuucuguucuuacaacuaaaauaaacuuacagaauucauuaucacaaaucuauuaauuuagaauaaacuuccccuuuuuucaguuucgugcacuaaaaaauaagcuagugguuuggaugagccuuacuuauuugcaguguaaaaucuguaugcugaguggcuuuuacugcucccugcugagccuugguugggacucuuagcuucaagggacaucuagugcauaagagagcaguguauuugacaggaggaugagguaaaguaguugagacugguauccccaugucuuucugacuggcuuuuuggcagagacuuuugcucagagagaccaucuggccugauuucuguaggugccuugagacuaaaugagugcuaguguucugagguuccugccacucagcguuccacagcacuauggucaaacaguucugguccaguuaucaguuguccacauaagugguuuuaaagugcaccucagugacaaauuuucaacacuauuuuaaaugauaccuuuaaggaugagaauuaaugucaucuuuguuuguucucaauuucagcaaguguaauaugcauuguaaauuuuuugcuuagaaauauggaucaagcaaauugaaaaauaauuaugcuuuaaaaugucugucucuuucuuucucuuaagucuuaugaaacugcugauaaaguccugcaaaauaaacugaaacaguuggcucgacaggcacuagacaggugaguuugaucucucaaguucuaauccauggauggcacuuaguguuauuuaaacaaauuuaucuaaauguguuguaaaggcugcaguaacaaaccuccaucuuuuaacugucaucugaaacaaaucuacuuucuacuucuuagugaauuuaccuccucucucuaguucccugcuuuaaacucaagaaauagcaaaucaauaaauguuuuuaauuuuaguuuagaacagaaaggacugugauauuugcaauggaggaccuccuuucuguuauguaauaucagacuuucaaagagaacuuccagagagccuuccagaucugcuaaaaauagaaaacaugagcaugaacuugcuuucagccauguacauaccucagauuauacaguguguagcucuuucaccucuuagcugaaaugucaacuuuucaaugaagccugcccuaaccauuguuuaaaauugaaucucccccagcaguugcaaccugauuauucugguauuuuucccacagcucuuauuuucugaggucugugagauuuacuagcuuauuauauuuguuguuaaugucuguguccccuccaaccuucaucccccagauguaagcucugagggcagagauuuuugucuauuuuauuuagugcuguaaccaaguacccagcagagugccugacauguaauaugugcucaguagauauuugcuaaaagaaugaaugaguuugcauaagcgaauuauauaucuugaaagaguguuguagacacacaaaaaaugaaaggguggaaauugcuuuuauaccuacaucaugaauuaucuccuuuugaggcucugaccugauagauaacuguaccaccccaagcccuucuuuuuuuaacugaaguaaaauagucaucccuccuuuucauugucaucuacuaacuuuaguuuguuuccucagauucacaaagauacgaguccuugacauacaguugucuucucuaucuugacuucuuucaccugucagaauuauaagugacuuuauuacgucuguggcuaacccauccaauauucucaagugcacccuaagcaaagggugggugagauagccaugggcuccuaugaggaucuuuugaaacuuauggauccauucucuaggaaaauguacaugaaauuuuuuugcauauaauuucagaguuuucacaagaauccugaagcucauauaugcaccucagguuaagaacuucuauuuuuuagcucguuaguucuuugacagaacaaaguuaaaauucuguugcauaucaugugaggcugucugugauccagccccugcuuuccucucuagucucaucuccugcugccucucguuugcacuucucacaggggcaacauucauucuuuugcaauuaccuggccgggcacgguggcucacgccuguaaucccaacacuuugggagacugagguggacgaaucaccugaggucaggaguucgagaccagccuggccaacguggcgaaacccugucucuacuaaaaauacaaaaauuagccaggcguggugguaggcaccuauaaucccagcuacucagaaggcugaggcaggagaaucgcuugacucggaaggcagagguugcagugagccaagauugcgccacuacgcucuagcuugggcaacagagugaaacgccgucucaaaaaaaaaaauaaaaaauuuaaaaaagaaauuaccuuaauucauugugcuguuucauacuucugcacguuuguacauguucuucugucuacuuagaaugcuuccucacugcccaggugaacaacucugcagcucaagcaucaguucagagcacccuucuccaacucauccccacuuggcaauucauuaagugaauaacuucuguuguacauucauuugcauguaauacuuucauccuaguaucuguuauuuuugaugcaguugucugucuuucccuacaaaacuaugaguaccuuaaggguagggauuguuuuauacguucuuuuauaccacuuaccuuaccuuguauggugucugauuauguaagugcuuaauuaauguugucaauagaauauuguuuguaaaagaugcuuaucuuuggaaguagcugaaguagugaaauguugauuaguauguaagaauuuuauauacuaauuuuacauuagggaugcuugacugguucuucaaguaaauuuuguuuccugaaaagcuuaaaugugaguagaaaaacuagaacaguuguuuguuccucucuguuauagagcagaagcgcugagugagccuuugaccaagccaguuggcaaaaucaguucaacaaguguuaagccaaagccaccuccagugagagcacauuuuccacugggcgcuaaucccuuccuugaaagaccucagucauuuauaaguccucagucaugugaugcacaaggacagagauacacagcagaagaaauagaaguacucagguaaauaaguuuacaauuaauuguaaugaagaauuuuguuaacaugaaugcagaauuuuauuuucauuagguuugcugaauuguauucagauuucuccuauaguguauugugcuguuauuauguaauuauaucaucauguagucacaacuugaaauaguuaaaauuuuaguucugauauauuuuauuuuauuuuauuauuuucauuuguauuuuuugagacagagugucacucuguuguucaggcuggagugcaguggugugaucuuggcucacugcaaccucugccuccugggcucaagcgauuuuccugccucagccucccaaguagcugggacuacaggugugugccaccacaucugacuaauuuuuuuuuuuuuuuuuuuuuuuuuuaguagagacaggguuucauaauguuggccaggcuggucucgagcuccugaccucaggugauucgcccaccucggccucccaaaguauugggauuacaggcaugagccacugugcccggcuuuaguuccaguauauuuuaauauuagcguuuuugcuagacauaauacacuuugcugaaaauccuagcauucugugaaacugagccacuaaagguuaaggagcaaaaugagcuguagcagaccacucuuaaucuaugcaacuuuguaaccagagcccuaaugggagaaaaaauguuacuuugaaauaggaguguagguggugugcuggcagcucaccccugcaaucccagcauuuugggaggcagaggggggcagaucacuugagcucaggaguuugagaccagccugggcaacaugccaaaaccccaucucuacuacaaauacaaaaaauagcuggguaugaugaugugcacuguaaucccagcuacuugggaggaucacuugagcccaggagguggagguugcaaagccgagaucacgccacugcucuccagcuugggcaacagagggagaucccgucucaaaaaaaaaaauauguguguauacacguguauauacauacguauacauauacguauauaguauacguauacguauauauauauguaaaguuuuucuuugaaagguuuuacaugcaucaaaaaaaaaaaaaaagaauauaugacagaaaccucauugcaaagccuaagcuauauaccauauggcucuuuacagaaaacauuugccgacccccugucuagcggggguuauagcgugucugaaagcagucucagaggauauuaaaaauguaaaacacggcuacucugggcacacugccuauggaguagcccuguuccacaaggagcuguaccaaaaaaaaaugaaaugugaaacacaauaauguggaaauucuugauugcccucugaaccaguguagcuaggauaagucccugagccagacaggguggcuuuuuuaaaguugagcacugcagaaaguucagucugcuuagagcuguguaagucauguagguguucaucuuuuuauuuucuaaaauugagcugaaagggcuucugccuagguagcagccaucugagagcauuuuucuuuccuuuccugcugaagauuguaauuguacuccugcuaaucuggcucccuuugucuaggaaaaauugcaugugcaccaacacagcacaauacaggacaaagaaggguaguuuugaagcuaaaagacuaauaacaguccaacacuuuuccauaugcuaccuucacauguuugaaauucuguacuacaccagaacaacucuauauuccaccuaacaaaaugcagcuauccuucaugcgagugaaaaguuuucauuaucuuuccaaaauaaggcuguacauagucccaacaaucauuucaucuauuccugacuauauuaaguaguccucagauuuccaggcuauuguuaccuaaagacuaaauucugaaguuacucugcaacaucucauaaauagaauaagggagagaaacagauacaagaaggaaauaguuaauauagauaaauaagcauauacacaaaacaaggagaaugcaaagcuacuacaaaccuuauuucuuuaauuugucaguagaccauagcugauaucuaugacacuuccuucuuccacuacccauuucauguccucauaaccagaaaacgugaagagcauguauuucagaauuguuaauguguuuuuuuaauuccaaaauaacuuaagcaauugauuucucccuuuaggcuuagcauagaauugguuuugugucuuggugucaaggacacuuucauuaccucuugaauagucuugucuucuuguggguguuagccuuuaaagaauauucuuauugguuugaauugauucaguuauuuucugauuuucaauuauuuuaugaaaauauuguccaaagauauaucaacaacaugagguugucaguuuaauuuuaauacaguaucauaccuugucauuuaaauuuuaaagaguugaaauaagauuggcaauuaagguaaacuugaacauuuagguuuuuuucucguguuugauaggacaacaucaaaaauaaaugguauagaauauguuccuuucaugaauguugaccugagagaacguuuugccuauccaaugccuuucugguaaguaagcacuguugcaauuuuuaacuccaauauuuuaacuuuucaguacucugaaguucaauuuaauagccuugaaauuaaaauuuguaauaaaaaaauuuguuggaauagagggguggcugugggaaagggauagggcaacauagcaagagcacuuuuguuauuugcccagucaugaggacaugaggaucuccuuuugccuaauauuauuucuguagugucuagcacaguaccugguguaaaguaaguacuccguaaauauuuguccaagcagugauugaaucacaacagaaauucuaacacacaguaaagaaacugaauggaaaaggggaauggaaugaugucauuguuuacuaagaagaccaauucaagcaaggacuauuuaugagagaauuaguuagcacagccuuccaggacaauggcagcuuaugucaagagcuuuaaaaauauuguuugguucaggaguccgagcuuguagucaucguaaggaaaucaacagucaaagauguacauaauaaggacacucaucaaagcaucuguugcagcaaaaaauuauugaaacaaacuggcaauaugggaaugauuaaauaauaguacaucuauacagucaaauauuaugcuacucaaaauaaguauuuaaaacuguaggaaaaaaaauguucccauuacagaaaucaaaaagaaaauuaugaugucccaaauuuuuuuuuuuuuucuuuuuuuuugagauagggucucacucccauugccuaggcuggagugcaaugaugugaucaugacucacugcagccuugacuucucaggcucaggugauucucccaccucagccucuuguauagcugggaccgcaggcaugcaccaucacgcccagcuaauuuuuguauuuuugguagagacgagauuuuaccauuuuggccaggcuggucuugcacuccugacuucaagugauccaucugccucagccucccgaagugcugggauuacagaugugagccacugugccugacccuucuuuuucuuuucauguauuuauagaugcauagaaaaaaaaaaugauguggagaaauauacccgaauauuuacagugguuaugucuagguaacaaaauuuugugauuuaaccucuuucaguacuuuuuuauuuuucaaaauuucuccaaugagcauguuauauuuauuauuagaaaaaaaaagcuggaugcuuacuauauagaauaugaaggcucuguaaagaacaaaagggcugcuuuuuauuuucuaguguuuugcuguucuuuugccaaggguuagguaucacaaagccaguuaacauauuuuuuucacucagguagcugugugaugcuaguaacugauugggaccaaaggaauuuuuauaucugagaaacuuuauagcauuaauguucagggaaagauucuagagccagacuuucuggucucaaaccuuguguaacaccgggcaaguuguuaaaucugucucaguuucuugucuguaaaauggggauaauaauagaaacuaccucauaauguuacugugaguuaauaaaauguaaaacccugagaauggugcuguuauauagcaagcacuauauaauaaagguuaccugcuagaaaaaucaucauuuuguuaguuacuaaguuauauaacaauuuggcuguauauuccaaauacuuuaacauuuuuuauaccucuuugacuaaugauuuuacuucaggaauccaguuguaaggaacuauuuagagauauacucaaaaauucguacgaaagcgauuuaucauuguuguuauaauugugaaaaugaaucaguuauucugguauuuucuugacaauauucaaauagagauguaaacuuaucauuucuaucuuuuugcaacaaauuaauguaaaucauauuuguuaugcuuauacgacacaguguccauaagaaaaauguuauauagccauaaacaaucaaguuuucaaggaauguaauaacaugggaaaaugcucauaauauaauuggaaaaguaaaauacguagccaugcagacucccuuaauuuaggcauagcacuugucacaguuggaauuuuucuuuuuuuucucuuuaaggugauuacuugcuuaaugcuugucugcuacucuagcauauaaacuucauaaggacagagaccaugucuguuuuaauuaaguugcaccccagugccuaccacaguaucugguguauaguagguauucaauaaauauuucuugaaguaguuaaauugggagaaaaacaagaauaaauacuaaaguuacuauucuaaguggcacgguauuuucuuauuuuuuaaauuauuuuacuuuaggaacaaucagaagaaaaagcaacaguaaauguuuuuaaguuggguuaacagaucaucaggaaaaggcuccagaauuuaucuuucgcuagagagauugaauuauuuuuuaaaauuguuucuauucggucguguauuacuuuuaaaauaauaaaauaagcauuauugaauaaauauuauaauuguaaguuuuuuuauuuuuuauuuuuugagauggagucucacucugucacucaggcuagagugcaguggugcgaucucagcucacugcaaccuccgucucccagauucaagagauucuucugccucagccucccaaggaacugggauuacaggcgcccaccacacgcccgacuaauuuuguauuuuggguagagacuggguuucaccauguugucuaggcuggucucaaacuccugaccucaagugauccgcccgccucagccucccaaagugcugggauuacaggcaugagccaccgcgccuggcuguaaaauauuuuuaauauauuuaaguucugagggaaaaaaccuugaauuuaauaauccucuagugacuugagagaacaaauauuauggaaucuuggauuuaugcugaaauaugguucauaugacagguuaauaauagauuacgaauuugaauuugcauuaauuuuuucuccucaaaauuuuugagagcugucuuuaaacucuucugaauucaauuagcucacuuucuguuuacaguuagcuccugguauuauacagguaccaaaaugcuaccuggaauacuagugguucugugagaugauaauaaaaaauguuugagauauguuauaugccauauucuauuuuaagagauugcaauaaacauuggcuuauuuaaagucuagagguguccuucaaugaaaaaacuaauacuuuaaccaggaguuuguagaucauacuugaccacaaaauccucucuucucccaguaucugucagcauucuuugaaaaaaaaaaaaguuauguuugugccaguuugcauauuauauacuuucuauuacuaggaaaucuuuugaaaaccaaggauuuguugcuucugcucuagaaaggguuuggggaugguugggccugguggcuugugucuguaauaccagcacucugguauuuacuucaggaaggcugguaucagccuuggcuggaggaucguuuaagcacagagguucuagagcagccugggcaacauauggagaccucaacuguuaaaaaaaaaaaaaaaaaaguuuagggaaagggggaaagguagauguuuccccuugguguacacaucaauuuuagagaaacauuguuacacacagugaguagaggguaauggauaagaaugguggauuuggcaccagagaccuggauucagaugccaguucugcuguuucuuaggugucugaccuugguaagucauuaaucacuuuaagcuauuuccaaaaauaauuccuuuaauagaguuguuuuaagaauuaaguggauuauguauguaaagcacuuuagcaugaugccuggcacaugguuaguauucacuaaauuagcuacacucauuauuagccuugccaaguggaguuuguaaaaaaccagcuuugaaucuuuagcuuccuagguccuuuugaaugaaucagcuuguacuauuguuaaugguuucauuuuauugcugaauuucuugaauacaguuaugcuaaauuuaaaaaauuauauucuuaaauauaaaugaauuuaaguuguucuucuguuuucaauuauuuagguauauuuuuuaauuggaggggaugaucagguugacuggacucuauaaagagccagauuugaccagaagguuauuuuaagauaauacaguacugcuauaaucacuagaccaaaaaaaaaaucucuaggaaauuuaauuuuggcuuugagucaucuuuuaagauuaauuuuuuuauuuuaauuuuuauuauuaccucagugauagauggggcaagcuaccauuaucaccuaaacaaaaaacuacauuuuccaaguggguacgaccagaagaccucaccaacaauccuacaaugauauauacuguguccaguuuuagcauaaagcaggugagcauuuauuuuguaugauuuuauagaaaagucagcauuuuaaaguaauuuguguauagauuugaguuuuuucuuagauuuuuuauuauauauucagguacagaaguguaauuggaaaaauuguucauucuacacauuuugacugaaacauacugagauaauauaaguauaaaucacuguuuugagugauuacagauuuuuaugugggcccuguuuaucauuauguaccuguaaauguaaaacuugagaaucugaauuucaccuuugauaaaggaauagauaucagcaauagaaggauauuuaauuauuugaguaauuauucaaaaucaauuuuuuugaaauacauuauuuaauuuucuaggauuuauuagaauaaaaugugugagucagcaguaugguguuucuauuuguuacuuuccuauucaaauaauaaccaggaaaauauuuaguauacauuguagcacuauucaaaauaacaaagacauggaaucaaccuaaaugcccaucagugacagauuggaugaagaaaaugugguacauaaacaccuuggaauacuaugcagccauaagagaacgagaugucuuuuguaggaacauggauggagcuggaggccauuauccuuagcaaacugacgcagaacagaaaaccaaauacugcauguucucacugauaagugggagcuaaaugaugagaacagcuuaaaagaaaggaacagcagacacuggguucuacuugagcguggaggauaggaggagggagaggagcggaaaaaauaacuauuggguacugggcuaauagcuggguguugaaauaauauguacaacaaacaccugugacacgaguucaccuauguuaccuuccacauguacccccgaaccuaaaauagaaguuuuaagaaaagauauuuaguauaaaaaguagguacuuggggcaauguacguauauugcgguaauguugaaauuacgugaaugaauaugaauauguuaauuauucuuauuaacagacaauaguaucggauugcuccuuuguggcaucacuggccaucagugcagcuuaugaaagacguuuuaauaagaaguuaauuaccggguaaaaaugugucucucuuuaccucuuuuuguguaauugucccuuaacuagaaauuuaaaacuuaagccuuaucuguauagaaaguggagagggcauaucauucagaauauggcccuucuguagaaauuaagcagaugauuuaugaauguggaaagauacgcuaaaacagucuuaagaaccuauacacguaguuaauauauaugaaauuaauguguuuugaaauaaaugaaauugaucaaaguaaaaucaugucauauugauaauacuuuaugauuggacuguuaagugagguagucacuagccacauguggcuauagacacuugaaauggauuagucugaauuaagaggagaugcacugcaaguguaaaaugcaugagauuuugaaaacuuagaacauaaaaaaugcaaaauugcaaaauaucucauuuuuguguugauuauauguuaaaaucauauuucgauuugugauuaaaacaucaaaauugguuuuacuuuuuuucuuuuuuuuuuuuuuuuuuuuuuuuuuuuggagacaaagaauuucgcucuuguugcccaggcuggagugcaauggcgugaucucggcucaccacaaccucugccuccuggguucaagcgauucuccugccucagccucugaaguagcugggauuacaggcaguuuuaccuuuuuaacuuuuaaugugguuacugggaaauauaacauauuucuguuggcuugaacugcuuuagaauguauuaaaauguuucugaaauacuuuuucaguuuuuaaaagauacauuagcuuaaaaucauucauugcaaaaacuaagcauuauaauuuuuucaacuuuuccugagcgguuuuuguguguuaaguccuaagaguauaaagaugaauuagacgcaguccuuaguuucaacuauuugccauauaagugguccaaauguauuuuaaaagaaaauugauacugauaguuguugaaguauguuacuguauaauuucaugcaacuauaugucaaaguuguaucuacuugccuuaguugugguuaauuggucuuuacuucuuagggccagugguaaaagauuauuuuaacuggcuuaaaauauauacacuuaauagaugguuuauuaggguauguaaguuaacauugagcacuuuucagaguauuuugaaauuuauguccacuuugugaucucagaaaauuacuuacuaauaguaaauaagcacuuugauuaggguguaguucauuuucuaggccuauuguaggaaaauauucuccuguuuguuuuuaugaaauugccaagacgguaguauauaccugaaugaaaugugcuguauaguaguugauauugaauacuaauguugguauuuuaauauuuauuuuucuuacaaaagcauaauuuacccucaaaacaaggauggugaaccagaauacaauccaugugggaaguauaugguaaaacuucaccucaauggugucccaagaaaggugaauaaugucucuccccacucccaucccuugucucucuccguucccuaccuuugaaucuugagugaaaucauuaagaaaugucaucuguuugaacauuuuaaaaguuagagucugugauauuauauauuacuaccaguagcaucauguguuaaucauuaaaaauuaauuaaaaccauggcaaguauaaacuuguuuuuuaaaugguuuugagaaaauguauacaguuucaaaaaguaacguucaacuaaggauugcuaaugcuuaaaauaaauuuucaucugauaguucaucugauuguuuugauuaaaaggaaaucagacaaacuaaaucuguuaggucagaagaguguauauguagucauaacuuaaguguaagaagccuuugaaauuauuuccuuuuaaauauauaugcauaauuuuaauucacacaaauuucuuuaaggaaagacucugaacucuguuauaagggccuugcauuguuaagguucuccaccaccuguccauguugagauccaugcagcaacaucagcaucaccuggaaguuuguuaguuuugcagaauuucaggcuucacccuagaccugcugaaucagaaucugcguuucaccuagauccccugugauccagccugaaaaucauugcucuguaguucaguaauacucaaauuuuaguaugcacagaaucaccuggcaggugauuaucuguuauuaaaacacagguuucuggaccucacgcccagaguuucugauucuggaggucugagaugagaucaaaauuugcauuucuaacaagauuccaggugaugcugauguuguugucuagaauacucucugagagccauuuuaccugauuuacuuaaaaaguaaagaaaauuauugagaauaauuuuacugaacuauaauucuugaccucuuguuuaaagaaucuuuaaagauguauggcauaaucuuccuauugguguuaaaucaaaauucuuauccucauaucucugagaacacuuuuuuuuuuuuugagauggagucucacucugucacccaggcuggagugcaauggcacaaucucggcucacugcaaccuccgccuccugggugcaagugggucuccugccucagccucccgaguagcugggauuacaggcacccaccaccacgcccggcuaauuuuuguauuuuuaguggagacagaguuucaccguguuagccaggauggucucgaucuccugaccucaugauccucccgccucggccuccuaaagugcugggauuacaggcgugagccaccgcgcccagccucagaucacuuuuuaauaugaauuagauacuguaucugaugacuuccucuguuauuuauauguauuuucuagccauaauguucuacucuuacaacuauacaugagucuuuuuauagguuuagaauaaaaugacaauaauacugcauuuaaaagugaggcccuuuuguaauuauuuuaaauguacauuucuagaauaauauagguugaguaucccuuauccgaaauacuugggaccagaaguguuuuggauuuuggauuuuaacagauuuuuuaauauuugcagaauaccuacaaguugaacaucucuaaucugaaaauccaaaacacuccaguaaguauuuccuuugagcaucaugucagugaucaagaagucuuggauuuuggagcauuucaaauuuuagauuuuuuauuucagaugcucagccuuuuaauuucagugauaguuacaugacauuuaaucaauugauugaagguuaucaucugacagauuagcuuguaaaauugaauaaagacaucauauuaaaaagaacaacauuuuguaauugguaugauucuagaaacauuaccuuaauagccgucagcauauugugcguuauauuuuaucaguaugaaagguauguuuuuauuucuugauagaaaggauuuuaagauauuuugugcaccuaagaagguuaauguucucuuucuccaggugauaauugaugaccaguuaccuguugaucacaagggagaauugcucuguucuuauuccaacaacaaaagugaauuauggguuucucucauagaaaaagcauacaugaaagucaugggaggauaugauuuuccaggauccaacuccguaaguaauagauaagacgauccagacacagauuuaagcuaucuaauauaacuguuuuaaauuugaaaaauucuagauagucuuuuuguuuauagggaaagagagcagauuaucaaccccugaaacaggaugaccaguccccguauuauggggauauauauauuuucuuguguauccgggaaagccuaaacugugucugcuuuuguugggauacaaggccaauuauaaauacaguguacauuuccagagcagucuguuuagaucaaauggaugugucauauugucauguauuuuuuuauuuguaauucagguucaaggaguuacuuguuuuauccagucuuaacagaacuuaaccuauaagauugaggugucuuccagugaccuuuuguugcaugagguaaacuagacuugagccagaaagaaauuagucagauuggcaugacuuuaaauucuuacaauaaccagccuguggccuuagaaaauguguuuaaccuuucuuagccucuucauguauccauaauauaaggauaauauccaccucuugucuuaaagucguaaagaugaaaauugcaucuuuauuccaauaauaaaaugaagugacauaugcaaaucacccaucauucauaagugauuaguuucccugccaaaccagguguccuugacuuuuccaguuuuaugcccaguucuaaugcuaggcaaagaauauauaggucauaauuaaaugcaauaggauguuacaguuuuucuuuucccagccuauacuuucaauugcucuauccuucacauacuuuuaguuuagcuuucuaauuguugcuuguuaauuuacucaguggaguuuagagagagaaagaaugggaauguauguaaaacaugaggaacaucauugcaagaacucacuaaaggacuugugacugcaucguugaagcaguuuuuucuguuacaugucuuuuuaucauauucaccuguaaaaaauaguuuuuuauucaggaaaagcaacaaagauuguagggaaaaauaugcauguucaaauucaguuaggaauuugaguuaaauaagaaauauauuacuaguugaaaacaacuaccuucugauuuauuucuaccaaaaucauuaugccaaaucagugagauguaauagcugcucuggggauuuaagaacuugaaaaugacacuggcaguccugaaauguguuucuguugcagaauauugaucuucaugcacugacuggcuggauaccagaaagaauugcuaugcauucagauagccaaacuuucaguaaggauaauucuuucagaaugcuuuaucaaagguaaacauuuuucuuuguuuuaugugugugguaaauguggccguuuaaaaacaucaugcuggcugggcguggugggucaugccuguaaucccagcacuaugggaggccaaggcaggcagaugaccugaguuugggaguuggaggaccagccugaccaacauggagaaaccccaucucuacuaaaaauacaaaauuagccggaugugguggcaggcaccuguaaucccagcuacucaggaggcugaggcaggagaaucgcuugaacgcaggaggcagagguuguggugagccgagauugcaccauugcacuccagccugggcaacaagagcaaaacuccaucucaaaaauaaauaaauaaaaauuuaaaaaauaaaaacaucaugccugauuuagaauagagauugcagaaguugucguuuuuaguuauuaaggaaauuguuuuuaaaauagacuucacauuauguacuuccuauagccaguccucaguuaucuucccuuaauaguuacaguuaauccaaauuguagauaauccaaaauauuagaauauguaauauagaaaaauuauuuuagauuuacuaauuaguuaccaaguugagggaaagugggaaaagagaagucugagaaguuaagccuuaaauggauaauccauauccauuuaagggacuggaaguuugucuaaacagugauacacauucgguugcaaaacuagaaagcucagugauuugauaaauaaaaugauaugccuguuugggaaaugccugugguauuucacgucuuuauuuuuauuuguaaaccacuugaaauuuagcguuuguuuuccuucuuugguagguuucugguuuagaauuaaguugccagaaacuuaaaaaaagagaaaugugauaauuuauuuuauauacugugcauuagaaauguacuucuuuuugaaaauucuucagggguaggaacagcccauuuucauguaagccauuagacuaaaagauaaaauggugugaucuuagauuacaaauguguuuuacuuuaauuaauugucuuugggguucauuccagauuucacaaaggagauguccucaucacugcgucaacuggaaugaugacagaagcugaaggagagaaguggggucugguucccacacacgcauaugcuguuuuggauauuagagaguucaagguuuugccuuaaaucuuuuucuuuuauuuuucuuguuggauaagacauuucagggaucccagauaauuuaucagacuucugaauacugacaaaucaagguuuaaguggaguuuauaaaccauuucaccuacauuaacuugaucucuaccguugaaaauuaugaaauuaaaaggugggaaaggaaaucauagggauggcacagauacugaugacagaacagaaaugcuguuacaccucuuugucuuuuccauaaaaccagcaguuuugaggcggaauacauagcuuccaagauuccaagcuucuucuucguguuuggaucaaucacaguguuaagcucuaaagcaguggucgccaaccuuuuuggcaucagggauccguuuuguggaagacaguuuuuccacagacuggggggugggugggagcaugguuucaggauaaaacuguuuuaccucagaucaucaggcauuagauucucauaaggggaacacagcuuagaucuuuugcaugcacaguucacaauaggguucacacuccuaugagaaucuaaugccaccacugaucugacagggggcagagcucaggcuguaaugcucacuugcccacugcucaccuccugcuaugcggcccaguuccuaacaggccauggaccaguaccugucuguggcccggggguuggggaccccugcucuaaagcauaguagacacugaauaaauacuuaugaaagugggccaggcaugguggcucacauuuauaaucccgauacuuugggaagcugaugcagaaggaucucuugaggccaggaguucgaggccaggaguucaaaaccagccugggcaacauaguaagaccccaccgcuacaaaaaauaaaaaaaaauuagcugggcauggugccauauaucuauaauuccagcuacucaagaggcugaggugggaagauugcuugagcacagaagaucaaggcugcauugagccaugaucacaccacugugcuucagccugagugauagagacccugucugaaaaaauaaaaaauugugaaaggggaagaaaauaggaagauagcugggcauaagauacaugccaguguguuuuguguaagcaaguauuuuucuuccuagaagcccuugcaugcugucaggccuuucagacagacccuguuucugcaauaucugguuagaauauuugacuucauuacuucugagguuguuguuauuuuuaacugaaaaauggauuuguucuauggauucaaaaauaaaaagauuauuaaacaaguacuauuucuuaaugaaggacccuugauaacagaacgaauagaaguagugaucagucagcaauaacagagcacuacuguguguuaauuagacugguuuucuuauguguggcacauggauuuacagucacguguugcuuaaugaugaguguacauucuaagaaaugcauuguuaggugauuuuguuguggcaugaacaucauaaaauguacuuacacaaaccuagaugguacagccuacuauacacccaagcucugugguauagccuagugcuccuagacuacaaaccuguacagcauguuauuguauugaauacuguaggcaguuauaacaacuugguauuuguauaucugaacauagaaaaacacaguaaaaauacaguauaaaagauuuuguuaaaugguacaccuguauagggcacuuacaugguuggagcuugcaggacuggaaguugcuuugggugagugagugaguggugagugaaugggaaagccuaggacauugcuguacacuacuguagacuuuaugaaugcuagacauguagacuuuauaaaaauauuuuuuucuucaauaaugaauuguucuaagccagucaaaucaucaguggugguuguauaccaacuuuagugauauguuauuaauaaguucugauuaacccauuaccaucggagcagcccaauaauaaauuaaccuuggcuuacuguaauuuuuuacuuuauaaacuuuaaauuuuuuuuaacuuucuggcucuguaauaacaacuagcugaaaacacaaacacauuguagagcuguacacaaguacuuuaccugagcuuuuuucuguuaauuuuuuuuuaggcuguuuucuuaaaauccgaaacauaaacacacacauuagccuaggcccacaugggggcaggauuaucaggaugucaauuggcaauagaacuuuuccagcuccauuauaaucuuauggaaccacuaugauauauguaguucaucgcugucuuaacauuucauuauauggugcaugacuguauaugaaguuaaugaggacaguagggaccuauugcaccauuuuaaaauuuauagucuuggaacuuucuaaauuagcuggucaguguugaaccccccagccaugcucuauagaauugcuucuuuaaaaguggcauaaaaauugcccacuuaaagcaaaaaauauaaaaauuaugugaaauuaaguacgccaauaaguuugggguuuuuuaaaauuauaauuugccacaaaugccagucaaaacauuuuaaguggcugggcaccgugggucaccccuauaauccuagcacuuugggaggcugaggcaggaggaaugcuugaggccacgaguucaagaccagccugagcaacauagcaagaccccaucucuacaauaaauaauuuuuuaaaaaauuagcugggcaugguggcacgugccuguagucccagcuaauugggaggcugagguaggaggaucacuugagcccaauguugcagugagcugagaucacaccacugcacuccagccuaguugacacagugacacccugccucaaaaaauguauauuuauauauaaagguuuucuccaguacucuuuuauuggguauauauucaaggaguuuccuaggugcauuauuuuuauuuuuuauuuuuugcuacuuauauuuugaaguguuuauuuaauucugacuucuuuuuuuuuuuuuuuuuuuuuuuuugagacagucucacugugucgcccaggcuggagugcaguggcgcggucucagcucauugcaagcuccgccucccagguucaugccauucuccugccucagccccccaaguagcugagacuacaggcgccccaccaccacgcccggccaauuuuuuauauuuuuaguagagacaggguuucuccacguuagccaggauggucucgaucuccugaccucaugauccacccaccuuggccucccaaagugcugggauuacaggcgugagcccccacgccuggccaauucugacuucuguuuuaaaauauuuccauauuugauucaagcauuuaucucuaggaccucuuuuuugcagaaagaccuaaucuuagacucugacagcucugcucaguauuacaucauuggugacuuucuucacuuaaagagauuuucaauauuuauuaauauuugcauaaaagugcuaucauuuuuguuugacuaccucuaaucugcuugcauauuccaaggucuucauuuuagucucagcgauucucucuuugggucauuuuuguguuuuugaggugauguuucauagucuacuauggaguuacaucuccagaucagggugcugacuucaguucagacagguguuaucauagaauuucugaagcuguccaaggcuuuuccuuugcugcuacuuggaaauaacuuuagaaauuggaugcuucagcaaaaucaaauuuuuuuuuuuuuuuuuuuuuuuuguucucuagcauuccuucuuuuuagagcugguucucuacccauccaaacaaaaucuacauccauaucuugguguccuugaauaucacugaugcugggggucugucucugaaaagcuuagcaacaauuugcucuccuuugugcuccucuuuuaggaaguguugagaguccugaaaugaguuaaauuuuuugaaaagaaaggaauuagaguuaaaugucgguugacuuauguguggugagacacauacaguguagaagauacugaugaaagaaacuguauuaaugaagcuucuagggaauauagccuaagaggaaugagucuuauguccagaaaucacauacaucuacccccagccacaauuugucaccauuuaaaauagcaaaggaauguguuguugugguuguuuagaugucuuccaaacaguuugauuuaugauaucauuagaaaaaguacacaauuuccuaaggugacugcuugcaguaagacaaauauuauuuuggauuuaccaccucuuuuauuuucccgaaucaauguaaucaauucuguagacaugccugguauuuacuaagcauuuaccuuuacauucuguuccauaaaugaguggaaaaucugaaaagggaugauaguguuaccauuucaaggaguugaugauuacauuggggagacaagaugacuacauuuguaggaaacaguauaagauaggauacuauuuguuuuaaacuaauguaauacagauugcuagcacuaugaagguuggagaauucaaaguaauuaaaagaaagaaauuacuaaaugcuagauacuuuauguuaauuccauuugaucuucacagccaucuucuagggacacaucauaaucuucauuuuacauaugaguaaaugaauguucagagaggguaaaugacccacccaaagaacuggaauuuggucccauuuuauucugaccccaaaguccauguuccuuucucuuuucuucacuaugucugucugcacugagaagaaaggguagcuaaagggaucaaagagggccuuucagaaaaagggaacagcaugaucaauugccuuuagaggcaaaauugaauaaggauuuuauugcacucugaaaggaaaaacuagauuagagccaaagguacauggaguauaaauacuggaaaauaaaguggagccagaguagagugagcuuugaaaaggcagaaaauacuucaugcucuaaggcaguacugucuaauagaacuccugcaaugauggaaauguucuguaucugggcugcccaaugcauuagccacuauagcuacuagcuaccuguggucauuuaacauuugaaauguggcugcugugacuaaggaacugauuuuugaauuuuauauaauuuuaacuuaacuacaugcggugaaagacugcacuauuagcucuagggaguaggcagccauuuacaguuuuugaucgauguaugaccuggugaaaguguuaaaaauauuaauuucaaguugauuugaggggaaaagaauugauaaguacucaguucauccucuaauaagagaacuaauaugguaaaaacuguuuuacaacuuaauguuaucuccuguuucuuuuuuauauaggggcugcgauuuauccaguugaaaaauccuuggagucauuuacguuggaaaggaagauacagugaaaaugauguaaaaaacuggacuccagaguugcaaaaguauuuaaacuuugauccccgaacagcucagaaaauagacaacgguaaauauaucuuuuuaauuuuaauaccauuuauucuucaaaaaaaaacauguuuuaacaagacaaaacauguguaacugacuuaaaucauuuagcauuaagauuuuuuuagauuaacaaagauauuaauuuucaggaauauuuuggauuuccugggaugaucucugccaguauuaugaugugauuuauuugaguuggaauccaggucuuuuuaaagaaucaacauguauucacagguaacuuuuugcacauugcagaguaugcuuuauaauagcauccacuuuccucacuuaaaaacauaauggugccaggcgcaguggcucaugccuguaaucccagcacuuugggaggccgagguggguggaucaguugaccucaggaguucuagaccagguugggcaacauggcaaaaccuugucucuacaaaaaauacaaaaguuagccaggcauuguggcgcacacuuguagucccagcuacucgggaggcugaggucagcagaucgcucaagccugggagguggagguugcagugagccaagaucaugccacugcacuccagcccggacaacagagcaagacucugucucaaaaaaauaaauaaauaacggaaugguuaauuuaggaagacuagcauuccaucuuuuugucacgcccacagugacuaucuuguuaauaguuguuuucuuuccaugcuuccuaguuaugccaaaaaaauuuaaaaacaguaaaacaaaaccaaaaacuuggauagcuuaauucacuuuuugaaauaguguuauauuuuagcucuaugagaaauuuaauuacaaccuucuuuguugacuuuaucuuuuaguacuugggaugcuaagcaaggaccugugaaagaugccuauagccuggccaacaacccccaguacaaacuggaggugcaguguccacaggggggugcugcaguuuggguuuugcuuaguagacacauaacagacaagguacugauacccuucuaaugauaucccauacagaaauuuuuuuaauauaguuagaacauugugaaagacauacguaaacaccagccuguuuaauuuacauaggugcccugagaauaguguuuucucagauaaaugaauauuuuccucuaaggaaauuuguauuuuauaauuauacacuuaaaaucuuguucaaaagucaucucugaagaaaaguaugagggaguuugugcuuuucagugaggguuuggggguugaucguguauaguuuagaucuuaauauuaacauugaaauaugcugaagggaauuuggaaauguugaaucauuagucuugauucuguaaagguuaaccauaaucuuaauagccuccgaaucuuaauauacauucauacauuguggucaucuauuaaaaugacaauuuaauucagaaaaacaauguuucuuauagcacuaaauagcugaaaacaaugcucuuaaaauuagagauuuuuuguggagagauuuagagcauuuuuuuggagagauuuaaaaagaaaauaaauagcauuuugaacccauuuucuaaccacauuggauucuuugugauuuuaggaugauuuugcgaauaaucgagaauuuaucacaaugguuguauacaagacugaugggaaaaaaguuuauuacccagguauguuuaguagcccagcaaacauuaaaauaaacauacauaagauuuuauuuauaugauuaaguugaaaaaugacacauuuuauguagauaauauagagaaauaauuauguugauagacuaauagaaaccacucaagcagauggguauucaugcuguucuguguuuuguuuugauuuguuuuaauuuggagacuccaaggggggauuuccauauucucgcacauggcugucagaauuuuauuucugaaacuuaaaugaugucuuuuacucuaaucaaauguauucugugguuuuccuugaacuucuggauaaaaucuaagcucuuuagcaugauauauaaggcuuuuuauucccaccuuaaucuaccugccccccuuuauuucaugccccagcuucucacaguugacauaguugcuacuccagaauacaccaugcccuuguugccuucuuucacaugguuucuucucucaagaaucucuccuccugccuuauuccuuucucccuauucugcuuaaugcacauaguuaagguccagccuaaauaccauuccuuccacugggcaccugagauauuuaacacauuguguugaaaccacuuugcuuucacauuuuuaaaaaauguguaucacuuagugagagaaacuaucuuaaggcucuggagaauagugaugaacaaaacaggauucugcuuucauagaguuuauguucuaguuggggagacaguuaauaagcaaaauaucaaguacugauacacguguaaaaaaaaggguuaugugugagugacugguugcuuuugguggguggucauagaagaccucuuugagcagggaugagaagagcuaugaauaacaaaaaggaaccagucaugcaaagaaaucaagggaaaagcauuacaggcagagggaacagcaaguacaaggaccuuacagugagaaaagaugguguauuuuugggacagagaacaggccaauugccuggguaggugugguaucaaaagaggucagaaagauuugcagaggucagaucacaugagguucuguacaccacaggaaggguucggagagucuuuggcuugucauaaucaggaaaaugacauguccuggcuccaaaugaagaugcagcuaggcuguuggauuuuugaauagaguucugggguaaggguagagauacagauaggggagucaggagcauauagauggaguuugaagauaggacugcauaaaucaccugugaagagaguuguggguacagagauuaacacccaggaucugacccuuggacucucagacaccuugagguucagcagaggaaaaagguaccacaaaagaauuugaacagagggccugaugaaacagugagguuucacauaacccaagcaaagaacauuuuucaagagaaaaagaaaggacaguuccaucuauugauguuugagaaaucaaaugagauuaggugagagaagaaacuauugugggaacuaaaugauaagaacuuacgaacacaaagaaggaaacaacacauacugaggucuacuugaaguggggggagggugggaggagggagaggaauagaaaagauaacuauuggguccuggcuuaauacgugggugaugaaauaauaugcacaacaaacccccaugacacguauuuacuuuuguaacaaacauucacauguacccccaaaccuaaaauaaaaauuaaagggaagaaacuauuggacuuagcaucguggcagucagucauuguugaccuugauaagaacaggcauaguggagagguggggcuagaagcccaguuggauugguuuuaaaagagacuaugauguaaggaagcaacuguugacaguucuugcaagaaagcugugcaaagaaaugggcagugaugggaagaugugaucagaagugguuuaagucuuacuuuguuuaaucauagggaaguauggcauucuucccuauuacaauguguugauggcaggcacugagucuugcuagucaauaucccugcguucuggaaugggcauggcacauaguagguccagugacaaauaucgaguuaaacuagccaagcuuuccuuuuuuuaaaacaaugcuccaucuuauguauagugauuuugccuuuucagaauacuuucauguuuauaauuuuauuuuaauuacaacacucugcaguaaauaggacaggccuuguucccuguuugacagaagaguaaacugaaacauggaaagguuaaaaaccuuguucaagauccacagauaugccaauucuuuacucuucucacuagaccacaccaccccuaaucauuagagacuuaugauuuguuugagauaccaaaauacuuaguuuuucugauaggucccauuauaaauauucagcguuccuaaauaagcuaagugagaccaucgaucuuaacauauaguaauugucaugcauaaaauuuuauuguaucaggcuugacugaugggacuaucaaauaauauauuaggcagcauucuuuguaauaacaaaauauugaaaauaaucugaauauccagauuuucuaaauaagcaauuggggguguagauaaaaugucauauuuguaugauggaauauuauacaggcaguuauaagaaauaaacuuaucuguauagaacaacauagcucuuuuuaaaauguugagugaaaaaugaaagauauaagacaugcacuauuuuuuuuaauauauacacuuauaccagaaacaguuauuuuuuucauucauuuuuaggaguggguacguuuguauucaagucuaaaaagaugcugacuaaauccaucaauagaagggaauaagauaaguguagugguuaaaagagacauuguuuuaugaaaaggcuagaaugaccaaaaaaaaaaaaaaguuaauuuaaaccugagugguggggaauauauauuuuuauauacuucuuuuuauuuuuuuaaauuucaucucaaaaaaaaaacuaauccugacuuuaagauccucuacgggagaaaaaugcaacacagaacaaauaguaggaauuacugaaaugcaacacagagcaaauagcaaguacuauuauacuucauugaaaguauucaaaaagauuauuuuuguuuauuaggaacuguuuaauuuuaaaguuuucaacugaaauuauaauucacuaauaucauuauauuuuaaggagagaaucaguuaaggagauguccauccaaguaauuauuuuuccuacaucaaccauaaaauuaaagaaagaaaagucuccuuuucucuaagccuacuuguuuguuugcagcugacccaccuccauacauugauggaauucgaauuaacagcccucauuauuugacuaagauaaagcugaccacaccuggcacccauaccuuuacauuagugguuucucaauaugaaaaacagaacacaauccauuacacgguucggguaaguaaaaccaacacacaaugacaaaacacaguaauauaaaguauguaauaugcucugcuuuguaagugguauuaucuggagaaaaaguuuauuucugaaaauguauugcucucuuuuuuugugcuuaucauuuuaauaguaaauuauacuuucuguagaaaauaauacauuugaaaagaaaugucuuuauuuugaaagagcauuuuuauuuucauaguaauaguuuagccccgugguaauauaguauguuggacuaauaauacauuucuuuuuuucuuuuugagacagagucuugcucugucacccaggcuggagugagugcauuagugcaaucucggcucacugcagccuccacuucccgggcucaaguaauucugccucagccuccuggguagcugggacuacaggugcugccaccaugcccagcuaauuuuuguauuuuuuguagagaugggguaucaccauguuggccaggcuggucucaaacuccuaaccucaagugauucacccaccucagccucccaaagugcugggauuacuggugucagccacugcacccagccaauauauuucauuuuaaagcaagcaauaaaaacuuauuucgcuguuuaauauuuuuauugacuuuaaaaagacuuugaacuuagugaaagagaaucagucaccuagaaauguacugcucucaucuagcugggaaggucauuguaauuuucuucuauauagauuuguuugcucuagauaagcggcucaauuugaauagauuuuuagugaugaaagggacauugggagcugcugccacccauuccuuuuucagaugcagaagccacagccuggaaaaauugugauuuguccugaggcauacaguuacuagcagagaaagccaagaccagaccccuagcuucucaguucccagcucauuaaaccugaccugauacuaggcugccuauaaugacuuguguaugccaacugauuuuuuuagucuuccaauauauucauguaucacuuugauguucuuguaaguguaaaauuuaucaauacagucuuuuuuuaaaucuagguauauucagcaugcagcuuuacuuuuucaaagauuccuucaccauacaccuuaucaaaacgggugagaaaauucauuugguuguaaucucagcauucuuuuagaauuuuuaaauucccuuucccauuucucucauuuuauuguuuauauuuagcaaaggcuucacaggaauauaagggaaacguaaauggccucaauuuggguuggaauacaagaucuucagugagcaacaucugugaaaagaaaauucagagaaagaagaugaaugcaaacuuugguuguuagagaaggcaauguggaugaaccuuaaaaguagcauuugagacuaacugcagggugggcuacauguauagaggaagauucuauggaaaauuccugguagaaagaacaacuugauuagaggcuaagagauggaaauagggguuaguggagcaaagcagccuggcugucagcagcaaauaaagaugggagagagggguuggagacacagaguggaaaauugccuuuuuuuuuuuuuugagauggaaaggaguuuugucuuuaaguggaauuggaaaugaaauuuuguuaauacuaaaacuuuuguuuuuauuagauuaauggaaaguggaguggucagagugcuggaggauguggaaauuuccaagagacucacaaaaauaaccccaucuaccaauuccauauagaaaagacugggccguuacugauugagcuacgaggaccaagguuugugaugaguaacuuucuuaaauuaaugauguucuauuacaaaugaacauaguauaacaaaaaaguuuagaaacagaccuaagcauauauggacauuggauuuauaacaauggcauuauaguggagugaggaaaggacaaucuuuucaauaaaugguauggaauaauugaguauccauguguaaaaaggguaauuagaacccuguuucacaucaaauuccagguggauuacaaaccuaaaugugaaaggcaaaacaauacagcuucuagaugauaaugcaggaaauguuuuaaccucaagagaggaaagauuucuuaagacaaagagcauauuaaaauguuuguaaauaugcugcauugauaagaaaaaaaucugcaguuuuuaaaaaauaaaaacacauucauguccuuuguagggacauggaugaaauuggaaaucaucauucucaguaaacuaucgcaagaacaaaaaaccaaacaccacauauucucacucauaggugggaauugaacaaugagaucacauggacacaggaaggggaauaucacacucuggggacuguuguggggugaggggaggggagagggauagcacugggagauauaccuaaugcuagaugacgaguuagugggugcagcgcaccagcauggcacauguauacauauguaacuaaccugcacaaugugcacauguacccuaaaacuuaaaguauaauaaaaaaauaaauaaauaaauaaaaauaaaaaaauaaaaacacauuauaaagggggcaauccagauggccaguaaaccauuguaauagccagaaauuggaaacauauauucauugacaacauuuaagauuauaauauagucauauaauaguccugauauaacaauggaaauaaauuacagcuacacacaacauaauggauaagucuuaaaaagccacauguacagaauacauaccaugugauucuacuucugugaagucaagaacagacaaaacugaaauacucauguaaggaugcacacuaagguaguaaaacuauaaagcagagcaagagaguuauuacuauaaaagcucugucgagggacaggaguugcaauuaggaauauacagggaauucuguggugcugagaggauuuguugaucugggugaugguuacccagguguuuauucacuuugcaaaugauuaaguuguauauauguuuuacuuaaguguuauauuucauaguuuuaaaagguuuaaaaaauauagagaauacagccugggcaugguggcuaacaccuguaaucccagcacuuuggaaggccaagacaggaggaucgaguucaggaguucaagacccgccugagcaacauggcaaaaccucaucucugcaaaaauuuuuuuaaaaauuuagccaggcaugguggcaugugcuuuguauagucccagccacuugggaggcugaggugggaggaugacuugagcccgggaggcagagguugcagugaucccagaugaugccacugcacuccagccugguugacagagcgagacccugucucauacaacaaccaaaaaaaaaaaaaaaaaacaaaaacagaauacaaauaaaaacagaacuaccuucuaaauaagauugggcuuaauuuugcuuuucuuacaaacuaauccagcagcagcaguuaauaacccauuagauacgaagauuugauuaaacuauuuuuccacaagaaagucauuuuuaaaaccucuaccaguuugauaggugaaauagguaaauaaaccuauuugcucuuuuguacuuaauuucuagauagauugaacauguaauaauguucauuacaauauuguuuauucccuauucauguuucuugcccauagaguugucauuuuuuuuaauuauaagcaugaaaaagguaaggguauuaacuccuucacauauuuguggauauuuuucucagauugucauuuuucucccacauagaaaaacauuucauuuuaaaauaaugaaucugucuucugguuucauuuugcuguggacaggaacucucaccacauuaccaaauuaauuuucaccauauucugauuauuuuaugguucaauuuuuugcauuuaaaaaauucauaugaauauauuuuuauauuugguaugaaauacaauuuaagaguuuuuuucuaaauuuuuuguuaccucaucaccaucuaaaugaaucuuuccuuacugauuuggaaugccacguuuauaauaugcuaaguacuucuguaaauucagaguuuguuucagggcuuucuuuccugucccauaggccuuuccauuuguuacaauaacaauuuuuuuuuucuuuuuuuuuugagacagagucuugcucugucaccaggcuggagugcagugugugaucucggcucacugcaaccuccgccuccuggguucaagcgauucuccugccucagccucccaaguagcugaggcuacaggugcacaccaccaugcgcagcuaauuuuuguauuuuugguagagacgggauuucaacauguuggccaggaugcucuugaucucuugaccuugugauccacccaccucugccucccaaagugcugggauuacaggcgugagccaccgcgccuggccaaugacaauauuuuuaauuauacccuguggccaggcgugguggcucaaggcuguaaucccagcacuuugggaggccaauguaggaggauagcuugagcccagaaguuccagaccagccugggcagcauagugagacccccuguccauaaaaaaaaauuuaagaaauuagacagauauggugguacauacccauagucccagguccugaggaggcuaaggugggagaaucccgaguccaggagggcaaggcugcagugagccaugauugcuccacuguacuccagccugggugacagugagacccugucucaaaaauaaaaaagaggucgggcgcaguggcucacaccuguaaucccagcacuuuggaaggccgaggcuggcagaucaccugaggucaagaguucgagaccagccucuccaacaugaugaaaccccgucacuacuaaaaauacaaaaaaauuuagccaggcacaguggcauaccccuguagucccaacuauucagaaggcugaggcaggauaaucacuugaacccaggaggcggagguugcagugagccaagaucgugccucugcacucuaaccugggcagcagagugagacucugucucaaaaaaaauaaaauauuucccggggagcccaugguaaaaauacagucucucuuaaaguaaguuuaaucugguguuaaucuuuaaggcuucaacugaaaaauauaaaugguguguuaugaucaaaaauagaguguguauguuucuacugaaacuucagaaacauaaacuuaguaugacaucugcacuucagauaaaguuauuuuaaaucacguuugagaauauauauuaauacaguaauucuguucauuuuaaaugcuaggcaauauagcguuggauuugagguuguaacaguuucuacucuaggagauccugguccccauggcuuucugaggaaaucuaguggugacuauagguaauguuggcauuuuuauuguaucuauuuuauacuuuacuuuuuguggcaucaucuucuauaaaccuuauucucauuuucucuaaauauagguguggguuuugcuaccuggaauuagaaaauauaccuucugggaucuucaauaucauuccuaguaccuuuuugccuaaacaagaaggaccuuuuuucuuggacuuuaauaguauuauccccaucaagaucacacaacuucagugauggagaaaucucaaguuacuggcuuuuauacuuaccaaacaucaguucuucaaauaaggacgcaaaucuucaggacaguaagcagaacaaucagaauggaauuaaaucucuaaaaacguguuacaguggaaucuggugcuugucaggguguuugguaagaacuguauauagucagaauuaccuaaaucaccuagagguaccguuuacaugguuuuguguauauagaguuggcuugcauuuuaggggccauuuuguauaaaaagugcauaugauuaaaauuagacucagucaucacugugagaugccuuugcuaagaggauaaaggaacugagaccagaugagaaaaagaaaggauauagauuccuugaguggaauagugggcuagauuaauauaccgaaauauuuccauuguuucccuuuuuugcagagcauguggaaguuaaaccugcuugauucuacuauacaucuugggcaacuaguuaccaaaugaauugugccaccauaacugauuuuaauuuugcauuauuuaugauuuuaaaauauuuguugcccagguguuaugaaagaauaaagcuuuuaaguauagacuaccuuagcaugaagaugcucaugccuaagaaugaaaauuguugagguuaucucccauucaaucauguagcaagaacuuaaagaaauucacuacugcaguuuuuauuuuuaaaaaacaguaauugagauauugaagacauuacaauuuaguuuguguggucuuuuuuuaaauugcuguaucguucagucucuuguggcaauagcacuuugaagaaaauagagaauuuaauauauggugauugggauauguagcauucaaaaaaagugaauugccaagauacuggugucauguaaauucccacuuuacauaaaaacccaucaggacagaaugaugcucaauauuuuaaaauucuaaaaauagggugggauuuuucauugucucuacuuuauaauuaucaaaacuuauuuuguauugcuacuaccuuaaauugaaauaaaauguuuauacuuacggauauugcauaguuuaaguuagauuuauugaaagauuucaucugucguguuucauguaaaugagaacagauuauuugcaugaaaauauauacuucaacaaaaaucuguucuuuaacagaguagugguagauuauuacacuaaugagauuucacuuugguaaauacuucaugcuuucaguuuuagccuauuaauuuuagguggacaaauuuaacaaguuuucuguuacuuuuuaaaaagaaaaaauccagaacauaagaacuauauuaugaacacaugauuugaaccuguugugguaaagaucuuguacaggaugcaaacuaaaaaccuaaucccugccaucaaauuuauuagaagagaccuauauaugaacaacuuaaaggcacugauuucuauaauagagcucuaaaaacaugccaccaguguaugaauaagggaaagauuaauuuuggcuggaccaauauaaaaaauuguauuugaagaauugauacuuuaacuuggaccuugaagguaaagcuucaaaagacagguuacugaccauugaguguuuacuauguacccaauguguauauuuuucuuuuuaaucuucccaauagcugaauaaaguauagauacua

SEQ ID NO: 192478 - RNA, 130948 nt, Homo sapiens
cuguuagucagcagaggcaguacaccagauuuccuuguggcuuuuaguggaaaauguuaaaagcgcacucauuuuucaguuauagaauuuuuuaguuugauuuggauuagucacagaacuggcaugaaccuucuaauugugaaggcuguccaaaugcacuauuuuuuucuccugcuagaggaaguuacaucccgagaaguagcucagaucucugguaaguguaacaugugagcauuacuaggcauuucauccugugggucugcagucuuugcucuucagacuguugcuccguuggaaugcuucugugggacugauacugagguucuauagauauuuuuuaaggaccuacucauuuggggaugucagugguguuuugcaagaucaucugaggaacaggaaagcauuugaaaucugaaaaggauaacuguggcgguuuucacaguggaaggaaacuauauuggcaaagaggcagaugacugaauaaaguaguuggcucaaagaagaugcacagucugcuauuuuuuucucugaaugaagacuguuuaauggaagcuguauucauguggagaucaaaggaaacacuggaaugauacacuacuauguuuuuccccccccuuuuuuuuuuuaaagaaaacaaaaagccugaagcaguaauuugagcucaaaugccuucuaauuccuucacagccugcuuguucuacuaggauucuccacuaacaccauuucugccuggugccugugcccuuuugcuggagcagccacagacaacugccugauggagaaagaaugaacgcucugccuugcuuaugcuaucgaugggaauaaagcuaacuguguuucuucuauuauaugggaaaccuggauuaaucaagcuguauucuaguaccaagagucguauugucucuuguggucugacucaucacauguaaacguacugcagcuuugcuauuaaugcagagugguuuuuuuuuuuuuguuuuuguuuuuugccccuuucccaaacacugaaagaauuguuaaccucugagcuucauuuucaggauuugugcugagcucuagaucuuuuuucugugaauaguaucugcauuaaaccagugaugaagaaaugaagacaaauuagaaguggaaacagaauagugagauuuuauuuuuuauuuucaauuauaagcaaaacagcuacugguaacuauaugaccuugcaggcaagaguggguaucgcugugaucaucucugucacagcaguuguuucucauuucauucuauauugugugguguugugucaccaaaaacaaugauuguuuugugcaaguaaauuucagagauagagcaauaagacuauuuugguagaggaaaaauauuuuuaaaugagcuuggacucaguuuuaguuauugacauguuggugugaaauuucuucuuaaguauugcaguaauccaacagaaauaauagaauuucguuauauuuaggaaguuacaaauuauguagucauaauuuuaaacuuguuuuuccaguaguacuuauuaacuuuaaaaaaaaaaaaaacccagcugugcuguucagagaauguuuguaaguguuguacagaagaggaggaaaaacuacuugugcucuuccaacugugacuuuuaucacauagcuuggaauuuaguguuuuaaaagaucgaaugagucgaguguguauuguuguuuuggaggagguagaagaugaaucuccugcauucauuucuaaauugccacaggaaaauaaaucccuacauucuccaccuucuggaaauguauugguaagauauguaaguuuauauguuuacuauauucuacugaacuaguaguauaaaucuuguuuuuuaagaauagauguaaauuuccaauaguuucuuuacaaacccaaauuaaagcaauacguguguagauaugaugcaguauuuuuguauaaaaugcacauuuuucguuuuuacuuuuuugaaugcugagauaacauuucagucuuuacuaugucuuaaucucuuuaaaagacuguuuaaaaauaauuugagaauuaguaguuauggcaaccacguuucuguuuucauuuugugguuucagaaacugauguaacaagaaucaggaacucugcauauuuuaggaaagguugacuacccccagcaacacuaaggcauggccuuuucuguaaugaauuuuauguauuuacauauaagacuuuauaugagauucagucuucaucuuuaaccuugguuuuagugcuacugucagcuggcuccuugacuaguauaguauaccuuaucaagaggcuguaucguugauuaagaaauuauuauauuuaguuaugcauguguuugucuuuucaaguuauuuaaguauccaguauuuuuuggucuuugauuaguggcuauuuucaucaacugccagguuugcuuucuugggauuuguaucuuuauacauguaaugcuaauccauguaagauaauuugaugccccaaacagaccuuuucaaaaaagccuuccuucaugggcuggaaauugcuuaaaaaguucugucccacaaguagauguugagaucacacauuuguauuuggaagagucuuucuuuuugucauauacagaaacaaaaggcuucuacuuacaagaaauaaaaucugauuuuguuuauuauacuaccuaaauugggucaaacugaauugauuuuuuuuuuuaauuaggccuuuuuuuuccaaguaggaauccuguacuuugacaugauuugguuuuaugaaacuucuggcuaaugucaaaagugauuauugcuacagggaagaaaacuuguagauuccagaacuauguaaaauauccuuagucaccccacauggaugauucuaauguuuuuauuacucucuucuauuuuagccaucacuggugcaagcuauauuuaacggagauccugaugaaguucgagcacuaauauuuaagaaagaagauguuaacuuucagguaaaacaguuaauucacugaugccagccuuuaaaacugcuuuuuaaaauucuuuccuagaauugugauuuuuguuuacaagacauaauauaacucuguaacaguuguuuuaaaugagggcaggaagguauugaggcaaaagggaaaacacuggacauauacucagggcaguagcagccaguaggggucuuuuguucucccagcuuuuuacuuugaaauuuuucaaacauagggaaguuaaaaaaacaugcugacuacccauauaccuuucacuuacuuuuggcauugauaacauuuugccacauuugcuuucuguauuuauuaauauacaacuuuuacauauauauguaguaaguugcagaaaucaugauacuucaccauuaaauacuuaacugugcauuucaaaugaggauucuuguaaguguauaucuaaauauaagaucagauuugcuuuuuguaaauaaucauggugaguguuuuacaauggugcuugauuaauuuuugucagauuagguuuucaguaaagucauuguuggaaaaguuuucagacuuaacgauacaguaguauauucagugcugacaugauggacaguuuuagaaagguggauauauggauaauuuucucucucuguuauguuuuuucaguggccaguauuuaguuuacuaaguuguggcugaaaguacauuacguacucuaacaaaauuacauccacuaauguauauauuuuuaccagaaacaaauguaccccugaguuauggagggggugaaaagucauaugauucacaaagucgcuguggcaacaccaaaacagaugaccuagaaaugauugugguuuuaagaaagcacccauugcaagcucauuuuuaacucucaucuuuccuccuuuuuuuuuuaauauaauacugcugugaccacuuaauguuagguagauacaaaaaaguuuuaccuuauuuuuaaaauaaugaauuaucugaauagauuugaaucauuggcuaaaacuguuguuaauuuuaacauuggguaaugaacagaaugcuaucauuauauauuuuuuaaaauuuuuucuaagugaauugccuucaaguuuauauuuaguuggaaacaugcaccuaauucaggauuuauguauguauguauguauguauuuauuuagagacagagucuggcucuguugcccaggcuggaguguaguggcaugaucuccgcucacugcaaccucugccucccggguucaagcgauucuccugccucaaccucccaaguagcugggauuacaggcaccugccaccacgcccgauuaauuuuuguguuuuuaguagagacaggguuucauucaccauguuggccaggcuggucucaaacuccugaucucaggugaucggcccgccuuggccucccaaagugcugggauuacaggcgugaggcacugugccgggccaugauuuauuuguuuuaaaugaagugucuggcuacuuuacccaggguauacugaagaguaugcguuucuuagaaaauagcucaagggguauagacgcaugaaaagguggaaaacauguuuuccauuuaacuccuaagguuuucuuguuauuuugguuuuauuuuaauaguacugacaaauacuaccuugauuagaaaguuugaacuauaauuccauuuaccagggcuaauuucuccaucauuacaaaguuuauuguagcugacauuacuuuuauguuauauuuaaucaauuuauccuaaauuaaaaaaaaauucagagucauugagagcaucagcucacucaucaguaggccuuucuugagaguaacucuuugacaauugucuucagugauacaaagguuuuugacaacaacuuuuaugauugcuuuuaggccuuuucucucgugacccuuucuuaguaguugagaguguugccuuaaagucaagauuuguuaacuuuuuggccauuauuugaauuuaagaugguaaauaucaucugauuuugucugauaaggaaucauaugggguuuuaaaaggcaauggguguuaaaugcacugacuuuuaauagguaauaaaauauuuuuaagcuuuaugucagugugacagucguguuuuuccaaaguaaauuuauuuaaauaaguauuuggagaauaacguuggacuuuuugaaacucagguuucucuuaaguuuuuugaaguuguuuuuauucauuuuuagaauggauauaaguucagauuuauuucucuaccauuaaauagucauuguauaauuuuagaugaguuucuuuagucacacccugagguuuugaauauuguagaccacuaaacagcacguuucuuaguaacacaccuaauagauuuuucuucuuauuuuaguggguuuuaaaaaaaauuuguggguacauaauaggugucuauauuuaugggguacaugggauguuuugguacaggcauguaaugugaaauaaucauaucaugaagaauuagguauucauccccucaagcauuuauccuuugaguuacaaacauuccaauuacauuauuuaaguuauuuuaaaauauacaauuaaguuauuauugacuauagucacccuauugugcuaucaaauaguaggucuuauucuauuuuuuuguacccauuaaccauccccaccucccacucaaccccccauuacccuucccagccucugguaaccauccuucuguuauguccaugaauucaguugauuugauguucagaucccacaaguaagugagaacaugugauguuuguuuuucugugccugccuuauuucgguuaacauaaugaucuccaauucuaucccuguuguugcaaaugacugggucuguuuuuuuauggcugacgaguacuccauuguguguauguaccacauuuucauuauccauucaucuguugauggacacuuagguugccuccaaauguuagcuauuguaaacagugcugcaacaaacauaggagugcagaucucuucgauacacugauuuccuuuauuuuggauauauacccagcaguggaauugcucgaucauaugguagcucuauuuuuaguuuuuugggggaccuccaaacuguucuccguagugguuguacauucccaccaauggugaacaaggguucccuuuucuuuacauccucaccagcauuuguuacugccugacuuuuggauaaaaggcauuuuaacugggacaagaugauaucucauugaguuuuggauaucugaugauuagugauguugagaaccuuuucaccauuugugugucuucuuuugaggaaugucuauucagaucuuuugcccauuuuuuaucagauuauuagguuuuuuccuguagaguuguuugagcuccuuauauucugguuauuaguccccugucagagggguaguuugcaaauguuuucucucguucuguggguugucucuucacuuuguugauuacuuccuuugcugugcagaagcuuuuuaacuugaugugaucccauuuguccauguuugcuuugguugccugugcuugugggcuauugcucaagaaauauuugcucagacuaauguccuggagauuuuccccaguguuuucuuguauuagauucaguuugaaguauuuaaugcauuuugauuugaauuuuguauauggcaagagauaggggucugguuucaugauuuugcauguguuuauccaguuucccagcaccauuuauuaaagagacuugucuuuucccaguguauguucuuggcaccuuugucaaaaaugaguuugcuguagguguuuggauuugguuuuggguucucuguucuguucuauugguacacgugucuguuuuugugacaguaccaugcuguuuugguuacgauaggucuguagcauaauuugaaguuagauaaugggauuccaccaguuuuguucuuuuugcuuaggguggcuuuggcuauucugggucuuuucugguuccauauaaauuuuaguauuuuuucuauuccugugaagaauuccauugguauuuugauugggauugcauugaaucuauagauugccaggacauuuuaacaguguugauucaucccaauccaugaacauggaauauuuuuccauuuuuugguguccucuucaauuuucuucauucguguuuuauuguuuccauuauagagaucuuuuacuucuuugguuaauuccuaaguauuuaauuuuauguauggcuauuguaaacaggauuacuuuuuaguuucuuuuucacauuguucacuguuggcauauagaaaugcuagugauguuuguacauugauuuuguauucuggaacuuuacugaauuuaucaguucuaguuuucuuguggaauguuuagguuuuuccaaauauaagauuauaucaccaacaaacagguauaauuugacuucuuccuucccaauuuguaugccuuugauaucuuucucuugucugauugagcuagauaggacuuccaguacuauguuaaauaacaguggugacagugggcauccuuguguugcaggucuuagaggaaagauuuucaguuuuuccucauucagcaugauacuagcugugggucugucauauauggcuuuuauuauguugagauauguuccuuccauauccaguuuuuugaggguuuuuaucaugaagggauauugaauuuuuuaaucaaauguuuuuucaacaucaguugaaaugaucauaugguuauucuuuauuuuuuugauaugauauaucauguuaauugauuuuguguuuugaaccauccuugcaucccacagauaaaucccacuugaucaugaugaaugaucuuucuaauauauuguugaauucaguugugcuaguauuuuguugaggauuucugcauuaauacucaucagcgauacuggccuguaguuuucuuuuuuugaugugucuuugucugguuuugguaucaggguaauacuggccuugaaugaauuuggaaguauucccuccucuauuuuuuagaauauuuugaguaggauugguauuaguucuucuuuaaauguuugguagaauucagcagugaagccauuauguccuggccuuuucauuacuagaagacuuuuuauuacagcuuugaucucauuacuuguuacuggucuguucugguuuuggauuuccucuuguuucaaucuugguagguuguauaugucuaggaauguguccauuucuucuauauuuuccaguuuaucagcauauauaguugcuuacaguaaccacuaacaagccuuuggauuucugcauaagucauaaugucuguguaagucguaauuucuguguaaguuguaaugucuccuuuuucauuucugauuuuauuuggaucuucuucucuuuuuuucuuagucuggcuaaagauuugucaauuguauuuuuuuaagucaacuuuuuguuucccuaauagauuuuuaacaaacuuuaauuuuaaaaaauuauauauucauauuauuugguaugacaugaagucuucuagaagucauguaacauaguuucacuagcaaauacuagaguuuuauauuuggcagauuuuggccacagauauaauaauugacuaccugaauaaauagagguuuuuugcuuguguaauaauuuaaucuagagcaugguaauuugggguuguuuaaaacagcaaugucagagcucugggugagcuucucugugaaacucuuggcuuucucauaauaaagagaugacugcuguaucauguacuuaugggagacaaccaaagacauuggaaaagagacucuccuguacauuuucuuuucuuuucuuuucuuuuuuuuuuaaaaaaaggagaaaaccucucuucgaaaguccccacaaaauuccuuccuaagguuccauugguuacaagacuacucuaaacuaauucaccagcaaagcagaaugggguucgcuuuuugcuagaucagucuugguucaucaccugguucauccccuggagcaggaauagggcuucaguggacuuuauugaauauauugccauauucaggaguaaaucaggauuuucauaggaaggaagaaagggaaaauaguuguuuggauaggaaccuaacuggacgguuauuaguugccuaaaaacuguugaaauagcaaaauuuuggaaaaauaagucaccuggauguggaagaagcacuguaaaccauaaaagggugaaaugcaaucaaaauguuuuaaaagcagagugguacauagaaugugaagaacaguuggacucuaaguugaaagaccuagauuuucauaucuucuuagccuuauuggcuauacaaguugagugaauccuguuaacuucagcccucacucuucuuuuuuuuuggggggguaaauguguaggguuacauuaaugaucuucacagucuuuccccacuccaaauucaggacacucuaaaaauucuaaaugacuuucagugaccuccugcuuuugcccaaaagcuuucauuuguguuucuagauuuucgugaccaaaauaauaaaugccuuucccuaagauuuacuagaacuuaaugccauguuguagaacccaaauagguuaaucugaaauauuaaugauaccacauuuuagaggaaaacuuugauucuucuuuauaagaaaauuauuuucuacaaauauuaauuuuuuauuaagaguauuaaaauugguguuaauuguagaacuuuacuuuugagacagacauaggcauaagccauuuuguauuacucaauuuaacuuguacaacaguuuuauaaaauugacagguuaacauuucuacuaaaauucacaaaaauuaaccgucugcagaaucaguauagcagaaugggaauuugaacccauguccgacuuaauaguaacuggagaaauaaagcauauuguugagagagaaauauuuuuucuucugccaaauaguacuauaaagcaauaauaguuggaaaauggauguuucucucuaaaauaguuaugucugugcccuaugaacuccugccuuuuaagcugugauacaaagauaauccuaauuuuuauaauaccaagugcuguuacauuuuaucauugcaaacaagugaugagacaaauaagacacaagccuucuuuagugccauauuuuuuugguagauaaaaaugucaaaguaguauuacacaaggauccagccaaacuguuuuuaguguuuaaacauaggaaggcugagauuaugagcaacccuuuuuaaacucuaaagagcugauuuaagagcuaagcgguagaucuuagauguagcauauaacuuaauauuuuugaaaguguuaccuuguauauucugcuuauuggcuucugaauuuagauauacuuuauuauucaaaaaugaauugcaaaaguaguccuccaaauuauuaucccuuguuuucaaaaccgcuuucugaaaucauugaaaugauguucauuuuacauuuuucacaugaagugcucagcaaauacagucuuuucugaaaauuagcaagaagcagucuaaucuugaacaagucuuucuuaguggccacauguugcuucugcugacugucaguacaccaagcuguugauguuucugagcucuuaaaaaaucucuucacucauuacuugaggcugugugcacucucuguccuaaaaccauauguguguacauggucuuuucuuauagcuauucacaguaacuaguguuggagcccacaacccuccaucccuaucucagguguaucuacccagcuuucagcuggcuuguauggaacguggagugaaggugggggcaggcaugggagaagaaccaacucagcuuucucccaggagagaaaugacaccucccuccagcucuuuguggccagugccucuagauuccaguuucaaauuuguaaauuaucuucgucaauguugagguuucucccaagauccauaaccaaguauauguccuaugucacuaugacuaaaugauuacucugaugguccugaaacaaagaagguauuauccacuggaaccagcaguuuuuggagguucaaaauacagaaauuuguauuccacucagguauuuauuuuuaguaagcauguuauacaugaguucugcauuuuccuuuuucauucccaguguauuuuaggagucaguccauauuagucuauagagacuuuccucauucuuuauaauuuauuucauagcauaauuuauuuaacuagcagaacuaguucccucuuagagggcauuuggguuauuauuaacccucuucauugguaauaaaugagaucuuuucaucaaguuaacaaaaauucuacuuaaauggacaagcaaaaaauuuuaaauguauuuauuaucuguuauuaaauauauuauuaacuucauagacuaccuuuccucuagguucaguauuuaaagcaauuuuagugcauauguuuauaugaauugguggacgguaaauacuggcauuuucuauaaagcucaaguaucaauacuugcauacucagaaguaaugcugaugguuacuuauacagauguugauaguuauaugguauagcaaaaauaugauaaauuauguccuaaauuucauacugaaaugaaguaacuuuggucugaaaguucucagcuagugccucagacuauuuuuuuaaacuuuuauugagauacaaucgauguauaauaaacugcauauauauaaaguguaaaauuucauaaguuuugauacaugcauacaccuaugaaaccaucaccacagucaagauaguuaacauuucuauggcucccaaaggacuccauuugccccuuggaaaucccuuccucccuccucucccugguaauuacuaaccugguuuguacauuuuguuuuuuccuagaguguuauauaaauggaauuacacaauaugucauuuuuuuggucuggcuuuuuuuuuguaauagauuuuauguuguagagcaguuuuaaauucacaacaguguugagaggaagauacagacauuucucauacacuuuacugccaccacaaaugaauagccuucccauuaucaacauuucccauuagagugguacauuuguuaaaauugauguaccuacauuaauacauaucauuauggcucaaaaaccagaguuuacauuaggguucacuccugguauuauacauugaaugaguuuggacaaguauauaaugacauguauccagcauuauaguuucauacagaguaguuucacugccguauccucugugcacccucuauucguucuuccccccagucccugguaauuuuuuuuacauugucuccauaguuuugccuuuuccaaaaugucauauaguuggaaucauauaguauguacccuuuucagguuggcgucuuucacuuagcaguaugcauuuacauuucuucuauguuuuuuuaauggcuugguagcucauuucuuuuuaauccauuaucugaauguaccacaguuuauccauucaccuacuuaagggcaucuugguugcuuccaaguuuuggcaguuaugaauaaagcuacuauaaacuuccacgugcaaguuuuuguugggacguauauuuucagcuucuuuggguaaaaucaaauaacaugauugcaggaucauaagguaagaguauguuuaguuuuguuaaaaaaccugucaaaguggcuguuuaccagugugcacucauagcagguauaaaugagagucucuauuguuucauauccuugccagcauuugguguuaucaguguucuggauuuugaccauucuaauaggugcguaguggugucuuauuguuguuuugauuugcaauucccugaugacaugauguggaguaucuuuucauaugcuuauuugccaucuguauaucuucuuuggugaaaugucuguuaaaguccuugguccguuuuuuaaacagguuuguguucuucugguuagguuuugggauuucuuuguagauuuuggauaacaguucuuuaucugauaggucuuuuggaaauauuuucucccaggcugccuuuucauucuuaggcaaugucuuuugcggagcagaacuuuugaauuuuaacgaagucacagcuuaucgauucuucuucauugaacaugccuuugguauuguaucuaaaaggucauccccaaacccaagaucaucuggauuuucuauuuuaucuuccaggaguuuuauaguuuugcauuuuuauaguuucauaguuugggcacagguaccugccauggggcugagauguggguuauggguagcugcuacugugcuuagaacugaaauugaccaaaauuaauugcaauuuaccaugaccacaguaaaucauaauuuaccccucugagucuuuccuugaaaguagcaaggcuucauuauaugacagaguuccaaaauaguuauauuggacagauucugccaguggaauuguuuucuaguuggggagacagauuccuggugcuuccuacucugcuguauucucagaauccucuccauucauuuacuuuuagccuacuauuugcaucuuuauauuuuaaaagguuuuuuacagacaauauauacuuggauauuguuuuuugaucgagucugacaauuuuugucuuuuaauugguguuuuuagaccauugacauucagagugauucuuguuauagguggauuacuguuuaucauuuuuguuacuguuuuguauuuguuaccauuggucguccauucuucuucugccuucugugguuuuaauugagcauuucaugugauuauauuuucucuccuuucuuaggauaucaguuauaccucuuuuuuuuuuaaguaaaugucuuacagucuacaauaugcauauuaaucuaauggacaucuagcugucaaauaacacuauaccacuugacagguaguaugaggaucuaacaacaaaagaauccuaauuccuccuuaucauuccuuguaucacugcugucauuccuuacacuuacauauaagcauacaugagcacauauaugugagcauuugucauuauauugcugccauuauuuugaacaaacuauugucuguuagaucaauucaaauaaaauguuuuuauuuaacuuacuccuucuuugaugcucuuccuuuuuuauguagaucugaguuucugacuauaacauuuuucuucugagagagaaguucagcugacaaauucucucaauuuuuguuugucugagaaaguauuuauucuuuacuuuugaggcaauucccaggguaccagaauucuagguuggugguauuuuuuuuucugucaaugcuuuaaauauuucuccggacucuuuucuugcuuucauggcuccugaggcguagucagacauaauuauuaucuuagccccuguguggguaaaguuuuuuccucuggcuacuuucagaguuguauuuaucuuugauuuucugcaauuuaaauaugauaugccuugauauauuuugggggauauuuuuccuguuaguguucuccuggaucugugguuuguuaucugacguucauuugggggaaacucugagucauuauuacuucaaauauuucuucugcuuuuuucauucagcauaauuauuuugagauucaucuagguuguggcauguauuaauagcuuauuccuuucuuucuguugcugaguaguauuccauuguaaugauauacagaauuuguuuauccacuccuuucguaaacauuuaggugcuucucuguuucaucuguuacaauuaaauguacugugaacauguguguacaaguccuugcaugaaugugugcuuuuuuuuucucuuguguaaauguuuagugguggaaugguugaauaugcuuguuuaacuuuuuaagaaacugacaaacuguuucccaaacugauuguaucauuuuacguucucaccagcaggauaugagaauccuaaauuuucaacauucucacaaauauuucguauaaucagucuuuuaaaaucuuaaauauuuuaauaauaguaauaucucaauuuggucuuaauuuguauuucuguaaucuuuucgugaucuugucaguccauuuaucuuuggugaaaugucuuuucaaauguucuugugaguuuuuuuaauuggauuguuuucuuacucuugaguuuucagaguucuuauuuauauguucuggaaacaaauccucgaucuguggcuguauuuucauucucuuaagaguguuuuugaaaagcucaaguuuuauuuugaugacauccacauuuaucaauucuuuuauggaucucgguuuugguguuguaucuuaaaaaaaaacugucccauugucauguuguuuugcucauaucuucuagaaguuuuauaguuuuaaguuucacauuuaucaacaaauccacugaaaaggauuuucuuccaaaaaggaaagaggcuuuaugccagcuaacaguuuguacaccaggaaaaugcagccuucuguacaaaacaaagguguguucuaagagaaugaagagaaaguuugucuuuuauggcaaaaguucucgcccagguucccacucugaucugcuuguacaaaugagggaugcaaacucaguuaguucugauuguuugaaacuuguugaguucugaugguucggcacagaucacagucuauugauugauucagguagcauacacagaacagacaacuaugaaagucccaaaguuuagugaguauggcauuuuucccugaacacucaguauguguguaaccucuaauuaccaaauggcugcuugacuguauuucaaauuuaguuccacuuagccacucaggauuccucuugaaggauugacccuuucagaguucacacauuuaaaugugcuauuuugacuuaauauuuguguauuuguguaugaugcagaguauaugacaaagcuuauuaauuucucucaccaauauuuuguaauuucauuauaaaugucuuuugucagauuuaucuguauuuuauaauuuuuuguccuaauguaaguggcauuuuauuuaauuuuaaaauauccgaauaauucugcgcuacugaaacaaguuucuccugaguacucuacuccaugcuccaggaauuauuaguuuucccuaacuggcuaguuggaacagaacacucuguucucugugauccgucauucucguuggaggugauaucacuccuaauugagaggaaauagauucuuuguggguauguagguauaugaaaaaucuuacauauuccaaugauuuguggcccucuaaauggccaaaaugcauaacuuagaaauacagugguauuaagauuucauggggaaugauuaggaaaaacugucagaaaagaguaguaaggaagaaaagguugaaaaacacugcuguuucuuucaccagcuucagguaguauucuuacacuccuuucccacucaguacucaguugaguacuaaggcgagauucugcagaucuuugggagucucuccauguacuacuuucuccucuguugcucuguccugagaauuccagccccuuuguucgcugcagacugucuccuaaacucacagggaauuaaaaacaacaacaacaaaacuuuguauacagcauuaagaauuuuauugauugaagcagcugacauuccacugaauguuuucagacuuagacauuacauauuuugugaaaugguaauuuucuuuuauauuccagcaguacuucuggaauagaaauucuaaacauuagccugccgaacaacuggauugcauuugaugauuacaauuguccagucacagauggcaucaccucuacuuuuuauuauuaauauuaguuuuaauugccaaaucauaauuguauauauuuguagaguacaauguaauauuuugguauauguauacaaugugggaugauuaaaucaagcuaauauauccaucacuucacuuauuguuugugauuuuuuuuuuccuucaccuuuuuguuccauccagaccugcccacaaugagggcagaucuuccccacucaguccacugacucacaugccagucuccuccagaaacauccucauggauuucuacagaaauaaugccauaccagcuaucuaaguauccuuuaauucagucagauggacaccuaaaauuagucaugacagguccuuugccucuuuuaaucagguuguuuucuugcuuuugaguugaguuuauuauauacuuugaauauaaauucuuuaucaaauauacgguuugcuaauauauacaugugauuuuuuuuuuuucugugcaaaagcuuuuucauuuaaugcagucccauuugccaguuuuuguuuuuguugcuugugcuuucaggucauauccaaaaaaauauugcccagaccaguauuguggugcuuccccgccuuguuuauaguuuuauaauuucaggucuuauauuuaagucuuuaauguauuuugagcugauuuuuauauaugguaugagauaaggauccaguuucauucuucugcaucuggauauccaguuuuccuaacaucuuuuauugaagaggcuguucuuuccacauuauguguucuuggcaccuuugucaaaaaucaagugaccauaaaugagugaauuuauuucugggcuuucuguccuguuccauuggucacugugucuguuuuuaugccaauacuaugcugucuugauuacaguagcuuuauaauauauuuugaaaucagcagugugaugccuccagcuuuguuuuuuucgcugguuauuguuuuuaacuauucauggucuuuuauuguuucauaugaauuuaaggguuguuuuuucuauuuucugugaaaaauuacauuggaauuuugauagggauugcacugaauuuguggauugcuuuggauaauauggacauuuuaacaauauuaauuuuuuaguucaugaacacaguauaucuucucauuuauuuguguuuucuucaauuuguuuucauuaauguuuuauaguuuuuaguauacagaucuuuuaccuguuugguuaaauuuucaccuaaauauguuacuuuuuuuuguuguugcuauuauaaaugggauuguuuucuuaauuuccuuuuuagauaguuuguuguuaguauacagaaaggcuacugauuuuuuuuguauguugauuuuguaucuugcaacuuaauucauuugucaguuucagucauuuuuuggugucucuuuagggauuucucuguguaagaucaugucugcaaauaaaauuucauuucuuucuuuuuuauuaggaugccuuuuacuucuuucucuugccuaauuguucuggcuaggacuugcagcacuaugguggauaggaguggugagggugggcagcauucuugucccucgucuuagaagaaagcuuucaacuuuguacguuaagugugauguuagcugugggccugccauuuuuggccuuuacaggaccuguuauugauguguaauuuuaguguuuuauuauucuacaaaaagcaaguaagccuuagaaauaucugauuacugcuaaauuuguagaauggaauaaauucaguacuuagaauaggaugcugucuguauuuuuauauauuauuauagagcagugucuagauuacaacaugaauuaauaacuagauucuaaaauaccuacagggaauuuguccuggggcaagaaccaugccuuccauauuguaggauagucagcacuggaaagggaucuuaaagauuaaguaguuaaaucaacuccguuacagaugaggcaaaacuaaggcccuuggaauuauuugauuugguugcuuccauuuggucacuuuccaagaucucaaagauaucuuaacgcaguuuucuuuaugucaaauuuaguuuuuuguccauauugucugcccugguaugucaccucucaauucuaccuaguggcuuagcauuauaaguaauuucuuuucucuuguagcuauaagcauauaagcucuuuaguaaauacuugcuuguuuaauuugauaauauuugguauguugguuuauucacuugucuaguaauaugugccaguuacuaugcugguuccugugaaggcaaguccaaucaugcauaauuucuucucccugcuuuuuaauguuauuuccuuauaucagauuaucaguuguaccugcauucucacccucuuccuuugccucgucuuaagcuuucaggcugcaguuuaugguaggcagacuuuuaagaugguccccuguauuauuucugguauuguaagcaugauaggguauuguaugaguuuguucucccucugcuaugaagaacuaccugagacuggguaauuuauuaaaaaagagguuuaauugacucacaguucugcauggcugugggggccucaggaaacuuacaaucauggcagaaggcaccucuucacagggugacaggagagagaaugacugccagcagggcaaaugcuacauacuuauacaaccaucagaucuccugagacucacuuauuaucaugagaauagcaugggggaacugccccccaugauucauuuaccuccaccuagucccauccuugacacguagggauuauuacaauuuaagauuaaauuuggguagggauacagagccaaaccauaucaggucucauuccugauuaguuuaugucaucuggcagagcacaaagcugacucuagguaagugagauuaucuagaugggugugcccuaaucacaugaacucuaaaucugggucuagaguuaggaacaaagagaguaggagauuagacguaugagagggauuugaugugaaggauauucucucuugcuggcuuugaagauggagggagccauaugguaagaacucaggcauucucugcuaguggagggugaccucuggcugacaacugggaaaggaaaauggaggucuuagaaggacaaagaacugaccauuuccugaaugagccaaaaaacagauuuuuuuuccuuuagucaggucucuaggugagaacacagcccaucaacaccuugauuucaacuuuguguaacccucagcagagaacccagucacaccaugccugaauuacugcccuuaaaacugugaacuaaaagauuauuuguuuuaagcuguugcacuuuuuuaaaauagcuacuauuuaucauacucuggguauaaaaacagggaauaaacaagauuccuaucuccagaguuagagccauugaacaugaaacaagucaauuaauaugaugauuguuacaagggagacguucagagugcuauggacaccuauuaggcugauguaauaccagcugggagaccacgaaaggagcuccagaaaaaagauacuuauguaugauacgcauuuuuuauugcugcauaacaaauuacuaaguguuagaagcgaaugaauauaaagaaaacauagccccugacuucagcaaguuuaugaucuaaagguauuugguuauauuauguguggguauugacggggcuagggcggagaggguguguguguguguguguguguguguguguguguguguguguguguguguguguaguuugguuuuggugaugggagcagucaacuguccagguugccccucugaagucacugcucugacagaccauaaacagaaaacugcaaaugauaacaaacuuacuauuucauaagagaauacuaccauucuccauauuucggguacacauguguuuuguuucgcccuuucuguuucaaguuuauugaaaagaagccuguuuagcuuaauuguacuugggcagcugacacuugacuaguucaaaagauaauaaacucaucauuuagaacacaugugucuuuguauaugagaaauaaauaacaguuacaaauacuguaggucaagguuucaucauugguuuggaagauaaauauguacagugaggguuugggguuuuauuuacacagaaacuagauuacuucccccacacccuaagauugcguugcacagaucucugguaauaaaauuucuacuuuuauuccugauuccguguagaaccaaauugaugcuuuggggagggggcauggguagauaaaggauaaguaguuuuuucaguuuucaggugacuuuuuucuuuuuuuucuuuuuuuuuuuuuuuuugagacggagucucgcucugucaccuaggcugguacaguggcgcaaucucagcucacugcaagcucuaccucccagguucaugccauucuccugccucaaucucccgaguagcuggggcuacagaugcccacugcuaagcccagcuaauuuuuuguauuuuuguagagaugggguuucaccacguuaaccaggauggucucgaucuccugaccuugugauccacccaccucggccucccaaagugcugggauuacaggugugagccucugcuccuggcccaggugacuuuuuuucauuuugaacauuaguucaggagaacaaaacuuccuaaaccaacaaaagcaacgacuguucuuaggcuggaaauaucauuucagagcuuuuguuuucugucaauucuuugauauauuuuaccucuuaauucagauguguuuuaauugauauuuuggaagaaugguuacacuuucauaaccaacuuuuuccuccuccuuuuaacuuuuuuaaaauuaggaaauauaauaaacuuauguaaaacaaauguacaauuuaaugaauaugugaaugucaccacgacccagaucagaaaacagaacaucauuagcaccucagaagugcccuuguuggugaccacuuuaugaucaaaacuuuccaccccaccccucaguguuacccguaaauuuuuauaauagucucuucugguuuucuuuauaauuuugccaccuacuuauucuuccccaagcaauauaauuuaguuuugcauauuuugaaucaaauggaucauacaguauauuuucuucgagucuggguucuuuugugcaaugcuauuuuguuuuaaaaauugaccugauuccacugaaugcauccaacacaguuuauccauucugcuauugauggauaauuggguuguuucacauuuuuuuucuauuuugaaugaugcagcuauuuguaaacuugucuucugaugcacauaagcgugcauuucuauaguauaaauacuuggcuauacauauauucagcuuuacuugauaaugucauauuauuaaauaacuuaaacuuccaugagcacugugugagaauucuuauucauccacaucuuuggaccacauucuugguuuuugaaguauguaguguacgauaugguaaaguguuuauuuggacauaguccaguuuccuagcauacagcuucuaaaaaacccuuguaauuucuggggugauaagugucuuuuuuaugcuuaugaggugcuaucugagcuauuugaggccccucagauagcuuaaagaugagggcuugucaccugaaagaccaaagcaugauuagagggcuugaacuuuucaagccccccaccccccagucucuggagaaagaagagggacugaauguugaguuggucaccaguagccaguuauuuaaucagucaugcuuauguaaugaauccucuauaaaagcccaaaaggacuggguucagggauuuuccaguagcugaacauguggcaguuccuggaggguggugcacccagagagggaauggaaguugcacgcccuuccguggaagcugugugccuuauacgucucuuucaucuggcuguucaucuguacccuuuuuuguguuauuaauacaucaguaaauauaaauaaaguguucccagaauuauuugagcuccucuagcaaacuaaucaaaccugagaaagagguagugggaaccucaauuuauagccaguuggugagaaguauaggugaaaaccuacuaguagggacuggcaucugaaguaaggggcagucuuuugggacugagcacucacuuugagaucugaugcuaucuucagguagauagugucaggauuaaauggaauuagaguacacccagcugguguccuccggggaauugcuuuaugaggaaacaaccuccacacaucaaguaucaguuuuguauugaguggugugugaguagaaggggaaaaacugauuuuuccuccuacauaguuguauguuguuauuuuagcuugcuuuuuuaugacaguuucaggcacauuuuauauguuaauuaagcaugcauauagccagccucuuuuaugaaguaccuguuaaaucuccugggccgggcacaguggcucacgccuguaaucccaccacuuugggaggccaagguggguggaucauuugaggucaggaguucaagaccagccuggccaacauggugaaacuccaucucuacuaaagauacaaaaguuagccaggcgugguggugggcaccuguagucccagcuacuggggaggcugaggcaggagaaucgcuugaauccuggaggcagagguugcagugagccgagauugugcugcugcacuccagccugggcaacagagugagacucugucugaaaaauaaauacauacauacauaaauaaaucuccugccuacuuuucuuuugaguugucucuuauuaauuugcagcgggucuuuuuauauucuggauaugagcccuuuuugacuugcguguguugcagauaucuucucccauucaaacuugucuuuucagaauucuuuaugguauaauuaaacaugaggucuuaauuuuuuaugccuuguuuuucaguuuuuuaaaaauaguuaaugcuuuugauaucuuguuucagaagucuuucccuaacuugaguuguaaagauaauauuccauauucauauaugagugcuuuuaacauuuugcugcuuacauuuaguuuuauaauauauuugcaguuaaauuauacauauaaugugagguaguguuuggguuugguuuuuguuuucauucuuuuccaaauagguaccacauugucccagcauaauuuaaaugcccauauuuuguugggugguuuucuuauuuuugaguuuugagaguucuuuauauauuccgaauucaaguucucugucagaucugugauuugcaaguauuuuuucccagugcaugcuuugucuuuuuauccucuuaacuaugucuuucucaguacaaaagucucauuuugaugaaguuuaauucauuaacuucauggauuuugcuuuugguauugcaucuaagagcucuuuacacaacccacaauuuucuaaguuuaauaauuuuagauuugggaaauaggucuaugauuccuuuuaaguuaauauucauauuagguguuagguauagauggagguuaauuuuguggcaugugauuauccaggacuauuuguugaaaagauuauuucuacauugacuugccuuuguacuuuagucaaaaaucaaucauauuuguguggguuuauuucuagacucugcucuggucaugucugccuuuuuucucauaccacccucccuugauuacuucacuuuuauaguaauuauugcagucaaacagcgugaggcccccaacuuugcuguuccuccuaaauuguuucugccuuuuuaguuugucuuucuacguaaauuuuagcuuuuuaauaucuacaagaaauccugugaggauuuuuauugugauugcauugaaucuauagaucaaauugaggaaaacuggcauuuuagcaauagugagucuuccaauucaugaacauggucucucaucauuuacuuagguguucuuugauuuuuuucuugcguguuucauaguuuucagcauacaaaucuugaaauuuuuuuuuucuuuuuugacauggagucuuacucuguugcccaggcaggagugcagucuuggcucacugcaaccuccauguccuggguucaagcaauucuccugccucagcuucucaaguaacugggauuacaggcgcacaccaccacacccagcuaauuuuuguauuuuuaguagaggcaggguuuugccauguuggccaggcuggucuugaauucuugaccucaggugauccgcccaccuuagccucccauaguacuggguuuacaggagugagccacugcaucuggcccaaaucuugcaaauuuuuauuagauuuaugcuuaagcauuuauuuuccuucuuucucuuuuuaccuuuugaugcuauucuaaaugauaccuuuuuuuuaguauaacuuucacuuauuaauugcuaguaagaaauauaguugguuuuguauauugaccuugcauucaacaacuuuucuaaacuuagucuaggaauuuuuuuuuuuuuuagauuccuugggauuuucuuuauaaauaauaugccaucuaugacuagagauacuuuucuuucuucccucucaauugauaagauuuuuugcuuuuccuuauuuuacugacaaguacuuggguaggaguggugagaguagacauuuuugccucauuccuaucucagaaaaaaacauucacucuuucaccauuaaauuaccugucagcuguagauuuuuguuguacccuuuaucggauuaagaaaguuccccucuaaguuugcugagaguuuuaaaaauuaugagcuagcugggcgugguuguaugugccuguaaucucagcuacucaggaggcugaggcaggagaaucgcuugaacccgggagguggagguugcagugagccgagaucgcgccacugcacgcuagccugggcaacagagggagacucugccucaaaaauaaaugaauaaauaaauaauuuuuuuaaaaaucaugaguacauguuggauuuuguuaaaugcgaugauuauaugaccuuucuuuuuauuagucugcuaauauguugaauuacaccaguugguuuuaguugaaugauacuugugaucccagaauaaacuccaguuggucgugauguaguacccuuuucaaauauugcugaauucaauuugcugauauuuaguugaagauauuuaugucucuguugaugggggauauucaucucuggguuuuuuuguuuuuuguaauugucugguuuugguaucaggaugauaauguuggcuucaucuuuuuauguuuuggggauuuuauugauaauccccucuuaguuaugauacagacuauuuuuuccuuugaucauucugacuugaagauuacuaauuauauugaucuuuucaaagaaucagcuuuugaguucacugauacucuguuuuuguuuuguuuucaucuuuaucauuuucauccuucugcuuuuuuugcugguuauuuugcccuuuuuucuaguuuaagugaaagcuuaaauuauugauuuaagaccuucuuuucugauacaaacauuuaauauauaaauugcucucuauugcuuuaacuuuaucccccaaauuuuaauguguuguauucauuuucauuccauucaaaauacuuuucuaauguucuuggagacuuccucuuuacauggguuauuuagaaguaguuuucuacauuuauucuacuuuacuacugaaauaugcuuugaaucccaaauacuuggcaauuuucaaauugucagguuaucuuucuguuauuuauuuccaauuuaauuuuguuauggccaaagaacauacuuaguaugauuuugcuuuauuuuaauguguuaagguuugguuuuggcucagaauaugguuuaucuaaauguuucaagugcuuuugaaaauaaaugauaucguuuggauguuuguccccuccaaaucucauguugaaaugugaucuucaaucuuggagguggagccuaaugggaaauguuuggaucaugggggcagauccuuuauaaauggauuggugccuucccagcaguaaaugugagugaguucuagcucuccuacuucaugcaacagcugguuguuuaaagagcuuggcacccccucuucucucucuugaucacucucuucaccuugugacaccccugcucuccuuuugccuucuaccaccauuguaagcuuccugaggcccucaucagaagcagaugcuggugccaugccuuuuuuuuuuuuuuuugagacagaguuuugcucugucacccaggcugcagugcaguggcgggaucucggcucacugcaaccuccaccucccagguucaagcgauucugcugccucagccucccaaguagcugggauuacaggugcccgccaccacgccuggcuaauuuuuguauuuuuaguagagauaguguuucaccauguuggccggguuggucuccaacuccuguccucaggugauccgcccgccugggcuucccaaagugcugggauuacaggcacgagccacugcgcccugccuggugccaugcuucuuauacagccuguacaaccauaaaccaaauaaaccucuuuucuuuauaaauaacccacccucagauauuccuuuguagcagugcaaaacagacugauacaauguucauccuuuuguugcaugcuauaaauuguacaauaauuuuacacaguaaauaagauguguuaagugcuuuaugcaauggcuugcacuaauaaaaaucuucagguuugcucuccuucucuaagacacucucaccauucuacauaguuacuacaggaacugccauguuaaucuuccccuacuuucaguuaauauagaaguaagcauuaaauuuaugagcaaauuuggugagcaccaaauuaagccaaucagauauucuuccgggagauugaauuaagagacuucuccuugggcugcugaaguucuaagaguaaauaucaggaguugggauggcuuauucccuaccaugaaaaaaaguguucugugaagacagaaaaagcagcucaugugcagagaagaaacagagacaaaaguguuucaaguguuugauuucaauuguucuuacgaccuagccacaugccugccuuuccucaauuuugguuguucagugcucaauuccauuagaugcuucaguguccuuccuuuaaaucgauuuugccuaaacugguuuaaguuagauuucuguacccaguaaugcuaucuaauauauauauauauauguauauauauguauucaauacauaguaauuauuaaggaugauaauagaaauguggacuauuuaugauuuuucuuuaaaguuacauugcucugauaaaugcuaaugauauuucauauuauaaucugaaacuuuaagguuccacagagguuuucaaaguauuccuuggaggaagaggaucauagcaugcaucuuggaacuaguuuuaacaguuguuuuacaguugucugucagagguaguucuaaaaugugcuucauucucauacccaaagucaauauggaagucuucuacaaccuauauggcaaguguucuccacuaacauaauuuguuaaauccuuucuagugccuauaagguacauaacuuuuuuuuuuuuuuuuaaguuagaccaaggcuuuuucaauggauguggaguccacugacagguguucaguguacucuuccuugcucagaccauacucacagugcauuaucuauaacuuccauuuugaguuucuguagcugaugugagaaauuagacccuuaagaaauaaucuuagggcaaaaccccuaagguuuuuacuguucacuguuugccuuaguguuuccaauugucucagccauacccaauucaauagcacuucccuuuuuucaguaguuugcuuuuauugauucuucaguugugguaacaaacacagcuuacccuugauaaacauaccccaucaugggagcaaaacuguguaggcuuguuagugguaaacuacuagucagaauauuuaaugugccaaagucaucuauuaauuuuacucaggaagccgaggauauugguuaaucuugugagucaguuaaauaaagauuaagaauuuuuuguguuuuauaauuuuagguaaccauuuagugggcauuuaaguuguuacuagcauuuugccuccuacagugauucaauaaauauacuuaaucauuuuaucuggauauguaggcuuuuuuuaaaaaagccuuaaaauggaauuacugugucuaaggggaucgucacuuuuuaauuuuaauacauuuuggugaaagaaaucuuaaauauuuuauuaccuaauuuucaauguuuaacuguaguaaaauaugauauauaaauucuuucuuucaaaauuagccaguuguauuucucccuuuucuucaaauugauuugcagagaggaaaaacuguguucauaugaaucauaaaacacauuaaugggauucgagaggcauugagucauagaauuccagacaucccucacacacagaugacucacuuucuguguuguugugcuaugugugugguuuaucuggugcaauagauguuucucaguuugacuaaaucugaucauauuuaaacacucuaggaaguuugcuguguuaaugaguaacacugaaaagccuaggcaaaguauccuuucuuuuaaaaaaaugacuaaauuaggacacaucuuugcauguauucuguuacuuuagugguucuguguuagcucuuucaacaauuguugaauaauuucuguguagagcauucuguuuccuggggugguauauguuggaauaaaaaacaaggucuugugcuaauuguggugagagaaagaacccuuagcuuacugaacaauuuaacauuauuggcacuauaucaaccucccuuuacuggaacaccuguuacuauuuuaaggacaaaagcagcauuaaaauuauaggaagaaauguuugaagagaccagugauaauuauauguuacacacauuugccccccugccccaccgccgccccccgccagagaagaucuugcucuguugcccaggcuggagugcaauggcauggucauagcucacagcagccucaagcuccuggacucaagccauccuaccucagccugccgaguaccuaggacuacaggugcaugccaccagcccagcuaauuuauuuacuuauuuauuuuuuuguagagaugaggucucacuauauugcccaggcugauguagaacuccuggccucaagugauccucccaccacagccucccaaauguuaagauacgucuguauaauaacaucacauacuacagcuaagccuuuuuuggauugccuguagauauuuaauccuucuuuugccuagcaagcagguuuuuacuuuaauucucaauagcccaacuauuuuuucuuaaaguaauuaagggauuccuaaacaagaaaauuauuacaaaaugaaguauaauuuuucauuuguuuaaaucuugaaaacuguauuaguauucuaauaugguaagaggccccccaaauauacuaccuacuuuaaauaaguuuauuuaucuuaauagcaugaaagucagugauccaagcuaguaaggcagcucuuuucuguaggauuauuuauuccagaucuuguugcuugacaguaugcuaguauauuggccugcauuuccauggucaaaggggcucaguuucacaugugccuuccagccugugggaagcaggaaacaauuagccccuuucuagaguaguuuuguuuuuguuuuuguuguuuuguuuuguuuuguuuuggugacagagucucucucugucauccaggcuggagugcaguggcgccaucucagcucacugcaagcucugccucccggguucaugcuauucuccugccucagccucccaaguagccaggacuacaggcacccgccaccacgugcggcuuuuuuuuuuuuuuuuuuuuuuuuuuuuuuuuuuuuuuuuuaguagagacuagguuucauuguguuagccaggauggucucgaucuccugaccucgugauccacccgccaccucagccucccaaagugcugggauuacaggcgugagccacugugcccagccuagaguaguugucuuuuaaguugaagaugaccuggaaguugugcccauuauuaauuuccacucacauaccauugguccacaccaagcaacaacuucaagggaggccaggaauguauucucucacuggguggcuaagugaccagcuaaaauuuuauuccuguggacaaaaggaagaacauaguggaaaacaacuaacuaucugucacaaaagccuuuaucaaaaaugagggauguaaguuucaaugugaguauuucugaauaguuuuuuucaaaugcagccaagucaguaauacucuguuguaacuuuagauaggguaucuaugaauuaaaaaucccugaaugugacauuacucuaaaaucuugcaucuugaacuggagagcacuguuguuuucugguaggagguccaugaagcaugcauuagagguagcuucuuuuccuggaggaagauuuggaugaguauguauuuuuuauauugaaacagacaugaauauauuuuggagaugaaaguaaaacuagcaggaauguuaagaaaaaacuuaaaauugcuuuaaaguauaaugucgaaucccccgaaauauuuucccuuuuugccccuaaggguacuguugugaaaacauuuugauaagcaaaucuuuugguuuguuuagguuaacaguucuaaacuguaaaacuguggaaauauacugacgaaaaaauuaguaugaaguaaaauuuuccuauauauaucagcagcacaagcaucuuuauucaaagaaaguguugcuauuucuuugucauuuuagauuuuuauuuuuauucuuugcuggacuuuauaccacuauuuuaaggucaaguauuuuuuuaggcuuuugccuuagcaaggaaauacccuguguuuuuguuuuguuguuuuuuuuuguuuuuaauagagacaggguccugcucuguuacccaggguggaguacaguggugcagucauggcucacugcagccucauucacuugcaggcucaagugauucuccuagcuggaacuauaugugcaugcuaccaugccuggcuaauuguuaaaaaaaauuuuguagagacaaggucuugcuguguugcccgggcuugucacauccuuuuauuuuauugggacuugcagacuaggcuagaguuauagaaguaauaaguugauaguuaauaaugguuugguggggggagggguuguuguugugguuauuaaaacuauuauuaaaauuaaucuuauuuuaaaacuuauuucccaccuuuccuuauuaucacaggacaaugaaaagcgaaccccauugcacgccgcagcuuaccuuggagaugcagaaaucauugaacuucuuauuuuaucugguaugguaaccucugaguaauaagaacacauuauguauauuuuuguuauucuuaauguuucucaaucauaauugacuauuuacugcauggccuguuguucauauuuguuuuaucagcugaaacuuauuuuuauauucauuccauaaauacugaucacauaucuuuuucugggugcuuagaguacauuaaagaacaaaacaaagauugcugcccucuuguagcuuauacucugauaaggaaaaacaagcaauaaauacaagugaauuuuauaguauauuaaaugaugaugagugcuuugaaaaaauugaaagguagaucaggauaaucggggugggauaagcauuauauguagcggguuuuuuugguugguuuuuuuuuuuuuuuuugguuuuugguuuuugagauggagucucgcucuguugccaggguauaguggcacgaucucagcucacugcaaccuccagcucccugguucaagugauuauccugccucagccucccgaguagcugggauuacaggcacaugccuccauacccagcuaauuuuuguauuuuuaguagagacgggguuucaccauguuggccaggaugaucucgaucuccugaccuugugaucugccugucuuggccucccaaagugcugggauuacaggagugagccaccaugcccgccuacauaggguauuauauggaacaguuauaguaggccucauugagcacagaauuauaggagaugguugcaguucuccuagguggagguaacggugguuuauagcaaauacaacaguggagacaguaagaaauagucugauaguagauauauuuugaaggcaaugccaguaagauuucuguguuuaaauagcuuuuaucuaacccuacuugagggcuuguaaaaugcuuuuagucaauuauacuccuuuauuauuuuuucuaaacuauuuaagucuuuauaauaugaaguaauacuagaacugucuaugauagaauagcuccuauuguggucagacuacgugcagucccaaaaaaggcaagcagacagacagaguuuagaaauacuuuuguuauagccagaugauuguaaugauauuuauugggaaaggauauaugucauugauuugagcuuguauugccaaauugcauaccuacaugcauaaugaaauuggauuaguaguaguauuccuuugauaguuuguggaaaggagggcucagagggagaaauuuugugugaagauuucguuaaauaauagcccagaguuuugccguuacaaauucauaaaaauuuaagaaucaguuggauuuuuaaaaaauaccuuauuucuauaucagauuucaugaucauauaaaauuaaauaugguuaaacauggaccuggcuaauauuuuguuagcuucuuuaugaauaauuucaccgcugauguacuucccugaagaugccuguuccuuauuaauuuucagcuaaaauuuacucaagauaagaacugaggagguugacaaaauuauuucuuuuaauaauauaaauuaaugggacucaaguuuauggaauuuucuacacaaacaucauccaagaaacaguuuaggacuggauaagaagucuacugcugcauuuuuuauuuuaacacagaauucugauuauuuuuguuuugucauaaauauuauuuuauaugauuccacguggaggguuuguuuuuuuuuuucauuuuuuauuuuuacacccaggagaaacuuuucaaaugcucaaaguugacuuaaucccuuccuuuuaaaagugaauguuugcaacaaggauuuuuaguuacuuguagaagguugacuuccugguuucuguaaguaugauggucaaaugagucuuaucaugagcaugauaguaucuagaugucagcugugaaauaagcauuugagagaaugcuuaguuucuucugaauaauccaaguacaaaucauguguaaaauuaaccaugauacuuguauaaaaagcuauuugaacuuaccuuuaaaaaauacuuuuuuuauuuuucuuugagacagaaucucgcucugucgcccaggcuggagugcaguggcacaaucucagcucagugcaacuucccggguucaagcgauucaccugccucagccucccgaguagcugggacugcagguguguggcaccaggccuggcuaauuuuuguauuuuuaguaagagaugggguuucaccauguuggccaggcuggucuugaacuccuggucucaggugauuugccugccucagccuccgaaagugcugagauuacaagugugaggcacugugcccagccaaaaaguacuuuuaauguuuuaucaguguaaagagguaauauagcucauguagcuauuuuucaaaggaaaaauacaauuuuggaugaauucaauuguucucaguucucaauaaaaaaaaauuaaguuuuuacauuggccuuagagcuguacauuaucuccccaccccagauuucuucugacuugaauuccugcuacucucuuuuuguuugcucugcucuaacccuacuggcugccuucuaccucugguucuucgcacugcuguuuccuuagccuuaaaccuucuucagccgcuuacaccaugaaccuuuucauguccuugcucagaugucgcaucaucaacaagaucuuccuuggucacuaccacuaccaccuaaucccccucgccuguguuaucuuuucuccuaguguuuauuguuaccugacauccuuuuuaaauuacuuguuuacugucguuuuaucuccuccagaauguaaacuccaagaaggcaggcaguuagucuacuuugccuuccuagcauauuuauuuaaagugccugggauggugauuauagcaauauaagcuuagacugugucuccuuuucagaaauuuguuuacauuuugguuuguuucucaagucuuuaauggaaaugagaaugggagagguggggauggguagaaguuaaggguugaaggguaucagguaaguggaaagggaaagaaggcgaaugauuugucuuugagugcaacucagggucuuagacuuuuuucucuuuagacuuaccaguuaggcucuaauuuaggaaaaauaaaacaaaaacuuacauggguuuggaguaaaauuagcuggaguaaaauccaaggcuagauuucuauugaacuagaaccucagcuuucugcuuauaaacaaaaaaaauaaagaaauaaaccaggcuuuguguugccaugagagacacuacagauagugugaaugucacaagcucuuuugccagacagauuuggauacaguccuggccuuaccucuuagcaccuccaugaucuuuugaaguuuauuugcucucugagccucaacuuccucaucuaaaaaaaugggaauaauauaaaauuuauaggcuuaaagaagcaaaugagauuaugucauuaagauaccuagaaaagucccuggcauauaguauucaaaauuauggcuauuuuuuuuuaaggagcauuucuauuuuuuccuucacuuuuuugguucugccaaguaaauaaauuccuugauaucaggaauuaucuucucugugacuuuuagauaugcuuucuuaaaaauucuccgcugucaguuuugaaguccaguuauuacguucugaaaugauaaagaggaaggaaugacuuaccuacugggggaaaaugaaaaauaauuuauuuccacaaucuagaaagacaaagguugaaaaaaaauagacucuauauacucuggagaaguguauuuauauguuuuaaauucuacaaucaagaaacagccuuuaaagcuuuaauaugauauaaguaccuuccugaacaggguagguauuugcuccccugaggaaauaguaagggcuccuguaauuuauggauaacagagcucuaacaaaaagauagguaguaaucaggauguguauuuaacuuacgaaaguugacacuauagaggauaacucccauagccuuuuauaaaaauauccuuucacauaaaugaggaaggaaccaggagaguuuuuuuuuuuuuguuuuguuuuuuuuuuuuuuuuuuuuuuuuuaaagacauagucuugcucuguuacccaggcuggagggcaguggcaccaucucucgguuuacugcaaccuccaccuaccagguucaaaugauucuccugccucagccuccugaguagcugggauuacaggcaugcaucaccaggcccaacuaauuuuuguauuuuuaguagagaugggguuucaccauguuggccaggcuggucucgaacuccugaccccaggugauccacccaccacggccucccaaagugcugggauuacagcugugagccaccaugcccagcccaggagagauuuugaaaucugaaccagaaaccugaucaggaaggaauuuugauugguggauauuucuucaguucauucauguuauauccauuuuaaauuccuauuaacucuuuaaauugaaaguugauuaggacaguuuuacagaagauauacuacacauuuuagaagucaaguauaagcuaaccagugaauucuuacuuuuauauuggaaauagauuuccagaauagcaggguaguaaaagacuaaucguauccaaauuuuaguucagaauaaauaucagaagaauagucuucagacaauauauaguauauagacucauaagguucuguauagaugcuccaggaguucugcuuaaauuugguuugaaugccaugguugcugaggcccaaguuaaacugacugauuucuauaacccuaauuuuaaauucuggauccaucaaaacagccuuuuaaugaauuaugguaaguugaguuauaaauuagaauugaaacuagauauuugaucugaucaauucucuagguaaagaugagaaaaaaauacaugaagagaaauauaggcaacaaaauuaggcuaauuuguuuauaguuaguaaugaaaauuuaguguagguguuuacacuucauguuaauuaccaacaccacauuuuaguagcagguagguauaaucuuaaguaaauuaagcaauaugaaauaaugcuuauuuguauaaaagucguguaagauugcauuaaagucauauguuuucauaagaacauacaauagucaguuacuguaauuuuguauuuuaaaaacuacugcgauauccauagcaagaguucuauauucucuaaauauauuucucuaacauaaaaaaauagaaagauugagauuauuuuagagucauuuccuucuguguucauauuucagguuuuuauuaugucugacuugugauuaaaaauuaggaaauaaggauauuuauauuuucuccaauugguuucacucuuuuguguugccuuggcccuuuaagugauguggaaaaccaauggagaguucuguuuggaguggaauaacaugcucugacuuauguuuuuaaagauugauucucuggcuuuggcuucaaauucuugaccauuuuaagucauguuuauccuacuuuuuguuauuucuagguuuuuaucuuuaauaguuuuccuuuuuuccccaaacucagcuagcucucauagucucucuacauugucuuaucucuuucuuguaacuuuucuuugaggucuccucuucagaacuuaaauucagugaaguugaguauauagaguagcucaugaauucaucuuauuuucugggaugguuuuuuccaacugcauuucuccuaguuuacucuacucuguauauuuuuauccuaguccugugcuggaugcuuucagauucuuacguaucuucgaggaauaugccucuuugcagaacagaaaggaaggggcaaaaagugaacaucuguuagguuuguuucuucaaauaacucucaaaccaaauuuuaaguucaggaguacaugcacagguguguuauauagguaaacuuaaguaaccaaauuuuaaguucaggaguacaugcgcagguguguuauauagguaaaguuaagucauguggguuuguuguacagauuauuucaucauccauauauuaagccuaguucccauuauuuuuccugaaccucucucuccucuuaucguccacccucugauaggccccaguguguguugugucccucuguguguccauauguucucaucauuuaguuuccuuuuuuuguugauauaccacagguaguugggcuggcucagcagcuucuuagaucaaugaguucuuagauaguaaucugcuggugauuggcuguuacucucccucaucuccagcuggguaaaaaauuaauaaagaugccuucuuggucucuuuuuuagcacugccccacuuuauucuuaugcagugugagguuaagaguucuguaggugcuuuuccugugaauuacccagacagcucuagaucgucugaaagauuuuuagggauuuuaggacacagcagagagaaaggagcaaaugggacacacaugcaaacaugacuuuuuagaggacucgguaaccuucccaagaucugaagaagcuucgcuugacucaguguccuucaguuugguacacauuucacuguuauugauagaaauaauucauaguuugguuugugguuguaacuguuuccuuauuguauugaagaugguaucucuucucauucucuuuuauauuuuggugacuuguuuuagaguaaaacuacucacuuucuuuaacuugcaguccagaauucuucagaaaccaaguauuuguacaugaugcaacucuaagauuuguggaugagagguauaauuuuuggcguggcaccuguaaucaaacaagugaauacauccauagaaucuauaguaauacuagaguccacuggaauuaauguuaauaauuauuauggaauggggugaaauaauagcaaacagugagcuuauuacauuuuaaauacuguuaaauuuagccauuucacuaaucucauuuuagccuaaauuugugaagguauuauauaaggaaacuaagacauuuagcuuuuaaacuuucaaaguuuuuauacugcuaguaaaagcuagaggcagaauucagauccaggcaguuugacuacagaauccguguucuuaauccugccguaaucagaaucuuccuuuuuucuucccaccauaauuuccacccuccucccccaaccaccuauuuagcuuuuaguaaaauuuacaugugaagucacuuuuauugaagaacuuuuaaagacuauuugcuggccacugagguauagauauuuuguuugggagcuuauucacuuaaugcuugcauucaaaacuauaugguuagcaguaccucagaccuuagacugccuccaguaaguauuaaguccuuaaaugacugcauuguggaaggcauuugucaaaaauucauucgauuggccuuuuauaaaaaauacucuccuuacuagaaaacaccguucugauguuucuggcauuaagaaugaaaccuaaaguaugugucucuucuuuuuacuucagugcugguacauuaguuugguggggcugcuguaacaaaguacuacaaacugggcggcuuaaacaauagaaauuuauuuacucaaaguucuggaggcuguaagucugagaucaaggugccgucaggauugauuccuuuggaaggcugagagggaaggaucuguucaggguaucucucucuggcuugcaaaaucgcugucuucucccuuuauuuucccucuguccaugucuuuuugcaaauuucuucuuguaaggacaccagucauacuguauuagggcccacccuaaugaccucauuuuaauuaccucuguaaagagucuaucuccaguuaaagucauauucugaguugccagggguugggaguugaacaaacccacaauagcugguauccacaacacucuuaaaagauacagugcagcagcuauuuuuuucagcauuauaguuggaaaaguggaaaugucauugguuuuugcucauucuacucugagccugaaaaccgaaucugaaccuuuugccacugcacuguuagguagccaaagaaaagcauuauuuccaguuugggaagagggauaaaaguacuuagcuucuggcccagcucacugguuauggacuaucuccucugugauuuaggagcaaggaagaaaacaauucucugcaaauagaaguuuuggaaaaugauuugugagacuauuuauaauuauuacaaacauguauaaaguuagcaauaacuuuaauaguaccuacuaucaaguucuuagccuagaucagagguuggcuaacguuuucuguaaagggccagauacuaguuacaggccauacagacucuggcaagauacaaguuacaggccauucaacucuguugucauagugaaagcuacauauuuaauauuuaaauugaauagauguggcucuguuccaguaaaacuuuacaaauuagguggcuugaagccuguggauaguaguuugaagaccccuaacauagaucuuuuuaauguuagagugaggugucuuaguccuuucgggcugccauaacagaauaucacagacugagugacuuaaaaauuuuucucaguucuggggccugggaagaucgugaugccagaagauuugguaucuggugagggcccacuucuuauuuauagccagcagucuuuuuaguauaaccucauaugguggaaagggugagggagcgcucuugggccacuuuuacaagggcauuaaucccauucacugccuucaugacccaauuaccucacaaaagaccucgccuccuaauaccaugacauugggguugggauuuuaacauaaauuuugggggaacgcaaacauucagaccauuugacaagguuuaauaaguaugacauaauuuauucugaauauuccaaaauaggauagaacguuauaacuggaaauggaucauaaggaugauuuagcacaaugcuuuauuuuacagguauaguugacccuugaacaauguggagguuaggggcacugacucccccaaccccaacacaauaggaacuuugaauauaaccuuuggcucccuaaaaacuacuaauagccuaauguugaccaaaagccuuacuaauaacauaaacaguuaacacauauuuuacauguuauauguauuauauacuguauucuuacaauaaaauaagcaauaaaaugaaaauacuaagaaaaucauaaagagaaaacacuguguauugaauggacgcagaucaucauaaacaucuucauccuugucaucuucacauugaauaaggugaagaggaaguggagggcuugcugucugggguugcagagauggaagaaaaucuacauauaaguggacucaugcaguuugaaccaguguuguuuaagggucagcuguaauugagguucaaaaaucaaagaauuggaagaauuuagugaccaauuagauuaggagaaaauaagucaaucaguugucuugcagaaugaaaucuggagucaaaugggauacuccuaauagaauugcugacuguagaacuucgcagaaagagugcccuuuguuguuuaaaucuggggcccauccucacccaauccuguccauacauauucauauccaccucccccucaccucaccacacacacagccuaggagcagggauuaugauuugcaaaaugaagacccaggccccaggaaacacuuccaggucacacagccaacuaguuauacagccauuaugagaucacguaucucuccugcuccaguguuccuuccacuaacccaugacugugucuucacaacguuagaccucucuucagcugcauugcuggcugccuagagcccuagacuaauguaaguaaguaaaucaaguuuuuguuuuugaauuuauguuuuauuuccgaauagcuagacauuuaauucuagauuuagguaaccuuuucuuuuacaaaacuauuguuucagagugcacuuuuauaugggugaaauauuacguguaaagauugggugagaggaaacugauuagcuggguuuuccuauauaaucuauaacugugguaugaaauggauacaaccuguuuaggugauccugcaguugauuuuuaguuguguuauuuauugcauguaauaucagaaacucagucacaucucuacucuagaaaggugaaucuaaauucagauauaugugugaggauaggcucuggccguuuaucugaagggaaaguucaguugguaugcauagauuugugggggacaagaaaagacuuguuaaaauauugauuauacaguuggacauaaccauuuugaauuuaaugaggugcuucuggcauguaaguuuucuguaaauauugguuuauaguacucacugaugguaucuuucuuaaauugcuauguguguugucuuuuguuucuuagcagugcuuuuucgcaccacaggcuaugccaguaaccuaacuucaacaaaugacaagggacugcuguuuuauauucuuuucugucuuaaugaguaggaaauaguaaagaaauuaaucuucuguugguuacuuaaggucauccuuauaaaccacaaauacuaucuucuaccauguagagggcaugugauuaugccaccagaggcgguuaacgacauuugguuuuauuucucucuacaaagacuguuuuuuguuuuaaguggguaugguuucucccugccuccccuguaucuccauccucauuauuagcuguuguggcugguguuuaauacuccaacuagcuauugaacuaguuaacuauauucuggaaaugucuuuuccauuucuagaaugaauuugucguuuaaaguauauaugaauauauagauaacuuuggaguauucuguguggaacagaacucuauuuagcuuuagacagcccacugacaugagcucugggaaucugaaccaucugaaaugugcugcuauguuuguugcuuuuacacucuuuuucauuuuacaggaacacagccaacugcugcucuuguaguguacauuacugugucauauuuaucuguuuauauuguaaaucacauguuaacuaauguuggugggggaauauuguuucauuguugcccucagauauagcccugauuucucauauaguugaccuuuauuuuccaaggaauuaaaaacauuugauuaggcucuuagaagaaaugcaugauuuuuuuuauuuuuuauuauuuuuuuucuuuuugagacggaguuuugcucuuguugcccaggcuggagugcaauggcacggucuaggcucacugcaaccuccaccucccagguucaagugauuguccugccucagccucccgaguagcuuggaagcuuggauugcaggcgcccaccgcugugccuagcuaauuuuuuuuuguaauuuuaguagggccuggguuucaccauguuggccagacuggucuugaacuccugaccucaggugauuugcccgccuuggucucccaaaguacugggauuacaggcgugagccacugcacccggccgauauauacauauuuaaagguauaauauaaaguugcauuacuacccuaguaccuccauaugcccaguuuucaaugugccucccaccaccaacacaaacguauaagcacccccucucauuaauaucuuagcauuccuguaggguuucuuuaugcauauuaagcaaauacaguaguacccccuuuugaagagguauguuccaagacccccaaguagaugccugaaaccucagauaguacugaacccuauauacuaugcacaaguuucuuuuucccucuucagaauuucagguagaagauuuguucuuacuguagaucuuagcaaccucagcaugauuuuuuuuuuauugagaacuuacaucuuuucacuuaaaggaagcauuuuacugcuucuuuuggcauacucaaauuuccagcaucacuacucuugcaccuuggggccauuauuaaguaacguaaggguuacuugaacacaagcauuaugauaccaugauagucaaucugauaaucaagagggucccauaaggaaagggugaauggcauaugcaagauacgauggacaaagggaugauucacauccuggguggauggagcaggauggugccauauuucaucauguuacucagaacagugagcaauuuaaaauuuaugaauuauuuauuucuggaauuuucccuuuaauauuuucagaccaugguugacuggguaacaagcugugaaaagugaaacaaggggggaccauugugugauaagauaaaaauaauuaucucuuccuuuuucuacauaaaaguaaagcguacuagucauacaauuacugcuuuuuuacuuuuuguuuucagaucuuuauuaacacagagucuccucaguuuuuugugccagccaccuucuguuuuuugagacagagucucacuaucuugcccaggcuggaguguguggugcaaucucggcucacugcaaccucuuccucccggguucaagugauuccugccucagccucugaguaauuagacuuacaggugcacgcgggccaccacaucuggcuaauuuuuguauuuuuaguagaggcaggguuucaccauguuggccaggcuggucuugaacuccugucuucaagcaaucugcccaccucagccucccaaaagugcuaggauuacagucaugagccccugugcccuucuauucuccugcuaauuaauacuuugaaucagacuucucagcaucccucaugagaccucauuucuuauuuaccuuuguugauucaggauacugucuguacuaggugucuguguugauacccuuugggccuuacugccagagcuuuccguucuacuguguauagauaugcaugugcacauaaauauaaaccuguagaaagaggcacagggcuuaaagagaaccauugaaguccuaagcagauaagugggaaaacgaaagacgcuagcuucugugucacuccuucacuaucuguaggguuccagcuuccagcuggcaaacauuucaaauguguguacuuuguacauuccgucuucuacccaaaacaaacguuggcauuacugugauuaggcaguuuguguuuuaaccaucuaggguuccacagugccuggcagauaguugcccaaauauuuauuacauggguaugucaugcucucugacugguucuuuauuugcugucuuccuuuccuucuuccauagccuaacugugagcauuguucaaagcucucuaauuagcucuugauucuuuguguccucacugccacugcccacagagaacucagcuacucucagcaucucaacuacuacauuuguggauguuucuuacaccuccauuucauuuauuuucucucauuuuucaaggcuuuaaagucuaccucuaacauauuugcuauuauguacuaggcacauuuauuauauguuaaucuuugugaagaaacuuggguucagagggaucacacaacuacuuagggacccagagcuacuaauugaaggcauuacuugaagucacugcacuugauuauucccugacuccucacacucaaaaccuagaaauaauguaagcguuaggaaguaugaagcuuuguuucuguuauaguugaccccaacguuagguuauuuuguauaccuguauuucaucauuuagaaaaugagugauuuaggauuugggauauaaaucuaggauugcuuauaggauaggaucugucagccaguucuauacuuccaagaaccagggcuguuucuucucuacuuagauauauuaauagaauuauccuaccaugcaugugcugcuuuuauuugauuuggauuuaauaugggagauaaauuauucccuccucgaauaauguaaauuuuuuugucuuaauguguuugcauucuauuaagguuaauuuuuguccauugacuuaaugauuuuuaaacaacuguacaaaauugauuuguuuaaaaaaauuucuuucuuaagcuuuagguauaaccuagaaagacaugaguugguucauuucuuucucaauuauuuuucuaaaucuguaaccauuguuucuaucuuauacaauguguuuuaaaucauggcuggagaacuauuuugauguuaucauauuaccuuauggcgugauauauucauuaguaaagaaauguaaugaagacuuuaaaauagucugcauuuuaucuccaaguauauucuuauauucauuuauuugauuuuuuuaacacacauucuaaaauggggucugauuucuaccuuggauaugcucuguauaaagguggcuuuucuaaccuauauauaaaaugauguuuauuuuguuuuaaauuaaaaaacuaagacuuuauuggacaauuauaucaauuuaaaaggcuaauuuuguuuuauauucuaaggguaauuuuaucagcagaaaguguaaaaaauaaguuuuuuuucaauugucauuuauccaauuuggauuauauauaacuacuauuucaggagauuuauuaaaaauauuuuauguacaauauuucaauuuauuuuuuucuucuuguugcaggagcuagaguuaaugccaaagacagcaaaugguugacaccuuuacacagagcaguugcaucuuguagugagguaugaaauuucucuuaguaaauauguuuuauaugaaaacauuaaauaggcguaccccugaauccauauucaaauucuauguuuucaaaagaaggaaaagcuacugagauaccuugacuggucauuuuacuuuagaauuuguacaaaccaaguuaauuguuucauuucuucuuuuguuuauaaggccucuugcagucugaaguagcagagaauagaaaacccuaucucugucccuucuacaagagaaaucauuuuucuguccuauauauucuuccucagggcuuuucucuaccuauuuacaauagucucuuacaaagguuucacugauugugaucaagaaagaaucucaucaguguauaauaauuaauugaaauguuacuuagcuaaauacugaaauuagcuucaaaaccauuacuugauugcacauuuuacugguuauaaauauauaacuuuaaaauguuugagagggauuacaaggaagaauaguuccuucuuguguacagccuuguauauuguuugcuuguugagauaacugacauuuuuagaaaauguucauuauuugcacaguauuuuuauauuucucauaucuuucaguccugaggacaucuuuguaggauagacgucuugaggaaacuauauaguuaaugauucaugaaaaacuacucagcuguuaaaugauagagaugagacaaaaaccugaaucaucuuuuuuuuuuuucuguuauuuuacuuuauaauguguauucggugcuuuucuaaaaugcauuguguccaaaguacccauuuuaccuacuuuacaguaguuguaacuuguugcaaagcuuaaaaaauaauuuaaaauacaaaaguaugugauaguauaaguuuauguucaucuaguauuucuuuaguuauucaaauugugagguuaagaaaggaacuccuaaguguagcuacugcuucuucuguccaucaugggacuauguaguuugggagaaggaaagggaacucuaacuagugccucaugagaaacuauggagcuucugucucuuuguccuuuguauuccucauugugaacuacaucuugaacccagagcaauagcugggcaagugaagagucauaaaggugaaaugugacugagaaggauuacaaacccuguaauuaacagaggcaaucuauuagcuguagccuccuaguuaggagaaggauggggacagugggugcaguugaacacacaaccuaacucugaacuggguccuugaugugcuauagcuuaugaacuuauggaacuuagauuuggagacacuggcuucaauuauuacgugcaacuuuucagcugugcgauguuggacaagucuaggaauuauaaaaacuaagacauacuagccaaaauacuuugaauucugaaauuccauuguaauguuauuaauuuugugguuagcucuccauaaagauguuuauuuaaauaaaaacaguuaagauaaacauuacuguuauuggaacauauuaauguuagccauaccuacgcauuuuguuuuaagauucuugggauuauggcuauuaaaauaauggauuuuuaccagauuaagucauaagaagguacaauuuauauauuugcagaaguuguaaaacagaccaaaaauuacuaaagaaaaauuaacauuaaaggaagacagcaaauucugccagagacuuaauuccuaauuuuuaaaaacuaugugcucagccugaauuuaagggcaaguuguagguuagaaagcaaauaauccuaguaaguuucuuaauucuacucuucagucuaaaaauuacaaggcagaugacuaaacagaaacacaaccaagaacccucagaguccgcuucacuccccugcuaccuccacuggagcaggugcuaguauccacagcugaaggaccugaagacagaucacaucacaggacucuuuacagacauuccccaguaccaucccggagccuaguagcuccacuggguuacuagacccagaagagcaaaaacaaucacuacaguuuggcucucaggaauacccauuccuaggggaagugggagaacaccacaucaagggaacacccagugggacaaaauaauuuaaacaguaguccuugaaucccagaucuucccucugacauagccuacccaaaugagaaagaaccagaaaaacaauucugguaauaugacaaaacaagguuauuuaacacccccaaaauauaccagcucaccagcaauggaugcaaaccaagaugaagucuaugaauugccaggaaaagaagucagaagauugauuauuaagcuaauuaaggagacaccagagaaaagugaaguccaacuuaaauuaaaaacauaggccgggcgcgguggcucacgccuguaaucccagcacuuugggaggccgaggcggguggaucaugaggucaggagaucgagaccauccuggcuaacaaggugaaaccccgucucuacuaaaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaacaaaaacauaauauagaauaugaaaggaaaauucuuuagugaaauagguaaaaacagucacaacuucuagaaaucaaggucacacuuagagacaugcaaaaugcacuggaaagucucagcaauacaaucaaacaaacagaagaacuuuagcgcuugaagacaaggcuuuugaauuaacccaauccaucaaagacaaagaaaaaaaauuuuuuuuuaaaugaacgaagucuccaagaaguuugggacuauguuaauuuuccaaagcugagaauaguugguguuccugaggaagaagagaacucuaaaaguuuggaaacuauauuugagagaauaauugagggaaacuuucccagccuugcaagagaucuggacauccaaauacaagaagcucaaagaacaccuggcaaauucaucacagaaagauuaucaccuagguacauagucaucaaguuaucuaaagucaagaugcaggaaagaaucuucagagcugugaggcaaaagcaucagguaaccuauaaaggaacaccuaucagauuaacagcagauuucucagcgaagcccuacaaagcuagaagggauugggguucuauuuuuagccuccuuaaacaaaacgauuaucugccaaaaauuuuguacccagugaaacuaagcuucaugaaugaaggaggguauacagucuuuuccagacaaaaauucugagagaauucaccacuaccaagccagcgcuacaagaacugcuaaaaggagcucuaaaccuugaaagaaauucuugaaauacuccaaaauagaaccuccuuaaaccguaaaucuuacaagaccuauguaacaauaauaugauuuuuaaaaaaagguauucaggcaacaaauagcaugaggaauagaauaguaccucacaucucaauacuaacauugaauguaaauggccuaaaugcucuacuuaaaggauacagaauggaagaauggauaagaauucaccaaccaaguuucugcugucuucaguagacucaccuaagaguaaggacucacagaaacuuaaguaaagggguagaaaaagauacuccaugcaaauggacaccaaaugugagcagggaucacuauuuuuauaucagacaaaacagaccuuaaagcaacagcaguuaggaaaaaacaaagagggacauuauauaaugauaaaaggacuaguccaacaggaaaaugucacaauucuaaauauguaugcuccuaacacuggagcucccaaauuuauaaaacagugacuacuagaccuaagaaaugagagagcaacacaauaauagugggggacuuuaauacuccauuaacagcacuagacagaucaucaaaacagaaagucaacaaagaaacaauggaccuaaacuaugcccuacaacaaauggacuugacagauauuuacagaacagucuaccaaacaacugcagaauaugcauucuauucaucagcacaugaaauguucuccaaaauagaccauaugauaggccacacaacaagucucaguaaauuuaagaaaaccuaaauuauaucaaguacucucucagaccacaguggaauaaaauuggaaaugaacuccaaaaggaagccacaaaaccaugcaaauauggaaauuaaauaaccugcuccugagugaucguugggucaacaaggaagucaagauagaaauugaaaaauucuuugaacugaacaauaauaguggcacaaccuaucaaaaccucugggauacagcaaaaguagugcuaaguggaaaguucauagcauuaaaugccuauaucaaaaagucugaaagagcacaaauagacaaucuaaggccauaccucacagaacuggagaaacaagaaccacccaaacccaaacccagcagaagaaaagaaauaaugaagaucagagcagaacuaaaugaaauugaaaccaaaaaaaaaaaaaggaaagauaaaugaaacaaaaagcugcugcuuugaaaagguaaauaacacugauagaccauuagcaagauuaaccaagaagagacaagauccaaauaagcucaauuagaaaugaaaugggagauauuacaaaugauacuacagaaauacaaaagauuauccaaggcuaaugugaacaccuuuacgcacauaaacuagaaaaccuagaggagauggauaaacuccuggaaauauccaacccuccuagauuaaacuaggaagguauagaaucucugaacagaccauuaacaagcagcaagauugaaaugauaauuuuaaaaauugccagcaaauaaaaaguccaggacuggauagauucacagcugaauucuaucaaacauuugaggaagaauugguaccaguccuauugauacuuuuccaaaagaggcaauccuuccuaaaucauucuaugaagccagugucacccuaauaccaaaaccagggaaggacguaacaaaaccacagaccaauaucccugaugagcauagaugcauaaguccucaacaaaauacuggcaaaccaaauccaacagcauaucaaaaagauaauccaccaugaucagguggguuucauaccaggggugcauggaugguguuauuaacauaccuaagucaguaaaugugauacaccacauaaacagaauuaaaaacaaauaucacaugaucaucccaauagaugcagaaaaagcauuugacaaaauccagcauccuuuuaugauuaaaacugucagcaacaucagcauagaagggacauaucuuaagguaauagaagcugucuaugacaaacucgcauccagcauuuuacugaauggggaaaaguuuaaagcauucccccugagaaccagaacaagacagggaugccuacuuucaccacuucuauucaaaauaguacuggaaguccuagccagagacaucagacaagagaaugaaauaaagggcauccaaaucaguaaagaggaagucaaacugucacuguuugcugaugauaugaucgcauaccuagaaaacccuaaagacucauuccaaaaccuccuagaacugguaaaugaauuuagcaaaguuucaggauacaaaauuaauguacacaaaucaguaguucugcuauacacuaauggcgaccaaguugagcaucaaaucaagaacucauucccuuucacaauggcugcagaaaaacaguaaaauagcuaggaguauaccuaaccaaggaggugaaagaccccuacaaggaaaacuacaaaacagggcugaaaaaagucauagacaacacaaauagaaacauaucccaugcucauggauggguagaaucaauggugcaaaaaugaccaugcugccaaaagcaaucuacaaauucagugcauuucucaucaaaauaccaccaucauucuucacagaauuagaaaaaaaaaauucugaaauucauauggaaccaaaaaggagccugcauagccaaagcaagacuaagcaaaaagaccaaaucuggaggcaucacauuaccugacuucaaacuaugcuauaaggccauagucaccaaaacagcaugguacugguauaaaaauagauauauagagcaauggaacagaaauagaacccagaaauaaggccaaauacuuacagccaacugaucuuugacaaagcaaacaaaaacaguggggaaaggacacccuguucaacaaaugaggcugggauaauuggcaagccacauuagaagaaggaaacuguaucaucaucucucaccuuauacaaaaaucaacucaagguggaucaaagacuuaaaucuaagaccugaaaccauagagauucuagaagauaacaucagaaaaaacccuucuagacauugguuuaggcaaagacgucaugaccaagaauccaaaagcaaaaaauagaugggacuuaauuaaacugaaaagcuucugcacagcaaaagaaaacaaucagcagcauuaacaacucacagaguaggagaaaaucuuugcaaucuauacaccuaacaaaggaguaauauccagaaucuacaaggaacucaaacaaaucagcaagaaaaaaacaaucccaucaaaaagugggcuaaggacaugaauagacaauugucaaaagaagauguacagagggccaacaaacauggaaaaauaacaucacuaauuaucagggaaauguaaaucaaaaccacaaagcgauaccacuuuacuccugcaagaauggccauagucaaaaaaaugaaaaaauaauagauguugguguggaugcaaugaaaagggaacacuuuuacacugucggugggaauguaaacuaguacaaccauuauggaaaacaguguggaaauuccuuaaagaacuaaaucuaccauuugauccagcaaucccaccacuuagauaucaauccagagaaaaagaggucauuauaagaaaaagauacugguacacacauguuuauagcagcacaauuugcaauuguaaaaauauggaaccagcccaaauacgcaucagucaaugacuggauaaagaaaauacuguauuggccaggcgcgguggcucacgccuggaaucccagcaguuugggaggcugaggugggcagaucaccugaggucaggaguucaagaccagccuggccaacauggugaaaccccaucucuaugaaaaguacaaaaaaaaaaaaaaagccagguuugguggugcccgccuguaguuucagcuacucuggaggcugaggaggaucgcuugaaccugggaggcagacguggcagugagccaagaucgcgccauugcgcuccagccugggugacaaaagugaaacucuaucuaaaaaaaaaagaaaaagauaacuaaaaauuacaaggcuauguaguauugauacucuuuugcaggauuaugagaaacagcuauaaaauguggccauuccaaaaagauauaacuucuguaaacacugaguaucauuuuucuuuugaaaagaaggucuccuaaguaguaaaacugcuagaaaaccuagucauuagugucaagaguaucacuuacaccaucguuacuuauuuucauuaaguccugagagcaaaaguagcuauacuuauuacauuuaacagaaaauauagcuauggccacagaaagauggguuuuucaccuguagguggcuuuugguuuauauuuuugagauaccaugggagaauuaaauccugugcaagcugauuggagugacuguuuucuaaauucuccuaaggacagaauagcuagcacagugauagaugcauagaagagaacuuaacuuagcacauaccguacuaccuuagugcuuaauuaccucacugaaacuagguuaagaaagacugcuucagguuaaauauuccuagacuccccaacucuccuucagugacauaguuuccacaccaccuccuacuagcuggcuaucucaaucugucucuacuacuaugauuuaugacugucauucuuuaagaguagcauauaguucagcucuguguaaguacugcauauuuuucugaauaaauggauauccgaguauuaggaguuggguuuuguuuuuggugugcguguguguguguguguguguguguguguguguguguguguguguguguuaaaaagccacacugcacugcuggagagcauacgacuuauauuuuaaccuaaucaggaauuacauuuuaggucugucaagauaacugaguuuaaauuccauuaucacaugagauauuguguggucucuccaagcuuuguguuuauuugcaaauauguuuuguuuuuuuuuguuuguuuguuuguuuguuuuuuauugaucauucuuggguguuucucacagagggggauuuggcagggucauaggacaauaguggagggagggucagcagauaaacaagugaacaaaggucucugguuuuccuaggcagaguguuugugucccuggguacuugagauuagggaguggugaugacucuuaacgagcaugcugccuucaagcaucuguuuaacaaagcacaucuugcaccacccuuaauccauuuaacccugaguggacacagcacauguuucagagagcacaggguuggggguagggucaccgaucaacaggaucacaaggcagaagaauuuuucuuaguacagaacaaaaugaaaagucucccaugucuaccucuuucuacacagacauggcaaccauccgauuucucaauccuuuccccgccuuuccccccuuucuauuccacaaaaccaccauugucaucauggcccguucucaaugagcuguuggguacaccucccagacggggugguggcugggcagaggggcuccucacuucccaguaggggcggccgggcagaggcgccccucaccucccggaccggguggcuggccgggcggggggcugacccccucaccucccucccggacggggcggcuggccgggcaggaagcucacacccccaccucccucccggacgggcaggcuggcaugggcagggggcugauccccccaccucccucccggacggggcggcuggccuggcagggggcugacccccaccucccucccggaugggguggcugcugggcagagaugcuccucacuucccagacgggguggcugccgggcggaggggcuccucacuucucauauggggcgguugccaggcggagggucuccucacuucucagacggggcggcugggcagagacgcuccucaccucccagacggggucgcggccagguagaggcgcuucucacaucccagacggggcggcggggcagaggcgcuccccacaucucagacgaugggcggccgagcagagaagcuccucacuuccuagaugggauggcagccgggaagaggcgcuccucacuuccuagaugggauggcggccgggcagagacgcuccucacuuuccagacuggguagccaggcagaggggcuccucacgucccagacgaugggcggccaggcagagacgcuccucacuucccagacgggguggcggccgggcagaggcuguaaucuuggcacuuugggaggccaaggcagguggcugggagguggagguuguagcgagccgagaucacgccacugcacuccagccugggcaccauugagcacugagugaaccagacuccgucugcaaucccggcaccucgggaggccgaggcuggcggaucacucgcaguuaggagcuggagaccagcccggccaacacagcgaaaccccgucuccaccaaaaaaauacgaaaaccagucaggcgugguggcgcgcgccugcaaucgcaggcacucggcaggcugaggcaggagaaucaggcagggaggcugcagugagcugagauggcagcaguaccugcaaauauguuaagcccuuguuuuuccugugcuuuccuucaaaucaaugguaagaauugcuaaaaaaaaaaaaaaaaaaaaaaaaaaaaaaaaaaaaaaaaggauagaaccaaaggggaaaacugguacuguggagccucuucuauacugaccccaugguaauaauaaauacucucugaguacaguuguuuaaccuucagucauuaucccauauuucauaaucucauuugaauuaaugucauggaauguuuacuuagcuuuuaaaaaaaaucaagacacaccagcagcauuucuuacacauucccucuaauaacugaaaauuuagaauuuagauuacuauaauaauguuuuuuguuaauaaaaucaucugugccguuaguuauccccacauuauuuuccgugugcuuaugaugauacacugauaauaugauguagaauuauccuaggguaugacaggcucuuugauuuguaguucuagaaauucaccucuucuuuuuuaaugucuccaaccuuuagggauuuucuucaguuuucucugaauuuucaaagaucacugcuauugugaucugacacguuuuuuguuuuuuguuuuuuuuuuuugagauggagucucgcucugucgcccaagcuggagugcaauggcgcgaucucggcucacugcaagcuccgccucccagguucaugccauucuccugccucagccucccagguagcugggacuacaggcgcccgcccccccaccuggcuaauuuuuguauauuuaguagagacgggguuucacccuguuagccaggauggucuugaucuccugaccucgugauccaccugccucggccucccaaagugcugggauuacagaagugagccaccgcaccaggccugugaucugacauguauuacucugaguaggaaauaauggauucaggguucacaccuugaucugucuugauacucuagugucuuaauugcuauguuuauugucuuauuuaggugcccacuuaccuacgcuuaccuacugugaaccagauuuguucuugcuuuuuagugaaacaaaaaaguagaauugauuuuccuguuuuuacuaauggaacauaaguauuucccaaacuuuccagaagcuuuaauguuuguguuaugaauuccaaaaugggaguggauaaggcaaggcugacaucucuaguauucuguguuugcccaguuuauccaauuacaaauuguucauuuuauuuuaaauuauuuauuauauccacuaacauaccuacuaacauuucccaauauaguguuaguuuuagaucccccaagucacaauguacuguucucagaggugaggaucaggaaucuugauaguguuuauaccuuguuuuccauaauuuuugugaguauucauauauguauucuuuccauauuccuuuuuaaauugaaauauaacuuacaauuaaaaugcaugaauuuuuuaguguacacccuuaaguuuugccaaauguauacaccuguguaaccuuuaucccagucaagauauagaagauuucuguuaccccagcaaguucccucauguccguuuucagucuucccuguccccagaggcaaccacuguucugauuucucuuagcauaauuuccguauucuagaacuuuauaaaaauggaaucauacaauauguauucuugugucacgacuucuuuuguucaacguuuuugagauuuauccauguuucaugcauuauugguucauuuucauugcugaguaauaguacagauauacuguuuguuuauccauuuuucuguugauggacauuugcauuucugguuuuuggugguuaggaauaaaacugcuaugagcauucuuggauggauuuuuuaaaucuuuuggauaaaucacuguuguggaauuguggagugauaggccuccauauaucuuugauuagcuggcugacuuccuuagcaauucgauagaugacugggcauuucuucagucuuuugccaucccuguuaaguacuggugcuauuucccauguuucaaacuguucugacuacuuuuuauuucagaggccuaaaaugguaugggugauucauggcuaauagcauuuuguucagucuuccuugaugcucuguauauuuauagcuauuuucacuuucuaacacuuuucauguacauuaguuuauugugcuuuauagcauacuugaaaagagugguaggcagauguuauuucccccacccccaucuccuuuacagauaagaacauuuaggguuaguuuuauaggacuugaauaguaugccuuguaaauaauagaauugacaugagaacccagaucucuuucgguuuuggucguuuucauuuucauauguaguuuggcauucauuuacuguugcgggaagucagggaccccaaguggagggacuggcugaagccauggcagaagaacauaaacugugaagauuucauggacauuuauuaguuccccaaauuaauacuuuuaugauuucuuaugccugucuuuacugcagucucugaacauaaauggugaagauuucauggacacaucacuuccccagucauuauucuugugauuuccuaugccugucuuuacuuuaaucucuuaaucccaucaucuuuguaagcugaggauguacaucaccucaggacccugugaugauugaguuaacugcacaaauuguuugaacgauaugaaauccgggcaccuuaaaaaaagaacaggauaacagcgauguuuagggaacaagggagauaaccauuaggucaggcugccugagagccgggcggaacagagccauauuuaucuucuuucaaaagcaaauaggagaaauaucgcugaauucuuuuucucagcaaggaacaucccugagaaagagaaugcauuccuagggggaggucucuaaaauggcugcucugggaacgucugucuuuuuacacuugcagauaagggaugaaauaagccccagucucccauagcgcucccaggccuauuaggaagaggaaauucccaccucauaaauuuuggucagaccaguugucugcucacaaacucugucuccugaucagcacgggaguuuugaccugcucuguuuccgaccugggccgguucaccccuccuuaggcaaccugguggucccccgcucccgggaggucaccauauugaugccgaacuuagugcggacacccgaucggcauagcgcacuacagcccagaacuccugggcucaagcgauccucccaccucagccucccgaguagcugggacuacaggcacgcgccacugugcccggccccugucuccugauaagauguuaucaaugacaaugugugcccaaaacuucauuagcaauguuaauuucaccugguccugugaucucgcccugccuccauuugccuuguaauauuuuauuaccuugugaagcaugugaucucugugacucauacccuauucguacacucccuccccuuuugaaaaucacuaauaaaaacuugcugguuuugcggcuugggcaugugaugucuccccagacacccagcuuuaaaauuucucucuuuuguacucuuucccuuuauuucucagaccagccgacacuuagggaaaauagaaaaggacucacuuugaauuauugggggcagguuccccgauaauuuaccaaaaauuaggauuaucacugaaagaaaaauuuuguugaguuuaguucugauuauauugcuuaauguugauggcauacugaauuccuuggaauccugccaugaguccaauuuauagagguaguguugugauguuuuccaugcgcuucugggagauaaaucccuuggacaguagacucuuaaauugccuuaacuuucucucuaagcagcacugcaaaaagaaccuugucuauguugugucuuuuuuuuuuuuuuaaugaaauugauccuagugauuuuucauuuugucaaauauagcauguauaauacauugagaaauaguauguuuuuaauuuuuauauaugcaguguaaaaaaucuauugcuuaaaauuguucaaagagccagguguggcucuaugacuggcucauguuuguaaccccaacacuucaggaggccaaggaaggaggaucacuugaggccaggagugugagaccagccugggcaacauagcaagaccuugucucuacaaaauaacuaaaaaauuagccaggggugguggcaugcaccuguaguccuagcuacucaggaagcaaaggugggaggaucacuuaagccaaggaauuugaaguuacggugagcuaugauugcucucuugcacauuuugauaggaauguuuaugcauuuaaugguaggguagggaaagggaauguuugaucuugaugcaucuuauauggcucugaguacucucaguaucgcuuuacauucaaaauauuuucuuuccuuggguaaauuccuacuuguuuauagugaguucuaugagagcuuuuuuauuuucuucauauguagauacauauuuauacacacacacgcacacuauauauagaaauaauuucucaaacucuuaacucauuugucuuuuauaacuuuucauauguuuuaggaagcaguucagguacuuuugaagcauucugcagauguuaaugcucgagacaaaaauuggcaaaccccuuuacauauagcugcugcuaauaaagcuguaaagugugcugaagcuuugguaccucuucugaguaauguaaacguaucugaucgagcagggaggacugcauuacaucaugcagcuuucaguggacauggugagguagguggcauucaauuagaccauuauuuuucucuccuccuguccaccccccacuuauuaaagaacuugcauuuuugcauaguaaaggcauacagaacuauuuaucuuucucauuuuugucuaauuuugccuccuuuuauaacuuucucaaauuuagaaauguauguaguagauacuacuugugcacaguuaaccuguggugaccaaggaaaacaauaccaacucuuaacacaacaggaaaaguauguucuauuauuguggcaggaaaaauaugugaagacagagauauguuauuguucuuccagaaguaaauagcaaaggaaggcagaauuuagaaaacaugcuuuuuaguaguuuauuaacauuuagucaagauaauacuuuagugacagaaccaucaaaacaauuuaagaaaauugcuauuuaguuaucuuacacaacaaacguugucugugcuaggugucauagcaaagauugggguuuauguguacaccaaagauuuagagaagguaacagaagaaccuuugaagccaacuugucuagucuuucauuuuuguugcagggguaggaacuuauagguaaaguaacauucccaagauucuguggcugggagcuaguggcugccaugucuuuuucaaaguaguucccacuuaucuacagaggauauguuccuggacccccuauggaugccugaaacauuggauaguaccaaacccuauagauacuguguuuuuuuccuauacauaccgaugauaaaauuuaauuuauaauuaaggcacaguaagagauaauaauauggaacaauuuuaauacaaguuacaugaauguagucuaucucucaaaauaucccacuguaacuguaguguagucaccuguuuucagacuaugguugacagcagguaauugaaugcagaaaguggaacugcagauaaggggagacuacuguacuucucugauuuuccaguguaaagaauccuugccucuacugcaguuaagguuacagauguaucccuauuugagaucugcgguagccuuccaguggagaaauuauuguaaauaugguuaguugcaauuauuauuuuugguacauugugagguaagcagacuaugcagugacugaccuucagguauaauuauacuguaggcacuauguuuguguuugaauuaaguuuaagacauuucuagaaugagaaugcacuuuuaacauuuuggacuaugaauaggaacaaaaccucuuauuaaauauuucagucuuagacuuuccagauuuguacuuaguucauaaaauaccaaggcacaaaguggcauccuaaaaagguacugaugccugacuucaguagcacccacaguuaaccuuuuuuucauguuuuguccuguuauguuaaaugaccuucaguauuuagucuagcuccuucuguucagcaacugcagaaauuuagugccagagaaguugagauaaguaacugucagaaauguacauucauagacaauugugcuucacaauuuugaugacacuguguuuacuucuauuccagauggucaaacuacucuugucuagaggugccaauauuaaugcuuuugacaagaaagauaggcgugcuauccauugggcagcauauauggguauguacuuuuuaaauuuaguuuuugauauuauauauuuagaaaaguuguacauuucaaguucuugcuguuuguauagcauuugucuuuaaggguacugaaaagcuacacaguaucugaguuugaugcccagguagaacaacccugguaaugggggagguuuggaguacacuggguccaguucaucuaaaagcuguuugaaauuaauuccauuuacccuuaaaaaaagagaugucccagacacaggccuggaauacauaauuuaggauugauguuuacuaaagcccauucuuauacccauuuuuguuuguaugagaauauaagguaaaaguaacaaagaugcauuaagaagccuauuauuuugggccaaccaguggguuaaauguguauuaccauguuugauuucuauaauaguaaauuuauagaaagaaacuggggcuuggaauacagacuuuuuugcuguaacauaauauauauguucuugaaaaaucuuacagucugcaaaauuguacucuaaaacuaauagagcucaugggaauaauaggccugggguagaccacccaaaaccuaugcaaccgugugaccacagcacuaacagaaacauuaauugguucuugcagagccggggagacaaaucagccuauuacaggauauuuuuaaaugcacaaaaacagcagaauagaaaugcucgcuucuggaugcuaaaacugccgaggaagguagaucucuaaguauagagaaaguacaccuugccauaaauccuuaaaguccuauaaggcugggguugugccucugguaagaagccaugguuguagacauucauuuuucaagguucuuaaaacagcugaaagaacucacuuugcagccauagagcucagggcuuuuuuucuuccugccagagguuauaauccugugcuucugcuauuuuaacuccugggugggaaaaagcacauaugaacugacauguuuucuguguaauauuuguaucauucccugauuuaccagucacauuaccugauuacaaagacaucuaguuaaccacuuuucuaagagccauagccuauccucauuacuuucuguucuugguuuugucuuuucuugacucucauuuaaaaauaaaagauuaacagaagauucaauggaggaauauuaacucaagaacuauauaguccaucccucauauauguggaggauugguuccaggaccaccugcuuauacccaaauccuugcauauggaagucccauagucagccauggggaaccccuauguacaaaaaguuggcucuccguguaugagcguuucacauccccugaauacuauauuuuugaaccacaugugguagaaaaaaauccauauauaaguggacccacacaguucaaacuuuuguuauuccagggucaacuguauaauauguaaaauagauacaaaccaguuauaauacacucuuucuagauaaauaagucuauacauaacaugucuguauauuucaaaccaguuauagauacccacaaggcccagggaaauccuaugccuauaaugaaaacaaccaaaagcaguagaauccuuuuucuuuuuuaagaaaaguuuugaaaaucuuuauucaauuccaguauaguuacucugaaaaaaaaauucuacauagguauacuaaauugaagauugugauguacaaaacccacucucauuaccaauaaaacauuuaaaauaaggugucaacagugauuuuuuacaaaagcaacagcauucaugcaucagagaccuuaccuuaucucucuccuuuguaucagaaaauuacuacauuuugagaaaugauaucaauugaauagaugaaauauuaucaccgaagaauagucacauaaagcaugauuaauuuuaagaaaugauauuugaagaaaauauuaaagugccuucaauauuucuaacaguauguccacagaaaagaaaaacauaguuagaauuaagcagauaaaugaugaaguugggaauagacgguaauaugucauuuuucguucccuuuucaauaagccucagaaggcaaucccagaucagcucaccacaaccaaagugagcaugcugauuuucccacucuugcuuauccccauaugacaguauuucuccuucgaaaagguucuucaguaguucguaagaguauuucagagguccauggugagcaagaaccugaaguaaucuguaguuagcaaacauguaauacuggagauguguuuuuguuuuuguuuuuguuugagacagagucuugcucugucacccaggcuggagugcagcggcacgaucucagcucacucaaguccaccucccagguucaagcgauucucaugccucagccuccugaguagcugggauuacaggcacccgccaccacaccuggcuaacuuuuuuguauuuuuaguagagacacgguuucaccauguuguccaggcuggucucaaacuccugacuucaggugaucggucugccucugccucccaaagugcugggauuacaggugugagccacuaugccuggucuggagaugucuuaaagcagccaucuccuuuuucuucuaauacuuuccacauaucuguuacaaggauuugggcuuguuuguaaaaauaaacuuucuuccccucaaaugggaaaaaacgugccuccagacguuuucaacagaauuuuccuggcuucaucgagaauccaaugccucucuucugucaaaggcaugagaggaaacauuuguuucagaaugaaguauaugccaaacuugaucuaggguuguuaacuguggcauaguaugagguaauaguaguugaugucccuuugcugaaggaucuguugacugccgcgacugcagggaccaauaccauauguucucccccauaccucacaacacacuuuugcguguccugcucucaccaaauagcagauaagguuaagugugucugucaugaacacugaguugaccauggucuuaccagcuccccugggauugggauuuagcucaugaagcaucuuccaccucuccacauacagcucuggccccuucaccuuggccagcagcgguucugccacccuguguauguaugccucugcuuucagugaacacaucccaacuguguucugcagugaauuuaauuuaauucccugggugauagaagacugugcauucucccccuccccuuucagacuguggagugaugcuuuugaccuccauuggggcaaacucuuuccuuucuaagcgggcaacauccagagucccucuguacuucagaguuucuacccacuauggggucaucacccuaaacaggguccugcucucuccgggaguggcacugagaacugagugcagcuaaaguacagccuuucucccaucacacuugcaugacuaggaaacuguagagaccauguagccaugcacugggcagaagcccgagaauccauauugcauugcagcucugaccuucagugugaguguaaaggaagauuaaaaaaaaaauguaacauccuuuucaaauguccccuccccacacacccccccccccuuuuuuuuuuuuuuuuuuuuuuuuuugagacaguuucacccuuguuguccaggcuggagugcaauggcgugaucucggcucacugcaaccuccgccucccagguucaagcgauucuucugccuccgccucccgaguagcugggacuacaggcgccugccaccacgcccagcuaauuuuuguauauuuaguagagaugagguuucaccauguugaccaggcuggucuugaacuucugcaaaugucccuauuuuuaaagcugaaagcuugguguauggugguuuacaccaaagauaugugccgcuaguuauguacugggccauuuucuuguguuaauugaagguaauagccagaagcaaguuccguauugcaucuuaaggucccuuucucacagccuguaguuuuucaucuuggucuuucugaauauucugguguggcuuacucuucaagacaggaacaaccagguuaugugauguaaaacuguacaucuuacguuaagaggcuuacaugguaagcagagugcaucaguguuuuuaccuacuaagaauuaagcuugacuaaacaacuguuuucauacaacugaaggccagggggauuuugcagguugccuguaguugagcucccagaauaguugaauguguguauuucaagggggccagaauggcucuguuguuucucacccgcuaagugucacuuuuuaggcaucucaguugagguugaaaaagauauucuguguuuccuggaccucaccacaaguuuuagucuauuuugugcuacuaaaauuaaaugucauagacuggguaauuuauaaagaacagaaauuuuauuuccuuacaguucuguaggcugggaaguccaggaucaaggcacuagcaucuagugagggcccucuugaagcaccacauuguggggagucaaacucaucuuuuuuaaggagcucgaucccaagauagcauugauauguucgugaggacagagcccuuauugccuaaucaccucuuaaaguucccaccucuuaacacuguugccuuggggauuacacuuccaacauaugaacuucggaggacacauuuaaaccauaguaccauauagcacugcccauuuaauuuaugagcauaacuaggcagagauuuauaauuauccuuuuucugucucuuccuucccugaagcacagaauaagaugaauaucgacauauagcuucuaaaacuguucagccauucuagguaugcaggauuaaagaguuaaauaugugaaaguaagaagcuauugacuggucaccucucuuacagacaaaccuaaaguacaagcauugucaccucuagguuauauucagagaauucaucaauguuaguguaagagacauuggggauuauguguagucuuguaauuuauuuaucccaguuuuccuuauuagcccuggcuuuccauuuccugguugaggcuccguuaauuuccuuuuaggcccuaccucuuauacuuaugcuauugaauuauuugucauuguucccuagcgccccaccucaucuccaaaugaauugaucauuuucuucuucccaccuugugcuugcuccugccaucaaccuuugucaaggucccuuuacacauucaucuuuccuguugcuuucaguacuuuuagaaauauucagccaaguuuagcuucaaauuacuuuauugugaugacuuugacacagaagguacugaauaaauauuuuuuaccaugggcugggcauggucacuuaugccuguaaucccaacaacuugggaggcugaggugggaagauccuugagcccaggaguugaagaccagccugggcaacauagugagacccucucucuacaaaaaaaagaaaauuaauauuagcugggugugguggcacacaccucacuugagcccaggaggucgaggcugcagugagcugugaucgcaccacugcauuccagccaaggugacagagccaaaaccgucucaaaaauuuuuuaauugauuuuuaaaaauuaccuuaacaccucauugcauuauuucuuuucuagaaacauaauaguagauauuucuuuuucauauuaaaauggggggaaagaggcuguaaauaucuacuuuaauugauaauuuauauauaaacaacugaaucugccugguucuuuaugcgucuugcaguaucuuggcuuaauuuuuuugagggaggggugccucuguuugaaagccucauuuauuaacuuuuuauagacucauuaucuaugaagggauuuuuaaaaugacaucacgagcaauuucuucaauguaacuaauauauuuuggaugcuuguuuucuaugcugcucuuggccuuguggaacauaucaagaaguagaacagccuucugaaaguauauauuuggggauucaugcacaaaaaguaauuaaagaguuaguaauuaaugauuccguuuacgaaacaucacaaggcuuauagggcuucuagggaagagaguugauuggguuggucaggaaagguuggaucugacauguuucuucaaggacuaguauaauagcaaugauugggaggagacauccaagcagaacguuccacauaaagaagguguuacaugaacaaagacacagaggugggaaggauugugggagaaggagaaaacacuguauaaucuaaucugacaaaaagugacaaguuaugaaaggagaauagugguccucucaccuuccagauacauggcccccuuccuggccuuucuauguaguugaguggggccuaggacuaguuuuggcuaauggaugaaagcaacaucagucugggcuggagcauuuaauuacugaugggaaacucugcagucuguuucccuuucuggcacagugaccagccacauucaagaugaugucaguuacaugagccuggguccuugaguaacugagcagagcccucuugccaaccuguuaugguugagagagaaauaaaaacauugauuguuuaagccacugagauuugggaguugauuguuaaccaucacacaguauaaccaacccuuuccucaugguuacaauggugaguaaacuaaguugguuaagaucugguggaaauuauaaggaaaaagaguuuuuuggcugcauguucuaaagagcuaacauucugaagaaacaagcccaagaaacccccagauugaaacgauuccaguaaggcagagaucagagagauugugaguuuggugcuaaacuaccacaacagaguaaauacagcaauaggcaaaucacaaagauuuuuugguuucccagugcauauaaaagauauguuuagucucccugcaguggcucacaccuguaauccuaacaucuugggagcccaacgugugaggacugcuucaggccaggaguucaagaucagccugggcaacagagcaagacccugucucuacaaaaaaauuuaaagauuagcccagugugguggcaugcaucuguaguccuagcuacucagaaggcugaggugggaggaucaccugaaucuaggaguuugagguuacagugagauugaucacaccacugcauuucagccagggugacagagcaagaccccguuucuaaaaauaauuaauuaauuacaaaauauguuuaugcuauacuauagucuauuaagugugcaauagcaauacaucuaaaacaauauacaugucuuuguuuuuucuuuuuuauuaauuuucaguguucuuaauuaaaaaauauguuauugcuaaaaaaaaaugcuaacuaucguaugagccuuuagcaagucacaaucucugauaauggagaguuuugccucaaugugaaugguugcugaagguuuggauggcuguggcaauuccuugaaaugagacaaagaugugcugcaucgauggacucuucccuucacaaaagauuucucuguagcaugugaagcuguuugauagcauuuuacccacaguagaauuuccuucaaaauuggagucauuucucuaaaagcuuuguugucauuucaacaacauucacagcaucuuugggaguagauuccaucucacaaaaccacugucuuuacucauccauaagaagcaaccccucaucuguucacauuuuaucaugagauuauagcaauucaggcacaucuucagacuccacuucuuauucuaguucucuugcuauuucuaccacaucuguaguuauuuccuucgcugaagucuugaaucccucagucauccaugaggguuggaaucaacuucuuccaaacuccuguuaauaauaauacuuugaccuccucccaugaaucagaaauguucuuucuuucuuucuuuuuuuuuuuuuuuuuuuuuuuuuugacagaguuucgcuuuguugcccaggcuggagugcaguggugugaucuuggcucacugcagccucugccuccuguguucaagugauucuccugccucagccucccaaguagcugggauuacaggcacccgccaccacaccuggcuaauuuuuguacuuuuaguagagacaggguuucaccauguuggccaggcuggucucgaacugcugaccucaggugauuggccucccaaagugcugggauuacaggcgugaggcaccgcaccuggccagguauguucuuaauggcaucuagaaugaugaauccuuuccagaagguuuucaauuuacuuugaggaaucacuauuuauggcagcuauauccacuucaaauguuauuucuuaaauaauaagacuuugaaaguugaaauuacucuugauucagggacaacagagugacuauuguguuagcaggcacgaaaacaacaguaaucuccuugucuguaagagcucuuggguggccaaguacauugugaauaagcaguaauauuuugaaaggaaucuucuuuuuucugagcaguaugucucaacagugggcuuaaaauauucaguaaaccguguuauaaacagauguguugucauccaggcuuuguuccauuuuagagcauaggcaaaguggauuuagcauaauucaugugggcuguagaauuuucagaaugguaaaugagcauugacuuaaagucauuagcugcguuagccucuaacaagagagucagccuguccuuugaaguuuugauggcaagcauagauuucucucuagcaacgaaaguccuugauggcaucuuccaauagaaggccguuucaucugcauugaaaaucugcuguuuaauguagccaccuucauuaauaaucuuauaucuuuuagauaacuuuuuacagcuucuauuaauacaucagcacuugcugcuucacauugcacuuuuguuacagggacaucuuuuuucguuaaaccucaugaaucaaccuuugcuggauuaaacuuuuccucuauagcuuccuaaccuuucucagccuucauagaauugaagaaaguugaggccuugcucucgauuaggcuuuggcauaagcgaauuuuguagcuguuuuggucgucuauccagaccacuaguacuuucucuguaucaucaguaaggccacuuaucuuucuuaucauuaguccauucacugguagcacauuuaauuuucuuggagaauuuuucuuuugcauucacuacuugguaacuuugucacaggaggccuagcuuucagccugucucacguuucaacaugccuuucucacuaagcuuagucauuucuagcuuuugauuuaaagugagagguaugcaacugucuuucacuugaacacuuaggggcugcuguaggguuauuauuuggccuaauuuuaauacuguugugucugagugaagaggaaggucugaagaggagauagaugggggaauggaguaguuggaauauacaacauuuauuaaguuaaccacuuuuuuggagacagaguuucacucugucauccaggcuggagugcagugacaugauuuuggcucacugcaaccuccacuuccagggaucaagugauuuucgggccucagccucccgaguagcuggaacuacaggugugugccagcaugcccagcuaauuuuuguauuuuuaguggagacaggguuucacuauuuuggccaggcuggucucgacuucugaccucaggugaucugccugccucagccucacaaauuguugggauuacaggcaugagccaccgugccugaucaguucaccacuuuauaugagugcaguuugugaugccccaaaacaauuacaguaggaaugucaaagaucagugaucacagaucaccaaaacagauaaaauaacauugaaaaaguuugaaauauuggcaagaauaaccaaaacaugacacagacacaugaaaugaacacaugcugauggaaaaaaugaugccaauagacuugcuugacaccggguugccacaaacuuucaauuuuuaagaaacaagaugcaauauuugcaaagcacaauaaagcaaaguacauacaauaugguaugccagcauuagaaaugaaaagcuaacuuuagaauuuaugaagguauuaaacuaaccuuagaccaaaaacaagaucuaggcaaaaggaagaugauagauugcaggguuaucacugaauaacauaaucaaaggaauuauaguugucccuuguuauccuuaggguauuaguuucagacuccuuuggauaccaaaaucagaagauacucaaguuccuuauauaaaaugccauaguauguacguauaaccuguucuuuaauucaucucuagauuacuuauaauaccuaauacaauguaaauaguuguuguacugcauuuuuaauuuuuuuaacuguuuuuauguuuucaaauauuuucagucugcaguugguugaaucugcagauauggaacuaguguauacagagggccaacauucuuuuuaauuacuaauugucucugccaacacuuaccaaaauuauccugaauucuauuuuuuugucuuguuuuguuucgagauaaggccucgcuccauugcccacccuggagugcaguggcaugaucacagcucacugcagccuuaaccucccaggcucaaguaauucuucugucucagccucccaaguaacugagacuacaggugcaugccaccauacccagcuaauuuuuuuuuauuuuugguggagacagggucucacuguguugccuaggcuggucucaaauuccugggcucaagugauccucccacuucagccucccaaagugcugagauuauaggcaugagccauuaugcccaccccuaaagucuuaaaauuuuccuucuguccucucucaaguuaacaugauucauugaugacuugucaugcaucaucuauuuugcauuuuuuaaauuugcuuaaagauauuugggauuauauuuaauaguuuucauaugcucaucucuauuuuuuucuucaaaaacacauuuuuaggucacauugaaguagugaaauugcuugugucgcauggagcugaagugacaugcaaggauaaaaagucuuauacaccucuucaugcagcagccucuaguggaaugaucagcguagucaaguaccuucuagaucuuggaguugauguagguauauuaauugaacaguauaaaauuauggaacccuuuuauacuuacuauuacauuauugacaaguuauuucagguuuaagaaauuauuuuauacaauguuuucauguuuuaauuggauauuuauaguccuuuacauaauaucuagugcacugauuuaugaucaaggcauguaaauagucaaagcauguuaagagguaaaauacacuucaaagguguuuuauugccaguuuuucuucuauaucacguuccaggcccuguaguuccauuucauuuaugggaaucagcagaucagacacacuuguauuauuagauagcuggguuauuguuagucuucuuugccuagucucauacucucuuaaaaugacuguagcaguuugcauuacagaauauuggcaagagcuaggcaggaaaacaagagguuuuuugcccaccaaguguaaguauuccuuacuauauaauucuguuugguuaaaaggggaugcugcuuuauuuggacauauuugauuccugaauugagauaacuuagaauaccuguagcuuuucacaagccauccuuuaaacauaaguacuuuacucccuuguuuauuuauuuauuuuauuauuauuuuuuuaaacagggucucugucucccaggcuguaguauaguggcacaaucacagcucacugcaaccuugaacuccugggcucaagugauccugccaccuaagccuccugaauagcuagaacuacaggcuaauuuuuuuuauuuuguagagaugaggucuugcuguuacccaggcuggugucuaacucuugaccucaagugacccuccugccuuggucucccaaagugcuggaauuacaggcaugagccaccacacccagcccacucagcguauuuauucuuacuucagggagaguucugacaaagucacugauucuucaaaacacacauuuugaagaacucauugguucuuuaauaaaacaguaaauuagaagauguagcauaaggaucugcuagagggauacaguuuagaucagcuacaaaaaacuaagaaaaguaggugauagccugguuggacaaagaauacaugacagaacuguagggcuaaauaggcucuuaacugauggaccaugugaaacacuuugccugaagcaagcuaauaaauacugaaagugugaggaucacaagaagacguugcaaaaaucucaauuccuguaccucuguuucagcagagugaaauaauaucuuaaaagacccuugaucuagauaaaugaggcaacuuuguuucugauuacuguuugaaguccauucuggugcaauuuuuaaaacugacuuuauugacagucaguuacauuuguaaacucuggugacuauuuguucaucaaaauaaguggccagacuuagagccuuuuaguaacaucuggcccccaauugugugguguuuuuuuguuuuuuguuuuuuuuuuaguuucguagagaauuaccacaaacuggagggcuaauagaaauuuaacuucccagaguuuuagaguauggaaguucuaaaucaaggggucagcaagguugguuccuuauggaggcucugagggagaaucuguuccuugucuguguucuaccuucuugugaaaaaaucuagguuacuuugauuaaaauuaaguguuaacuuuuuuucuuccucugauuucuauuaccagugaucccagaaaagaaaauguuaauuaaagcugcauuauguuggggccaacuacaagauuaggguccagaguuuccacacaaggccacccuuuacuuaugaccaacuauaaguuuagagggcuuucaaaaccacuuucagguuugauaauucaccagaaagucucacaaaauucauuaaaagcuuuguacucaugguugugguuuauuacagggacaagauacaaacugagaucagccaaaggaagagacacauaggauagagugcaggaguauucuaaaggcaaaauuucccuuguccacucuucacggagucaggacacauuacuguucuucccuggcaucagugugugacaguaugaaugaaguauuuccaacaaggaaugcucaccugagcuucauuuucgguuuuuauuggggcuccauuauauggcuugauugguuguccaugugguugauuucagucuccaaauacaugauaccuggugacccaaagcucccacucuaaauagagacucuuuuaucaggaauaucuuagauuaccuaccucccugaagccaggggcaaaggacagaccucucuuugggagaggucagauucuuuacuacacacuaaucauauaaacuauucccuuauuuauuagaaauagaaaaacaaggcugggcacagggucucacgccuguaaucgcagcacuuugggaggccgaggccgguggaucauuugaggucaagaguucaggaccagccuggccaacauggugacaccccgucucuacuaaaauacaaauauuagccaguugguaguggugugugcauguaaucccaguuacucaggaggcugaggcaggagaaucacuugagccuaggaggcagagguuucggugagcugagaucgugccacucaacuccagucugggcgacagaaugagacccugucucaaaaaaaagaaaagcaaaacccuuaauuacaugaauuguuucucauuuuugagcauacucuuuuuacuugugauaaaauaccugcauaugacacuggaagauauuuagagcccaaguuuguggcaaaaaaugaauuaaauaaauagaacaugccguucauuuuuuuuuaaaucuugaucuguacuuuauuacuaagguuagccuuugucacugcaaaaugaaaaagaugaaaaugugcauguuacugaauauaccucagaaucuucaguuuguguucauuuuuuaugauuauaauuaauucuauaguaaauccuuuaccuagaacgccuuuaaaaauacauuaguuuacguuucccugaaauaccucuuuuguauuauucaguuuugucaugaaguagacauuguguaugugaauuauauucccugaauguauaaaaucaauguaauaccaaaaugcuugucaaggguuuauuauuuuaaaccaacuuuagaauuauaagccuuaucucuguacuuaucuugucuccguuucucacuuuaguaauuugauugcaaccacagguugcuaaaauagcucacaacauugauaauuagcaaaacuacuuuaacauucgcauuuuuuucccuucuaauagaugaaugaaccaaaugccuauggaaauacaccucuucauguagccugcuauaauggacaagauguuguagugaaugaacuuauagacuguggugcuauugugaaucaaaagaaugaaaaaggauuuacuccuuugcacuuugcugcugcaucaacacauggagcauuguguuuagagcuucuaguuggcaauggggccgaugucaauaugaagguaaggaacaaaaucagaaucuauaaguauuucauaugucacuguuaaaacaacaucaauggugaauaccauugagcaauaaaaaggaauauugauaaacucaagaacauggauaaaucuuuaaaauauuaugcugagugaaagccuuacucaagaguauguacauucuuuccauuuauguaagguucuagaaccaauaaaauuccauuuauaugggguuccagaaucuauaauugaaaaaaaucacaacaauuauugccauugugaggagggaucaacugggaaaggggcaugaagggacguuaugugaugaugguaauguuuuguauuuuggcagggguuuauguuauauacauuugucaaaacugauaaggugguucauuuguaugcuuucauagcauauaaauuuucucuuagaaggaaaauacuaaacagauguuuaacccuaguuaauguuguguuuagaggugacauguaugaugucuguaucuaauuuuaaaaagcaucaaauaacuggguggauggaaggauagaugaaucuacaauaaaagacauagaguaaaauacuagugguacaauuuagaugguauguauauggauguucacucuacagaucuuuucaaauuuuacaguguuagggaaaaaaaacugucaguguguugcacauaaggaauaguugcuuuuugguuuuuuuuuguuagaaucacuuucaagaguaagcauuuggauuuuagaauuaugugaaaauucugggcuggcauaguggcuccuaccuguaaucccaccacuuugggaggccaggguaggaggaucacuugagccuaggaauucaggacuagccuggacagcauaaccuggcuccacaaaaaaauagaaaaugagcuuggcaugguggcucaugcuuguagucccagcuacuugggagguugaagugggaggauuuuugagccuuggaggucaaggcugcagugagcugagaucaugcuacugcccuccagccugggugacagagugagacccugucucaaaaaauaaauaaaggaaugaaugaaaauuuuggccggauacagucuggcucacgcuuguaaucccagugcuuuaggaggccaaggcgagaagaucacuugaggccaggaguucaagaccagccugggcaacauagcaagaccucuaucucuaccaaaaaaaaaauuaaaaauuauccuguaguccuagguacucaggaggcugaggcuggaggaucacuugagcccagaaguucaaaguuacagugaacuaugaucgcaccacuguacucuagccugggcgacaggugagaccuugccucaaaugaaugaauauucuguacccaaauaaauaugcuuucacuauauaauuuuauaagagagcacaugcaauccagauuuugagcauugcuauuuuauaauauauaaucauuuuauuagauuuuuuagaauucguuaguuguuucuguauuaauuuuaucaauucauccuuugagcacuugccaaacuguaucuggugguaugaagaaaaccagacacaaaauugagccauuuaggauuaguaaaaauguuuaagcuuaaaaugugauuuucagagcauuuugauuacaugagauuuucucaccuaacuucagugaagccuuuaaugaugccacgggucaauucugacagcuguaacagcaacaaauccaucuguaauuaggccauugcuuuaaauugcccucucaacuacaggacaaaauguauacauacuacacccaaggaagaaaaaacaugagaugucacaaagugcccuaauaugauuagagcuaaaccaucuuuuuaaaaguuuuuaggucucggucaaaucaccuaguaacauuuuuuauaguuuaaguaauuacuagaaaguuuauuuauuacagguuugaacugcuuauuuuaauuugaagaauuccugcacuuuggauaaucagggcccagaaaaauaucuagacaguugugaggagaaaaguuaguuuuuuccucaaaggcgcaguaauguuucuuuaaugaaaguuaggcuauuucaaaaauaaaagauuuggaauuaaucuugacauuuucaaaagcaaacgucacaaccaaguuuucucagucucugugagaccuguuuacgauagugaauguggauaaaaucaucuuuguguguuaguauuauggaaauuacggaacuuuaccugugucgucagcuacuaugcauuuuuugguucacaugaugcugucuuuaaaagguagagauugggcuuccuguuuuaugcacugccauuuuggcaugaauauuuaauauaauuugaugauaaugaaucacuugauucuguuagugucuacuuaggugacuauaguaccugugauuguuuuuaagucuguauuuucuuuugaaauguagaauugagaaucaguccucuaagaggcccacuuagaguaaaaugcucaaaccagugguccuauuugaaguuaccuccuuaauaauuuagaaaacucaguggugaauuucauauaugacaagugaauuuuuuagcaaaggcauuaagauauauuuaaguagauuugacagcaacagccugugauguugguuucaaaacagauuucacgaaagucaucuuaacuucaccuaaggguguaugacaucucauuuauaugcaauuguccaauuauuuuauugucaaauuuuguugaaacacauuucccauguugauuucucagaucccuuccagcucuuacacacaauauguugauagcugugaguuuucauccagcaagaauauauauucauuccugacaacuguauuuuuuauaauuuguaaaaucgguguuauuaaguuauugauugacuauggggacacuuuacacuugcccuuuauuauaaaaauuugauuuacuaacccucauauucuuaccauauuaucucuuuuuuccugcuuaaucuuuuccuccuacuacauucuccauuuuguuguuucugaccuugaucaaguuauagaugacuagaaauuggaaugugaauuuaaguuuguaauaacucaguuucuaagguuauaaauucauuuuccugcaaagugguagagguaaaaugaaucagguuuauaaagcaguauaggucuguuuuuuagaacugcuugacaugagccuuacugcacugauugcuucauuuauaugcacacguuuucccacccacauuguucuuuaagaauagauuuuggucagcuaagcaaaauacaccaaaugcuuguuuugaaauuuaaaccuaaaaaaauacugugaaguguuuggcuuguaguuacuguuuuugguugccugugagaucaacuguuaggauuuuuguagcucuaaauuuugguuuuuguuauuuuucuuuuuuuuuuucuuaauacuccuaguuuucugcuaaagugauuugaggugauuaagaaaaagaaaacuccacauuguuucuccaguucagaaagaaauaacugugccuucuccccgcuaacgugucuuauggcaaacuuuuuaguuaguaaucugaaucucuuuuuccuuuguauacuuagaauagguuuuauuaucaguauguagaaaguaaaaauguugauccagugccacauauaggcuuauaauaaaggauucuaaccaggcccaguugugugugccuuuagucccagcuaccuucggaaggcugaggugagggaaucacuugagccagguguucaagucuagucugagcaauauagcaagaccuugucucuaaaacaaaauaaauaaauaaauaaauaaaggacucaucacuuauuagcuaugagaccuaguaaaaucacuuaacccuggggccuacauuuccucaucuauaaaacaagauuaaugguaucaaucugauaggguugugagaauuaaauaauauauaugaaguagauuugguuuuggcuuuuuaggaggaagggagauggggagacagaaucucacucuguugaccagcccagagugcaguggcaccaucauagcucacuucagccucaaacuccugaguucaagcaguccuuccgcuuuggccuccccaagcgcuggaauuauagauaugagccaccgugccugaccauaugaaguguuuuaaaacugugcgugaaacgugcuauguauacauaaauguuaacuauaguuauaucuuccaaauuucaucauuuuguuaaucaaauuauuauuacaaguuuuuauuuguuuuguuuugaguuguggggguuguuuaguuaguuuuccucuuguuuuucuuauccuucuuaucaauggaaucuauguuuuuccuuaugucuguaaaaauuggcuauagcuggccaggcaugguggcucacaccuguaaacccagcacuuugggaagccaaggcuggagaaucacaugagcccaagaguucaaaaccagccugggcaacuuagagaccaucucuacaaaaaauaaauuagccagguguaauguuacaugccaguagucccagcuacuccagaggcuguuguuagaagaucacuugaacccuagaguucaagguugcagugaacuaugauuacaccacugcauuccagccuggcugacagaccaagacccccaucucuuuaagggaaaaaaaaaaaaaaaaaaaguccaggugcgguggcucaugccuguaauccuagcacuuugggaggccgaggcggguggauuacuugaggucuugaguucaagacaagccuggccaacauggugaaaccccaucucuacuaaaauacaaaaauuagcugggcaugguggugcaugccuguaaucccagcuacucaggaggcugaggcaggagaaucacuugaacccgggaggcggagguugcugagagcugagaucacaccacuguacuccagccugggcaacaaagcaagucucaaaaaaaaaaaagagagaaaaaaaaggccauagcuaaaauauuaacauuaaaaauuaggauauauccuaucuggaacauuuuggaaagacagaauccuuuugccaagaugcuuuuuugcccuuuuuuuuucugguugaacaaauaacaacugguacaugaaaaauaaugguaaaacaaauauauccugagaagcacugauguguuaucugaguguuuuacaaaggauuauuguauuuacucuguacaacagaccaguaagauguagaugguauuauccucauuuucaguugaggaacugaaggcacaaagaaguuaggcaacuuguccaaaaaucuugcuugugguaaguaggagaucugagauucaugcuuagguuauucugacuccagagccugugcaugcaugcauccucucuccuccuccccuuccuuucucguacugccuccaaaagauuagaacuucuguaaaauuacuugucaauuggauggcuuguuuacuugaaaaauucauauuauggaaucaaacacuuaaguagauacuuaugauguucuaauuauuauuauaaagacaugaggauuuuuaaagaauaucugcguuguacaguguuagcauaaacuuagaauacuugugacauuuccauuuuaguaccuaugcagaaggcaugcugaauguugcugugagauuaggaagcugcuaaguaguuuauuuccuuugcguugguaacauguauguuuugguuaacugaaagauuuuagaaaagaaaagacacuaccuaaucagaagaaaagauaaccuaaaucagggauuguuuuucuucauauuuggaacuccuuuagaacuucuacaugaaauauauaugugugcagccagucugauuuauuauuuuaagugauuugagaaaauauuuaguacacguaacuauaaacaaauauauguaguuuuaauuauuuguauuuauuuuuuuaaauguauccacacaaaauucacgaaguuaauucuaauacucacuuuuacuuggucaaggaaggauucagaauuucuuagaauggaaauguuggagcagugugaaauuuugaaucugaaacuugggagacacauccuuacugucccacucccaauuuuuauaaauuguaagcauggaauuuuuguauauuuguguuuuaugauacacgugcuaaaaaaauuaauuccuaauuuuaaacagcuguuuuaccuccauaggccucaguuaaacuuaauucauguaaaauaguuauaaaaauaaagaugcaagaggguauucaaaguaaaacuaagguuuacacauuauggauauaguagagugaguaauuuuuuucuuccccccccagaguaaagaugggaaaaccccacuacacaugacugcucuccacgguagauucucccgaucacaaaccauuauccagagugguaaaaaguauuucuguuuuuuuuuugggguuuuuuuuuuuuuuucuuaaauguaguaaaaacauccaccaaaugaaugguauugaggaauugucaucgcauuuuguguauuuuuaauacaugauuucagagcucaugaaaauaaaauauuaaagaguauaaaauaccacguagcuguaucuuucauacuuuuguuuuuuauguuuuguuucccugaacuguguuauuucuucagcaguuaguauuagcuuuuuucaauauugcuaaauagaaaauuacuuucuaccauaauuuguauuauauauuaauguguguacucuguauauacauuauacauguaucauuuuccccuguugaguaucugcaacuauuuucaggauuuuaauuucuugaguuuguauucuuuuguguuuaaauuaauaucaggcaagcuaaacuuuuaaaucaaaagaacuuuuagguguauuacuuuaaaucaguguuuuccaaggcauauuccaagaaauuuauccucaagauaauaggugcuaugguuuugcaggggaaaaguugaaauagguucaugauccaauauuuuuugaagcauugcaugcagucuugaugacagaguaugcacauuaaagcucugaagucuugcucuaaagaaacguguuuaauuuuguuuuaauacaguaguuuccaaacuuauuggaccccagaacccucuugucaauuuaaaaaucuacuaaaaucuuaugcuuaauucacacaauugcuuuaaguauaaaagcuauaaauccauugccuggcccaauaaaugagcuaugaaugaaaucuaguuaaaauugcuguaucuauuaguuuguaugugaacagcauuuuuuauuacuuuucauguaguacguuugaccugaucuuuauaugguccagugucugacaguaaguccuauauugcaggagcuguaaucgacugugaggauaagaauggaaauaccccuuugcacauagcagcacgguauggccaugagcugcugaucaacacucuuauuacaaguggugcugacacugcaaaguaaguacuuaccgagguguugauaacugauacaggcaagcacaaagggaagugaacugcaguuuucuagacauuucacguggaaauguggauuuuauccucaauguuguauuaauugcuugaacuuucuuuuguauugacaaagugguagguuaaaauguuuaaauacaauuuuauuugguaagccaguguauuuuuauguauguuaccccaguucuuucucacuuugaguaauaacgcaguuuugaucagagcuguuaauuuuugugaucucuuuauuuuuaaccuagaaguacuuaaaagucccagaaagcuguaugugccagaugcuuuuuuuuaauccaaauacuaucuguagauaauacuuuucaggcugugcugugccaagcucagggauuccuuggaauccuacgaaggaguucuuacccccacccccauuuuggucagaacaguuugcuuguauuuauuuuauaaauuaaaguucccauuguaauauuuuguuugaaagaugaguccuccugcuaaugcucugcaagaaacaccauacuuaaauuuauguuuaucauucuuuguaucacauuuacauguguucauuaacaaguuuuaaaucuuuuuuacuuucuguaaugguaugguacugcaccuaucuguuuuguaacuuuuuccaaaaaaauuacaugagcuuauuaauuuagccaucuagauagaaauuuaggccuucuuucacaucuguacaaguugcucuaguucauuuauuuuauagaauuauuguauaaagauuucacaauauauucauucuccuuauuugcaaauacaaguugcuuacaguuuuucacuauuacagaauuacuacaauaaauauucuugaacauguugcauuauggaaauguuucaaugguggggugacaggguagugaauuuugcucccuaagcaaauguccagauacauuuuugguugucacaauuuggggaggaagguguuaauguuaaugacauccauuggguagagcccagggaugcugcugaacagccuguaagccuguaugcacagaauggcuucucacguuuccccagcaaaguccauaaugacaguagugcugaaggugagaaaccugacuuuuggagaaaaauagcuggcuaauaaguuaugcccaccaucaaacuuuaaccaaauuacucuccgaaguguuagacauuuuggcucuuaguuaucuuucacuuaaguggucucuuuguaauguauuuaacugauuguauuuuucuuguguuaaaaugaagauacuguccuguucuauuaacuuuaggcguggcauacauggaauguucccccuccauuuggcagccuuaagcggcuuuucagauugcugcagaaaacuucuuucuucagguaaguguaaccuuugcagccuuuuguaugucuccucaaaccccucaaaauuuuuagauggucucuauccugcuuuuuaaaaauuaaugcagauggguccaguauggauaauuuaauaaccccuuuuagaacguguuggguucaggucuggcgugguggcucaugccuguaaucccagcacuuugggaggccgagacaggcagaucacuugaggucaggaguucaagaccagcauggccaacauggugaaagcccaucucuacuaaaaaaaaaauacaaaaaaaaauuagcugggcgugguggugagcaccuguaaucccagcuacuugggaggcugaggcaggagaaucgcuugaacccaggaggcagagguugcaguaagccgagauugugccacugcacacuagccuaggagacagagcgagacucugucucaaaaaaaaaaaauacagaaaaccucuucauccccuguuaaagaaagaccauuagcaguuaaucuccauuucuuucuucccucagcccuaggcaaccacuaaucuacuuuucaucucuauaaaauuugccuguucugaacaguuccuauaaauggacucacccaacaugugaucuucugugacuggcuuguuucacuuaauauaauguucucaaggguuauucauggaacaguaucaguacuuuauuucuuuuuauugcuaaauaauacuccauuguauccuauugccuuuuaaacaggcacucuagcacuuaagaacccauaguuuuguuugggauuggaggggaggaugugauucuugauguuucaugacacaauucuuuaguguaaaauaauaugucuguuauaaauaagauguauucauucuuguaggauuugauauagauaccccagaugauuuuggcaggacuugucuacaugcagcugcagcuggaggguauguuaauaguauuuuuauuucuuuaagaaaagauagcuggucauggcagguuuucucuuaucuuuguucuuuuuuauuaauucugggcugccagaaaauagaaaacaaaacaggaguuguuugggaaaaaaaaguccaggguggcagaauacuuuuuuucaucuuauuccagccaaguuguagguuaugagugagagagagagagagaauaaaccuacaaaaggaaauacugccuucuguaaaagaacauaauuucuggauaaguaaaacuauuucuuuaaaaaguauguucucaaaugagaacaucaaaauacugggaauauucugaauaauacaaguacucuuuaaguagauuuguuaauuuuuuuuucccccaggaaaaaaauguucauuuugugcugugucuuaccucuacuaggaagaggaaaguuugagauuggaagauuuuggacuaaguuuuaaauaguaccaccagggaaaaauuaggcaguugguucauacgagcaacaaacuucagcuaaaacucauggccucuggaacaugcuucuuaucuaaugcuucugauaauuuagaucugugauaagccauuuaauucaugauuucucaaaaggacauuuugcaaaaacguuauucucaaugauaauuucuuaaaaauuuucagugauuucagaggacgaguacguugaaccaagaguacaccagcacagucuaaguuguagagauggauugugagcaugugacugguuuucuuguucuuccaaggucgccagagaaccuuccaguuaaaaccuaacuuccacguaacuugccuacagagagagggacaacagacuugagugucugaucacuugacaguuacaguuuucauuguaacauaguaauuugauguugagguuuauacaguuaaauuacagaaauacuuaaguuauauccuuuccuccaguauuaacuaaagauacauauauguaaacagucauaguauaggagaagauaagggaaagcugacaggacucaugcaguggcucacagcuguaagcuuaacuacucaggaggcugagacuuggaggaucgcuuauauccaggaguuggaggcugccguuagcuaugguugcaucacuggacucuagccuaaacuauagagugaggcucuguuucaagaaaaaaaaaaaaaccuauaagcaaguuguuuccuaaagccuccucagaaucucuuuugcaaaugugaucuuccuuuuaaacaaugacaacaugaaucguguguuauuuccucagugugccaauauguaaguauauaacuuucuaaauucuagauaagaugaauuucaauguuuuauucuucauagaauguaaaucaucauuuuugucacauuuaucuucauauaaaaacaugcuuucaugcuucuuuaaaccuaccaauuucauuauaaaaucacugucaauuaaguuuucuaacuguauuuucucucaauaggaauuuggagugccuaaaccuucugcugaauacuggugcagacuuuaauaaaaaggacaaauuugggagguaggguaugauacaguuucuuuauggagccuauuuuuacuuaauaacuugauugaccuucuaacuggcuucugaaaauuaacugaacaauuuagcaucuuguacacugaucaugauucauugagagucccagcugaagucaguaacuuccaaauauucguucucacccacaguuuucuucuugagucccuaccacagcccuagccuaccaaccacagccuuggccuuauaaaugccucuauacuugcuaucacuucccccccuccaaaaauuaugacuauggaaauguaaagccccauagaaccuauguuuuuucaagaaacucacaauaccuagaaaauaaugauacaguucuccuuucuccaagucauuucuuggugagggauucuacugcccauaucuuguuccagagcaguaguaagagggaggaaauagguuauaaauauauauguguaauuuuucuuucuccucuucuauauaaaucucucacacacauauauccacacaucccacuaaguauuucacaacaggaaggcagcugugaaaugacagucuuuguagucauucagcaggccucauuguugaguauuugugguagcaguauuuaaaacuacuguuaaguuacuuagaguaggaauugacacagagugcauuagaaccauacaggaaagaauugaaggcaguuggaauugguuugaaagagaugacaguauaagcaaaacugugugugucaacaguuugagaauuauacauagcaaaguguaugagaaggaaggguguaugucagaagaaaaugugugaauauaugucaaugcaugugauagaaccagugcagaagagaaguaaaaagaauuaugcaugguaggaaaucagaaaugaauagaagaaaauaaaaacuauuugacaccauaauuacuuugaagaacagauugcucucauaagccuacuuaauggaaagaacuaaugacccacaaaaauaaaaaaaucacuuuggcuuuggaaugcaauauuuuuauagcuaauuugcuuuuauaauuauacuuuaauccaguuuauauuaauuuuuaguacuucaggcauucuauacuacaaauaacagagagggcuucugaaaaaugcuuugaguugagaggguugaaaguaauucaggguuaauuacauuuuuuuuaauguuucuucuauuuuuuucucuuaccuuuuguucuucuucugagacaugaauagaaauugcuaccucuguacuguggaacauuuuuauuaauguaggggaaacuuuccuaaaaugaaaguuuucacauuucugagcagaauaugaagguuauuugaaagucacucaaaggacugggacugggauugcugcuacugccuggaggcgaugaaauaacugcauuuucaucuuauuucauauacuuaaagguucucugccaccuugcuuucuucuucuagcuuuauguccaguccuccgcaagacuuaguauaugguagucuaagucucacuguaaauaaaguauuuguaacugggaggaguaagagucaacuaugcuuuuguuuacuaguuaugucucuggcuuuuaucuuucuuguauuaacuuggacccaaaagaucuccacugcacuacgcugcugccaacugcaauuaccagugccuguuugcucuugugggaucaggagcaagugugaaugaccuugaugaaagaggcugcacaccccugcacuaugcagcuacaucagacacagauggcaaguaaguaccauaggagugagaguggaggaucaauauuucuauaaacuggcaucuuccauauggauguuuuuguugcaaauuuguguuuccucuuuguauuuuuuguugauuaucuuugcccuaagucuauuuugggaaauagauugguuucauaguuauugauaaaucauaguuauuacuaccuauucucagcaccagccuuacuagcugaucugguggaagaaagauaaaggucccuucuuguccuaucugccaaaagagcaucuuaauaucacuuuuauguuuuuuuccaccugacuucuuagaggcuacagccgugacuauaucauggggaaagggagagaggagauauaugaguaaugucaucagaagauuggguagagguuggaauacaaguauccuucagagguagacaguucagauuugcaaggaacccuuguaaauugguguccaaaagguaguaauugaacuggcagaaucugguacguaguagguacuacauguugcuuaaauagguaaauuagauggcagaauaaguaaauguuggccaagaaugaauaagugaaaacaagaauaaaugaugcauaaacuguuucauaaguauaauaauauucaccuaaaguuaucagaccuaucuguaauaccuugauacauauuuuuuuuuucuucuugcacgaaaauaaacucauugaaaacagaaaagauuuucagugucugguaauucccuauggugugggucagugaaaaguaaaaauaccauuggcagaaauaaguaaugguuucuggggaaagauguuauaaaauguacuucauauaacagaauuauuuauucgguuuuuaacauuuacuuuucgcccucaaaauaagaagcauaauuugauucuucacaaauguuaauuuaguauaaacucuuuaauuucaaaaccauuuuuauaaguaacuuuuuuuauguuggauuguggcuaaaauucuagggguuuuucaaacaaccccaucaaaaauugggugaaggauaugaacagacacuucucuaaagaagacauuuaugcagccaacagacacaugaaaaaaugcucaucaucacuggucaucagagaaaugcaaauaaaaaccacagugagauaccaucucacaccaguuagaauggcaaucauuaaaaagucaggaaacaacaggugcuggagaggauguggagaaauaggaacacuuuuauacuguuggugggacuauaaacuaguucaaccauuguggaagacaguguggcgauucaucaaggaucuagaacuagaaauaccauuugacccagccaucccauuacuggguauauacccaaaggauuauaaaucaugcugcuauaaagacacaugcacacguauguuuauugugacacuauucacaauagcaaagacuuggaaccaccccaaauguccaucaaugauagacuggauuaagaaaauguggcacauauacaucauggaauacuaugcagccauaaaaaaggaggaguuuauguccuuuguaggaacauggaugaagcuggaaacaucauucugagcaaacuaucgcaaggacaaaaaaccaaacaccacauguucucacucauaggugagaauugaacaauaagaacacuuggacacaggaaggggaacaucacacaccggggccugucaugggguggggaggagggggagggauagcauuaggagguauaccuaauguaagugacgaguuaaugggugcagcacaccaacguggcacauguauacauaugugccaaaccugcauauugugcacagguacucuagaacaaaguauaacaauaaaaaaaagauuucagaaucacacacacacaaaaaaaaaauucuagggguuuuuuguuuguuuuuguggguuuuuuuguuguuuguuguuuuguuucguuuugagauggaaucuugcuuugucgcccaggguggagugcagugcugcagucucaguuuacugcagcuuccaccucccagguucacaagcaauucuccugccucagccuccugaguagcugggacuacaggugccugccaccaugccuggcuaauuuuuguaauuuuaguagagacagauucaccauguuggccaggcuggucucaaacuccugaccuaagugauccgcccaccuuggccuuccaaaaugcugggauuacaggagugagccacugcgcccagccuaaaauucuaaucuuaaaggcaauaguaauguguauuuuauuugcaagaauauaaaguauguuuuuagauagcaacuauuuaaauaaaaucugugauaaagacuauaaaucagaaaauauuuugguaaacuuggauaaguagcuuaucccuaauuuaucaguuuuauaauuucaugguuugauuuauugauuugcuuaaaauaaguuauaccuuuuaucaccaucuguaguccuuuaccacuacuuucacagacugguuauuggguacagcucagcaugauccagauuccgcugagagauugucucccacauuccuucccccaaaaaaagauuacacuuugauccuucugcccuuagacaaaugcacuaaaccugaauucacacacacacaaaaccacaaaggaauaacauauaauucaacccauaguguuggagaugugugguuucauuguaagccaaucuacuuuuccuauagaaggguacuaguacuaaaaucacuaguuuucuuacugaauauaaacgguuuugagcaaguaagcaaugacuuuuauuauuuaaauauuuaauccucaguauguacacuaaacagccugauacacuggaaaguaucaggcuugauacuugggauccgaaagacccaauuuaaaucuuggaguuuccauacuguacccauuugaguaugagcaaguaauugcuaagccaaaauauucuuuauuuguaaaaggaaaaugaaaccucccuguuagaguugcugggaaaacuaaaugagacugugcauaaucuagcacuguuaaugggagccucuguuuccuaucuuuauuaaguaucaaaaucccagagagccugucgagugccaucauuuauugauucaaugauuuguuccaugggagccuaguggaaaauauaagccacaguaauuauucugggauaccagaggcauccuuuuaauaagugauuguuuuggaggcuuaaacaguggcauuaaaggauuuauuuuucuuaaauuguaaaaaauauuuuucuuaaauuggguacaauuguacccaauuguaauuguauucccaggaauagcuugaguaauaagagaaucaggcauaacucauucugccaaagcaacaaugaaauauuuucuaaaagaagagacaaauuccucagagcuuccaauugcuauuauucaguaauguacauuugcuuauuuguuuuuuaaaugguuuuuuaaaaauccccugucagcaucacaguuucuaccuuuaaagcuccccaggaaaaguuguuguuuauacuuuggaauuuuuaacaaucugacauugguuuucuuuuguuuaggaccaacauacaguaauuauaauucugcucugccuuuuaucccuucauccucacuuugaguaaauaauuggaaaaauacaugaaaucuuccgugacucauucuagucauucugcuuguuacccccauuguccugaugccugcguucuugguagacagucauucagcaaguccucugaagugucuuuauuuuacaucauguaagaauccagcaaacaaauauauggcugcuaucgcaaugaacauauuaaauaugugaaauauuaauaaauaaaauuauauuugccuguugcagauacguauagggcugucuuugagcaggaugucaugugggucuucuccacaccuguguguaguauguauauaagagaaggaaagguugagggcuguuuuuccugauuauaaggaagaaauuccccucauaccagcucuccugagauaaccaucaucaacaguuauauugcucuguguguauguagauuauuuuaugucccucacagccuuaaucaaaguugaaguccugguauauguuauaaagccuuuucuauaucauauauaauuuuuuaaaauauuuuauggguuguuaucucuagcccgcacuucauaacucuuccguccucuauccauuacccaguuccaaaaccucuuccacauuuuagauauuuguuucagcaacaucguaacuucgcaauaacaauucucuuagucuguuuggacugguauaacaaaauaccaaaaacuggguggcuuauaaacaacagaaaucuuauuucucacaguucuggaagcugagaagucaagaauaucaaggcaccagcacauucagugucuggagaaggcccacuuccucuuugagggcauauucuugccauauccucacaugguagaaggaaugagagcucuuuugggccuuauuuauaaggacacuaaucccauucaugagggagggcucugcccucuugaccuaaucaccuccuaaaggccccaccuccuaauaacaucaccuugagguuggaauuucaccaugugaauggguguggggggacauaaacauuuagaccauagcaacacucuuaggaaaugaggcuacauuuugacuucuaauggcaguuuauuuuugucuguuuucaaacuucauaaaaaugggaucaugcaguuuuuuguguguagagguuuuguaaugcugagauuuauuccuauguaucugauauuuuuuauuaccaaaaucaaucuuuaaauuuuuuuguguugguauauagaagauauauuugccuuuuguaugugacuuacauucaacaaccuuguuaagcuuauuguguauauauauguaagagcaguguuugauacuagcucugccuuuuacuauggggaccuucagcaaauuacuuaaccucucugugccuauuuaaucugugaaauggagauacuagucuaaacucugucacgacuauguagaguuuaaaaugguuuaguauauaugaauuguuuggaacaguucugacguauccuaaucuuccuauaaagguuaguuguauuuuuuaaaacugauuuuuugggccagggguggggugguggggggugguaagaacuguuguaugccaugaugggaagaguagagaggagggagggccucuuggagugacaauaccacaucuguuuuccuggcugagugguccuuacccagggcucugacuagccaugggacacaugaauuugaaucagucugaacuugccucagaacucaaaauaguaggguucaugagugguaggguaagaguaggagaaauuuaaauaguuugaaaugcauuccgauuuuaaccuaugugguuaguggggaugaagauauuuaauuugccuaacauugaggaaaaaauuguaacagaauauuguuuagccuuaaauauuuuuucagauuuuguguauauauuuuauuucagaggacagauuauggagaaucuucauuucuuaauugucugcguuucauaaaaugaacauguguuaaugugcaaacagaaaaaagaguauacagacucuucugcccccacccucuaaugaaguucacauuuucaagaucaagcaauuuugugauucaguauuuuauaagcacccuaguuaacuuaccacuguaagugauuaaccacuguucuaaagcuuugugggaacauagaacaauggauaaagggaagaccugaggugguuuaguccuugguuugccauauucuagccaaaaggauuugggaaaagucauuuaacuuagugucaguaaucuuuuucauuuguuagagauaaugcuuacccagaguaauuaugaaaauuuauauuguuuagcaaaaucugaaagguaugccaauaaaagaaauuguauuagaauaaguuuuguauucaggucucaguaaggaagacccauuucuguuuuaucacuaacaucuagagaacuugauuaaagauuuuuuuuaaaugcccuuggguaaaauguuuuugccuguaaaguauuccuacagacuugcaggcuuuuucugcaucccagugagcacuguccucugaauucggcaccaaggaaggcuguguacagaguuuacacacugacugaaacacuuccuuuuccugacauguccucagaauuaguuugugaaacaaaacaaaacaccagucuuauuaccuuagagccagacguggguuuuauuuuauuucuuuaucauagugauacccacuuuaaccuuuuuauuuuauuuauuuauuuauuuauuuuuugagacggaguuuugaucuucuugcccaggcuggagugcaauggugcaaucucagcuuacugcaaccuccgccuccuggguucaagugauucuccugccucagccucccgaggagcugggauuacaggugugugccaccaugccuggcuaauuuuguauuuuuaguagagaugggguuucuccauguuggucaggcaggucuugaacucccgaccucagguguuccgcccaccuccgcuucccaaagugcugggauuacaggcaugagccacugcacccagcuuaaucuucuuuuuuuuauuaugcuugacuccaaagaauuuuagcuguacauaaauaucaaaauugcacuuaaauggaugaauauuugcugccauugaagauauuacaaugaagauucugaaaguaauuucuaagaggucuaaagcauuuuaagaaauucagcauuuaaagaaauaaguguuagcauugaaauaauggcucucauauauuugugagcuagaguuacugaaagaucaguuacauugcuuuagaauuucuuuucauuuguuuuuauaugacuucagugugauuuuggaaacuuuuaauaaggaguauuugauuaaagaauuuuuuccccagguaguuuaauauuuggguagacguauuugaauaccaaacaaauuaucacugaauaauuauagacuuggaauuugaacaugaauacacuuuagauuauuuagcuggcuucuccauguaucaaaugaauaaacagaggcuauuucacuuuuauggcccaagaucacugguaccagugcuauuucagugcuuuuuuuuucugcuguaauaaaauguauuaaaauuguaaauuauggccuauauacuguuguguuucuuuugcagucucacucugucgccaggcuggagugcaguggcgcgaucucugcucacugcaaccuccgccuccugaguucaagcaauucuccugccucagccucccgaguagcugggacuacaggcgcccgccaccacacccagcuaauuuuuguacucuugguagagacaagauuucaccauguuggccaggauggucuugaucucuuggccucaugaucugcccgccucagccucucaaagugcugggauuacaggcaugagccaccgcgcccggcccuauauaguguuuuuuaauuaauuuuuuuuuuuuugucauuauacuuuuaaguucuaggguacaugugcacaacgugcagguuuguuagauagguauacaugugccauguugguuugcugcacccaucaacucaucauuuacauuauuuacauuagguauuuauccuaaugcuaucccucccccaggcccccaccccggacaggccccgguguaugauguuccccucccuguguccacauguucucauugcucaacuuccacuuaagagugagaguuguguguguaauguuccccuccauguguucuccuuguucagcucccacguaugagugagaacaugcaguguuugguuuucugaucuugugauaguuugcugagaaugaugguuuccagcuucaucugugucccugcaaaggacaugaacucauccuuuuuuaugguggcauaguauuccaugguguauaugugccacauuuucuuaauccagucuaucauugauggacauuuggguugguuccaagucuuugcuauugcaaauagugccgcaguaaacauacgugugcaugugucuuuauagcagcaugauuuauaauccuuuggguauauacccaguaaugggauggcugggucaaaugguauuucuaguucuagauccuugaggaaucaccacacugucuuccacaaugguugaacuaauuuacacucccacugacaguguaaaagcaugccuauuucuccacauccucuccagcaucuguuguuuccugacuuuuuaaugauggccauucuaacuggcgugagauagugucucauugugguuuuuauuugcauuucucugaugaccagugaugaugagcauuuuuuuguaugucuauuggcugcauaaaugucaucuuuugagaagugucuguucauauccuuugcccacuuuuucaugggguuguuuuuuucuugugaauuuaaguucuuuguagauucuggauauuagcccuuugucagauggguagauugcaaaaauuuucucccauucuguagauugccuguucacucugaugauaguuucuuuugcugugcagaagcucuuuaguuuaauuagaucccauuugucuauuuuggcuucuguugcuauugcuuuugguguuuuagucaugaagucuuugcccaugccuaugcccugaaugguaugcccuagguuuucuaauaggguuuuuuaugguuuuaggucuaauauuuaaguauuuaauccaucuugaguuaauuuuuguauauaguguaaggaagggauccaguuucagcuuucuacauauggcuagccaguuuucccagcaccauuuauuaaauaagaaauccuuuccccauugcuaguuuuugucagguuugucaaaaaucagaugguuguagaugugugguguuauuucugaggccucuguucuguuccauuguucuauauaccucuuuugcuaccaguaccaugcuguuuugguuacuguagccuuguaguguaguuugaagucagguagcaugaugcuuccagcuuuguucuuuuggcuuaggauugucuuggcaaugcgggcucuuuuuugguuccauaugaacuuuaaaguaguuuuuuccaauucugugaagaaagucauugguagcuugauggggauggcauucaaucuauaaaguaccucggguaguauggccauuuucacaauauugauucuuccuguccaugagcauggaauguucuuccauuuguuuauguccucuuuuauuucauugagcagugguuuguaguucugccugaagagguccuucacauccccuguaaguuggauuccuagguauuuuacucucuuuguagcaguugugaaugggaguucacucaugauuuggcucucuguuugucuguuauugguguaugggaaucuuugugauuuucgcacauugauuuuguauccugagacuuugcugaaguugcuuaucagcuuaaggagauuuugagcugagacgaugggguuuucuaaauauacauucaugucaucugcaaacagagacaauuugacuuccucuuuuccuaauugaauacccuuuauuucuuucucuugccugauugcccuagccagaacuuccaacacuauguugaauaggaguggugagagagggcaucccugucuugugccaguuuucaaagggaaugcuuccaguuuuugcccauucaguaugauauuggcuguggguuugucauaacuagcccuuacuauuuugagauacauuccaucaauaccuaguuuauugagaguuuuuagcaugaagugcuguugaauuuugucgaaggccuuuucugcaucuauugagauaaucagacagaccgcuagcaagacuaaugaagaagaaaagagaagauucaaauagacacauaaagggaauaucaccaccgagcucaaagaaauacaaacuacaaucagagaauacuauaaacaccucuacgcaaauaaacuagaaaaucuagaagaaagggauaaauucuuggacauauacacccucccaagacuaaaccaggaagaaguugaaucucugaauagacaaauaacagguucugaaauugaggcaauaauuaauagccuaccaaacaaauaaaaguccaggaccagauggauucacagccgaauucuaccagagguacaaagaggagcugguaccauuccuucugaaacuauuccaaacaauagaaaaagagggaauccucccuaacucauuuuaugaggccagcaucauccugauaccaaagccuugagaauuuuaggccaauaucccugaugaacaucaaugcgaaaauccucaauaaaauacuggcaaacugaauccagcagcauaucaaaaagcuuacccaccacaaucaacucggcuucaucccugggaugcaaggcugguucaacguacgcaaaucaauacacguaauccaucacauaaacagaaccaauggcaaaaaaaaaacaaacacaugauuaaauuuauuuuuauuguauuuuauuucaauaguuccuggggaacaggugguuuuugguuacauagauaaguucuuuauugaugauuucugagauuuuggugcacugguccccugagcaauguacacuguauccaauguguagucuuuuaucccucacauggaguaaaauaugauggauaaaagacuacauauuggguacaauuugggaacuucccccugaguccccaaaguccauucuaucauuuuugugccuucgcgucuccucauagcucccacuuaugagcgagaacauacgauauucguuuuccaucccugaauugcuucacuuagaauaaugaucuccaacuccagguugcugcaaaugcuauuauuuuguuccuuucuaugucugaauaguauuccaugguguauauauaccacauuuucuuuacgcacucguucguugauagauagccuaaauagacuuguuucauauuuuugcaauugcgaauuguacugcuauaaacaugcaugugcaagugccuuuuucaaauaaugacuucuuuuccccuggguagauacucaguaaugggauugcuggaucaaaugguaguguuacuuuuuguuccuuaaggaaucuccauacaguuuuccauagugguuuuacauauaguguuuuuuaaaauuauuuuccucauauuuuauuaucacagaaaugaaaugaaguaucucuuauggauaccuucuuaccacuuuacucuguuuauauaccucuucuuaguccucuaauucagauucauugaguucugaccuugguuucuugagguuuuguuuuguuuaacauccuuucuugagcuucaugaugaaaaauuuacucauucuguguucuagauagauaaauaguaauauugccaauauuauguacucaccaccacgaaaaguuuaauccuauccaacauuguuuaguagaauagguggugguauagauagagacuguguaaaagauagccuucacauaugaaaaaaaaagcugucugacagacuuuugagguauccacuuugaaucaagaagauucucaugaauguuucauuugcauuuuuaugauacuuuagucagugucauuuaaaugacauuuuuauaguguaauacauuuaugauuuuuauauuacucaaguauaagaaaaauugucaguuuuuaauuucagucucuuuuuaucauugguuaauaugcaggauuuaggauuuucaguauguuguuguuguuguauauaggugccuggaauacuuauuaagaaacgaugcaaauccagggauccgugauaagcaaggauacaacgcaguucauuauucagcugcuuauggucaccgucuaugucuucagcugguaagauuccugaauucuugugaaagaccuaaugggaguuuauagucuaauaauguaacaaaaaugagaauaaauggaucaaggaacaaauuccauuuuguuuuuuaacauuuucagaauuuauauaccucuuaaauucacacuugcuuuaguaagauauaucucauucucuuuuccuuuuaaaaaaggagaaaauuagaucucugaagagggcuacugauuaccccauguucaugucuacacuauuuacuucuccugccccuuuaaauuaauauuccucauaaguuucuaaaaaacuauaacugugucuuuugugagaaauaaaagucccugugaaaggaauaucucccccauauauuuagggaauuccaaaaggcacauuuauuucacaaccccuccuaacaagggagacuccacuucugcagaggacguuuuuauuucugcuguggucugauucuggaauagaauaccaccauucacccaaauuuaccaaaccagaaggaaagucaaggaaaagauauucauguguguaacagauacuuuagguuaaagaugcucuuauuuagacuuaccuuauaaauuacauuaaacuuugcuucccuucaaggggaaauaaaauucaacgagcguagauauaaaacaagaaaagggagguugacaauuuaauauagcacuuagagcccugcuacaaaaauaacuauuuuccuacguuauggauauucacaccaaaauuuuagaccuauguauauagauuugacgucuguugugauauaaaauuguuuauucaaaacaccuaauuuuuuggagccaaaggaagcacggguuuaggguaaaaguuagcaaagcucuauauaaguugagacuuaauauagaugaauacuucccaagcuaaauauuuuuguuuugacuuuuauuucagauugcaagugaaacuccucuagauguuguaaguauuagucaauucccucccaccaauuaguauuggucaguucccuccuaccaguuauguuuaucuguuugcucucauuagagcugaaaguguuuuuacauauuaggcacaaagacggugacagaaaucauguguacagaggaaaggaagauguuuacuugguggcaauuaaguagcauuucccccaaacucuuaugccugucuucaaagcucuuagucugugguccuuaguauacuuucauaauaaucauguuuuauaaguuugcugaguugccaaauaauacucuaagguggauuugaacugggugggugggagagaauaauugcuguaguaugucuuucugacauuuaaaaugccucuucuuuuucaguuaauggaaaccucaggaacagacaugcugagugauucagauaauagagcaacaauaagcccuuuacacuuggcugugaguacugccuucauagccgacuugauggcugcugguuuacugaaaauaucuaauaaccuauuuguguugacucaaacuaguaccauaaacuuuugguccauguaauaguuaucauggaauuaaaacuuugagaacuuucuuuaauucagagaauuacuuaaugugcuggguuuuuguuuuuguuuuuucuguuucuugcuuuagaaaaaaaaaaaaaagacagacagugauccuuaggcuucccccagggccuucuggggagagaaagggagaaaauauggagaauaugccugugauggugaauuuuaaaaugugcugcccuaguggaaugccuuauaaguuggcuaagcagaugguauacacacacauucugugguauuucuacaauuuuuugcuuacuuugugaucuuggggugcuaacuuguuguguguucacugguccuuuaguugcucacacuauaggauuuggcuacauugucuguuaugucccuuccacuuuaagauuccucuaaauuuuuuuucagugucaaucacuaaauggagaagguuagggaagaaugugacaauuuuuuaagucaaaugagaauuuauuaccuuaaauuucaaguagauccuaaucuagcuuccuguacagaaagaauuuauuuuugagacaaagcauguuagaguuguagggaaggggguacuuugagaaucaggagaccaggguacucucaccagguguuugugagauccaugauuuuuaguaaaaugcuuauaaggauguauccuuaauuuaauguggaacacuacaaguucaguuauucauuugauuguuucuuuucauauguacuauuauuuuuuaucuuaauauucuccuugcggguguuuuaacacugacauauauacauuaaauuuucugccauuucucccuacugauacuuccuaucauguucuaaauaacuaagaaagcauucuugaagcuuucuacuucuuugcccuuugaguccuuggaaacaccaucaccucucccagacaugcauaguaaauaagucugaaaaggcaaagccagcauggaagaaauagccauuuuacuauugaugaaaagaaaugaagacugagcagcauuagcagcagcagcagcagcagcauucucauuauaauaauuucacugucauuucuugagcacuuucuaggugccagacuauuuccgccuuguggagauucaacuaguagcauauuaaagacucccaaaagcccugcagucuuuaggacuuaguuaucaguuuaaugauguuguuuccuuagaaauucucauuuguauucuaccccacccuucaauuuggcaaguuucucuuuuugugcuugcaaguuaacagugugcuauacauugauuagugggucggucucucucucucucucucucucugcccccccauuacuauuuuuuugucagagauuuuguauguguauauggugguaaugguagaaaaaagaaaacauagcauaaaacguaccuucuuaaccauuucuaauuguacaguucagcaguguuaaguauauuuacauuacuguacaaccaaucuccagaaucuuuuuaucuuguaaagguuaaaacuaaaacucuguacccauuaaacaucucccuguuucuccuuuccccagucccugguaauacuagccuaccuucuguuccuaugaauuugacuaaucuagacaccucauuuaaguggaaucauaacaguauuuuuuuguguugugugacuggcuuauuucaucuagcagguuucauccauguuguagcauguggcugaauuuccuuauuuuuaagcugaauaauuauuguuauguauauagcacauuuuucuuuauccauucaucugacaauagaugcuggguugcuuucuucucuuggcuauuaugaauaagugcugcuaugccauagguauacuaaauaguguuuuuaaacuaaaaauugaaauaauuuagugauuaggcuuaaugaaauaugauuauaccaccacuuuugcauuucauaucuaucucuaggagguuuucagaaguuacuuuaauuucuuacacgaaacucucccauucgggacaacuugguacagugaaaacauacugaucugaggcuuaaggagacuggccuugauuccuaauuuuagucauacuggacauuuggacuucuucucucagucccauacaaggauaucauggggggaaaagcccuguggcaaaucaucauggcucccauuuauuucucuugucuuuucauuuuuauuuuuuauuuauuuuugcuguuguuuuucauugucucacucugucauccaggcuggaguguaguggcacaaucacggcucacuacagucuugaauuccugagcuccagugagccucccucccucagccuucugaguagcuaggacuauaggugcacaccaccauucccgacuaauucuuuauuuuuuuguagagacaaggucucacuguugcccaggcuagucucaaacuccuggccucaaguaauccuccuguguuggccugccaaagugcugagauauaggugugagugaccaugcccaaccucauuuuuuuuuuuuuuuuuuuuuuauuuagagauacaaucucauucugucacccaggcuggguugcaguggugcauucccagcucacugcagccuguaccuccuagacucaagugauacuuccgccucagccuccugcauagcugggaccacaggcaugugccaccagguccagcuuauuuauuuguuuguuuauuuauuuuuggcagagaugagaucucacuguguugcucaggcuggccccaaacuccuguucaaaugauccuuccaccucagccuccccaaagugcugggauuauaggugugagccaccacaacuggcuaaacucuucuuuuuauauugucuuuuauauuuaauguaugauuccucagaguucauucuuucaguagcauaauuuucauugaccuaguauugaggaacaaaguuagauguaauccuaaaacaguagaauuccgugaccuacagucacuuuaaucuuugagauagucaagcuuaaguagucaaguuucuacacagauucauuauaaagagaucagugaggcccagagcaaguuuaucucuugcugcuacuuucugacauuuucuacaagaaauggcauuauaguccuuugaaguuuauuuauuucuuuauguccugcucagcauuuaguccaguguaaauaauauauguucaguugccauguuggauuuugaaaagacuuuucuggaaagcccuuuuauuagacuguaugaagaaggcaacucggggccgggcgcaguggcucacgccuguaaucccagcacuuugggaggccgaggcgggcggaucacaaggucaagagaucgagaccauccuggccaacauggugaaaccccguuucuacuaaaaauacaaaaauuagcuggggcaugguggcaugcgccuguaaucccagcuacucgggagacugagacaggagaaucgcuugaacccagggaggcggagguugcagugagcugagauugugccacugcacuccagccuggugacagagugagacuccgucucaaaaaaaaaaaaaaaagacaacuucagucugacaaaucuucagucuuacuuuuguacagcuaggacaaugccugguauguggugauauucaagcagggcucgguuaugcauuucuuugcuaaaagaauuacuucuuuuuuagcuauggcacauuaugggguggguauggucaguuuaauuugagaaauccgaauauucaagcacugacucaaguugcuagcugucuuugcaguugauguggagcacugaacugugauuaagaacacaggcuuggcugggcacaguggcucaugccuguauuccuagcacuuugagagaccaagguaggaggaugacuugaggccaggaauuuugagaccagcccggauagcauagcgagacccucaucacuacaaaaauuaaaagaaaaauuagcugggcauggugacguguaccucuggucccugcuacucaggaggcugaggugggaggaucacuuaagcccagaaggucaaggcugcagugagcuaugaucacgccacuggacuccagcuggggcaacagagcaagacccugucucaaaacaaaacaaaaaaaacacaggcuuuuuagaaucagacuugaaaucaagacuuuaaaugaauccgugucacacauccauugaaugucugccgugagccaagcauuguauacucaugaaaagaugaccugucauuugaacuuguauuauuuuuagaaugccuguucccuaacacaguagccuacuauguugauuauuagaaagaucuguaguuaacuuccugaauucucgauguagaaguuuggauuaucucaaguaggauaauaauaugaagacaaguuugcuuauuuacauuuauucaaguauuuaggaagucagucuaaauauguauguuuuaaauuuacauuuuuauuuauuucuaggccuaucauggucaccaucaagcacuggaaguguugguacagucuuuguuagaucuugaugucagaaauaguaguggaagaacaccccuagaucuugcagcuuuuaagggccauguugaauguguggauguacucauuaaucagggagccucaaucuuaguaaaagauuacauuuugaagaggacaccuauucaugcagcagguaugccagauauuaugcuugauuuauuuauaacuucuauccaauacuuuuuuucaauuucugauauauaauauuuccaguuaauugucuuuaaaauuuugaccuuuuuuuuuuucaaaucauauauggauuauuugaccucaccaaauaacuuuauucacacaaaugaauuuacaaagccuccgucauucauaaacauuaggaguaucccaguguucagggaacuuaaauacaguguauuauaucaacccaaguaaaccaagcacaaaaaauauucauauaaaguuguuuacauguagguccuagacuaccagcuucugugugaaaaaggaaauaaaaauagauuuauuaacuaguguuugaaacuaacuuugugccuggcuuaaaaccucccucaugcuccagccugucccacacaaguguuuaagaagucauuaaaacuguccugcucucaugaaaagaagcuccucugcacaaaagauguaagugcccccaaguagcucccuuccuccuguggccucucuuggaaaacaaccuuggcagccuccuugcugauaccuucugcaauuuuaggggccccucagggggcaguggcaguggauucaucuuuugaugauggcugcagaugcuaacauuggccaauucuaugucacaccuacugguuacucuuugaaggcauuucuccagacagaagccccacuaccgucaaagcuuagguagggcaggaucagagaggcgccuguguuguuuugaagguugugcuacagccuggacuuaucucuggacuucucccucuaaaacccaguggcccaaagagcugaaaaaugucagcuuggcucuucaaaaguuuccagacccaaggagauuaccaagagcuacaacugucuggggaaauuuuugacuuuaagugguaaaaugauuguauucucagggaauaccaacaacaagacuaucaucacuuaaaacauuaucugccuuagaaguuggguuuauguaauaaucuaacuucugaaacacuuuaucaacaaaacaaugcaguauuuauuucuuucugguagaaguuauuuuggauugguauaaucuuucauuuaacaagugauacacguuuugacuuauuuuaccaguguacugcauuaaacauuuaugcagacaggcuuuacagagcacuuuaugcaagaacuauuccauauugugauauuaugauguagcagauacguuaaaauacgaaggucuauaaccaagucaguuaaaugacuugcuacccacugcguaucacuggcagaugcagauucacaacucucuauuuuuauagagugauccuuaagaauacauuugaauauaugucuuggauuuuuuuucuaguccuuugggaagcuuacauuuuagaagacuauugauaacacccacuguuacucccagagccgcccuucaaagcuaucagauguucaaguggggcugagaaaaauauuuuaauaauacauuagaaccucuaauaaacauauauacacuacuauaugguuugaacaagagguuaaaaugcauuacuugcuguuaccuuauucugaaaaagagugaaguuauauaucacuuugcaaagccaaacuugguggcgcaugccuguauucccaccuaacuugggaggcugaggcaagagggucacuugaguucaguuucauugcacucuaggcaacaugaugaaacccuguuccuaaaauauaaaauaaaaaucaauuuuguacacuggaugggaucugugaaaaauaaguacauuuuaaaaauauuaaucuauagcuagaaaaauuauaauugcagaucauaugcagaacuaauuuaaagcuugcauggagugguugcacucucaauagguaaauauugaacugagacauuagccagucccuuagaaguaguuaaccaaugccauauaguucagcauaaauccuacccacaaaaagaaccacagguuacucuuagugccuaucuauucaauaaaugcaagccuuguaucuauagaugccuuucaaauuuggaggucuauagagagcaucuauaagccaugaaaagaacacugaggguuuuuuuuccuggagguuuaccagucauuucccacagagaugcugugcuugcuguuuggguauugaacuuagaugacacaaacauucaucaguagcgacugugaacugaguguaaaugaacugauuugaaaaaugaugggccaaacaaguucuucuugaacauccccaaguguuacgacccuguuuuuuguugcuaagcugugagagcugcuggcagagugcagcauacagauuggacuaggguaggagaggugauuuaagccacaaguuuaauaacuauuaguauuuaauauaacugugggaacauacuguggaauauucagcaccuagcuugcuuuugcuaguuuugucaucuuuuaauuagaagaaauagugauagacguucuuuucuguaucauaugcaagauacauuuuuuucuaauguauuucuuuaaacuucagacuuuguauauauuaacaggaccugaauuuugcagaggauuuaacuuacuucaaaagcucuuuucuuuggacuacuucuacuuguacccuugcccauuuuaugcauuuggacuuaacacaugcauucuuuagauggaucauuuuucuuguacuguauguauauauauauauaucauuugaaauuauuucagccauaaauaacagaguacccuacugaaaauagcuuaagggguuuagugucucauauacaaugucgaaaggcaggcugggcacgguggcucaugccuguaaucccagcacuuugggaggccgagguggguggaucaugaggucaggaguucaagaccagccaugccuagauggugaaaccucaucucuccuaaaaauacaaaaaaaaucgccgggugugguggcaggcgccuguaaucccagcuacuugggaggcugaggcagagaauugcuugaacccaggaggcggaaguugcagugagccaagaucacaccacuacacuccagccugggcgacagagcgagauucugucucaaaaaaaaaaaaaaagcaauaucaggcagaugcaguuccaggguugguugauucuacaacggugucagagcucuggauuaaauucuguuauucucuuacauuugcauucauguugugggauuauugcugcugcuuuuaaggauugcaucuaaaaucaggaaggaaugggggcuuuucauuauuaaagauaaaaguauuucccagcagccucuagacuuaucggcaucucaguagucagaccugguuccugugcugcucaccuuaaaacugaucacugucagaggagaaugggguucuugugauugacuuggucuaaucaugguaucaucccuuugcuggagucaaggcacucuuccugaccacauugccagagagcuaaauaaaaugagcauucuuuuagaggcagaugauagggcaugggugcuggguaggcggucugccugucauguuuuacugugaggaauucacauuuauuccagcuuuaacagucaaaggccguagaaaccuucuuuuuaccuauaguuuucauucuugcauauuaaauucagugcaacuaucccaaaaguaaauucuagaagaugugcuuuuagauggacauuuucuauuuuaucauuauauguaauuacugaaauguuuaaauuucacuuuacagcaacaaauggucauucagaaugcuuacggcuauuaauaggaaaugcagaaccacagaaugcaguggauauucaagauggaaauggacaguaaguuucgauaaauaauuguugcaucacagaagggcguauuucgaaaaccagaguacagucuuaagugacagcacugaaccuauuccuguuguugcucaggacgccucugaugcuaucuguucucaacgggcacacagacuguguuuacucauugcugaacaaaggagcaaauguagaugccaaagauaaguggggaaggacagcguugcauagagggguaagcagaaauaugcucuuuccuuucaaaaagcuuuuaugaccucauauuaccuagaacugaacuagguuauguuuauuuuuucuucauuaaauguucgucaaauagucuuuaccauuucuuucaguaucuuaguuuuuaaaugcuaauuuugaacaauuacagaguacaacuuaaucuagagaacaauguuagaacaaaauuuuaaaacucuaaaacuuuuaguagaauuaaugucaauuugacuuuuuccauuaucucacuuauuuucuuauacacuuuaaucuuuuuucaccuuugaaauaucauuauuuucauugaauaccaaguuucucucuuccuguuuucauacuauuugcauuuuagaaggguucuugcuuuaacugaauuuuuaaaccacuuccaauaaaaauacagaauuacucauaaaaugauaaauggcuuuaauugauggaaggauauggagaguauggucuuuaaaguuuuuaauuagcugaaauuggcauguaauguuuagcauaauauguuugacuaccuuuaaauuauuuucuuucaggcaguuacaggccaugaagaauguguagaugcauuacuucaacauggugcuaagugcuuacuucgggauagcaggggccggacgccuauacaccugucugcugccuguggacacauugguguucuuggagcccuuuugcagucagcagcaucuauggaugcaaauccagccacagcagacaaucauggauauacggcacuucacugggcuugcuacaaugguuaaguauacaaacacaaaugcauaucauuguguagugaacagagauaaaagaaugacauauuuauaaggcaaauuuuaaguuuaaaauuagcaaaaaccuugggaauaaucuacuguauaggcucacguacuaauaauacuuaguacguaggcucacuccuguccuuugucaugcuaaagccaagacacuaguugucaaagguguucugagauaagccaugaaguauuuuugagguuuuucuuuucuuuucuuuucuuuuuuaguuuugguaggaucuugcuauguugcccaggcuggucuugaacuccuggcaucaagugauccucccaccucagccucccaaaguguugggauuacaggcaugagccaccauguagccugaaguuuuucuuagauccuuauuuccacaaauauuuugcauuuuuaggagguuuuuagaauguuuccauugcuuuuauauagugugcuuguauuuugauuguguucuuuuacuauuuuuuuuuuuuuaagagucccacuauguugcccaggcuggucuugaacaacugggcuuaagcaauccucccacaucagacuccccaagugcuaggauuacaggcaugagccauugcacccagccauguucuuuuacuuucuaaauacaaucauauuaggggaaaaauaaccaaaaguaggagaaacagugagauguaucacauucuaaacugaaaucuauguauguuuucugagcacauugcaagauaacauucuuauauuaccaguaauauccauguucaauguuuuaaaggaauaaaucccuagcaggucuuagaauuagaaacuuugauggguuaacucugcuacaugguuaaaagagauuuucuuuggccuccuacaggcucacagucacagucaucgcuuuuauagguagacucauaaaaggucacguagggaagcauaaagcuacuuugaaguuauagauguuaaaaaugcaguuuggcuuaugaaaugccacuaauuaaaauaauuuaugcaaugaagcauguugagauauuuuuagauuugaucaucuuagaaaacucaaguacauuauauacagugcaagcaucaguguugucaaaguucaagcuucaggcuuuaguagagaaauuagagguuuuuaaaauuuguuuucaauuucaguguagcuucaagauuaauguuaauuaugacagcagaucuacaaagcuguaguucacaauucuaauaaccuucccucaaaaugcagagaaaauauaaguugucucuuuauauaaauacccauuugcuaaaaauaaauaaguauaauaucuguuguaaaaucagacugccuuaccaggaaguugagauuuccuaucuuucuauaauaugcuguuucauaguucuuucacugggagcuguucugacaaaguuaucaaguuaaagcaaaagaggaaaaagcugaaucuuguaaaauuauaacuucauuaaauguuuccacaaguauuucugagauacaauauuuugauuuucauauuaguccuuaugccaaaguugggaguuguauucuuuugccguuagaacauuuuggguucuugagguuuguccuguuauacuguugguuauccuucagcugaguacugauagcaccauaaaaacuugaauaguuaaaucuguugcucauugaacaagcuaguuuagucucuuuguuuuuuacuaccuuaaauccuuaaccaaaacaguuuugaaaacuauaaaaccuuugggguuuaacuucucuuuuucccauuucuacucgcuaaggcaaguagaaaugaguguagugaaguggccagagacuaguacucauacuagaacaaagaagauacuguauuuugccauugauguuugauuuguuucuguaaugugacuugacauuuuacaaguauaaggaaaacccaaaauaucuaauauagugggaaaauaucuacaauugugaguuguguuucuguaaaaaagucagugagauaaaacuguucagaagcaaagacuuacugcuugguuuuuaaaaaaauauaucccugaagauuaaccauuggaaaaaucacacagugagauauuuuuccucaggaagagcauuuaguuguaaauguacugcuguaacuguccuuuggagaguugcuuucuauuacaguguuuguuaucagaucuauauguagaacauuuucccuaaagugaguuccuacucuaucacugcuaaauuuagacucuaagcacguuuugugcaagagacagaauuuugcaagaacugcaugccugguugccauuuaaagaucauaacaaaugugucugauuuucagccuguagcaaaauuguggugaugcugaauuugagcuggaaggaauuuaauguguguuggcuauaugcaauaagcgacuauauagacagccuaaaauuaauaccauauuuauagccaaaagcccguuuuauaauuuggcauucugaaaguagaauauguaaaaugguuuuuacuuuaacuaguaauuauuguacagcuggaaagaaaaguggaagcaugccaacagaacagaaaacaaccucuuaaaauuaaaaugaaaugauggccaaguuuuagaaaaacacuggcuguagauacuaaaaguucacaauuucaguuuauauagucauucaaucacagaacuuaagaauacuuauuauuccuuuaaaaaauguguucauuuuuaugaagcucuaaacauccucagacuagccucugaaacucaggaggacccaguuuaccauccuaucuaucuuucauaaaugaugauagaaaguuaugagauugucugcuugauaucacccaguaaugauuucuggaggucacaaaggggccccacuguucccuuuucucagucuguacucagauggugagugguucucaaacccuuuggucucaggaacuauggauugauacugacuguauuagaaauuguaauugagaaauuuuuaaauacuuacugauuuauuuaaaaauaaugucuauuacauguuaacauaaauaaucuuuuuuuaugaaaacuauuuuccaaaaguauuuucuuuuuagugagaagaguaguacaucucuucauagcuaauuuaagagaauaguuggguucucaucuguguuuuuauucauauuuuuuuugcgucaccccaggguucccuaggccacaccuuaagaacccauauaccuggagaaugaggggcucuuaagucaacaauggacaacuuuccauugcuguaucuuaguaaugaguuaacauucagaacgauggcauuaaaggaguuucucaaccucagcacuaugacguuuugggccagaugauuguugcaagggacucuccagugcauugcaagauguuuagcagcaucauugguuucuacccacuagaugccaguugcacugccccaccuucaguugugauaaacaaaaaugucuguaggcauugccacauacaauaucugcugaugggcaaaauccacuugaaaacuacuagauuagagaaaagaacugacaaaagauggaacacaauuacagguuuuucuaaaaauuacuuuuccacaauuauaggguaaaguuuaagcugauuaaguuugaguaauuuaaaaagaaaagaaaauauaacaucacuuugguaggcaaauauuaaaccaugaaaauguauaaagaggccauguaagaaucuuauuccuaaaguagaucccaaaugacuaaugaaauaaaauaagcaacauuuuauuuguaguaauuaggguauuaaauuaaaacccuggcucuggaauuaggguaagaaaauuugaaauuuggauuuuucuguuuuugaaguuacuguuaaaaacuauggaccagauauugaugaacagucaauacagucagcccuccauauccaugggucccccaucggugaauucaacugaauguccaucagaaauauaguuaggcugaacauguacagacuuuuuuuuugucauuauucccuaaacaauacaacaacuauuuauauagcauuuacauugaauuaaguuguaaguaaucuagagaugacuuaaaguauaugagaagaugugcauagguuauacacaaauaaaccauuuuguacaagggaccuguauaagggacuauggaguuuugcugucaguggggaguccuggacccaaucccccaagaauaccaaggcuggauacuucuccuuuaccacagcaauaucacuuugguaggaaauuguccuacaaaaauacuuccuaaaauaaaaacaaaauguuggccgugguggcuuaugccuguaaucccagcauuuuaggaggcugaggcaggcagaucacuugagcucugggauucaagaccagccugagcaacauggcaaaacuucaucucuacaaaauaucaaaaaauuagccaggugugguagccuugcaccuguugucuuagcaacucaggaggcugaggugggaggaucacuugagcccaggagguugagacugcagagagucaugaucaugccacugcacuucaacuugggcaacagagcaagacccugucucaaaaaauuguuuuaauaaaauaaaaaaauaccagaauguuucauuacagcguuguugauaauaucaugaagaauuuuuuuaaacuagcaaucacuuuaaaauccauaauuagauuaaauaauuuaugauauacuuugauacugugaagcucuucagaacauuaaagaauaagauuuuagccgggcaugguggcucacaccuguaaucccagcacuuugggagacugaggcagguggaucaccugagaucaggaguuugagaucagccugaccaacauggugaaaccccgugucuacuaaaaauacgaaaaaagcuagcugggcaugguggugggcgccuguaguccagcuacuugggaggcugagacaggagaaucacuugaacccaggaggcagagguugcagugagccaagaucgcgccacugcacuccaggcugggcaacagagugagacuccaucuaaaauaauaauaauaauauuucauauaugcuauuauggaaggauauguguaguuaauauuaaguaaaaggcaaguugcggaauuaaacaucccauugccauuaagaaaaaaauaaaaaaauagcacagucauuucucguuugcuguugaggauugguuuccaggaccccuugugaauaccaaaaccaacaggcgcucaagucccuuauagaaaaugggauaguauuugcauauaaccuaugcacauucucugcuauacuuuaaaucaucucuggauuacuuauaauaaccaauguaauguaaauguuauguaaauaauugguaugcuguauuuaggguauaugacaagaaaaaaagucugcucuguuuuuuuuuucccccaaauauuuuuaauuugggguugguugaauugauggaugcagaacccacggauacagagagccaacuguauguauuuugugcgugcaguuguauaugccuagaaauuuucaggaacuacugguggcuuaacagcuaccaaugguuauauuccagagaggggaucugggagaugggaugagggagagacuuuuacauuuuuccuuuaaacacuuacauguaccugugauuuuugccaguaucuccuuugaauuuuaauaccugguucuuuacaccuauuuaggucacgagacauguguagaacugcuuuuagaacaggaaguuuuccagaaaacggaaggaaaugcuuuuaguccauugcauugugccguguaaguaaagccagaaugaaucagauuugguuugaguguuuuaagaaauacaccauugcugugagaaugaucaccuuguuaccuuacacaggauaaaugacaacgaaggugcugcugagauguuaauugauacauuaggugccagcauugugaacgccacagauucaaaaggaagguaggaauucaacuauguauuaaauaguuuuagccaggcacaguggcucaugccuauaauccuaacaaucugggaggcugaagugggaggaugacuugaagccaggaguuuaagaccagccuggucaacauagcaagaccugcaucucuaccaaaaaaaaaaaaagugcaugaugaugcaugccugugaucccagcuguucaggaggcugaggcaggaggaucacuugagcccaggaguuugaggcaacagugagcuaugauugcaccacugcauuccagccugggugacagagugagaucccgucugggcccuaccccccaaaaagguuuuauuuucaauaagaaauaaauuuuaacuacuggcuggugugagagaauuuacagaaaacccauuauuaaaaguugauuuuuauauuugcgaguauaaauuguuauaagaucucaauuauuuuuacauuauaaaagguuuuucuauuuauagauuuuaggaaguuuuccuccuuuaaacuauuuuaacauguaaauauuuuucccucucuuucgaauuuguuucccaaagauuauuguuaacaaaguuaacaguuuucuaaaugggaauaaagccuggaaaaaaguccagcaguuguaauaaguggugguauucagauuaggauuuauuucuuucaaaauuuccuuuaaugauguaauguuauuuuagcaauuuuguaauuaaucuuuacuucauacuaguucuaguuuaauuaaagccuucuguauuauugaaaguacaaauuucuaugagagaaauuaguaagcuccauugagccuauuuguuuguguacaggcagugcuuuuguagccuaauauguaaacccuuaaaaacagcaugucacaaauuaaagaauauuuuuccagcauauauaacauucaaauuuagucauauauuucaauuuuucuuuaucacagaacuccucuccaugcagccgccuucacagaccauguagaguguuuacagcugcugcucagccauaaugcucaagucaauucuguggacucuacagggaaaacaccucuuaugauggcugcagaaaauggacaaacaaauacaguugguaaagaaacuucuuuaaaauuguauuuuccuaaguauguguaucacuuauguauaacuuagaucccaagacuucugacuucaacuaguuaucuuaccacuccuaagacuuaaaaccuuuuaccuguuugcaauccacauuuucauuuagggauacaauguuuuaguuugcccugacuauugaggagucuacuuuaccauggccuuauaacauagugguuaagaacacuggcuguggaguuggauugccugaaugugaguccuagaucuuucagcuaaaugaccuuaugccucaguuuucucauuuauaaaaugagaaaaauaacaguaucuacuugguguguuguugugaggguuaaauaaauuacuuuaaauccagagcauauaaaacaguauuuaaaauuuagugcacagucacaaaauaaauguuaauugccauuguuagagugugugacuuauacaacaauauaauugucucauacaauuauaugaagauauauauguuauauauuacaauauuuuucuuguacuuaaguuuuugugagagggacuuuuuugcuuuguaucuucauuucucuacagugaguuauugguaaucuaagaaacauguucauaaacauaagaauugaugcacuuuuuccucccagagaugcugguuagcagugcuagugcagaacugacuuuacaagauaacaguaaaaauacugcccuccauuuggcuuguagcaagguauguauacaucuuaagaauauguuuccauuguuaauauuaacagugaccuuaaaaguuuuuugacuucacuaaaaugaacaacucaggaccaaaccucucuaaugaucacugguauuagauuucuugaacaaaauugacuuauaaggcaccauggcguaucaaagucuccaguaagccaaauaaguuuuggaacacaagucuaagcauaauuauccucuuuccuuaaucuuaauuuuguccucuucuccuacccucacucccaagauguguuugggcaaauauuaagauauuagccaggaaaauucaugguauauguaugguguuguacauaauauauggacuaggauugcagauuguuggguguauaaauguaucuuuaauggugcucaaguuuuuauaacuuaucugccacaauuauagggucaugaaacuagugccuuguuaauacuggaaaagauaacagauagaaaccucaucaaugcaaccaacgcagccuugcaaacgugaguacugucaguaucuaguauaaacuuugugaccuauaauuauaaaaaugauaaauggauuuuuuuaaacaugugacuauuggaauagguuucauuagucauagaagcaauuuuaauaguuuuacaacugucaaaacucauuucuaaaaugaucacaacuaaaagccauauuauuuaaaaugcuuuugaacugaaauuuuauuauaacauugacaauaauguauuuuuuuccuuaauccaccuaccuaauuuucugaaggaaaguaguacuauuuuguguauucuguggaaaucaacuguaauaauauguuacuugaaacuaacaauaaaugagguaagaagcuuuaugugugucuguaagccaauaagguuucuuaaagaaucaaaauuuuuaauaaugugagcagccaaccuccagauagacugacagagaucuuacaucagugucucucauugucccuugcuauuccauuuugagguuuaguaaagauaaaaaucuuagaauauuguugcccguucugggauuagucagaucccuugaagguccaaaaauuagucaugaugcuuguaagcuguuuucaaagccuauuagaauuuaugcuacugcaguuuacaguuuuuaauguauagucuguaucuuuaccagccucauuccuuaacaacggaggaaugcaauuucaaugguaaaauguuuuuaaacauugaaaagaaaaguaacaaaaggauugggugaagguagggaccugucgaugggaccuauggcugagcuugaugccgagcuacacguugacaaggugugacagugcacugcacagagguucugcucucccugcccccaucuuuguuauuaggacuagguuucucgaguuuguaccucuuggucuucacaaguugacaaaaaugcucuuugacagccagguguguauguguaugugcaugcacaugcacauauguguacauguaucauguuuuuuccccuagaccucugcauguugcugcccgaaaugggcuaacaauggugguucaggaacuuuugggaaaaggagcaagugugcuugcaguagaugaaaaugguaaguugguucuauauucucuucccuuaaccuagagcuuuuaucuuuugauccauauuugaagagaaauaaacuuggauauuuuuuauuggucaaagaggagagcuaaaguuaauauugaagaguaguuuguggcaaaggaauaagggcaaaagaaauaggaaaaguuaucuaacagauguacuuccgaauuccuauaucaucuguuacagcaaaguuaguauuuacuguuuauacuugccacuuucuguuguuuuaguagccaaagauuuuguucuuucagcaaauauguaucaagauccuaguuaaguacuaauauucuuauuuaaagccaguguuucuacucaugcacuagauccuguccccuuuugccuacuucauaaugucaguuugacaguucucuuuuguguccuggaguaacauuuuucgcucucuuccuguauuauuccucucaguauauaaacauuaguucccucauccuuaaaaaauaauuuauaaaucucacugcuccugccagcuacugccauauuucucuguccccuuuugcagcaaaacuacucucuugcuguccgcaguuauuccucucauucuuccauucuuuuguuguuguuguuguuguuuguuuuugagacggagucuagcucuguugcccaggcuggagugcagugccaugaucucggcuuacugcaaccuccgccuccuggguucaagcgauucucaugccucagccugcccagguagcugggauuacugacaccugccacgacgccuggcuaaauuuuguauuuuuaguagagacggaguuucaccauauuggccaggcuggucucaaaccccugaccucaggugaucugccugccuuggccucccaaauugcugggauuacaggugugagccacagcguccagccucauucuuccauucucucuuaauuuccguauagucaggccuucucccccucaccccuacacauagcaaaacuguucccaucaaaaccaccaaugacuucuacuguguuaacuacuacuuagcucucauuuuacuugauagaucagcuuuuggcacaacugaucguuuccuuugauaaauuuuuuuacucugcuuuuugaaccccacucuuccuugguuuuccuucuacauuacuaguuauuccuucuuaauuucuuuuacaaaauuucucccucuucuucuaggacucaauucuucguucuuuuugcuuucucuaucuacauugacucccuagugcucucaucaguuccuuugguuuuaaauacuaccuauaaugcugaggauucccagauuuauaucuccagcccagacuucucacagucucuauauauccacgugccuaauugacacauccauguggaugucugauaaacagcuuaaaccuagaaugugcagaacugaacuguugauccuuucccacuccccuugccagaccuacucuccccacagcaucaugcucucuccauugaagacaauucucauucuuaacaguggcucagggcaaaaccccuagagucauccuugauuccucucacucauacucaauguauaguccaucagcauauacuauugacuccaccucuaaaguagaucuaaaguaugcccacuuuuuucuuuacugcuaccagacugaccuggauccuuuuaaaguauaugagaacauguuacucuugaauuucgguucuucuucuuuuuuuuuuuuuuuuuuuuuuuugaagaggcagggucucacucuguugcccagacuagaguacaguggugagaucauagcugauuguaaccuugaacuccugggcucaagagaaccucucaccucagccucccaaguagcuagcacuauaaguaugcaucaccaggccuagcuaauuuauuuuuugugcugacagacucucacuauauuguccaggccggucuugaacuccuggccucaagcaauccccccaccucagccucccagagugcuccaccuggccccacucauaguucuuaaaaugaccuuacuaggcccuacaugauguguccuccaccuuguuaccuuucugauauuauuuccuacucuucuccuuucucuacuucauucugccaugccagccccuccauagcaggguuauacaugcauugugaucuucauucuggcuguuuacucugccugaacacucuguccccaaacaucccaugacuaaauucgucaccuguuucaaaucuuagcuccaguuucaucuucucaaugaagcauauucuaacuauucuuuacuacaacuugcuagauaccccuaccauagcauucucaguccuuguuaaccugcuccacucuuuccucuuuuuuuacauaaagcuuuuaacauauuguauauaauguacuuuuuuguuauguugauuuugugucuucuccacuaaagugaauguaagcuccacaagaacagugaaaucuuugucaguugcauucacugauauauucuuaguguucuaaauagugccugagcaaguggaggcucagugaauauuugcugcaugagugauuaugccaagcacuguacuaacuucugaugauauaguguaaaauaagacauagucuacucccuugaauggagauaagagugcaaacagccuauuaacgaugcacuuaaaauaguuuaauuggaauaagcauagaaugcuaugagaguacuuaagagggucuucaaauccuuucuugcaggaucagagaaggcaucccaaaaaaugcaacugcuaagccaaaauccaaaggauaaggagaaagugggggaggaacuuucuaagcaaagagaguggcauguuaagagauaaaacuggccgggcaugguggcccaugccuaugguccuagcacuuugggaggcacaaggcgaguggaucaccugaggucaggaguucgagaccagccccgccaacauggcaaaaccccgucucuacuaaaaauacaaaaauuagccaggugugguggcaugugccuguaauccuagcuacuugggaggcugaggcaagagaaucgcuugaacccaggaggcagaaguugcagugagccgagaucaugccagugcacucuagccugggugacagagccagacuucgucucaaaaaauaacccccaugcagaggagaggagccuguuuuuagucauauucugacuagaaaacacaccugaaacaagcuucuuuccccacucccgcucucauccaaggcauccuggccuauguaauggguuguucugccugccagcagcaggaacagcagcaggcaccuuuagaagaacccuugaaagaagugugggcagugaagcacucccccagcuacuuugaacaaauaaaauuuaauuaaaaauacggacagccuucagccacugcugccaaacuuggaaggacaucaguuguucucuuugacccuugacaaaaugggaacuuuacaaagggggaaaaauuacuuuuuguggcugggcacaguggcuuacuccuauaaucccagcacuuugggaggcagaggcgggaagaucacuuaaagccagcaguuugagaccagccuggggaacaaagcgagacccuguaucuacaaaaaaguuuaaaaauuagccaggcauggcaugugccuauagucagagcuagucagggggcugaggugggaggaucacuugagcccagagguugagggugcagugagcaugaucauuauacugcacuccagccugggugacagaacaagacccugucucaaaaaaaaaaaaaaaaauccuuuuuuuaucaaggccaauauagcauagaugaaaauaugugggagaacuggaagcaaccagaugcccaguaguugaaauguauaacuaaaccauaguauaaucacacaaugaaauacuguauaacaaugaaaaugaaccaacuacaguuacauacaacauugauaaauuucauauaaugcuacacaaaaaugccagauaugaaauaauacauacuacaugauuccauuuauauuaaguuuuuuaaaaacucuaaacuguaggcuggguaaggugguucacaucuguaaucccagcauuugggaggccgaggcaggcagaucacuugaggccaggaguuugagaccagccuggccaacauagcgaaaucccaucucuacuaaaaauauaaaaaauuagcuggucaugguggcacacacguguaaucccagcuacucaggaggcugaggcaggugaaucacuugaacccaggaggcaaagguugcagugagccaaguuugcaccacugaacuucagcuugggugaccgagcagacucugucucaaaaaaaaaaaaacaaaaaaaaaacuauaguguuuaugacuccaaguugaaagcaaggaaauuacuaccccauaagucaggauaguaguuaccauuguggaagaagaaagguguaacgacuggguagaggauauauggaggcuucugguaugcugguaauguucucuuucuuaaucuguauggugguuauacaaauguauguuaugugauaaaacuauuaaaguuccauaugguauaauugaagcuuggcaucacacuauuaucacuucucucccgcuccguccucaagacugagucuuguaccaacugagguaccaaauguuuccuccuugguuugcuguguugacacuuugugguaacuuacgacuaaggucaguugucuuccgcuuaaaaaaagggaauauuuacaaaggaaauauuuguuuugauuuaguaguuuuuaaaguucaucugcuuaguuugucuacuguuuuucuucaagagacugugaccccaagagaaaaguuaaauugacaacuaagugucauucauucaacacauaucuuuugagcaccugcccuguggcugauucaugaagcuguacacauuuaagauuucuuagcaucaaaaaguuuccuuacauaacuacaaauuaaauuuuuuuauuuuuucuuaccuugacacugauauaacugcaaauuaacaguaaaucucugccuaccauccugaaagaauauucacgauaugugguguuuuucuuauucuagcccaguuuuuucugugaauucagauggauacggauaaguugugagaccuuggggaaucauucuucucugggccugcuuccucuucuguugucuagucuaacauccccuuccacccuagguuucuauggcuauucuuuuucuacuuauuagaaacuugcgaaucaugcugguuacagcaauuuauuauaagcuaaguaauguaaaauaugucuaaaguugaaguacuuuaggcuuauuuccuugucuuuggugaaauacaucucaggaugcuuaauuuuuaaauuuuaucuuuaauucuaggcuauaccccagcuuuggccugugcucccaauaaggauguggcugauugccuggcucucauuuuggccaccaugaugccugucucaucaaguaguccuuuaucauccuuaacauucaaugccauuaaccguuauaccaacaccucaaaaacagucagcuuugaagcuuugcccaucaugaggaaugaaccuagcuccuauugcaguuucaauaacauuggaggggaacaggaguacuuauacacugacguggaugagcucaacgacuccgauucugagaccuacugagaggcugaggaggagggaguucucacaguaaagcuucaaacugugcuuuuucaggaaaaaggcacuuugauauucacguagaaauucaaccuaagaggaaagaucccacagugagccaauguuaagagaucugauggcauuaggaggaagaguuuuaaaggcaaguuuuacaaaaggaacuucuagaaucuugaaauagaccugacugaggaaaacacauugaugucagaauucuuuguggaauuguuuaauuugguuuugcagugccaggaacaauuggggacacugugcacucuaaccugcuuacacaagcaacacuauuguaacagaagaaauaaagacacuagauuuaaauuuuaucaauaaaauuacaacuaaauuuaaaggcaauaaaaguuugguacaguaggcauuaugugcacagcaaauugcaaaaggaccaaauaacugaaagguuuuuuuaauaaaaugccauuuuguggaaacuggaguagauuaaaugaaacauuaccuaaaccaaacugcaauauuucuggaaaugaagcugagauuugguuuuaaauguugaguuuuuuuggguuuuguuuuuuuuuuaagaaaacaucugaaagccuuccaaugcuguauuaaaccaugagagaaagcagauguauuuuuacauuuuuuucuuuuacagaacuauuucaaauuuccaauuuuuauacuauuagaauuaaaaaccagcugacugggugcaauacgggugaaaauacuugugacauagacauugagauggauuggggucaggcuguugcccuguuuugaaugguuuggguuuaaaauaguacuauuuuuguuugaaaauguaaagaauuuccuagaaaaaaauucaugaaaucaaaaaguagacuauuucacccuauugcagcuaagugguccuggggcauggagucuucaaccucucuaugaauggcacaccuuagucacuuauguuacuuuuguguccccaccauggguugggggauuuuuuguuuauucugaucuaugaguuuugaaaaagugaauaaucaaaaggaaaauaauuccuuguuguucauaaauuaagcaucacuaaagucucuugaaaggcauuucuguauugggcaagauuuaaaauacuaaagccuuagguccuauucauauuuaaaguagcauguuuguaaccuguuacuauuuggagagagaagcaguugccugccaaauugaagacuaccuuucaaauagcaaaagagagagagaaggcugauauuucggcuuuuaaauaaagauuugugugguucugcuuuuacuguaacugucacuuucccagugaaaaugauuucauauacauugagggucuuacagguauggguaaaguucuauaaauugcaacaaaaugauacccaauuucauuuuauccuuuuuguauugugaaacuggaaacuuuaugacauuguaaauuaucagcugguuuuucugaauauaaagugugaaaacacagaacaguauuuugaucuauuugauaauuuuguggguuuuuugaagaauuaaugagcauguacauagaaauagugacugcuugaauacuguauuuacuugcacucuuucaguacaucaagauuccuguauauuuuagaguauaauaaaacacagaugugaguuguauuuaaugaauaauguauuuguaucugugcauauuaucuacaaaucuauaaaguuucuagggcauugacuacuagauuuuaagcauuuuuucuaaaauauuuacagaaauuauaaaucuaaucccccaucuuuucuuuauaauauaaagaagucauaaugaacccuuccuaauuauuaguaguaggaaggugaauaugcauuuuaaugacaguggacuacauuuucuauuguaccuuuugaaaaaaaaaaaaaucaagcagauucuaaaaguauacauaugugugcuuucucuuuccuuuuaggaauucucuucugaauucccugagggaauuuucuagaaucucagaauugaaagagaccugagguucauccagucucuaaccucuuaacaaaugcaggagucccuucuacaagggugaucuuuccaccuugaacacuuccaagugacucuaccucaccaagcaguccauucaguuguugagcagcucuaacuguuagaaaggucuuccuuagauggaguugaagccucccucccgguaacuucugucuuugggccugggucuguccuccaagagaacccugagaauguuggaaggaugaaucucgcacauucugccaugucuucucuuuuacaggcuguuugacuucucugcugaagugauuuccagaaggacucauuugacacacuauuagauuuaccacaucuaaugaaauccaagguguagcuauaaagugacaagcuguuuuuaauuuaucacauacaccagaacuucuauccugcaucacuuauauguaaaugaugcuguuaccaaaaacauuaagguaguucuugcgaaugccaccccacuaagaaaacuauuucauuacuuuuguaauccaucugugagagucugccccccagcuuaaccacuuccuuuggucugcacccaaugaagggaaaccccaaaguacugucucaaaugguauuugaacuacgccaguauuguuggaauaaguacauuaauuacuugaaugaaugaacacagcaccguagaaauuuccuuuaugguuacaccuuguaugucuaaagcauucaggcccuguucuguaguguuucuuauccucacacagaguagaaaagccuguuugcuuuauuuaacuuauacauaaaagaugacaucugaaauaucugauguguauuauaauaccagcuucugcucuagaacuacuuugggugaaauggugguaauagcaaaugaccuccuuuaacaagacacucaucucaaacaaugccauuuaguucaggagaucucuaaguguagcuguaaauuuugggguuaauuuggcuuauauuggaccuuuuaaaagaaauaaaguuuuuuaaugcaauaa

SEQ ID NO: 192479 - RNA, 159060 nt, Homo sapiens
ggacugccccgcccugguccagugauugaucagcagugauuacugaggcuuuaaugguccgcuuggaugggaauuaauucugggauggauaaauaaugcaucgagguuuauguaguccaaggcgagccguccguccggagccaggagagguagccgagggagccugacgggugacgccagcggccacggggccccgaacgagcaggacaugaggggcgacuaggcgcgaggacgagcaaaagcaaguggaugacagcaugaacggcccugcggggcuggccggacggcugcaagaacaugcugagcccaaagaucaggcaggccaggagggguaaguccaacuuucugggguuucucugggcaccgcaugugccucuuggcaaacgugcgcggacacuuggccagccgucacgccaugugucacauggggcgggcguucugggaccauugccgcugaauagugagcauccuccugaggaagugcccuuccucgugaaacuccugggcuggguggggacacgaccugaaguugcaaaagggcgguggccggcuuagugccccagugggugugcacacuucgccccacauuccacauuuuacagaggcccucggucgcuccaggugaccugguggcaacuuuaaggaaacuuugcuucuuuacuaaaaaggaaaugcccaagauuugcccuguggccaacacagaagcaccccuuaccagggaaggccaugcccuggcuucuagagacagcugggugcaagcgagggucuucguucccgcugcuuugcagacaguauuuccucaagcaggccaggggcaggcaggcuuuccugccagaacacucagaaagcugcagggucugggggcaggacggguggaugcgggagcagacucagaccagcaagagaugggggucaggagaguccaggacugggcuagccagccuguguccagccagcgacccagcacagugaccugaagacuuggccacuguauggggcuagagacagcaucuccauggacaacaacuucuuagccacggaaagugucauuuugaaugagaacaucugucuuuuacaaaaauagaaugugucuuuucagguggccaguaucugggagggcugagcuccuuuuguaaacaaugaaguggaggaugggucuuuggagguggauggagcauuugccugggagcuuggaaacaguuugugucucaccagguguuugcagcggggggccuccagccuccuguggauucacagggaacacacccaucuuauuagcacacugcaagcacuuggaugauuuuccuggaugggaccagccuuccaguguguuccacagacgucaggaccccucuguggggugcuuucgcaugggcugaacccuguguaccccaaugggcaaaggaggaacuugcauggcucugcugaggagggggcaagucuagugaugacccaagggauaggacaagccagauaccucugcgagagcuuaguuccacccucccacuccuguguaaugagcuggccacuggccacauguggcuacuaagcacuuggcaugucacuaguccaaauugagaaaaagacacaccaaauuuugaugauuuaguacaaaaaaagaauguacaauaucucauuaauaauuauuuuacugaaaugacaguauuuuggauauauuggguuaaauaaaaucuauuauuaaaacuaauuuuaccuguuuuacauucuuuuacuauagcuacuagaacauuuacaaguacauaugugacucauauuauauuuuuuauauuucuauuggacagugcuaguaagagaccagugcuucagcaaaggggcuuacaggcagccugucuuugaaauccaggauuucucauaaauguuuguuuuaagucaaugguucucaaccaggagcaauuugccccacuagagaacauuuggcauuguuuggaguauuuuugguuauuccaacugaggggugcuacuggcaucuagugcguauaggccagccauacagcccucuuccaguccucaguguuccaugaggcuuccaccauagggcuuuugcacaucguucuuuccccugaaaugccucccacauucacaugugcgcacaugcaugccuguaugugugugcacaugcguucaugcauacaaacauacacacacaccuuaauuccuauucacccuccaguuauaguauaguucaaguguugccagccagggaagucuucccacacaccccaguccaggcuggauccucugcuccaucucuccuuuucuuuaugguauuuaccauagguugcaguuguauacuccugagugugacugauuggugaauaucugucacuugcauugcuccaugagcuucgugaaagcaggaaccauuucuguucggggacaucauuauacccccaaugccagguaccugguggacacucaaccuguguuuuuugagugaguggaugaauagcuggauagaggagaaagcauuugccuggguggcuggagcacugucucuacccaagcuggcccgguacuuaggaaauuuggccucaucuuucacugacucauauguugcaaauauuuucccaauuuguugcuugcccuuuauuuuuauauuagaguggguuuuuuuucuagauguaccuguuuuuaacucguauauauuuuccuuuuagaauuucugucuuuguuugcaauauuucaaaauaaaauuguugaugcuauuaaggaggcuccuucuuuuaaaggaaaucaucagacugaugggccaaguuauaggagcuuuaaccaucuccuguagcaggagugucaaugucucaggagccuugaugaauguucagagccuggucaauacuuuggggguggggagagaaagcucuauuaauaugaugaaguaccuucaauggccuuauucuugugauugucccacaagaaaguaaaccaacauuuauugugcacccaugcuccaggcacuuuuguuguaccucauuuaauucucaugacuacacuauaaugugauaucauuguuaccauuuugacagauguagaagaaucauggucgcccagccaauaaaugugggaucuaaauuugucuguccaaugcuaaggccucugccuucucucuaacccaacacuaucugaagaccucugcaccuggcccuguacaucuccaugagagcuguagauuauuucagugauaaaaugcaaugauauuuuuaagaaggugcaucuaaacacauggagauuagaucuagacaacucauagaauguuugagguuggauuauugauaccuagcagaaaacuaagcaaauaaaaaacaaggcaauuaugaacuccacagaaaacaaaagugauucaugaaagaaaaauuauuaucauauauaacauaccucaagugggacuagcaauuaaacggugcuaauaauggaaauucuguuguuaaucuaaccaaaauuuuaauauaacuaauugggaggguggagugggugcuuauggaugguggggggaaaggguguaaaagaaacaaaaucuucaucuucuauaguaagaaguuaauaaauaacacuuaaaaggaaaaaaucaagaagugguaauaaauaaauacuaucuggaaacauagaaguaauaccaaaagaaccaaugacaaauguugaaaguggcugccucugugggguggggaauggaaguaaagggauaggacacuccuggguuuugccccaaggcugcaggacuacuugaaaagugguuagggaaucacagcccagaggucaacugaccucauaccugcucagacugggggauccuucagagcccuggaagauucugcccuucagggacacucauaggguuagcaggccuccugggauugcuuaguuaugaauguuguggcucccaggaugugcccuuggcgaugcugugaugccccugcccagguuugucagguaccaugauggcucccuaugacucucaccaccuucauggcucugagagugaagcagcuaaggaacagucaccuaauuaggugacacagcaucuggcuuugccugauucagagagaggacagaggucuagcagaauggucaguaagauaugcugaagaaggggcguauuagaacugcucauggaagggugcauccaggcugugggcuggagcuuagccagggacuagaggccucagaagagccugcucuggagaaggaggaccaaagggaaucacccagcagucucuacuuccaggccaggcccuggcaccacuguuuguagcugauaaccuuccgugacagcagaggugcccaagccuggacauccucugccacuagccagguacuccaccccauggagagaaccaagcugucucuugucaguccauucuaaaaauuugcucagaagugaaaugaaguugcagaggcccucagaucagcaaaggguccaggacaaacccuggggaaccugauucgaggaaauaaaaguuugcaauuuggggaucuuugaacaagaguggccucaaaucacacugcagccugauuuuuuuuuuuuuugaauacuccucugggauuuucauuguuuauuucuaaaauuuuuaacauuuucuuauugaggcauaauuuacagaguaaaaugcacaaaucuuaaguguucucucagugaccagccugaagaucaagauauaaagcauuuuccuuaagcccagaaaguuuucuccugugucuucccagucacccuggcucgucucccaaccagagugacacuuuucugauuucuagcacccuagagugaucucaccuauucuucaauuuuauauaaaugcaaucaaggauaugacuuuccacuguuaauacauuaaaggccacaaacaguccuuccacuuuccucuuuaaggaaggaaggaaagugagagaaucucuguugaguguuuagaaugugccagaugcaagcuggaccuuccauuacaugcaaauguccuauuuuaaucuuuacaccaacucugugagacaagggagaaaacagaggcagaauaauauaaguaaaaugcucaaaauugcaccacuaauaagagcagaagcagcuuaaacacaagacucugagaucugagaagccucccucccaaaucuagugcugcacagaggcagauggaggcugacgugucacugaacagcucaugcccccagggaugccagcaauacaaagcugucagauccuguccaacccucacaagcaccugucuccauggcagguacgcacaaugccaucacuaggugcaggggccaaaaugaaagguggagacaggccacccacucugugcuggccugucccagauuuguuccccugaaagucagccuggccaagcagcaggcuagugggaaaggggagggggaacugaugggccacagagcagugggcacccuguggaguuagcccucaccaguggugccagguguuggccauggauacaaagguguguggugggcucagaugggccuggccccugccaccuggugauguugaggaaucccagauuuggcugcuauuuuacuucaacucccauauuucugggaaaaaagauuggcuauuccaaacacugcaggcucggguagcuuccccucccugcucacaugaggagucagaacugauuuaacucuucaugcacuuaccaagugcuuaauaaucgcaacaaccacacuaaugacuguugagcucaugggacaugcugucaagcaagcacagcacaugaaaugacuuuacuuguguccuccaguguccccacguggcagucccuggguuaacucugggcaugccuggauagaggugccccagggucacuuuuguuugcaacauauaagaccaggucaacauuucucgguccaugguagcaggcuuugaccuaccucuuugaaagcaugcuuccugguuugucccucacuuuagaaugucacaucccguguggcuuggagcccuguuggaacuuccugcuugaaguccuauugcaccuagcaugugcagucacaugcauuaucucccuucauccucaaaagauucccauugagaaaaagaccacuauugccccauuuuucggauaaggaaauugagucccagaaaggauaaagaacuugccagccaggaaggguacccaaccaggaaggggcacugcugggaucaagaacccaaaggcuucugaacauauagugcgugccuucacauuuacaugccaggcuuggauccaggcagcaagagaggaaagcugccccagguugugaaagccucugugcuaaggcccagagguggcaaccuggggcaagcggugugccccugugguggcugcaaugcaggaaggcagugggaggacaaggugaugugagggaaugagccugucccacauccaggcaggguuuuagacaauggaguggcgugccugucuggagccuuagucaaugaugcaggcugcagugggggcagcaggugcgcagggaguggcccugagggcagggagagaggguaaaugcuagugggagcaaugguguuucccgucugccaccugcagagaaggagagggagacacaggggccuuuguugaaacagaucuauggagagcuggguuccucugcuuccagacacucuucccccagugccagcugugugcugggcagcagcuggcaccuccccgcccugcagaguuuguaaguaccagaguguuucagcaccacaagcugagaacaaacacucccagccaccacccuccacccagcccuuaggccaccaguccaucuguugcugccugagguucaugccaggagaugaagguggcuguuuguacccagaagaggggcgcugcaaacucaagccucuucccccaccaacccucauguucuccuucuucccagauaacuccaaccaacugaugggaaaacagaguuucucuucccacggaagauguuagacauccauaagugcccccaccugaccagugcucuuagacacucagaacacacagugcugcuaggugcugggcuggagcagcuccaagcuggucuuguagccccagacagcuggagaacuggccaugaccuuauuguuugaaggaggggauaaaugauuuauuugcaagacaggccugaacugaguuaggcgugggccaggaggccaccuuggacuccacuauccaaggcagcaagguagucaggauccugcccugacucugcugaaauccucaccagccccagugauuacuuaaccaaggguagagaauauauugaucuaagcuaauggcucauaggcaggcagaaaaugaaauuuauaaucgacauggaauuauauugauuuuaccgaucccaggcucuuggugaauggccugcuuaucugaacagagcagaaacagcaagcaccugggguccugggccaucagccccugaacaaaguccagaagagaggagagaggcuuccaaggggcacagccugcgggagcaagaaacagggccuacacuguucacucagcacuuaacugcucucaaagaaaauugcccauugauuucauccucaccacagucuaggaagcagcaggauccguaucuggcccccauuuauagacagaaaccugaggcucuaagaggcuaaagggccucgggacucagaauccugugcaucuuccaugaccucccacugccucuccucacccacugcuaagcuacaguuucacuuuuccacucuccugcuugcugcuucucugauuaugggcagagaaucaguaaucucaugcccuuuagcuuuucauguguggaaacaggccguggguaggagaauccuguuggcagauuucuuccaacccaagcagaucaucuacagaggcacaaagucucuuggauuugaugaguucccauccucuucaaacuugaggauuccugccucacauucgcagacaugagacacauguuuaugaaggagaggugcauguccagccagaggugucagcaaggucccaggggcagcauaagggauggaagucaaucauucugcguugagagccuaccagaggggucuucauaccuuaggaaguaauugcacugacacugaugcuucaaaagugagucaggauucaccagcagagucaugaguccagggaaagggaaaggcagacauacagggguggagguguggcacaauggcccaugcgggaccugucagcuuggagagacccagguguguggugugagagggaggaagcugggcaccagcucacagaggcccuccacaucacagccacaucagacccaugucucugauggcuaaggcuguagcgaaaacugucuacacccuguaaagggggcacggucucuuccaaggagccacgagagagacaccagaauggguugaaggcagaaguuggaagagguccaacaggcugcuuuuucucagaggguggguuuucauuagucuggcaagggcuuaggguauggucucuccuaagacaggaauguggguccuaugagagucagggugaaaagccuggaaguggagccauacuuccuggucuggacucacccucucacuuucugcaucuuccuguucccgugcugggcacacuccaccucucagugaggcucaccucauucauucaucccuccucaccucaccccggcucccugcccccuccagccagccccaccccaagcccgacugucucacugcugcugccuucacacuccccucucccuuuauagaugacagcaagaucugguguuggggcaucugucccccguuagcucugccagggcaggugugugucuugcgucuccauaugcaguggcucucacaggugggcauacgggaggccccauaaucucaagaauggauaaaugaacaccagauccgcuugaaucuagggcugcauccugcauggaaguaaagagcaaacacuucgggugucucccggcuucccacugcccuugcugaauaccagccucagcugagccaggaggcagacccaggaagcauugauuaaaauaacuuucaagaaugcaaucuuuuauauugauuguuaaaucauuaaaguauucacuaugaaaaaaaaauccaaacucucuaaucuaccuaaucacuacuuaaaaauuaauauuuucacuccugggggcaggaauggauaggcugugcaccuuauuggcucuaguucuucaugccgaggcgaggcucauuaggagggccuggcucauucucuagauccccuuagauggaaaccuaggaacaaacagguggccaauuagggccaggaagaaugcaagucacaaauuaagcuggguguaguagcucaugccuguaauuccagaagccgaggcaggaggauuacuugaggccaggagguugagaccagccugggcaacauagcaagaccccaucuuuacaaaaaaaaaauuagccaggcauagucauacacaccuguaaucucagcuacucagaaggcugaggugggagaaucaucugaaccuaagaguuugagccugcagugagcuaugaucaugccacugcacuccagccuaggugauacagcaagacucuaucucaaaaaaaaauaaacaaauaaaacuauacacauauauauaaacaaguuuuuaaaaguaggggcacucaagaaccauuagguaauaaaucaucugaugcuugugcacaauucccaggacggugugggacccggaaggagguccccuuugcccuuggcagcaaauugcauuaacuugaugaaaccaucucuucccggccccuccagagugcccuuccaauaccccaucucucucuccucaaucaaucuuuuggcucaauacuuacccuuuaaaucaauucagcucugagauccauuuugcucuuuucccagcccggcuuuaaaaucucauugacuucuauaaaucaauuguguuuuagcucucuuguccuacagccacuucuccaugcucuaggggcugcacucacagagcugcagauaggaaacaucccuggcccacggcagggugccucaccccagggaguaucuccagagcugagagcccagcagcugcucaaaggcacaagucuauucaaaggcugccacagucuauucaaaagguccugaaaacaaugaauauguucaguggggaucuccaaaccaaagcagacccugagauaaggauucacaugcaguaaucuauuaacgagacccucaggggacacaguugggggggagggggagggggauccgaaagcaggacaugagcaaaguccuguuacccuuucagauguaacaggaaagggaggucucagccugagcccccaacugaagagugaaguacaccccuguaccuagcuagaaauaagguugguuagagguuuuuaagcuccuaaguugggcgagggguggaugauauaaacuccuaggcacucccagucuucccaguacaugggcaaaacaggcuccaguagcccaaggccggucuuccaaaaccugucagcaauccugagaaaccaccacccaccccugggaagacuguuggaaggacagcacauuuggggguggggagggaaauagacacaggaaaagggauucaagagaauuugggcagagcuccaucaugauccauaugaucucagagagcaaugucugagcuuuggcagcugccaggugcucuugucagugcagggcucggcccaugagugauccacacacccucacugagccccugguuggcaagagagagacgggguggaggaggcaggcuggagucccaggcucacccaagcagcucaccugcagagagggaccagugugcucacucacaguucccugaugguggucccaugggaggaccacagauaggcuugguccaggcuuccaccagcauccuggccuguucguugugggcugaucgguguuagucucucccacuagcuugggagcuccaugcaggcagaggcucugaccuucuugcuugcugugguccagagccuagugugaugcuugucucagauaaauacucauaagcauguaucaaauaaugauccuuuaauugcuauuuuagaacuccuguaaggggauccagcuccacuccaaaagagcucuuucauuuaaaacuuuuaauuguaauuuauauaauaaaaaaauucauucccuucaugaaauguacaauauaacagcuccgggcuucccuuuaggaacauuaucaccauucuaggugggauauguuccuuccagaccuaacuguguacaaacacgagcacccgcugagaauacauugcaaugucuuuuguuuaggauuuuuguuuuucuuuccuuuuuauauaaagugguuccccauauccacaguaucguguuugcaguuucaguuacccauggacacccacaguccagaaauaaacgauucauaaguuuuaaauuguaugcuguucugaguagcguggugucccacucuaucuugcccagcacaugaauccucucuuuguccagcaucuucacacugucuaagcuaccugccuguggucacuuaguagccaucucagcugucagaugcacugucgcuguaucacaguguuugucuuccaguaacccuuacuuuacuuaauaauggcuccagagcacaaaaguguggugccaauuuaguaauuaaacuuugucauagauauguauguauaggaaaaacuguauacaggguucaguacuaccugcaguuucaggcauccucaggggucugggaacauccacugggggucuaagaauauaucccuggcuugaauaaggggagacuacuguaguuuuauauuuuguaaauuguucugcaacuuacuuucuuccacuucuauaauauaauugaaguaaauguugagguaaagcaggaaggagaaauggagcagugggggaagcaguuucuaaagagugauaagagaggugucguugaaaaaguaauguuucaguaaagagugaaggggcugagagaggaacccuagggcauccgggagggcccagagagcagagggcauauggcagguguagagccagaugcugggcacaugucuguaggaacagcaggagacagugcggccaggacaagagaggauaaaggaggccgagaggccguguggccgguccccaggacccucauaggccauagugucagaucugacuguugcucugagcgagcucaggaaccugcaggguuuucacagggcgcaaugugaucuaagucccacauuuaagaacucuugcuggcugcccucuuuugaagaggcugcagcaguaacucgggugagaaacaaagcagcugggagcagggaauaucugaggaugggguauccacuggcugagaugggggaacccugggaggaguggguucuggggcagggaaagaccaggaguucugcuuuggacaugcagcauuggcagggucaaggccaggguugagccacaugagggccuucugugcauggaugguguccaaacccaugaggcagagauauagacagacaugggggccaaggacuagcccugcacacucagcacugagaggucaggaagacggggagaugggagugacagccggugagggaggggagaagcgggggaguauaaucuuggaacccaggaguacaaagugguccugggacugggauggaucagccucacaaucaaguguagccaaagggccaaagaaugggaggacugacuggacgcuuggguugaacaaugugagagucauugccaacgugguaagagcaguucuggugggacggauguuggggaagccugacugaagcuuaacagagaacagaagccaggugcggugacagauacccguagccccaccacuugggaagcugaggauugcuugagcccaggaguucgagucuagccuaggcaauguaguggugagacucugucuaaaagagagagugagagaaaacaaggcaggaauuggagacaaggauugaagacagugaggugcuggauaaaagagaagcuaaccauguuagcuuguauauuuugaucucauucuuuucaagucuuuucuaaugugaauauagcacaguuuguccauuuucuuacuaacgggcacucagguuuuuacauuuuuagauaucaaugggcaugcuugauugugacuacccaugcauuuguaguucucucugcaggacagaggugagcagcacaauuguuagauugcagagcaugcauguuuuguuguuguuguuguuguuuugggguuuuuuuuagacagggucuugcucuauuguccaagcuggagugcagugaugcaaucucgacucacugcaaccucugccucccaggcucaaggaauccucccaccucagccuccugaauagcugggaccacaggggcacaccaccaugcccagcaaauuuuuguauuuuuuguagauaugagguuucgccauguugcccaggaugcacguuuuuaauuuuaaugaauacagcccaauuacucucuauaugugacuuaggauuacucacagccucgccaacaugugauaucgccaaacuuuaaaaaaaaaguaccuaucuaaaugguacacagugcgguaucuuauggcuguagucugcauuuccccucucacugcugaaguucagcauacccauacaugcugguaguuauuaguauuuccucucucucccauugcauauucacuucuuuaauuuauucaauucugagaaaugaaggaucccuccuggaugagaaaauggcgugaaaugguuccuccucugcuggcccugugccucggggugacuucgcguugcacaguccuucugcucuccucuaacgaugaaugaaccuuuggguacuugaauuccauuugccuacacccaggguuuugaccucuuguguuuguguuaacguguuuucaucucaggcuucauuucuuuuugagucugcgggcucgcagucacccucccucuuagccuggcgcuccuccucucuggaggcucugagcugaagcacuuaagggcuacucaggcuccauuugcagucucagaacuguaguguccauagugagcaagaccagccagggcuugaaucccggcucugccacauaagagcaauguugugugaccuugaggaagcucuucucuccucugagccucaauucgaacaucugagaaaucaggguugcgcugagaaauaagugaaauuauucacugccgggcccuagcucuggcagucacaggcucuugugaacguccaucccuuccacugcccacccaccccagcccuacccugcccaugcgcugaauuucuucuuucucucaucucaccccaagaggaagcaauacccccaugaccaccuccagaguccccaggacggccaggccagagucauagagcaagcgccaaguuuaccauccucagugacugggaaggcgugcagcccacguccucccucacaggccagauggcccggcacagcgcgaccuguaguccugaccaggccacucaaggguuuaugggcacccuggcacaaaugcagcucagggcugcagcaauauagaggcaugggauggggacguugucagaaugagcacaaggagggcuauggggaacagguagacucuccaaucccagcagguagggccucagcugguggggcacuuccgagcagaggaaggccucauucuugcuacagggcaccuccuugcccccaccacaaccgaggacagugucuugccaucucaugcuaaccucugacccccugagcucaggcuccacauccugucaccucccaggaagcucccucuugacucaucacccuaccugacccucacccacagccuccacaucugccaguccaaaugcacuuaaaccggcucgggucccucccguucuagcaaggggcacccugccccuccauaccacucuccccucuucucuccugcuugcagggaacauuccugaaagaguucucuaggcuucuuugcuguacucccccuccugucaccccuacccucucucuguaaaguggcccuuguguacccucaccccuccacccaugacacugcgaccuuaacucucuucccuuggcgugguuuaccugcuuuugaaaauuuuguuuauaauugacacauaauaauuguacaugcccguggggugcaguguggagggagcuacacacaggaaaauccugugcuguggaaggguagcgauugccaggcuggggcuggauuuuccucuguguguaguaaauaccauaacuacuucugugaaaagaguaagauuuuuuagaacuguguguaggaagaucuguguguagcucccuuaguagcugcauaucuauuuuggagaaucuuguggaaggcaggagcuaagagucaggaaguagcccaggcaagggauggcuauauacaaaucaguucaguaaaggggagaugaaaagaaggcagaaugcacugagagaaucuucagauuuggaaacuaagggacuguaggacuugacggggagggauuugucugaacaaguccaagcuguuaagucugcuuggucauggagcccuggaugagaauggggaggagaaguggguuggggagagacauguugaauuuggacauaggcccagauaaccaugagacauuucucuggaguguccugcagaugguuugacacaugagucugaagcuccugaguaagauccgggcagaaauaacgcccugggauucauaaugaaauagagacagcugggacaacccugggcaacagcaggauuugggaggauggaggaaguugaagccagaagcaggcuggggaagcggaaagaaacuugagcaaaaacgcugguauuugggcucugcagaggggaaggaaggaagagcuuccagaagcagagggugauuaauagugucugagccaccacagggcaucggaggaugagacccugagauccaauucagguuggauuuggucagagcaauaucaggagaggccaaaaucucuaaaugcaaggaguugguggggacuggggggugaggaaggagaggcagguaugugggccacccucucaagaugugccugucagcaagaguaggugacagcggccccucggcacacgcagucaugugagccaaaagauugcaagugccaggcuagcuucuuccucccaagccugagccccaccuccccugaggucaucccacacucuaguauccuucgaggccuggccuggggccucccuccacgggguggagggaccucagcagaggucuauagcagaaaggucggcaccucagggucagcauccacagccuuugccugccccacaaggccugugcucuuucaucccuccguggugguugugauuuacuuccccugccagacugcgggaccccacagggaacaccaucaagucaauugggcucuguaccuggaggagcuccauagauuuggaauaaauggaugagugaauggaugguccugcgugugcauggaagagccaccuuugggaaggguggagggugaagggcaccuuccuccucucugggcccugagcuugccugggccugcuccuggggacccuccagaaacucugaucuguucuggagacuuagaaugccagagcuguuugacuugaggccugguuuaaauauuaacaggaccaaauaaauugauuaaaggaagugcugaagaccggaacagcaguuauuaauaaaucauagcaaugauuauuuuccuuucaagaagcuccaucagccuaauaugugugugauugaucagcuggggaaaauccuaggcugguuuugcagcuucaguagcaucugcaggaagugcuuccuugucagagggacuggagccagccuuuccuauccugcaggguggggcagguggaacccucggggaugccuacaucuacugaaguagagaccacccagagcuuccugccuacccuugccccagugaacauggccccccauaccugcucccuccuuacgugaagcucucaggaggccugaugccugggccuugggcaucagggcacagaaugugcccaccuucuuugucuugccacauugacuacaggccagucccacagucagccauguauugauugugcaagauccugcucucagccaggcucagcauccaugguccuaugcacagggagcucacccuucuuggggcaggcaugccuggacagagagcaccucacagacauuguccaccgcugggacagagggugcagcagugcucagaggagcuggacugugcugaugaguuaccgaguuuuuguugagcuccuaaugugcaccagcccugcacaggaugcuaugggggauguggaaagaagagcaagugcauuuaaugaaccagcuucaggccuuguuguaauagaagacaagagacagaaucagggauguagcucuagaacauuccaugacuucaguccccacuaaagaccccaaagaguacucugcaaacaucuguggaaggacaaaauguucuccauagcccuugaagauucucugauaagagauaaaggagaauucaagaauagacaguggagaccuaagccaacccaucagcuccagagacuccucacugccaggggaaacaacaucugccaagucucaugguaggaaucucacuugauuaaacaaaaaaaagcccaggcacuggugaccuaauuugacuagcaauucucaacccauugaaggaauuuuagagaugagcaaguugagacccagauaagaaaacucaguaaucaaaggggcacaccucucccuguccuccuuaguccccugccagacuccucucgagcccagggguccugauaacacuugucagcuccaccucccagggccugaugcagccccaacccuggaaagggacuggugagugcugcugaauccagcccugcucaaccccuugcuggcuugagauggagaaggggaggcagcagcccuggagcagaaaggccccuucugaugcuuugggucucuucuggcacaaccccaccugucuuaucagaggcucggcucacccuuaucugggcagggugguuucuuccaagucuguguccuccacacggggcugcugagguugcagagcagccagggcugugcagcacagaugcgggauagggugcuacaggugucuggaaauacaggugucuggaaauuccaggcuguaggaagacuugcagggaaggucuggggcuccuauggagagggaaagggggcccaguagcucugggucuccaggacuccaggauuguaugccacugaguuugacucagugcuccuccugcugugggcaaucagcuaaaugggcaaauggagcgagcagacgucucauacaauugguagaagcccgugcaaagauguuccaguugauuaaucacccaaaaucagaacagcuaagacaauaacuacgugccauuuuauaccuacuaaauuauggaguaggaacgcucaaauuauacuauuuuauguugguagugauggggaaaguggcacauuggcauaauuguuugguguaauacagccaaaugccaucucuagaaggcaguguauagugacauuuaaagggccaggggccagagagugguccauucucugcccugugaccucacugcugggagcccagcuuuaggaaacaaauucugcauggagacauccacugcgccaucuccauuauccuaauccuuaucaccauaguaacccauuacuaggcaccuguacgucuaagcacucugcaguuaugcugucuccccucugccagcuugcccugcugggugagguguuguuaucucauaugggcccaguuuucugacuggcaaacugaggcacagagaguucacagagcuggcagugaugcaaacucaaaccuuaguccaaagccuguauuucuucaguugggucccaacgucuuuuuaauuaaauaacucacauuaaggagagugccaauacccaucaaugugagaaucuaaaagcaauguacgguguguccauuugcagggauaauaaccagccauagauauaaaggagggaagcacacucuaaauccacaugaacaagugcagggaccaaccccacagagaggagggaaaaaaagugccgaucauucugaaacacagauaaggugaagcucaagcccaguuucagggcgcuguugggcuucagagggggcuguuuuccuugaaaguccugggccaugugauccacacucagcucccugauuugccuucccguuagucucuggaaaaaacccacuguccugaggaaucaccaauccagcuucaguguucaggggcaagcaugcaaacaacccacuuccucucugggccaaaacacagccaaggcaaggcuagagcauucaaccccaaccucuccagcagcagagggacagcaacagagaaucaagguggagcgggugaggaccuagacagucugacaccaggguggcuagugguacccauagaucuaucacagcugcuugggugccagagagaagagaugaggccuccugugaaugcugcuguuguccaugagcagcagccugucuggaggggacaaccccuuccagagcaggggccuguguaaaagugauagauucaguauuauaccccaggccauaugacaguugaggugaaggugugaacaucaguguuggagugauuggacccaauaccaggcugugggagcgaugaaguccagcagagucaaaggaaugagaaaagacaaguuaagagagaaagugggaucagggggccaauguuaguauggaggccgugaaggcccggagcucugggagcccacaccauuuauuggugaucaaacaaaaaaacagguggugaggauguggagguugaaaggaagcaguguaucaagcaaaugugcuacagcugugaugguuuagcauuuucuuugaaacauauggcuacuugagauaaugggagugcuagaagcaaggagccagcaagucuagacacauugcaaaguccacgagggguuuuagucccuggacccuggacauguuccaagcccugccucagcuucucucucaacacucagcuuuucucccaacacaccaagcuauaauguguccucagacagugccugagugcuauguaauuuuuuuuuuuuuuuugagacugagucuugcucuguugcccaggcuggagugcaguggcgcaaucucagcucacugcaagcuccgccucccggauucaggccauucuccugccucagccucccgaguagcugggacuacaggcuccugcaaccaugcccagcuaauuuuuuguauuuuuaguagagacaggguuucgccguguuagccaagacggucucaaucuccugaccucgugauccgcccgccuuggccucccaaagugcugggauuacaggcgugagccaccgcgcccagccaguacuauguaauauuuacugucauguuaagauacaaaaaauaccuaacaauaagggugacccuaaguauccagugauauuugaccaccaugacuuacgucuguuccuugccccccacaguaacgaggacacgcauguagaaguggguaagacaucaucuccuccaguccccacccuucaguccagaguggcagaaagacaaccacacagauaaucaccagccaugggccaccuguccugguaggggagggagugacuauuuggaggagauucagaaggaagccuccauggaggaaguguccuuugaguuggcucuugaaggauauauaggagcucaccaugcagcuaaugccaggguauggauggaagagggauggaagaaaaguccaggcuagugggaccacaugggcagaaguaggccaggcuuagagaacugcagucacuaguguagugggaagagcuuacacccacacacacagaaucacagauacagugcaagaauuguaggucacaggcacugugcuuuccaaucacaaguuaggauccauggccuaagaauuacaggugugauuacauuugaacucagaauuauuucuccagaguucaagauggccccuccuagugaucacuguggcaauggccuugacacuggccagagagaggagaggagcuucccuggggacagaggagaaugaaggagggggacagaaggggaaggaguaggggcagaggggacaagaauucagucaucccugugaagggcagcaccaaccucggugggguguggcucagcaccaucaaccagaauaaggaccugcagggcucacgggcacucagaggcucugggguaggagugcuggccccucugcccugccaggaagccaccaacaaggcacagcaaacagcugaagaagaagccccgcugugggauguucccagggaacaaauacaaaggcuuugggggcucggaugccuccagaguagaggggcuaagcagaaaccagaucuggguggggccaguuccuucuggaccugagcaacaggaacccugcuagacugugagcuccaggaggauccagauguuuaucuguuuuuuauuucacuacuuuguccccuggaaaacuagaacgguucuaugcacauaguaagaaaucaauaagcaauggcugaaugaauaaaugaaucguugaacaaaugaacagguggauggaugaauccguggaugaacagguggaugcauggauggaugcaugguuggauacauggaugcauggaugaacaaauguggaggaaugaagaaccuaggaucccagagacagagcagaaacuaaccaggugggcaggcuguaccccuaccccagggggaucacugcaggcugcugcacagaugcuccaacccaugccccuucaaugccaaggggaaguaggcccagcugcucacauccugcuggccugggcucccaugccucagucacgaggcagcugggacaccaggaugggggcaggacugauagcaggcacgcugccuucaugcucacucuguguguccuuggcuuucagcccgcuccaaaagccuagugaugggggagcagagccggagcccugggcggaugccgugcccucacaggcugggccccgugcugaaggcgggcuggcugaagaagcagaggagcaucaugaagaacuggcagcagcgcugguuugugcugcguggggaucagcuuuucuacuacaaggacaaagaugagaucaagccccaggugagaagugcauguccggugugccgugggcaucguggcagggcuccacaagagggaagaccaugcccaggagaagggaggaaggcacagagccacugacuccaucacagugauguuuugccaggauuuccaaaguaauuuucauucuuaucccccauguuccugguaucacagccuguuuuacuggaacauguccacaacuucugcaaugaaaauguuuccuuaaaauguugauagagaauguccuuguccaacuuaagaaaacaacgucuuccauguucuuuuuggccccuucaugcuuccaagaaggacauacaugcacacauuucauuacuuguaucuugcaggaaaaugggucaccagacacaucuagccucaaacugaaaccuggcucacucugaagcccuugcacccauccugcauaggguuucuguguccagcacugugugacccacauuuuaagaaggugcuuuaaauaucugccuuucauccaaauugcacuaaguuuacucccucagagcagcuaguagccucgcccaucacaguauagccucgucacagcggcccaugcaaacgucauaaugagguacucugugugcugccauccaagacaccugggccagaagcacuugggcaauccagucccugugauggguuucagagagagaaaggguaucucuuggggauaaaacaggaagggaccuuaaaggacuuguccgaaaagcugcuucuagucauggguccaagucagagagggcagauccccuguucggugucacaggucacggaaucuugcugggaagggaccugguucacaucccagccauccccacagcuugggggcagagaggggacucugggaugggcaaggggugaagggggagcugggcaugagaaaaugucccuuuccucuuucaguucuucuaagcaugucaaggaugaagugucaacccugugagccuaccuuugacacuucucaaacacuuggauccuccuuuuaaacaaaauaugggggcacaggggugaaaagggaacaggccucaucuuacuuagagcuuucagugcaacaggaacuggcugcucaugaauaacuuucugucuucguucuguccauuccaauagcuaccucuauggaaaguucccgcuugugauagagauaccaaguuuuccuuucuaaaauaccguauauugacguuaaaaccaaaaguguuucacagcaacgugaaugcacuuaauggcacuuaccuauauauuuaaaagugguucaaauaguagacuuuguguuacacauacauuaccacaauaaaaauaaauuaauuagaaguaagacugcuucaggaaaacuuuuacacaaauaauagcacagaugaaaugugaguaugacaaaaaucaugaagguggauucagaaaacccugauguuguccagccuccuugauuguaugagaaaggagaacucuaaguaguuaagugagccagauaggaacucuggagucagcuagaucugaaugagaccuagcaugcuagcugugcagugugaacaaaaguuuucugaaacggaauauggaggaaagagacuuuauuccagugaacaguuugcaaacuggggagacacagcuuccaugcaaaaggugaagguguguuccagagaacauaaaggaggguuuuauagcaaacgugccagcccagguucccagucaggucuguuuaugcaaaugaaggauuuggacuuauuuaguucugagggaugauacagcugagcucuggaaagugaguucugauggguugguucaggagaacucugauugguugguucaggugagaucugaaaguuccagaauuaaacaggagucuggucuuugggggaaggcagaguacaugugugaucccuacucagccaauguccacuuggcccgauuuuaaauuuagguccaguuagccccuggggacucaucuugaaggacuggcuguuucagguucacauuuguuuacaauggggaguccauuuuuuuuuuuuuuuuacuuuagauuguaucauuuguaaaauggagacaauauuaccuccaucacagggaugagcuagggguuaaauuguauaacauacacauaacuggauacaaauccuagcacacuggauacucaaaucugagccaacaagcccacccagcccugcccucaccuggccaccaacugccccucaggcucacuccuaggcuaggcaccacaccucugguuccccacagucauuuccuucuggccucccaguuuuguagaccagccuuggcccuucaacagugucuuggcuuuccuggcugaccuguuggugaucugucacucugauuacugugaacggaguugccagaguugcucccagccuuucagagcccugccuggacccuuacugucacccuccuccuguaccagcccacagcacugccuccucggaacaggacuuugugaugcugggagagcccgggugcucaugacccugaggccacccaggccacacauggacagagccuccucugccacaggcuuccccacguauuccuuauagugaaccuugaaguggcccugggagcccucacccaucagcuagcuccauaaggaaccucuaucuccugaaauuucugagccagacacuccucucccuccccugccacguuuuccagaccuccacauccucugguggaagcaacuaauaaaauggaggcauggacauccacagucacaagccuggacacaagagcagcccucaagcccaaucuaaacugaaccagggcauuuauugccagggagcacguugaaucaugagaggggccaguaucucccagcagaugccagcaucugcccagagcucuuguggccuuucugggucuggcuggcacucacucccaauuccucuugggacaauaaaacuucuucccauuucccccaacaaagccuggcuucuauggcaccccacugcccagguucccaaucucaaggcaacugucggucaauuuugauucauucagcuuauacaguaugaucucaaacuugcacagcugcuggcaacauagccucacaaauuucuauuuaauugcaugaacggcauguaauagacuaauucucaauaucugguuccuggaaaaauaugcccugcucacuguucucagugacagggggcccaggcggucagcacucuccuguaggacgggcugcaccagcagauguaacuguccggaagaaggauauccagccauguuugaugcuucgcagagcucacaacacaggaggagaaucacucccagcccacauuccuuguucucucuccaaagcccuaucucuuccccucuccccaucuugcuggcaggagggucagcagaggacagaaagcauagauacaagacaguucaagacggagaaaaaggaagcagcuugcacaagcucaaauggaaagaccaggcaaaggcaugucacagcagagccuggaagugcacccuugauccuccagcuuuucccagcaccugucccugaggguuuccagcagacagaucccacaguuucacaaguagaggcuuccagguuuuuuaaaccuuagugauuuuagcuuguguuuggaauguugagucaugaaaacuccugccacauucuuuguugaucagccuggucuauuuccacuguugggaacucacuuuaagucuaguuaucucgguccuuuauuuguuguggguuucuuggcuuugaauugaaauggaacaaaauagacauggaaaguauaacuuccgaaaccuaagaccaaaggaaaaguaaaaaauuaaaugugaucaguugagcaaaugggacaaaaugggggaaaggaaaaaaaaauaaaaaacaagaaagaaagacaaguaaaaaacuaauaaauaagauggcaaaagaagguacaaacauuuuguuucucauaauaaacaugaauagguuagauucaucuaucccuuaaaauagaaagugugagauugggucuaaaaaagagagaggaauaaacaaaaagauuaaaaagcaaaagaacggaaaaaaaaagguaagcaaguaaaugugagcaaaaagaaagcaaauuuaguaacaucaaauaaaguaggauucaagaugcuaagaaaaaaggggaacagagagauauaauuccuaauauagauaaccuacugagaaaagacagcagcugugaacuuuuaugcuccuaaugccauagcuuugaggaagacauaaacaaagaacacucauuguuucucuuuaaaaaaaaaaacuuuuucaaaaaaaugaaaucagagacccaaucacugucaauaaugcuaaagcaaaaaagacaaguuaauaacaaaaugacauugaggagagugugcaggcaugagagagcgaagaucaaacacacacacacagacacacacacacacacacacacacacacauacacugcauaauacuucuguaguuaaugagaaaaccaaaacucaaauucaaacuuccaguuaagggugacauuuaaaagucacauuuggcuccuccacaucacaaaacuucaugauacagcacuagaggauguuuuuaaaggcacaagcacaacuagauggaaagaacaugaggggagaaagcauucuggaugcaggaaaacagaugagggagaggcugcugauuuauuuagcugauccaagacagcuaaaucccaaaccagcacaaaggagagcauggaagcugucugguuugcaaaacaaaaccccucaaagacuuggggcuuggcaggacuagauaucucuggaaaugagggcaaaaaaggagcucaggacaggagcacugggugaagguuaacuuaaaaaaaagcaguuagggccaggcgcaguggcucacgccucuagucccagcacuuugggaggccaaggcaggcagaucauuugaggucaggaguucgagaccagccuagccaacauggugaaaccccguuucuacuaaaaauacaaaaauuagccgggugugcuggcacaugccuguaaucccagcuacucgggaggcugagacaggagacuugcuugaaccugggagguagagguugagacaagauaagcgcuacugcacuucagccugggcagcagagcgagacucugucuccaaaaaaaaaaaaaaaaaaaaaaaaaaaaccaaaaaagagcaguuagaucucagauuuucugagcaauccagugccaagaggugacugcccgccccgacucagcuguaagacuggaguuguauguauucucugagaauaaaagggagcccuuuauaauggggacucuggcccuuucuugguggaauaucuuagagaacaggaagguugggugaacaucagugugcagaccaguuccuuaggccccagucucuauccacauuugguuuccaagccccagcagucaggaguagcccccaggaaggaaacugaugaauuuucuccaguaaauuucuccagagguucuccaguaaaauggcggagguggacccuccuguguaugcccuccccauccuccgacgccacccagucagcuccauagagaaccauucucaagugggagugauaggccugguucagcagacauuugaggaaacacucucauuugaggaaccaagacaaaaagaggaagaaaacaaaaagcaaguugcaggcagcagauacugugcagggggaagaaaacuguuauacaaaacuacuguaauauccucagagagaaucucuaaauacggaagagucagaggaggaaccgauccccagaagucagaaauaagauaucaugaauaaaaaacuccaaagaaggguuggaugaaaacuugacacuucuaggaagaagaggacaauaagagagacaacccaauguccgaauagaaggaguuuuagaaaaagagaagagagaaaugaaggaaaaagagucuuuagagaaaugcuugaaauaaacuccccaggaugggaguauaaacacuaaauacuaacugagauaaccaaaauuaccauggagauuugggaaggugugugguuggguggcgguggguggcgguguggggagggaugggugaguggagaaggggcagaaagcaaaaucucacugcccaugcuaggaauuccacagacaaugacuaaaauguaaaaucaaaaaggaguaacauaagcauacuaauuagaaauaaauaucuuaaaaaaaggagaaagauagaaaagaaaccucaucugagaccauagaacguggugacagauucaggcaauggcaggggaagaauuugcugccucaugauaagccguguagaacucuugauucuucaaacuaugugcaaguguaaacuuucauuguaaaaaaaaagugaaauaagauggaaauaauuuauuuuugagauuuugagcauacaaauaagacaagucagagccauggggcagggaugugaggcaggggagugaguugguaacagggucagcuugcauuuuuucuguguuauuguaauuucucacguugagacuaucuucauguaaguccauauuuuaaaguauuuuaaaaauuuaaacaagaaaagaaaaacuauaaccaaaaaacggaaugcagcagggccacagugcuagagguucuuuggaugaccaggaggagaauggggaggccaggccaggggcucccucuucuagaaagggccacugagccccacgcuggccucugaagaggcccuggcauauuggagguucuuggaagauguguuuagaaugaaccuaggaaugugugggagguccauggaugcuaugugucuggcaguccacacccaguggggagcccauagucucugacguagggcauaggaugcucauccuacaggcaggaacacaaaaugcagaugugggacuagaggacuccuguaaaggggcuucacugccacacccaggaucuagguccucacuucgugggcugcgauaggggucagugaagguuguggguugcuuauacuuggccaucagagccccaagaggagagucauccugcagcagcacagauaggggcugaccaggaccaggcuggaagcagaaaggccacuuagauggggcugguguucuaauaucagcugaggccaagaaaauccucaccaugcuggaacaagggcugggggccuuggaagaagcaggggagggaacauggcagguggaguuuggaauccacacuucccccucccaccuaccugccauggcugaugcaacauuauguucuagaagaggcaauuuaaaaaucacuuugagagcaggcuagguuucuguuguauguuuuauuuuuuuuccaggagaauaagugagggaagcucagcaauaaggagccauagaagauugauuuaaaguuugaugugauugaguaaaagcuugagacugguggggagaaagucaagauggaugggaaagcacaugcacuucuaggaguggaacauuaauauuggacagucggaaaccagaaaucuuuaagaaagaggaaaccucaggggaagaaagagaggccauccuaucccauaacuugaaagucacaggaauauuucagccugcagggaaucuucauuucccaccccauuguuuaccaaacuugcacgucaaaaacaaaaacaaaaaauaaaauguugcuuucaugaacucuguuacuccauucucccauugcuauaaagaaauaccugagacuggauaauuuuuuuuuaaagagguuuaauuggcucauuguucugcaugcuguacaggaagcaugaugcugaccucugcucagcuucuggagaugccucaggaaacuuagaaucauggcggaaggcaaagagggagcagucaugucacauggccagagcaggagcaaaagagagagcagggaggugccacacacacuuuuaaaccaccagauuucgugagaauucacucuauuuugaggacagcaccaagaagauggugcuaaccacucaagagaaaccgcccccaugauccaaauaccuuccgccaggccccaccuccaacacuggggauuacaauuaaacaugagauuuggauggagacacagagccaaaccauaucacgcuccuucccugaguccuugaccuggaguagaugccuggguugucuccauuucucaaaugaggaaacugaaggacugacaucaggccaagacuaacagguacucacucucagauagcgccugaaagcugacacaaguucagugagacugcuaggacaacccccugccgugccauuaaugucugcccacaaaaaccucacaccuuuggcuggcucuaucuuccauggcccucaucucagcaccaccuggggguacgaugaagaugccaucaggugucggagcucaucuugugcucacagcucacaggaccgccccugugucagaugcccuucacuucuggaccucauaaccuccacccagcucaaguugacuuagcaagcccuaacugugcauccuucauaagcuguaaauuguuacucaaaccagccaagaggaugucacugcuauuauuauugcauuacuguuuugauauugcuguuguuauuuauaacacuuccucaauuuaauuucuguucuccauucuauaucauaaaccucauucagguggggcuucaaucugucuuauuauuucucuuuuccuaucaccuagcgguacuugacacauaauugguauccaguaauauugggugcuuacuugaauaauugaaugaaugaaugaauaaaugagaaaaauaaauggaaugaaugagugcauagugugacccauauuuguauuagauccucaauggaaaaauaauuuauugcuuuuguaaagugccugagaauuggcaaagagcuuauugacugccuucccuaucagacuguaagcccaacaaggugagguuuuugucuaucuuguuuaucucugugucucaguauccagaacaaugucugacacauaguagaagcucaauaaacacuuguucaauaaacauucacacagcaucuccacaaggccaggcacaaucaauuuccacuguacugguagagaauguggggcucaaaaagguagaaugaaagcuugcauacuauaauggaaaaaaccauaauauuuggaaccagaauaccuggcuucaagucccauuuauaccaccuacuagcuauagauuugggaagaucauugaagcccucuuguuccuacuuuuggugugguccuuugaggcuguggcuucacuaagcauuggacaaauggaaguugcugugguugauaguguugucaaugcugccuaaacacucagagauaagacuauuacaauucuuagaauggguucugaaaugaaagaccuucaagaagcaugcgaaggcaucuaauaugaauuauaaaaaggaaguugcagaucuagaaaacaaugauugccugaacaugcagagcucccugagaccagcccuucagauggucuucacucccuuucuugauuaggaguccagacucgugggugguaagucugccacgaauaccuggugucuaaauuuuagcaugucauauuacaggaucuugcgugauagagaaaaauggcagauuucucuugaguaaccaggaugguucuagcugguaacuagagaagauauuucacucucugagccucaguuuccuccuuguaaguugagaauaaccacaccuaucuuauaggacuauggugagaguaaacucaugcgguaaaccauguaggaaauacccuaguuguggccuucuccccuggguggaacuuuacccuaugaagguuuagcaaaucauucaacacaaucaaacaguggagucuaggggcaggcgacauggcuccaaccucgccucugccuuacuucgugaguuugaucaacaguuugaaucuaaauaaaagcuaacuuuuauauaucugaugaaccaggcucuguucuaaguguuuugcauguauuaacuugcuuuaauucccacagcaacucugcaagauacaugguagauaaucccaaagauggcugccacuuauuccugccccuucucccaacaagcagagccuauuucccuuccccuugaaucugagcugucuuugugacuauuugacaaacagaauaagacagaagugaugccaugccauuuccagguuuggucucuguuaacuuaaaaaucacacaauuuauaaauuuagaaaggagaucuuauuuuucguaaagcauugcaaccugcaggcuggccaucugcagguugggaagcauagccucugguagacccggaaaggcaggcacuuugagggaauggaugguaaggcaggaauuuguccugaacagauuagcuaaguaggguuacaggaggagcuaugaauauucacaaagaggguccugacucaugccuacugaacauccauauuaaaugugacucauauucacucuggagcagaggcuuaacauuuaaaugcauugcaggcaggcccuauacagcaauaggugaagcagggacaugaaggcccucugugugcagccucuuguuaacuggucagagccagccuauuguugguggucuuuuaucaggagaaaguuacugacauccaucucuuguccaaucaaagcuguaguugugacuuguggaccagggguugggggucaguuagucaaggucuaacggugaacuacaauuguuuuagcacuuguuucuuagggcuagugccuguuuaacugcuagagaaaaagaaaaaccuguggcaguuagaacauuguuuauucuuuaaguguacagguguaugacuuaaguguugguugguuggaauggccuugggucuuauuuauaauuugguaucuuauugccauaaagucaguugugugaucacuacuguaacauuauugcuggucggauguggugucuaaacugaagaaggauguagcaaggcauguuugaccuccuaucacagccaggaacucaguuuuuaagguuucccuagguuccccuuggccaagaguguauuuauuuggucaggugggggccuuagaguuuaauuuuagaucucaucccuaagaaaccaagcauguuucugcuuugcucugaaaagccgccaccauucuguaagaaugucugaauggaccacagaaugaugaggaagcgugaaugagagaaaaaccacacagccuagaugaaugagugaggccuuccuuccuggaccuuauagcccagcucagcugccaaaugcaacugugucagugacucuggaccaagcuauauagagcagaagaaacauccacugaucccugccacgguaucauggcaaauaacagaucacuauuuuguaggcaauaaguuuuggaguuuucuuacacagcaguagaugauugaaacaauuuaggaaugaguacuaucaccacugucccaauaaggaaacugaggcacaaagagauuaggugacuuucuuaagaugcauagaaauuagaacaagggaggggaagccccaccaagcuuuuccauggucagaccaggucacuucuggagagugacgguccccucaaggcacuauauuuucaagaacagggcagcaaggauggagaggaguccaaacucauguccauaggaggaauaacugaauaagucaucuggagaaaagaaaucuugcuaaggggcaguauaugaagcucugaauccuuauaugaacaagaccagaagacaaauggacagacuccccgauuugucuucuacacuccauuccacacuucauucugauggaguggucuacugggugguagcgggcuccagucccuggugcuggacaaguagaggccagacuauuaguagauuaaguggcuuggagaagagcugaccacuggguagcaaguuggccagaaaugaucuccaagagcccucucaacuccaaaagucaaaaguucauccgagaccuuauaaggcaaagaggaauggaagaaaaagaacuacauucagccaaauccuagcaguuuucagaaguuccacccuagaugagucaaaaacgaggccaaagaagcaggcaugcucuggaggucuggccagagcagggcaguuucccagaagucccacugugggcaccccuggcaguccucaauggccguuucgugcagagcguuuggaacccuggcuccacuauugggccaggugaaggucucuggggagacacaguugguggcaagagagcugauggauacagaccuugaugccauggggcccuugaagauagggucacucauggaucucauugcucuuggugaauuugccccugaccuccugagaagcccugaagagucugacuucaaucccuccuuccuacuucccaccugcaagucucuguccacaaaagaacaagcaacugauuaccucccaagcugcucccauagaucuugccacagcaaauuucagucagucugucuacacucagaaaaaaacaaaccugagcauaaaagacaggcucugaugcaucccucagacccucucugccccaggauaagccagcgaugauugaaaagugucuucugcagcacguuagagagcaccuugaguuaauuaggaacugagcuucacacucccauuagugcugcagaagaaaaauucaacaacagauauuuccuuuuuuaaaauguccugggggacaacuugaaaugcuucuucugugaagaauuacucauuggagucauaaaaagagagagggguaucauuuauuuagauucaacugugagacuuuguggcuuuuuuaaagggaugcuguauuuuugcagcuauuuuagaaccauaauuccccacauuaaacauaucaaaaugaaaacucuauucaagcaaguuauuuuaagucaaauauaaauuuauuuacuaacuugaaauuggcaguagcagcuguguuuuuaaacaaauuucaaacaauauuuaguuaaaaccauuuuuucugcaugucaaagaaaaacacaagauuuaaguaaucauacaaaauacauuuuaagguuuguuuuauaccauccugcaggguucugagagcaggccccugaaaugacagcaucagcaaugucuggggacuaauguauggacagcaaaauucugcuacuguccuaggaaaaggaaaucaaguuagaagaggccugaugacaccucaagaccaaauaaaucacaagugacaaugucuugguugcccccgaauuguuuugcacccagagcuauacugccuacaagacggaucuccaccuucuaaaaaugacuuuuguguuucuuccaguguuaccgguaguaaugagcuucucucaggaucugcuaauuuaagucagcauggauauuaguuuacagcacuuaaaggucucacacuuauaauagagcaauccuuuggcuuucauugcaacccaguuaauuuacaguaauacguagaaaacugauaguuaaauuaugaguuuuaucaaucacaaggcagaaaaaugaaucaaguaacauugaagcagcaugggaaacauauuuuauucauuguucagaagagcauaacuuauguuucauuguguuuggagcauucuagcuccuuaaugcauugguggaauacugaguuacaguugaucagcauaauggaggugguuuggaagggcugccgaggacgauggguacauuucccaaauggacuguggccuuugcuaaagacagggaugaggugugccuuccucagcaaaaugcagccagugccccuuggcagcaguuggcucagcagaucagccuggcacagccagggcaggucaaugcaaaagugucuauaccauguuacucaggcuaaccugugcucaacuaagcagcauggcagccucucucacagagacaccauauaccccagagcauagcacuaguuucagggccucccagaaauaagacagaaucaaaccauuuucagccaaaggagggccccacccacuccaaggaggggcccuggacccagcaucaacaugucccaaagguguauuuugagcagaaaaaaaucuuccaagagugugcucuuaggcucaggacaagacaggacagcaccagcgcucccagucugaguagcugggucuguucuucgugggcagagaagacuggaaacacugugcaacccuggaaaacauggcagggaccauggcauggaagagcaggccggugguucagugcugccaacccaggcaguggagaggcccuguguccccaagggcucuuccuggugggggugggggccaggcagcaccuaccaagagcucccaguucuggaggaacaggagaggcuguuucacacccagccggcaggcucugaagagcagcggagacggugagcaucacaauggugcagcagucaaugcccauauccaccugagucccagaucagagaaaauacuaaaaagugggcggucacucccucuggagaggcucagcgcaugugcccucugagggcugguucccugugaacauaccugucucaacugcagugucuuaugcagccaccaaaugccgugggcagccagagggauucagcucaucugaguuucccccuuagccccucuacauggaacaccagguacuucagggggcaaagaggccuaccauaugguccaguaagccaaggaggaagcagggucguuugcaaacucccaggaucucaugcugcccaggacaugucauucagccaggaaugggcaugggguccacaaccccucuuggacagugaucuagaucagucuuuucugggcucccuccaaugcuccaguccaaaaagugaggcaggaagugcguacuacacggccaucacagcuugagccagaaccuagacaugccaugcucagugcuucuaaccaucagaguaagacagcucccagcagcccaagguccccagagucaaaguagaugagacugaccucuccuuucuuuuuccuucccaacauccaauccauggagcaaggaaaucaucauuauuaguuaaauggauuuaccagcauggaaauacgauguuuaauuagugcuaugauuuuauaacuucuuuguucauguggccaggugaucagcuaaggacaaaauucucuaacacuuauuuucucaaaauaacaucuaauuaguaaaaugaacaauguuaaauguccuugagaucccagcagcuaaacauaauagaaguuuaccucucacuguaguaaugucuguggugggccagauguuggccucaucugucucuguggucaccaagguugacucagggggagagauaggagagaagacuggaggucacuggcaguuuuuaaaggaccaggccuggaaguggaugcugucacuccugcccaaucccacuggccagaaccccauaccauggccccaaccuaagcacaaaggacacucagagagcagcccauggagauuugaugacacuaauggucugccccaaauguguuguaaaaucacgugcaccuuggccucuccucccuucucccagggcaagcuaaacacuaggggauucaagagcuccccuggguaagcauucuguucacuagucacuuccacauuaauccugcugcuucccuguggcacugcucagcacccagcccugggcugccaccaaggccggggcacuaguacuagugacucuucccaacguggcauggcaucucauucccaugagcauggucgcaggcauuagaauguucacaugaaugacaagacugagaggaagagaggcugagccuaaggccacugggugaggaccaguagugcagccucaaccacagggucuucugcagggcucaggaauacagugagaugaggcugccugaagggguagaccccaggagugacucagggcaagucacaggcacccuguuuggcacggagucuagugcaagguccuggcuuaccacagagcaaccagaacuuugcaaagaggacccacucacccugaaaagggcacucccugggguuuggaagaggccaugagcucugagaccugaagauccuugagggcuccaccaggguuuccagcuuaggcugcaagucuaccccaggucucaggccccaggcccugggcucauucaugacucccagcuggacuuccacaggcucagggccugagcugugcaacacugaaaguaagagcuuuaggggcuguggccaguugggagggauagggagggugcagggagccgguguucugaguucaaagccccugcucucugcagaacauggugcugaccucaacacacugucccuguggcacaccacaugugcuaaagauuuucuaagaggaccauggauagccucaugacacagugaagaagcagggcguucccagguccgaucugcugacugcagaccuguggaucauaacaagagcauuuggaguucacagguucacagguggcagcguuacugcggaaucuguuggaagaagcuucaagagaaagucaucagcaaggaaagaagcuggacaaaugauguaucucaacuccuuagggagggaacguuccuuuaccaagaacucaauuaucuccaauuuucacaaugccuuuuuaaaucuguauucuggacagucauggggcaugguuacaggcuugugugauaaggaagcaaggaggaugcuucccuccuuggcacugaacuucauucugaucuguauuauuuauguacaacucagagacauucaguuccugguugggugucagguggauaacgguuuuuaagauugaucugaggccccaaucagaguuaacagagauagggaacccugagcgauugcuuucuaaaacaugccugccauuuuccaagaugcugccuguggaggauuuuaucaggagacuugguaaaaagaauugcagaaguuguuucuucaggcagucuccuagacaaggugaaaaaugaagacuucccagagagccagucuuugaucauguugaaaagagcugaauucagacugcaaagaccucaaacugucacaaacuccaaaggcuggccaauaggaggauuacagacaucccgggcccugcaggagguccccauggacugucaucacacacuaggaagcagggcccugccuucaccaugcuaggacuacugaagucuguuucacaccucauuucauggcacaagcaaugguauuauuaggggaggggagauuguuucuacaaacagaccaaacaaaugauacagugaccaaaaugaguuuugaagucauaauuaugauaauucauauuuauauaggccccuaguguauauacagcucuaucucagauggcccagugacaaaucugggacaaauaucuucauuuuuacacauaaagaaaccaggccucagccugguggaacaggcuggaacacaccugucuguguucuaccuaagcggcaaugucacaguaauuacaaacccuauaauaauucuaaguguuucuaucuauucccacuccuauaaaauguucaugcacagagucuacuccuuggcccuauaauaaugcaugaucacagcaauagcacuuacucuuacugggcacuaaaccuggggaaauccucaaaacaccuccacauugcagaggaggaaacggagguucagccggguugguggaggaccugucugacccugacccccagucaugagcucacacaaaacuucugcagcacugcccuuucuuaggaugcugccauccuggguaccugcuacagcccagcuccauuccacaccuucugcucacuugaucccguuuaauucucagagaucugugagggagaugccacuaccccauuuaacagagagagaaacugaggcuaaacuugucccaaaguuuacuaucacuaagcaguagucaggauuaaaaccagaucugucuggggcuaaaaccugugagguuuccaugacagucuuacaggaucucggauuuauuauguaaugggugcuuaucuuuuuacgauuugggugaguucugggugugagacaucugacuagagacaugucaguagaaaucauugucgcuguugcuguuguuaaucuccuuuauuccccuggacuuagcugaggcuuccagaccauccgguguucugggagcuguucccaagacggaucauucuuugcaaaaugagcuauggcagucuccugaugugggcaggggcuuccugcaggcagggaugugugcagacccugaucagaggaccuggaaaguacuugccacuuuauuucagucugaggaagcuugaggggacugucacccuaaaugcuugcagaagagagagggaaaucacucuuuguuuccugaaaaugauggaugggcauucugggcugcagaaacacugugcaggcuggccuggccccagcacaugaggucggagaguaugaugguagucagauggcagcagcccgugaguagggcaugggcagugcugcaugaauuagcugacugcuuuccauuucaacuuuaacguuguuuaaauuuuacguugaugcaaacauuauagggcaaaacaugaaagcuccuucaccauucccaccacucccucccagaguguaaguuuucugugcuauuucuauacauuaacauguaacuugugggcucuggggagaggacaguaacagacacugggauggaauuguauuaaaauuauuuuucugguguucuuauuucuuagcaauucaucuuagaaaccuuuuguauguaccucauucugguauggccuuaccagaaaugauuuaaccguuccucuguugacagaugaacaagucauuucucauuuuguguaguaaaaaauguuacauugaggauuguuaugcauccauuuuugugcauuuguuuuuccuuagaacaaauucuuaaaauucaauacaagguuacaggacauuuuauuuuaaaguuguuuuagacauugcaaaauugcuuucagaaagucuuuaucaaauuauguaucaaaaguguaugagaaugcccauuucuguaugcucuuccuguugcauggucauuaaguacugaccguccuuuuaaauugagaaucuuaugacaaauuuauugaccauuuguauuucuucuauuaauuccuuguuaacacccuuuacccauuuuucuauuggguugucuuuuauuuuaacaacauauuuuauuuauuuauauuggauuacccaauauguccaaaaaucagccuuucaacaaguaaucaauauaaaauuauuaaugaaauaguuuacaucuuuuauagcaaaucuuuggaauccacuuauagcauaucagauuuacauugcaaguuuuuaucaaauauaugugaucuguauuuagaucuuaucaaaucuacauuugaaguagauucacauacccaacuuguuucagauauacuguagucuacuguaguauaagguagaauaauggcuccccgaaagauaugccuguccuaaucccuggaacaugugaauauguuauguuacgauggcaagcauuuaauuaagguggcagauagaauuaagguugcuaaccaucugaccuuaaagaaauuaugcuggauuggccaggugcgguggcucacgccuguaaucccagcacuuugggaggccgagacgggcggaucacgaggucagaucgagaccauccuggcuaacacggugaaaccccaucuccacuaaaaauacaaaaaauuagccaggcgugguggugggcgccuguagucccagcuacuggggaggcugaggcaggcgaauggcaugaacccaggaggcggagcuuguagugagccaagauugcgccacugcacuccagccuggggcacagagcaagaauacgucucaaaaaaaaaaaaaaaaaaaaaaaauuauccuggauuauccaaguggaucuaauauaaucauaagaguucuuuauaguggaaagggaggcagacaaagaggucagagucggagugauuugaagaugugaggcugcuggcuucgaagaugguggaagggugcaggaagacuuuaaaagcuggaaaagugagaaacagauccugcccuagagcuccagaaggaacagucgugccagcuauugacuauagcccaguaaggcccauugcagaauucugaccuccagaacuguaagaaaauaaauuuuuguuguuuugagccgcuacauuuuuaguaaucuguuaggaaacaaauacauauuucuaaaaguuuuuugauaacugaaucaaauucaguuuuucuuaacagcuuuauugagguauaauugacauacaaugaacugcacauauuucaugggcacaguuugguaagucuuaauauagaugugcaucugugacacuaucaccacaaucaaggcagcaaacauauccaucacugccaaaagcuuccuuguauccuguuguaaucccuccucccacucccuuugccccuccugaccccugaccccaggcugauccgcuuaguucucauuuucuacacuuuuauagaaauggaaucacacaguauguacucuggcuuguugucugucuucuuucccauggcauaauuauuuagagaagcauccauguugcagcgugcauuaagaguucauucauucauauugcuggguaguauugcacuguaugcagguaccucaauuugcuuauccauuuaccuggugaaggccauuugcauuauagcaaauuuuuggauauuagaaauaaaacugcaaugauuugcauacaaaucucuguagggaaauaugcuuccauuucucuuggguauauguaggagcggaauggcugggucguaucccagguguguauuuaacucuuuuuucuuuuuuuuuuuugagauggagucuugcucuguugcccaggcuggagugcaguggcucgaucucagcucacugcaaccucugccucccggguuccagagauucuucugccucagccuccugaguagcugggacuacaggcacgugccaacacaccccgcaaauuuuuguauuuuuuaauagagacaggguuucaccauauuggucaagcuggucucgaacuucugaccucgugaucugcccaccucggccccccaaagugcugggauuacaggcgugagccacugcuccgggcaguauguuuaacucuuuuaagagucugcuuaacuguuuuccaaagugauugucguuuaacauuaccaccaacaguguauaagaauucucgguccucugcacccacaccaacacuuagucuggucagucuuuuuacuuuaucuaauagauauguagugguauccaauuauggguuuaauuugcauuuuccuaacuacuaaugauguugaagaucaucucaugagcuuaucuuccaauccuauaucuucuauaguaauuaucuguuuaaaucuuuugccucuuuauuuaaauuggauuguuaccuuauuauagaauuuugaugguauuuuauauauuuuggguacaaguccuuuaucagauacaugauauucaaauauuucuccuaguauguaauuugucuuuucacucucuuaauguguuugaaaagcaguuuuuuuaauuuaaaugagucauauuuaucaauuaguucuuuuuugagucaagcuucugauguuguauccaagaacucuuugucuaauccaaagucauaaagguuuucuacuagaaguuuuauagucucagauuuuguguuuagguauaucauucauuuugaguauauuuuuauauauggugugagguaugaauugagauucauuuuuuugcacacaaauaugcaguugcucaaccaucauuuguugaaacaauaucuucuccaaugaauugccuuuacaccuuugucaaaaucaauuauccauauauggagacagauagauagauauggagguauaugugggucuauucugaucuuucuauucuguuucauuaaucugucuauuuuaaugcuaauaucucauuguuuugguuacuguagcuuuacaaugucuugaaaucaaguaguauuagaacuccaacuugauuauucuauuucagaaugagcauacuuuccaauguauuuuaugagguuagcauuaccccuauauaaaucuagccaaagacauuacaagacaaagacacuauagaucaauauucuuugugaacuuaguugaaaaaauuuucaaccaaauuuuagcauauugaaucuaacaauacauaaaaaagaaaauacauaaugacaaagugggguuuaucccaaaaguccaagguugauuuaauguuugaaaauuauuaauguaauucaucauauuaauaaaugaagaaagagaaaaaauaaucaucucauggauucagaaaaagcaucugacagcauucaauauugcuuccugauaaaaauucucaacaaaccaggcauacaaaggagcuucuuuaaaccugugaaaagccaucuauggaaaacugaaagcuaauaucauacuuuauggugaaagacuaaaagcuguuucccuaugaucaggauaaagauaaugauauuuauucucaccacuuccauaaaacacuuucauggaguccugccugguguaauaaggcaagaaaaagaaaugaaaguuguucacauuggaaaggaagaaguaaaacuguauccauacccaacauaauuguuuaugucaaaaaucugaugaagccugcaaaaaucuacugaaguaaaaaaugaguuauuauuguuggggaaaaugaaagcucuaaauaaaugaggaguuauacuguguucauuggucagaagacuuauuauuguuaggaugucaauucuccccaaauugaucuaugcaaucccgaucacaaucccaguaggcauuuuucuguuaauagaaauugacuagcugauucuaaaauucauauagaaauuuaaagggccuagaauagccagacaauuuugaaauagaauaauuaaguuggaguucuaauacuacuagauuuaagaucagaugguuagcaaacuuaauucuaucugcaaccuuaauuaaauguuugucauguagcauaacauauucacauguuccagggauuaggacaggcauaucuuuuggggagccauuauucuaccuacuacaguauaucugaaacaauuuggguacaugaaucuacuucaaauuugauaagaucgaaauacagaucacauauauuugauaaaaacuugcaauguaaaucugauaugcuauaaguagauuccaaagauuuacuauaaaagauguaaacuauuucacuaauaauuuuauauugauuacuuguugaaaugcugauuuuuugacauauuggguuauccaauauaaauaaauauguuaaauaaaauauauuguuaaaauaaaagacaacccaauagaaaaguggauaagggauguuaacaaggaauuaauagaagaaauacaaauggucaauaaauaugucauaagauucuccauuuaaaaggacaaucagcacuuaaugaccaugcaaugggaacagcauacagaaaugggcauucucauacacuuuugaugaaacauaauuugauaaagacuuuuugaaagcaauuuugcaaugucuaaaacuugcaaauacugagcccuccuagaugcagacaaaauggcacauccuuuguccauuagcuacuuacaccaauggacugcauuuguauggcgcuagagaugcauuaagucagcugcagccucucaggaggaacuuagauacauaggcugagcaauucccuaacagagcaaauuaacaugagcucggacacauggggaagggggaaagggcccaacauuuguggaaaucuaucaugugccuggaguuugcacacucuuucuguaccuaggugcccgucugcaaacugccguucuaggugcaaacugugugccugguuccuucugagauacaaacacuuaagcccugaccuggcacuauaguaggaaggccagcuggcaaagugcugacacucacuuugcgcuccucaaagaauucccaggacccucauaguugagggcacugucugaggugccagaaacagguacugguucuugugaccugcaugcgucuaaagcacagaaucuuggcaaaacacaggcucucaaaggccauggggccagauaucaaaucauuuaauccucacgacagccucaugaagcagauacuauuauuguccucauuuucuagguaaggaaaccaaggugcugagugagcucauguaaaaggugucauccucuggccaccuuccuuuagugucccuagacuagugguucucaaaguguauuccccagggcucucagcaucagaaaaaugguuagaaaugcaaaugguccuacuuuccccagaccuauaggguuagaaacucaagggugggguccagcacuauucugauugaacacuuacauuauuagaaauugaaucaggcuggguggugugacucacaccuguaaccccaacacuuugggaggccgaggcaagaagauugcuugagcccaggaaaucgagaccagcauggggaagauagggaaaccccguuucuacugaaaauuaaaaaauagcaaaaauuagcuaggcaugguggcauacaccuauggucccaaauagaggucgaggugggaggcucacuggagcccgguagguagaggcugcaguaagccaugaucgcaacacugcucuccagccugggccacagagcaagacccaaaaaagcaaaacaaaacaaaacaaaacaaaaaaacaaaaaaaaaacauuaaaucgcaaaaaucuacugauaaauaaguuauaguaaaaacaaagguuaaaaaguauucaaaauauaucauuuccuaacuuaauguacuaugacuucacguacuaugucuuaagcucuggagguuacugacauccauugcauccauguggugcaaacacuauggugcaucucuucucagcuccacaugcaaugaugucauaaaaugggccauggagggggagggcauuuauaucacugaaguuagcaaacacuccaaauccagguacuuuauaguuuucagagaccccauuguuaaacaccaccaaaacaccagacucucuguguuuuaacaagcccuggggugacuccaaggcacguucaaaguugagaccuacccugagugucucagcugaaugcuauguucugacuccauucacaucuuuucaucacagucuuagcaaaugucauaccagggaccagagagcagacucccucugcuccccaggcccccaacccccacccagucccagagccacauucuugaccugugggaggcagaggaaucugggcagccgagggccagugcuagggccccugcagugguggggggcacacugggauuccccugagaagugagcagcagaucccacagucacagccuggcucuccacgguggcuucuugcaaacaaagucaguugguggcugccaugauaaagauagggaagcaaagaguaaagccuggggcuccagcauugggcacaccugagcugacguccccagcacacccuugugggcggugggcacagggcugguugcaucaccuuccugaccucugucugcuugucugggaagacaggaaugguagugucuaccccucuggggucucuacauuaaauccaguaauuuaggcaaagagccaggaauauaguacagucuuuauaaacagaagcuauuacugcuuuuccauuuagcuauaguagaaagcaaugucaaugucaauauuguuacucuccuuguacggaugacagauuuugggacacaggaaaaaaaacagcaaaguaccuagaaugacacagggacucuguuacugaaacagcaaacgcccaagaugcaucccguuagccagugauggaucucacccacacccucuaaugagcacauuucuccauccuggggcugcuauccuaauguauuuccaguagcuccaaguucucuagcaagaaaguaaccaucaauucaguuacaaagauuaccagcugguucucugguuuauugcuguaauuccucuaaagcaagcaucugcggguaaggacgauguucugccuuuccacauuaacguugcuuaaaugagaagagucacuuccauguguccuuggagcgcaggauuccagcagcacaugggaggcucccaucacccugugaaagccaggauuugccuggaaaauauuggggguguguacucugugaguacacauggggguagaggcaggaggcgaccuggauacagcaggugacuuugccccucaccuggguaaaugcagacacagggaugcggugccccacuagguguggagcccuuauauacaauaauagcaggcauuuauuuagcaaacacuuacacaguucucacuguguaccaguacuaaguacuaagaacuuccaaguacuaauucauuugaugcuccaaauaucccuacaaaguacuuuauuauuccuguuucacagacaaggaaacuggggcacagacagguugaacaauguuccuguagcugagccaggauuugaacccagguaguugguugcagggauggaguucaaaaugcguuucccauugagaggaccaaaaauauguagugaagccauaccaagucugaguugagcaaaaccaagcaugaaugaaauaaaggccucagcacagcucauagucacugacauacagaaggaggauaaaggaggcccugccuagccuggggguuggggaagggucaaucacagcgguuauaacaccucauucucuugaguaggacuuaccacaugggaaucuggcaucucgacccuccugagacaugucccauugugcagauguggaaacugagguucagagacauugagcggguuaccugaggucacacagccuggaagugcaaggcugggacucaaagccagccuccccgucccuauaccucaugcuuuuuuucugcaccuuucagcccagcugccagaccucagcacuagagagcagguggagccgcccucugucaugcauacacaugcaccccaggcaccuggcacucucuguagugggguaccauguacaugguaacugacuccuaucucauugguaaagaaaugaaaucucacccagccaagacguggcaggacuggacgcacacagaucuguugauccuuucccccauguugccucaggagccagagugccaggcuucucccugacccuguccagccugaaacccugcuggcccagaaaggcuuagguggcacacuggaucaggcgcucccaguggugggagccucccucccugcuccagaguucccccugccugugggcagagcuccuccaaucauguaugcagacuacaguguccaccuuaauccaccugggacucugaguaggccucaucucucccuaggagaggaggugugugccccucucugaggcccagccuucccagccauggccuggagggccccagguccuaaccucuccucuccagggacccugacgacagcaguccccuccccaucaucucaugcucccuguguuuguguuugccuccuuuuuagggauuuauuucucuacaagggacacaggugacugaacuuccuccuggccccgaggacccagggaagcaccucuuugagaucagcccagguaggccugagcaccuuccagcucugcagcccugguggggguguugccaugccccuggccugggaagggcagaccuucgugacacuccucccgcaggagccacagcacagucuccaggcaugacucggaaaugugggccaaaucgacagcauacucacauggggaagaaauuagaaagucccaucaauuaucuggacaaugagcuuuuggguaaugcgaaacgaggauuuuuaaauucacgauaaaugcaaggaaagaaauuagucaaugggaacaucucagggugaaaaucuaaacacaauaccuggaaauaaagccagggaaaaacacuagcacagaucaagaauauuuagguaaggaugauuauaaauuccaaggcagagaauugggauguggcaggaggaaggggaauaauuuuccuaaagaacugcucuacugucacguuagcaguuacaaaacaauauuuuaaacuuccaaguuugacaaugucguuguuaaugcacuaaguaaaagugccuugcagagaagccaguguacauggcagggccggcucugcugucagccaguguuuucuuuagcuuggccuccccuagaagcagagccugagacaaggaucuggcaugaggaagggagucagagaagggaagaaagccagcccagacaugcuagugaguggguugcugcugcaggcauccuagcucaguucccacaggggcuucuggacacagugcagaacaggcuucagaggggucucauccaagaagugaggcuggggcucuacccacccacucccaccccccaaguccuugagaacugcuuucuggggaguaaccgacauuucuagccuacccucacauggacaaaacucugcagacagagacagccuucagggacaguugcagaugcuugaggaaggagaccacuggcagcgugaugggaacagugagugcugaggagucugggaaggguaccaagagugucagcugaauuuagacauccugggaagugguggcugugaacugagugugcuagggccucacuguggcccagugaaccaguaaaucuaugauuggucgcaaagcaguaaagccaccccagccacccugagaaaugaucuauuggcuguccacugagggagcaccccaggcucaggccaugaguagaggcucuuugggaacagguaugagaagauccugccugggauaggggcaugucuaccuuuguccuguccauaccagaguucgcaggggcacaggcaaaaguugaagugcagaaacacccuuuccaacuauacgcgccugugcaaaauucaaguaccuaugguuucacuuggguauuccuuuucaucuaaugcaagaaucuuugugguaaaacugcacaucagaaggugguaacaaagggauccugggguauggaguagaaaacagagguugacuguggaaccaggagaaaaggccucagcuauucagauagagaagaaaugcaaguagugacguaggcagggcccugccaucuaggcgagggguguggccccuggcucuggggacagggguagugacucaaggccagaacuagaagguagaggucaacacacuccagccaucaauucagaaaggcacugagugugugcuccauaggccagauaagggacaucaccugugugcauguucauuaucugggucagagcuauuuacaagaauuuauuugacucuugccagugguguuggggguguugggggcgguaggagaagacccuuugccauauaagguaacauagucacaagguuccagaaauuagaagauggacaucuuugaggaccauuauucugccucccacaauacucccaacaucccucuaagauagggaaugucgucagaccuauuguacaaaaacagaccguggagauuagaaagaauccccagagagacacacagcuaguggcggaguuggggcuucagcccagacauucugggcuacacacuuaccuugcccuccaacacaggcaucuggccaucugaggaccccuacagauucuagcauuuuccccaccugggccuaaggacuuuguuaugggaaggaaaguuccugaacuccuuugucucaagcacagcagcaguagccugccugcgcaucagguuccugcagauccugcgagcugcuccccagagcugcccaucucugcccuccagccuuugugcagcugcugagcaguucagggagagcgggacggguggugggcggugagcgguccagucagccuuugcagagugcggcgcagcuaucugcagagcagagcacaaugccagugcugcccggggcccaagagugguccccucugcuccccucccacugggggcuccggauuuaggaugcuuccuaucagccugcucagaugggaccugggaggcugcacucgaagcucaugcuugguucuggcugcagcuggcaaagcuccccauccuucacagcccaugaagaugucaggccagagggguaaggugaaucuccugaggccaaacagcuggcagguacaggagccuggacccucccaggucagccugaccccagaagggugggcuuccuguuacagcaguugcugacugaggcuucagcuauaggccauguuggggcuaaaaacgaauaagaagauuggaugaacccaccuuaaaccacagcaacgugcagucacaggaaggccaagaaacccauucacauccaacucagcaaaccucucgugugaccucagcuuugagccagccuugcagggcccugagaugagcaggggucagucucugccauuagggagucuggggacauuuucuuccugagcucaaggcacaauaaggacuuauccucacuaggcugagcacaguuaccugggggcaggagcaggaaguaucaccaagugggccaugccagugugcaccaagcacagcccccgggguaaaugugcaaagaccaagaggaaauccaggcugggugggugaaggguggcaagugcaucuggggggacaaggggcuucuccuacaguuccgagggugccagguggcaggcucugugagcagugaacuaacaggcgcaggaaggagccuaacagccccgccuggggucugggccuaggccaggaaaucagggcaggauaugaggaaggaggacaaaccccggaucacuuccaggcuaugccugugcuggccugugguacuggucacaccacaaugggucccucacucuccaaccagcacccccaagagggggaaaaacuugacaacucuuggaaaugugacagaauuccaaggaaggucaugccuagaauuaacuacguaaauuuuaagccauaguucuauuugugcaauucaacgguauaaaaaaugacaauguuuucaaaguagaauuaaaaaugaggaaacauuauacugugagugccaucuaguggagagaucugccaguucugggccagaaagugcaggcccuguugcccacccccagccuuucagccagcacagcuagauaggaguggagcuugaggccaagccaucuggcuuccaaagccacacacuaaaauugcccuccaacacagacaucuggccauauggggccuccuacagauucuagcauuguucccaucugggcugggaggucuuggaacuugauacagcauacaccucugguuccaaaagcaccugagaaccugcacauccagccacugagcaagacacagagaaaacacucuuauaagggggcuuuagugccagugggacuucuguccucuuguggcuguggccugccacugcuuucccgacauggucaguauauaaagcguacugagaggugggagcaauugcuuugggcagaggugacggucuccucccugaagcugcggggacacgcaggaaaaccacuuauaaaguuuaagggaggcugagagaaagggugacuggcauuugugucuugcuuggacaguugcuuacacacaagauuugcuuuucaugguuacccaggcaaggaaaaucugacugaggacugauggcaaaugggguucugccaggcacaccuccugccguaagcauccaguucucaagaggagcagaaugugaagccucugugggaccacaggccugggcacugauggagaaaagaggaugacaugggcccucagacuuucuagaauucucauagugcagggcagacaggcaagaugccaccugcaggaagucagcugagauuugaggucagaacgcacaacagauccccagugcccagaggagcugguugggagggugccccugccccaguucacaacaccguccaccagggagggaacugcaaccuugccuggcaagcaaagaaaggucuacauuuccccucugccuccuucccaccccagugcccagggugcaguucagggaagagucuaggagaagcaaccccuaucuaugccagcacaccccaguccgugagggccacagugcugggggagcagcacaaaaagagcuuugaaccagaugugagggaacagaauuaaggauuggagagauccuuaaugagacuguuagaauaacuaagaguggcacacacucuggacccugggaaaaucaccaagugagcaacgacucaaagggaagguaggaagugauaggcauaguuauugggaaaguaaaaccauuucauguuuauucuccagugagcuuagcuuuuuuguauuaggguaagugaacugcuggaauaacccccaaaucucaggaucuugacacaagaauguauuugucuuucauauaaagucaaaaaugaacacuugugauuggcaggcaguugaucucccagcaucuuccuauuucaugguuucgccaucugaaaccuguggcuugcaaaaguauccuaguuguuuccaugcuaggaggccaucaugccugggagauguguugguccaggccuggaaguggccccaucaucccgucacagcccauuggccagaaugcaguugcauggcuacaccucggagcaagagagucugggaaauggaguccaccucuuuccaggaggaaggcaaggcugguuuggugaacagucaguaguccugccauucuguauaaugaucuguuaccuuggaguaagaaagacaccuuccuacccucacagaauuaacaaguucaggaagcaggcaggaaggcagacauugacucacaggaugagaaaggcuaggaggagaguaaaaaggcaauugugugagccuggaggaggggacccuaaugcacgcagggagugcaugggacuuccaggauaaagugacaacgacccugcucuuugaagguuaagugagagucagccaggugaagaaucagggagagcagcugggcagaagcagcaaugggcaagcacagugggcacggggucugugugucuccuucacaccuuaguuccaaggcgcucagcacauagguaacugaauuuaauguaaggauuggaagcaacaggagguuaagcuuucugccagaaugaaaaguuguccucuguggcaggagaauggugucgggcagugguucucaagcuuuagugagccuccgccucaucuggagggcuugcaaaaaacacugcugagugggcucaggguccaagguggagaggcugccccugguguagagauagugggggacuuagaauccuggaagggugaaugagaugggccucacaagcggacugagugagaggagguuugaguuaauugggggcaggcaaagcuauaaccaauguuuuaauucuaauaauuauuauuccaagaggaggaggaccguauaauguauaagaugcugguuugugcuuugaucuccuggcccuuuuuaaucccuaggccacuugccucaggggaaggugaggucucugcagcagaaagcagaaaucuccugcucucccaccccagauaauugauguggacagggucgggaaagaggcguuccccuagacuggucacccugcccccagcaaugccccaggaaggugauaggcauggugccaccaggaaagcaggcuccagacaccagggucccgccucagacagacacaccauggucaagaaaggcaggagagcuaccuagcuuccagccccaagugacugcagguaaagacaucaggugaccaggagggaccaagaacagcccaucccauugccaggccccauguaagccugaccacagcaaagaggaccccuucccuccaucucaauaguagcugggacucagcucccuuccagccugggaacauagggcuuggagauagaauuaacaugauucuuucuaacaaauaucauauuuguugagugccugagguuguagaccaagguguguaugagugcuagugggcuaaacauucacugaguuccuucuaaggaaugaagcugagcacaccacguuuauccucaccacacuccugggacuaaccucuacuaacccaucuaacaggcaaggccccugggacucugacaagcuaaguaacuugcugggauccgagggccggugagcgguggaacugcagcuugagccagcucuaaccccagagcccugcucuuccucagccugcugaggcuagcucccccggggcaggcaugaaggagccaggccccacaaagggacugagacucaaggacccccagguccugcccaccugguacuucugucuugccagggcagcugccuggcaaacccugccccucccagcccuuugaaagcugucugcuccuugcagacuugauccugggggccucucagaccugggcuuuuugcugaugugggcauccagccccaggccaaguuuaggccucccuuuaaauccacaaggagcggguggggaguggagaggccugcuuuggcacucugggcaaaaagaguugcuaagaucccagagcaggccuguccccaaaaaacggccauguuuggugagaugaauuaggucauccguuaagcuuuguaacucauugcuaaaauccgucuucuggaauuagcacaaugcuauugaagggaaccaaguggguuggugcuaucaaagggaaccaaguggguuggcugcaggcuugagaccagaaccauaagucuuucuagugaguaaccguaaaugggguggggccgggggaguggagauuaagaguccugguuggagcagguugcagaagccagcucuggcuaacucuagcaaaggggaaauucaccagaaaccaggggguaggaugugaugggagugacacuuguggaaggggcaagcggcugggcugucacggggccaggagcugggaggggcgagcgggugguacucugugcugggaagguugaaucucgccuggcucugcaaucccggcauggcucacuugccgaaagcccaaagucucaguaucugugcuuaagcuacaugccuaccccugacuacacugggguggugaggaagggccuauccacucuggcaucuggaccagcccucccaagacuucgccuagugggggcaaggagacuccaaaggaacuugggugccuuccagaggggagaguagaagacaaacagccagucucugucaaauguucacugcuccagaugguccaugacuguauuucugcagggcugagugucacaucauuggccuugcccuuuccaagugccagacaaggggccaggacgggaugccuuuucaacaacauugcaccgagccgauggccccccacacucaggagcaauuccuacuuguggggaaggaccugagugugcagugcugaggauuagcccgaggaagacgugaauggccacccuggaucugaggaaaaggaggaggaggagagugcucuguuuucuggugcagaaggaggugaaggguaccacagcugcucugaggccugggucuaguccccauccuggagcaccugucugcuuugggcugggagccccauauuucucaagaucagggucaggagacucgggggccagcuguaccauucagaggccuggcaagcucucugcucucccacagagguccaugcuccuucccucccacugggcuccuuggggccucccccccaacuccccaaacaccagaugggaauccugcaggcaauaggaggccuggacagggauggcuuugaggucuuggguuuucagcuccaaccagucuucagagaccaugguaguagcaaagcuagcauugugucccaugggaaucagggccaugggguugauugucgccagacacaccacacgcggaugcagauguugccuaggcaagcuggugucugcauguagaaaggaagcuuccgaggaagagcuggggaggcaagccugggagccaucuuccuguuugugcccauuuuccacacacucucaacagacaucaagggccucacagcaucuagucagugcuguuccagaccacccaucucuccaggccagagucagggagagcuggaugugagcauagccaugcuacucagggacuguguggguuuugacaagucacagagggcuccgugccucaaugucccauaaacugggggugagaauauugccaagcaccuuggguuguggugaggauucacugagaacccagauccuggcucauaguagguaccuggucuagauaagcuccccuccucccugcaugcucucuaaucauuaaucguuaugauuaauaacagcaacccaaucccaucacaaugcugugugaugagugcucugauagaggugucccugacugagacacuuuuaucuuuagcuucaggauuucccuuggccaacggcacaguaaguaaccucagaguucaaagcauucagcaaacaauggaaaggcagagccaccagaaauguacacaugauuuucaugacagguaugguaaugccauguuagcuagcggagccucuuucucuacugcccguauggaccuauguugcaacaccaauuggaauuggauggaaucugugcccuguugccagggucaccccuaacggaauggagagaucaguaaucaucccagcuggugucauacugaauuguuuaaaacacaaaucauaauugaugccaaguaaaagcuccaugugcccauuaaaauauggcauuauggaaaaaguaaaguacauuugaauccuuaaaaauaaaacaaaaacuauguguuagaaagaucacucaggguagaccaacugaggggcuuacaagaacuguaaugucugaugcucaucuccaccaaugucuauucugugcccccaccccuacccuggcaaugucgacagaaaagaccacacugccacaggaguagcggggaccccugugggaggcagcgcagaagccaggcugcuuaaagcagagcccugagucuuucgugcauuuacaaguuuaugugucaaguucuccaggaucaagccagggaguccugaucacuaacaacaucucugccuugggggccuguuuaaguggcuuccagacucagcucagacccuagcucucaagggcaaccagauuagauuucuucccuucucugaaucucaguuucccccuguguaagacgagagggcuggcccagugaccuccgacgugucugcuugaacgaguagaauggcaccagcuggcauucuauagccaaguuuguccagagggagccaguuccugcccgucuuauggcuacacaaggucauugaagucgcccucaggcauggagcuuguagcugccuggccuuauccagccugcccuuggagcagauaggagacugcugccugcugucuuaaagggaggccugaccuugaaggagagccagugugcacagauuacuccgcagaggagacagauacugugugucugacaugcccagagcaucccugaucacauuagccgccgccugaguggggaggaugcugauaccggccuaucucggcaccugguaccagccagccugagucuuggccugaccucgugcagccccugcugagguugucugcagagcgccagaugauggguaaugacagaaaugaaauuagaugagaaguuugccagugauccccaccccugagaugggaguggcucuuacacuuccuggcuuugcagugggguucuccugucuuagccucacuucucucagcucagcacaggaccaggugugggaaacuccugcaggcucccuggaaagaguccccuugagcaggaucauuccuuuggccaaaaucguguccuagagcagcgcucuucuauagagauguaaugcaagccauguuugugguuguaaauuuucuagugaguacacaugugaaaauaucugcauaaauauauacaccuacuacacacucacaaggacuaaaaauuuaaaauuuuuuuaaaacuaaaaggaaagaaagcuagugaaauuguucuuaauaauguauuuuuauuuaaacuacuggcuccaaaauacuaucauuucaauauguaaucaaaauaaacauuagugaaauauuccacauucuuuuuugcuuccaagucuaaauugguauuuacacuuaaagcacauuuccaugcagacacuaaauuuucacuggaaguacuugauauauauuuacuuauucuaauuuuuuaauuuuuuaaauugacacauaauaauuguacauauucaugggguacauagugauguuuugauacauauauuguacagugaucagauuagggugauuagcauauccaccaucucaagcauuuaccauuuauuuguguugcgagcauucacuguccuccuauuugaaauuauguaauauauuaauuaacuauagccaucuuugaucggcauuuagauuucauaaaauguaugauugaaaaguagagucacauacccaaguuauuccaaacauacuuaaauguuuuucagcaauggaacugaaugucaguuuuuaaacuaauguaaauuaaauuaaauugacaauuccauugcucaggcacaccugcuucauucacaugcucaggacccacaugugugguggcaccguauuggacagcacaggccuagaugagaacaccagcauagaacaggugcucuacaggcaaaaaugaaagaagcaaggggagaaagagaaagaaggaaggaugaacaaagaaagaacggcagggauggggagggggugggagccucagacuuggaguaagacagagcuagauucacauuugagcucugccauuugcucaauaaaagaaccuggaccaauaacuuaaaucccaugggcuucauuuucaucaucugaucguagaagggaaacugccuacuuggcaagacagcuguaaucaucaugugaaguacgauaugcagacggcaggacaguuucuccccugaccccacccaguccuuucucuuuuuuuuuuuugacggagucuuguucugucacccaggccggagugcaguggcacgaucuuggcucacugcaaccuccaccucccugguucaagcaauucccugccucagccucccaaguagcugggauuacaggugcacaccaccauguccggcuaauuucuuuguauuuuuaguagagacgggguuucaccauguuggccagacuggucucgaacuccugaccucaggcaaucggcccaccuuggccucucaaagugcugggauuacagacaugagccaccacgcccagccucucucuuuuuuuuucaguucuucuuuuaucugucauagacaaacaagcuuccaaugagauuuuaauuuuuuaguuguguugcuuuaaaacaaacaaaaaaucuaauaaucaucgcuuuacagcugugcuucucaaauuuccuggugcaucagaaucccccaggcugcuggcccuucccuggcuccagaggccuggagugagucaaggaaucugcauuucuaaugaacucuggacaauacuggugcugcuggucugagaacuacucacugacaggucaagagacagcagaaaaaagaaaaaaaacuuuauacuuaaucccuuuaauggcacuuuuuuuccuuuuuuuaaauacaggacauguuuauuuuugccuugaguccccaaaaauucucuagcugguccugagcagagugggugagccaccccagaagcaggggcccugaggcugugcucaggguggugugaaucugggaugcagagagaugucccuggacuguguuugauucugggcacugugcucaggagggcuguccccaaggcagugaggagccuggaggccaccccgcuucccugcagcucugagcuucuccacugugauggaaggaggacucugcggggcucaauggccacacaaauggaugugaagggcugcacaucucugugcgggccuagggcuagccccugcaccauguuuuuuaguugauauuuagcugguguguccccuugggcacauggauacucaaggggugagaacagacccucacagacacccaggggcccccaaguugcuccauacaugcccaccagcagccaggucccucucccaccagucacuaggaccgugcugcucugcugaggguguacugaaaaugggcaccaauagggagaugacuccugggcucagccuccccagcucuccuauggagccuuccuuucuacauacagacaccaaccugggcaaggaaguccagccaggcagcuccucuuccgacagccugcuaccccaccugcaguggacaggccacccccaaggguguucagccuccacucugccaugcacuaggcaccuggauuggggaugggcaacagacccauccccacaaagauacccacccuguggcacuggcacugccgacccugagcauacuccaccccaaaacacucuggggugccugaccccaaccccagcccuccucaugccuguggucaggccuccacugggcaugaggggaagacagcaauagccacugggcagggccaggagaggcggggcagaggccugggaaucaggaggcaggagggagccaggaaaacccacucacaggaggcggaggcagaggcagcaggaggcaggacugcagaagggccccagcccucagcauacgcuccacuggcccacucgacuucacuuaaaaaacacaaauuuaaagauagaaugauuaagaauuucaagacacuaaccacagagcauucaauucuaaaugcagagcccuucaagaggcaagggugucacugagcacaugcccuaguuaaaggccaugaaacuggcccugacaaugaguuucugaauuuaaaugcaggaaguggcccucuguucugaccugcugggcuccauccuguggguacaaccuucgaacauuccuugcuggucucuuccugcaaaugcacuggcccucagagcucaaguccugagugaguuuggugcacaucuuaucaugguccucaucucauucauaaacuugacauccagagagggaaaguggcuucuccaagggcugggcaugcacagcucccaccacauucucgugccaugcucuucccuccagcacccggccccugcccuacagccuucuccuguccaaccugcugauagcaaggcuccagcauacacuucacagguggcucuuccugauccaauacggcaaaggggccuuuaacugaacuccccccauggagcucaauagguaaugucacccuuggaggguggccugcaccuucauccuugcagaucgaggccagggucccaauuaggugaucaaacuucagccacaucucuugaaugaugccaacuggaaggugccuuuagugucccaccaauaggacugccugccuggaccagcuuggcuuccugggugcauaacauggucuauacuccagugcacuggcccagccucucucuuuagugugacacucugccugccugccugaccccacagccuguucuacacagggggacacuuccauugccuuugggggcuccaggaugccgccuguccugcagcgggcuagcugcauggaucuagacuccaggcugacucucagcagggucaugcucuuagcaggaggcucaagaagaucaggcuggugcugggcaccacgguucugugacacagagacacagaaggaugugcacagaagucccucagauggugauagcgcaccgggcaggaaggggugaugcgcaggaggagguaugcuugugccagcgcagaacaaagauguagauaaaauucuuuaugagugaucucagcuagacuaaaucccuagauaaauuaggauguggggaggaauguggcaggggauuaguagguggggguugaaugacccaggucaccucugagaaaccaaacccaaguacagagccuccuccaacugucagcucaggaacccucugagacauaggcugcuccccagaguagguucuuccuaugcacgugugguccaugggccagcugcaucagcaucaccugggagcuugguggaaauacagacccuggggccccacccaugccaccucaaacagaaucuguguucuugcaguuuguccugggugcucugugugcaucuuaaaauuggagaagcagcacuuucaagcaaaacaacaucaagccuacccaacccuggacuaggagauccugagaugugauccccucccucaagaacuccuaguccgggguugaguagccuugauguuguuuugcuccaaagcgcugcuuuuaaggugccugguucuuuaaaagugcgugauaaauuaaaccaaugaaggagcaaucauccaaaagcagaaagaaugcuaaaagucaugguugggagaggcaacaauaacaagaaauggagucuaguucucaggcugcaaacugagcugcaagccagggcugacuacccaugggcugauucuggcucacagacauauuuuguuuggcucaugcaauauuuucaaugcacaggauuuuacccacuaaaaauauauagauuucuauaggguaaauuugggccugcuuccuccauauaaagaauugacaggagcuggcagggcaugguggcucacaccuauaaucccaggacuuugggaggccaaggcgggaggaucacuugaggucaggaguucgagaccagccugaccaacauggagaaaccccgucucuacuaaaaauacaaaauuagccaggcacaguggcgcaugccuguaaucccagcuacucgggaggcugaggcaggagaaugaacccuggagguggagguugugaugagccgagauugugccauugcacuccagccugggcagcaagagcaaaagcugcuuuuucaguuuaucuuaccugccugaucucuaugggguuagagucuguguguacuagugcacauaauaaacucaaaagcaaagauggcuagaaaaugaugguuauuauguauuggcugacuuauuugacacucuuaauuauuuguccuguggggucaugguuaagggugaggugcucagucuuacugucugaguuucaaucacggcucagccucuccccagaucugagguccagagcgagucacagaacccuguaaacuucaggcuccuuauuugaaaaauggccgugacaaaaguaguuccauguaggauguuaaacguguugcuuggcacaugguuaguuauugguaaaggcuauaaauuaguuuaaauuaaaaaauuuauuauaagucaauguauuuaaauuaauuuacagcuauuuaacaauagcuaauuagcacagcauuauaauugcaguaccagagaaaaacaacaugaaggaauacaaguauuuauucccuacauugcuaaaauaccaacacugauuaucaauauuuucuauggaaagguauucagaaugccuaacauuuuaaaauucagcuaaaauauuagacauuucaaauaaaaaguaaauauuagaagcauuaagugaaaacaaaaaucugugaaauauaaauguuaaaaauguuggccgggcgugguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucgcgccacugcacuccagccugggcgacagagcgagacuccgucucaaaaaaaaaaaaaaaaaauguuacccuucucauacuaauuguuagcagaugacaugaauaaaauauuauucaaaaguaaugaacuaaacccuacaagauaaagaaacuucuaauaauauuuggaaugaaaaucuacuauuugauguuaucuggaucaugagcauauuuuugugcccauuuuuuccggcugcugaaaccuuuuguuuacucuaggcuggucaaggcaauggugagacguuccaagcuaaauuucaaacuaauuuccaauauuauccuuugaguuuuucaucuucaaguaauuccauuucuucuuccccacuuuagaagauaucuuuuauuuuaaccucccuucuuuuuuguuggcaggaacuacauuuuuuuauuugaucaugagcuuuaguuuuauuucagagaaagcauuccugguuuguggucaucuucuccaguguuaauauggguagguggagaugccagugugucaccuggagcaaauuccaggcuggaaagucucugaagcagagugaagauuucuaucaugauggaggcagcguaguuccccuccuucuggguuguggaagaauagaaaacugcuuucuaaacaagcuuuccuuuacuggauccaaacgccuacuguagugcauucccagguguaaaugguucuaauuuuuaaaaaacaugucacaaaaauacuaauaguucagcauuucucaaaagcacauuauucuggaauaccagaaucccaaaaacuggaauuacaauuacugaaaaacaccaggucuggagagucuucugcuaguccguugccuucguggguuccaagaacauagcucucccugaugcuuuucuguugacuugagauugaggggacagaguuugggaggccaagguuaggaaagaagggaaguuguugucuugaguugaauagugucccccagaauucaugcagaugcaaugagcuaagaggagguaauccugaauuagagcggccccaaauccaaugguugguguccuuagaagcagaggagaggacagacaggaugcacagagacacagagggaggaaggucaugugaagacagaagcagaagcugggggaugggucuacaagccaaggguuucuagggaaccuggaagucaccagcagcuggaagaggcaaggaaggauuccucccucaagccuuuagagcuccaccgcgauccuggacuucuggccuccagaacucuaaccaaagaaguuucuguuguuuuaagccacccaguuugugggaguuaguuauggcaucccuauggaaaacucauaccauuguggcauugggagugacacugccagggccacuggcccuccgcagcagggcccaugcucacuagucuuggaauccaguccacacucucaggggccggaagaccaagcuccuguuccugcuguccacuccuggcgggucucccaucuuccugcacccccucucugccuagcaccuccauccaugcagcaugcugcuccagccaugcuguaucauuuacuuggcccgaggcacugccccugggacuuccggugccgcucccggaggccugcggucaggugggaagaacagagcugcaggcauccaagagaccgaggagaggaccugcugcuuccccccugugugcgccaccuugaaaagucaccucaucuuccugaguuucacuggauggugacaguaaugaccuuugcaggcccuuggcagacauuuuggaauacagcagugccuggcacacagcagaugcucaauaaacaugagaaccucccgucaagucagcauaggaaagacugagaauuccagcauccuggagaaccaggccuccccugaugggcuugggggcagagcuggagcauguggggacaggagcaacacacccauagugaggcuggagagggaugugagccacuuauccucaucacauguacacagcccgaggaugaggagagggcuccaggaaggggcucugguccacagucuuccaugucuggcacagagcagggcuccacaaauccugguggcaggaauaacgcuggagaagcagaggacccucuggcugaugcaccagagcagagcugcaagaccagccaccccgcaagggcugcccugaaggaauguggaaaccagaaggauuucuuucuuuucauuuuuuaaaaauuaagagaagcuaaccuucuuuguccugugaagggucacuuaaguggcccucuuagauaugcaaaugcaaggcuagaaagcagccggccuccugggauuccuguauaacaggaauuuuugcagcccuuggugaugggguuuuuuuuuuauugaguggccuggcaaagauugugcccuucuuuggccugcagaagaggggugauugguugagagagcuuggggaggaaaagaaauuuguggacuaauuugcacaaagagcccagguuuucugaaaggaaugagacaaauacaccaacacaguguuuucacacuuuuuugacaagaaauagacauuacauugcccccugggagcccagggcaacagaagcugaggcuucaggaaacaccgcuguuccuacaugcagugccuucuggcauguucuguccuaugugagucuaucuccuucuuaaaaauuccagacaaagcccacagaauugauuucaugaccccucuaaugaacugguguccauagucugaaaaauguuuuuugagguuugguuuacaggaggucuguuggguggauugaggccuggcuguaggaaguggggaaacagaggcacuggagguugagugagccaacuugguacugaguaacuagcagguggggggacaguggucuucugagcuaugcaacaguagagcugggucugaccuggccaucugaggccaacucagcccggaaaauaguggcgagggcacaagagcuugcaaacuuuguccucuagcaugaagguccccugccugauccugcagagacuuggcagcccuuuccuuccccugcuggcagcuccacaggcucaacccccuauuucuauacagcuguccucucauuggcaacaccaaggccagcuuggaagauaccacccugugcccaucauccuggggcaacccagugcccucgucuggcagagaccucccccucaagacugagcagaguguggagguauucucagaaggcagaacacccucgaagaauugcaguuucugcagcaaaaccccgaggaacaagggaccuuccccaccccaacaucuaucuaugcuuugaacaggacccaggccagccucugccgggccccauccugcgccuuucuccuuccacagcuagguggccacagcaagcgcccaugcuccccuuuccucagggcagaaacucucccaauucccgccccuccaccugugagcacaccuggccacagcuccacugagaaagggaagggugucgggcauuugccaugugccauucucuuuuuuucauaucacagccaaugcugacaacccucagggccuucuaccccauucguuguccacaugaacugagagucuuucaagaugguagaaguuggaauucaauucagauagcuuuggcgucaguuucagucaaagcagugugguggcaacgcaccagcuugggugccaaaaguucugacugucccuuacagcaccucaccccucuggaccgguguggcagccaaagccucugcuucucuugcagcugcaaagauugacuccgccucccauccucccugcaguaagacagggucacaugacuaaacccuggucaaggaaacacagguaggagugacaggugaccucugaggcuucugaggcugcugucagcaccagcuccuaaaaucccuugagaaacucccugcccccucucccugcaucucacagcagaggauucagaggaggacacugagguccuagaaggagccugggucccugagugaccacauggagcagccccacucccucuucccuuuucaugcugaccugcaggagccagugaccugagcaagaagagucuuuaggggauuaagccacugagauuugggagcuguuagagcagcaagcaugaauuaccugauugaugugcccgguuuccuuaucuguaaaaggagguuaucaacaucauucucaggguuguugugucaaugacuuaugauucagugaaaacacaaacccaggaucugacacauucuagguaacugaggucccuccuuacagugucagcagcagccacagcagcaacagugcaaggagcacuaguuaacucccagugugcacaguacuaugccccagcuaaguggaccagacaccagaugggccuaguucauauacagggucucauguucuauagcaugggggugcugggagccuuaaaaggugugcaggacugacugcaaaugcuuuguaaaaugaauuuuuccuauaacugcagaccauuaaggugauaucuguaaauagaaugcuaagcugaggggucacacauaguaaaagugagaaguaagaaaguaaggaucacccuggaggcagacaccucaguucuaauucugacuuuuccgcuuacuauuuggaacccacauaaaucacuuaaccacuucaagccuuaguuuccccaucuguaaaauggagauuaugauaggguucuugcagggauuaaugaguuaauuuaugcagaaugcucagaacagugcuuggcauacaguaaguggcguguaugccacuaagugauuccugcucagguaaccgagaccgccucccacccugagugcaugguagggucugaugucaucacagcugcugggaaguaccuguccccuuugggagcuucugcuguguuuguccauauggcaaggacagagagcccucuuggccccauggccuccugcucuuucccaugcugcauuucuccugggggugggggaggaaagaaaguuggaaagagcaggugggggcagggugggggugaggcuucagggaaaggacaaugggcuuuguaaaucccucccugggcaggcuggccaaguucaauggcuucaggccacaugaacagcaagaaaaauguggcccaggaauuucuccccaacgauuccccuugucuuucucugugggaauuuggagcugcagacacauuccuuccaugaacagcauccguggcagcugaaggcccauuggcccgagcuggggaaccuggcuggccggcacuucuagagcucugccccuacugccucccccuccaaggagugggcacugccagugugccagagaaugcacucucacuggcagaccucacagcuugcucugucagggacugaccccuccugggcacggcccucuccucuccugaaccaaacugcccagacagcuuucacagcugcuuuuccacaaucugucaccuggaaguggagacuagacaucuuggagagaauucccauccauuccuuuuuuuucuaagccaaguacuucccgacuuaagaggaaauuacuucccagaugcucuaaaauucuuuuaaaacacuguaaaguacaguccacaggccagaucuggcuugccaccugcuauuguacauaaaguuuuauuggaacacaaccacacucauucauuuacguagugucgaugguugauuucacaccacaaugguggagcugaguaguugcuaaagagacuguauggcccucaaagcuuaaauauguuuacuaucugccccuuagagaaaguuuacugacuucugguuuacuccuuuguuauuccacacaggauuugaaauggccucuauugagaagacuuagaauaaaauagugauaccacaauaguucaaaauaauugagagccugagaaaaugcaaauaaaaguagcaacucaaaaucaugaaccacaacacaaauaugaagacuguuaggaccuacauauuugccaaagccaggcuuuaaauuuuucuugagcuuccuggaagccaaaggaaaaagagaaaugagacaagucucaucaacagaaagaaaaaagaauaccaguccuuaugggaucuagagcuuuuucucuagaaaaagauguauggggcuugcuucaaacagaaaaagaguaauacccaccuuccccagaaucauauacuuaguuaaaaaaaaaaaaaaaaacaacagaacaaugagucugcaaaaugaauagcaacagcaaugcuguugaugagggucaguacggggacagggguucuuguuaauaugucuggccagagauugaacuagauaucagaaggcaaagcaguuggcuuccaugcacugugcuaaaagugcauaaaacauuuugagaggguguaagaagccucauuucugcuuaucacuucuguauaucuauuuguuucagagcaaaaacuggaguucaauaaggacaggcccaacuugucacuaacucaccuuacagugccuggcgcaaaguaggcccucaagagauugcucgugaacauauacaccauggaauacuaugcagccauaaaaaaggauaaguucauguccuuuguagggacauggaugaagcuggaaaccaucauucucagcaaacuaucacaaggacaaaaaaaccaaacacugcauguucucacucauaggugggaauugaacaaagagaacacuuggacacaggaaggggaacaucacacacuggggccugucauggggugggggguugggggagggauagcauuaggagauauaccuaauguaaaugaagaguuaaugggugcagcacaccaacaugacacauguauacauacguaacaaaccugcauguugugcacauguacccuagaacuuaaaguauaauaaaaaaagaaaaaaaauugcuugugaaaaaugaggagguuguguuaaaagagaaccuuccaauuccaaugucugugggucuguguuauguggacauacagugugugugcacacugaauuuuagccaaacuccuaauauagaucagaaauaugaugggagaagggggugggggcagggacgcaggcccagaugagacccucaccaccaagaggcagaagucagugagugguuguuaagaaggugaccagcaguguucagacugcccagauuggaggacaggcucuacccucuacccaccagcugugugaucuugagagcucgcauaaccugggcggguguccauauccucaccuguagauuggaucugaugacauaucacccuuacaggcuauugugaaaauuaaacaaaauaaugcccgugaguuacuagugccaaucaaagguauguuuugugauaagcugucuacaaagugucuacaucacgcccuucuucaacaagcucccucuaccagaggccagggcuggcaggagacagacauuauucugaaaagcuaggagcaauaacccgcggucucaauccagcacuccacagggcuugucuuuuuuaacuggaagucucaacuacaguuaugugugccuuugucccacaggccaucuuauucaccaucgagucccauuccuuuuccccaaaaaacauuuaucauagaauuguuaagaucacaggcuagaaagcaagaugggcuggguuccaaucugagcuuaaccacuaauuagcuguugugaccuugugcaaaugacuucacuucucuguacuucggugcccucacuucucuguacuucggugcccuccucuugcaaguggaaauaaugaugacaucgaaugcauaggauugcucugaauucuaagugaacgugcacaugucaagcucuuagccuggcacauugucagggccaggcagugcuagccauaaggauuuugcaucacuuccuauguuucagcuaucuguaacugccuaacagacuacuccaaaguuuaaugacuuaaaacaacacauauuuuccuuuuuuaaaaaaauguauuucaauagguuuugggggaacaugugguguuuauuacaugaauaaguccuuuaguggugauuucugagauuuuggugcacccaucaccucagcagugcaaauuguacccaauguguagucuuuuaucccucagccuccugccacccuuucccccaauuccccaaaguccauuguaucauucuuaugccuuugcaucccauaacuuagcucccaauuaugagugagaacauacgauguuugcuuuuccauuccugaguuacuucacuuagaauaauggucuccagucccaucuaaguugcugcaaaugccauuauuucguuccuuuuuguggcuaagaaguauuccaugguauuuauauacuacauuuucuuuauccacucuuugauuuaugggaauuugggcugguucuauauuuuuguaauagcgaauugcgcugcuauaaacaugcgugugcaaguaucuuuuucauauaaugacuuacuuuccucuggguagauagccaguagugggauuguugaaucaaaugguaguuuuacuuuuaguucuuuaaggaauccccacacuguuuuccauagugguuuuguauuaguuuccauucccaccagcaguguagagguguuugcuuuucaccacauccacgccaacaucuauuuuauuuuuauuuuuuuauuauggccauucuugugagaguaaggugguaucgcguugugguuuugauuugcauuucccugaucauuagugauguugagcauuuuucuauaugcuuguuggccauuuguauaucuucuuuugagaauuguuuguucguguccuuagcccauuuuuugaugggauuguuuguuuucuucuuguugauuuguuugaguucuuuuuagauucuggauguuaguccuuugucagauguaaagaucacaaagauuuucucccacucuguggguugucuguuugcucugcugauuguuucuuuugcuauacagaagcauuuuaguuuaauuaagucccaucuauuuaucuuuguuuuuguugcauuugcuuuuggguuuuuggucaugaagucuuugccuaagccaaugucuaaaaggguuuuuccaauguuaucuucuagaauuuuuacaguuucaggucuuagguuuaagucuuugauccaucuugaguugauuuuuuuuuuuuuuuuuuuuuuuuugcaauggagucucacucugccucccagguuggagugcaguggugcaaucuuggcucacugaaaccuccgccuccuggguucaagcaauucuccugccucagccucccaaguagcugggaauacagaugaccaccaccaugccuggcuaauuuuuguauauuuaguagagaugcgguuucaccauguuagcaaagcuggucucgaacucuugaccucagaugaucugcccacguuggccucccaaagugcugggauuacaggcgugagccaccgcgcccagccaaguugauuuuuauauaaguugagagaugaggauccaguuucauucuucuauguguggcuuaccaauuaucacagcaccauuuguugaauaggguguucuuucccuacuuuuauguuuuguuuguuuuguugaagaucaauugacuguaaguauuuggcuuuauuuuuggguucucuauucuguuccaaucgucuauaugccuauuuuuauaccaguaccaugcuaaaaacaaaacacauuuuauuugcucacuguucugcaguguggccauggcuugguggggacagcuucucucugcuccacaugguaucacuuggagaauccacuuccaggacagccucacucacacagcuggaagucagugugguugcuggcuuggaccucaguucuccauuuggccucuccacauugcuagguugggguucuugcagcacaacagucucaggacaauuccacuguuuacaagggggugcuuucccugacgacagggaaaagcagaagcugccaaguuuucuuaggacuuagacccagaauugguccagagucacuucugcuaccuucugucaauuaaagcagcucauagggcagccuagauucgagggaggggauuacauaagaugcaagaacuggaaggugugguuagcuggggccccugagcuaacacauugcccugccuggucuccaacuccuccaaccuguguucggcccacaucucucaccuggcuuaugccuuuugcaucuuugcuuuuucucugcuccagucucccccuuccagucccuaucucgcucuagccaccaggcuagccagucagaaucacaggcugcaucaugucuucuacccuaaaugccauguugugacuccccugacccaaguaaagagcaaguucuuaaugggauacuacugcacccauuggaggacuguguuaguccaugcaaauugcuauaaaggaauaccugagacugggucauuuauaaggaaaagagguuuauuuuggcucaaaguucugcgggcuguacaagcauagcacuaacaucugcuuggcuucuggggaggccucaggaaguuuacaaucauggcagaaggcaaaugggagcauaugugucccauggcaagaaaguaacagacagagagagagagagagaaaaaggaggagaucucauacucuuuuaaacaaccagcccucaugugaacuaccagagugagaacucacuuauugccacagggauggcaccaggccauucauaaagaaucagccccaugacccaaauaccucccacuaggcccaccuccaacacuggaggucauacuucaacaugagacuuggaggggacacacgucuacaccauaucagggaccauuccugugcuguccccuaaggugcuggaccccuccuugcagcucaggucccaccucaaagcauucuccucugcagaguuuucuuuaccacccucggcagacuggcuuucuguccccuacagcucccggggcaaccuccuaucccccgccccacauugggccuugugucaggcauugagcuguguucagucaucauuuguacaugagugaaggaaagaaugaucauuauaggcucccuaagcuaugcuuguggcuaagaugguacauucccauuuauucccuuccucugagcuacccagggcugagcucacaccugagauagugcugugagggugccuuggauauucuggggaggagcaauccagacuccugcauuggaacuauggagggcagguccugagucuccuaagaaaauccuugaaugaccuggggcauaucugggaccaggggcucaggcugcacaggcuucaggaucccagcagcagcagcacccccuagaaacagcuugacauucucaccacccaacugugggucucccagagaaauggaguaaaguggcaggaaguagagcucuggaugaauggggcagccucuaucccauagaaacuuuguccucaaagcugguguccagccuccucccagagcccauugugcccacuggauauccacccccugguucuaucucuucugcccugugccugguggugggcuggaggcuggccuuccugcugggaaacauguccuagaggcucccaccucuggcccuucuucuggagcaaggcggcuugagcacagcuagagccuugcagcauaugugauccugauguuuuggcuaaauucuaguuaguuuggggucaucaucaauuuggguggcagagcuauguucagaaaauuugauuuuucagacaaauucuaugcuaagugggugcuuugccagucgcagcccaugacuuuaggccuaacuagggaaaacuacccauucuucuguuuauuuaaccauuaaaccauccaucauccuuccuucuguucaccuauggaacacauccauucaaccaucccuccacccauccaucauucuguugaccuauccacaccuccauccaaccaaccauccauccacccauccauccaucuauucaccuauccacaccuccaugcaaccauccauccacccauccauucaucuauucaucuauccacaccuacauccaaucaacgauccauccacccauccauucauguauucacccauccacaccuccauucaaccaaccauccacccauccauccaucuauucaccuaccuacaccuccauccaaacauccauuacuccauccauccauccuuccacccauccauccauccauuuacccauccaucugcccauccauccauccaugcacccauccauucauccacccauccaucuuggcucugccacuuacuaccucauuggucuugggcaagucucuucaccuuucugaacauuaguuucuuccuuuguaaauugaaucucauggcaucugcuucaugcgguuguccugugguuaacugagauaaccuuugugaguugccuggcacauggugggaaacacauagugaauguuauuuuccuucccccuugaggaaggacacacaacuaaaaaacuauaaaaagacaauguguaauuaggaauuaaagugugugaaaccaaaggcaauaaaacaagaagccccugccuuccuauuugucugcugaacugccuugggaguugauauuuaaagccgcuuugaaaagucgaguaucccaaaauauauuuaaacgguucaauggggacguugacccuuuauaauaggcucauuugaaacgauccugcuuugcuacuuccucucagaaagauaaacaagcggcccacaauggccgcugugauguuuucuuuuaaaucuugcuuuccaaauguaggacuuggccguuggacaaucacccgaggggcucacuccccgcagaugcucucccugaaugcagggagcucuagcuuggaauuccuggggccucauuaagcccgcugugacuaagugaucuugccuggugcuaaaacuguuuaaaaugacuuggcagcaaccagaagucaggucucucuguuuuuucucaguuacucucucuuuguaacccccaccuaugugucaugaagugaaaacaucuuucuuuccggaucuaacgcaggaaaacccuucucucuccccgaagccucacccuggucuuucugaggaguuaaaggagagggagggaggcagaaaucugcccugcucuuguuaaucucuccuuugaaugaagacuuaacuccugggaaaaccucuucccugcucuaagucauucuuuccugcccccacauuuauuuaacucuucugcuccgugccuugggcagccucugcuuuccagccugcccuugcugagauucuccucugagaccaccucuguucuccccaaauggaauugugguagggagggagggagaaaauuccagucaagucaaggccaucagagcuggaccacagcccugcuucaggguuaggaacagauccuaggaacuggggggugacaaagaaccuuacaugaagaagccuacucugugccaaacaccuaaaaauauaauuaucucaaucaaaguaaauugauuauuuacuuuaauuacacaauaauaccugauuaugcuuuccuuuuacagaaugaggccauuauaaaaaagccaaagucucuugacacccacuuuacuccauucuucuuccaccaucuccccaaagggaaccacucuugguuuccuguuuuccucccauauauuuuucuaagcccaagggccuagaacagagcaugguacagagugaacacuauaguaauauuuugugaguauggguaugugucuuacauaagugccaugaauccguaaaucucaaacauucagccauagcacucuccuuuuauaucauauaccaucuuaugaaaauuccaguguacuugauaauucuuucauuuguuuguuuguuuugagacagaaucucgcucugucacccaggcuggagugcaguggccgaaucucggcucacugcaaccucugucucccgaguucaagugauuaucaugccucagccucccaaguagcugcaauuacaggugugcgcuaccaugcauggcuaauuuuuguauuuuuaguagagaagggguuuugccauguugcccaggcaggucucaaacuccugggcucaagugauccaccuacuuuggccuccuaaaguacugggauugcaagcacgagccaccaugcccggccgaugauucuuuuacugaugaacauuuuggugguuccaacuuuuugcaaucacaagcaaggcugccaugaauagccuuccauagacuuuccugggcauguggggacacauuuccauggggugcauacuaagaaaugagcuugcucccaaggcagcagcauuuuuaguuuuaauaaagcagcuuccauguuaccuuccaaggugauugcaccgaacacacucucaugaaaaagugcccaaauccucuccaagacuugaugaugaugauagcucacacuugcaaaacacuuaccuacaggccacuuggguucuaaguccuuguauauaucaacucauuuaauugacacaaccauccggugaagcaguuucuguuaucuucucuguuuuauagguggggaaacugggcacagagagaguuugaauaacuuaauucuuaauuugugcuaaguagcaucugaaccgguaucauuuuccucacuuuucaggugaggaaacagucucagaggggagaugacuuauccaaagucacacagcucauaaguagcccgccagguuugaggguagccugggcaaacacucccucuuccuacuacugcacaguacaggugagcugggaaacugagagcucggugguccugaacacccccgacaaagucacccuugagaugacugcccagaggaugcuggugggguugggggcgucucccuugcacagcgagggcgccccuucuucccauucugcgcggggaggccaggccgguguggccccccaccccugcuuggcucccagggaggcggaggcagccccggcuccguggcgcccccuggcggcuccugggagagcgcgcggcccggcaccccgggagaguaacgggccguggggagggcgccggcgagggcagggagcagcgcggggccgccccggcgcgcggagauaaaagcgggcaguggcgcggcggucgcgaucugcgcguucuccuauugauuagcagggucugcccggaggccggcaugcccgcugcgcggggccgcgguggagugugagggcccgggagccgcgggccggcggucccgcgcacccugcgcccagcugggcacugcccgugggccggaccucggccgcgccgccccggggcgcaggcggcaggcggggagaggagccgagcggcggggccgcgggcggcugccauggggcugugcugcugcaaggacuggaggggacaccugcgagcgcccaaagguaacuccggcgcgcacgugcgccccgcucccugcggccgccgccagaggcugccagccccgccucggggacucgccacgggguguccagggccgcccgcaccugccucagcuuuggaaagggcucaggugcggcugcugcuccucugagucuccuaacuuuggaaggggaggcuccccuucacucggggcgcgggggcgcauccuggggcuccucgguccccaugugggagugggggugggguccggccccugggcgggaguggguagagcggaggggaggguccgcccuccagggcccggggcuggccgcggcgccggcugcagguccgccaaguccacggccgggacggaggaacccccggcgcccagacccgcucgcaggucucugcaccgcgagcccggcgcgcgcccugcgccgccccugcggcuuaacugccgggagagggaccauucauucucgcccgccucugucacaaacuuggacgguggggcccugacucagaguuuuccaaaacucgcggcggcaaccugcgagcagagcugcuugaggaaugcagcagucuuggagagggcccaaagcccagaaacacgcuuaggacguuggcggccgccggagguccggccucccgggggcuggggcccggccgacuuaacccuugacugacugaaaugaucccuguugaucguugggaacauaguggugcaucccuuuacugcagcgcucccuaaacucaccugacccuaacacucaccugccgcgcuuauuaagcaugcagauucccaggccccacccuggccugcuggauaggcucuggggaaggccuugggaaacuguguguuuaaggaguuccccaagugacuccuauggccaggugagucugggaagccuugccuguaaaccauauaggguaaggcaggcucugccagaaugagcacuaggucuuccuuccuccgaaaaguguauucugcauccagauacagaaaaggucaggcagccuucgaccuuguccaggugagaauggugccaucaauguacaggcugguuucacaaaggguuugaaguagcuuauaacauauauaauacuuaacuauuuaaaaaccuaaacaggaccccacauuuacacaggacguagagaggucaagggaaaauggagcccaguuaaucuggcuaugagguaugaucugugguugagccucuuugcaaccaaaaccaagugaaaaaugugagugcuguaguugcaagguucucauugucccagagcaacaguuuccucagcuucugauuguagaaagaaugaaaaagaauuuugcacaugaggcuucauucuuggaagcaggggccgagagcccuguguguggugucuucacuaugacaauagcuagggcugcaguaggguuuagagggcaaggucuugcugcaugcuccccgagggcaggucagagcccaggauuucacccccgccagggccuggacgagcagcuuuagucucuccugaccccucuucaguaaacaugguaaagagugucccaaaagcaaggguggauuuacaaagucuugguuagagaggacauagacucauuaagcagccucagaagagagccaggggcaccuccucuugcuuaggucuguccucuggggcuguggacccccaaggccagcugcuggcuucaccaguccagguaaggaaaaagccuggucugggaguguuccccagcugggcccuacccucccaccuacccgagagauggcuggccacagcagccugggaguaggcacugagucugaagugccuacaagguucugcagcccauggaaguuagccaagcuggccaaguggguggggagcgcuguggugccagaguggaugaccagccacugucuggcagggaggagagaacccaugcaauuguuggagagucugagguucaaggaagacagauguuugaugucuuaguguacaaagucuccaaggguuuaaaugcugcaggcucauuuaacaaauuugaacccauguggccagucuggcuggguggcggacagucugaaccauuguucacaauuaguucugcaauaaacacgggaaggguuauuuggucaaauaaucuuagacauaaggaauuaugaaaguuuggaagauuuuucacagcaaacagagccuuugccacacuggcacaguugugccugcuaagucagguggauuggagguauggucuccacaccuuucccuagggaaccuucuuuucauagagcauuucauggcacacauauguguggacacacuuugagaaaugcugcuuuggacauuaaacuguucgguuguaauagcaguaacacaguaugucuguguauguauccauguguguguuuagcucuugccacccaccuaaggagcuaucugacucucuagccuagagauguguaugugcauuuuuuuaagaaaagcuugaaagagaguccauuaaucauugauaucauuucaauuaaagcaacagcuaagacaacaguuguucuuauugauuucauucuuggaugaaucaaacucuuacaacagaacauuuuagcauguuugucccuguguaaaaaucuacuugauaaagcagaaaagcugaaauauucuauaaucucaugaagagagcagcaaaaauauaucaagagccagagccacauuaguaggugucaucaucacgccuuuaaaacccaaauccugggcuuuauccaggagccccuugcucuccugcuggcugcaaagcuguaggugggcacaguggguccgggaagggauuguugcgugccuuuuucggggaggggagggugugauaugcugugacauuaaucccacuuaauaucauaugcaagacagguuuucacaaauagagaaauccuggguuccaggugcucccaaaaagcugaaaggucagugagcaggaucugauuuguagaggauaagccuccucuaaaagcagagggcucauguacuugucugaacuccgaggguauuguuucuggggcauguuuccaggugcaucuguauuuagagcucugugaugggucuguuugguggcaaauuucauuuucuucagcuuugcauuguuacccaagguggaaauuuggaggaagaaggugguacuggagcacagcauggagucagcuuuguuccagggcagcgaggggcaggagcggacugguaggcccuuagauccugacacgugcucauucucugccaccgcuucaucuccagcugccuuuggagcucuucgccccucacccuuccugcugcucucagcagcagcagcucuuccuugccuucugggguuuugcccaugaccaggucccaugcucuucccgacauccucacccucccucccgucaacuccugucagcccauaaaccugccugaguugcucaaccaaaaauucaaaaacaaaaccaacaagaccaauuucuugucccugucuaugcuccauaagcccugcccauuguuccuccccuccuuucccagcaccagggaacagugugcccagcccugaauccccuuuguccuccuccccacucauccuggccccccugucaggcucugccuugaaggagaucaucugcacuggaccagaugaccaguucugacgcucugagcaccugcgggccugcuccccuuaggccccuccugggcugcugagggcugccugaggacuguggcucccugaaugcugcagcagaacagcagaaccagggcugaaggcagcccugcccugcuggcuuuuggcuauaaguuuguucaccuucugagcugucucccucaaggcccugaugacugugauugccucuaaacaaaugccuccgagauucccucuccaagcucugcagugccugucugcggccugcagauccagagccccucauuagacuccagugcagucccgcacucccacugccucuucugcuuuccuggcucucgacccugcccucuucuucauuucucacaaccaauggcugauggcuccugugcuccugcccuggaggccaccgcaacaccugugcauucccucgacuuaucgccuugauggcacugcuuccuggcuggccauccugaguucacccuugccccuucuaguccacugcccaagccagcauccacccacagcucuggagacacuaugauccuccucaaaccccacgcuuggccccagacugccugcagaaaaggcucagcuucccagccuugcuggcacuguguuccccccucccccucccaggcuccccagaccaccucucugguuuccgcaccacaccacuuccucucaagaugccaucaaaugggccugagggcagucgagccugggcagguggccugugcccgaauccaucucugagccccagcccucgggcccaguucauuucauucccuuuggugcggugagccugggucugccgcuggggaucacuuugucaccuauguggccuggcaccacacuagcacagaaucuguacuugugaacaguagcaagagcagagugugggcagagacaggaaaccauugagcucaccugcuggcuggccccagccuauuguuggguuacccaacacccagcagaucccaguggcaguccacuguguuuaucacugcauuguaauagaugagcucugggcauggguuccugcagacccugugccccuuugcugguggacagaguauaggcucugccaggcuugggcucacuggggugcccagcagccagaguacagaggccaguggaccugggcaggaaugcuguugcuggucuggugcaagaugaggggacagagugcccugcucugucuuggagggagaggucaggaggcauggcuguuacugacugggugauaggaccgguucugcuguucugcugcagcauucggggagccacaguccucaggccagcacaguggcugccuccugcucugccauuccgucucugcuccugucccuaggggccugcacauucugaugcuucuugcuugcuugcucggcccucuggcuggcaaacucaucagaaucuuuagucacuuuccuggcucaggccucugaccccuggacaccuccauuggaugucuccugggcuagaaauuggccaaagcuaaucgggcuaaaacugaauucucaauuucauccuuuuccuccaauuugccauccccacauccugccaguucuauuuccaaagugcacuugaaucuuucugcugucucuaugcuaugccagcaccugcagccccaucugcugcaguggccucucccaacaaggccucccacauggacccuccucaacuccagucccuucuccaguagccaguguggccugugcaggucaccugcggggucucacugcucccuacuugcucacugcaugcucagugguuccaguggcagugacaguugauucucagugccauacgcugcuggccauguggucuccagcuccccacauccccauccuccucucacacguggccugcuuuugcuucccucauuucucucugccugaagucaccuugcuccuuguuugucugggccuaagugucacuauuuccugagaggccuuuucugaccccuguuguuugcucacuugccauuauguauuuuuccuuuaaaacacuuaccauaauguguaaauauacaugugucauuacuuugcacaaucuguucccucacuaagugagccagaagcucccugaaggccagggcagacucugucuuaugcuugcugcugggaaggcuggcagaggccaggcgagguggcagcccucaugucugacuugacuuugaaggcaguggugggcugacguggacagaucugaggccuggaaccacaugcugggauguggucgagccuugccguccugcgggccuugcucaggagacugaaccuugaggcuucuggcuccacucgauuucugagaagggccgcucuuugugacuucuucuccacucgguguccugcacagcagcccuggggguuuuucaaaaagggaaccagcauccagcagagaaauuugguuucauuuccuagccaggccucccccucacaccucugagccucugcccucccaccugcaauggggauaggcacgcaggccucaagacugucagaaaugccagcagucgucccagcucccugccacucagaaccucaguuucuuuaguuucuuuaucuggaaagagggaaacaagcguaacucgaugaucucuaggucacugguggcuugaacuuugaugauucucugaggaaacccagaacugcuggugugccuagcaacaggacacgagaagucccggcacccccuccuaccugcuuggagaggaguccuguggccuuucagcuggagggugggggcucgacagcacauagccggggucaacgcugcuggccuccaggguuaggggguuggcucucauggcuccagagaggaaccaauccugaggaagcccuaagucccugaccucggcccuuagggcagcaagucuccuagagagcuucagaggucugaacucccgaagggaagaggaagaagaggcuuggagguguguuuucucaucuuguuacucugugguccuuguaccuguaggggacccuccuugguccccaggaauccuggaaccaaaauggggaacaccucaaugaaaugaaccccuaaaauaucucucccuaucgcccacccccagccagcuauguagcuaaugcuuauccugccuaaguugucuuuugccggcucuucuaaacauccuaucacuggacucuuuuaaacagcuguauugagguguauuucauguauuauagaaauuaauugaauugaauugaauuugaauuuauauaauucagcaguuuuuaauguagucacagaguuaugcaacuaucaccaaaaucuaauuuuagaacauugucaucaccccggaaagaaaccccaugccuguugguagucaugucucauuccagaaacaacccuccccguguccccucguccccagcccugcagccuaggcaaccaugaaacuguuuucauacaauaaauauauuguauuuuugugauugacuucuuucacuuagcauaauguuuucaagguucaucuauguauggcuacuucauuccuuuuuaaggcugaguaauauuccauaguaugaauaugccacauuuuguuuauccauucaucaguagauuuggauucuauuuugcuaguuuuucuugaggauuuuuuaucuguauuuauaagagauauuggucuguaguuuucuugugaugucuugguuuuugauaucggaggacuauuggcuccauaggaagaauugagaacuauucccuuucuucuguuucuuggaagaguuugugaacauuugguauuaauucuuaaaauguucaguaauacaaauuuuaaauuucuuuuugaguugguuuugguaguuugugccuuucuaggaauuugucuccuuuaucuaagucaucuaauuuguuggcaaacaguuauagguuuuguuuauuuauuuauuuauuuauuuuugagacagggucuugcucugucauccaggcuggaguccagugguacaaucauggcucacugcagcuucaaaccucugggcuccagcaauccuccuaccucagccucccaaguaggugggagucaagcacauaccaccacaccuggcuaauuuuuaaugaaaaaaaguuuagagauggggucucauuguguugcccaagcucgucucaaacucuuaaccucaagcaguccuccugccuuggccucccaaagugcugggauuacaggcaugagccacuguaccuggccacaaacucuuuuucauauuaucccuuacaaucuuuuuuauucuguaaguuugguagugauguucccuaugucauuccugauuuuaauaauuuuauuuuuuucuuggucagucuagcuaaaguuugucaaacuugguaauuuuuucaaagaaccaacuuuuguuuuuauagauuuuuaaauuuuuccuauuguuuuucuaguuuuuuuguuuuuuguuuuguuuuuuuuugaguuaaggucuugcugugucacugaggcuggaaugcaguggcacaaucauagcucacugcugcgucuaacuccugggcucaagcgaucuuccugccucagccuuuugaaugguugggacuacacgucccaacucaccccuaaauacccaaagaugcuagcacagaugccacuaugaucagcuucuugaguauuuagaagggaguuguucaguuuccacauauuugugaauuucucaaauguccuuuuuuauugauuucuaauuucauuccuugguagucagugaauauacuuucaaacuuuguuuugguuaauccuuuaaaauuuuuaaggcuuacuuuaugauuuaguaaauggucuauccucaaauauguucugugugcauuugagaagaaugugcaugcugcuguuauuagguggagcauucuacaguuguauguuaggucugcuugauuccuuauguuauucaagucuucuguuuccuuguugauguucugccuaguuuuauuuuugaaaguaggauaucaaagucuccaacaauuauuaaaaucuccugcguucuguuuauuuuugucaugugaauuaugggguucuguuuauaggggcauauauguuuauaauuguuuuaucuuccuccugcaacuacccuuuuaucauuauaaaauguucauccucuuuguauccaguaacauuuuuguuuuaaagucaauuuugucugauauuuguauacccacucuagaucucuuuuggguauugucuuuaugguauaucuuuucucgucauuuuacuuucaaccuacuuguguuuuuuaauguaaugugucucucauaagcaguaaugguuugauuauuuaaaaaauuuauuggccaaucuuugccuuuuuguuggaguauuuauuccauuuauauuuaauguaauuacugauaauacagauuuauguuagccacuuuggaauuuguuuucuauacauguuauaucuuuuuuguucuauuucuccauuacugcuuucuuuuuguauuagauagaaauuuuccagcauaccaauauaauucucuuauuguuucuucaugguauucuuuuaguuauuuuauuagugguuauucuggggauuacaauuagccucuuaauuuaaaacaauauaguucagauuaauacuucagugguuuacagaaacuuugcuccaauauaacuuuguucucccugcugccugacucguuggugccauuauugccauacuaacuauaucuuuaugaauuacuggaguuuuguaaguacugcuuugugcaguuaucuuuuaaauagaagagcuauaaaaauacauuuauuuugucuuuuauuuuuaacuauauaugugcucuucauuucuuaauguggauuucaaugaacaucuaauguccuuuuauuuuuccugaaggagucccuuuaggauuucuuguaggucugaucagcuaggacgaaggacugaauauucuugguuuuuaguucucugagaaugucuucuccauuuaugaaugaugguuuugcuggauauagaauucuugguugacugucauuuuuuucucuuucaguauuuugaaaauguuguucuguugccuucugguuuccaugguuucugaugagaagucaacuguuaauuuuaaugagaaucucuuguauuuucucuuguuucuuucaagauucuuugccuuuggacagcuugacuaugaugugucuagguguaaaucucuuuuuuucaacaaauuugggaaguucuaaccaucauuccuuuaaauauucuuucuaccuuuuuucucuccccucuccuucuaggacucucauuuuguguauuuuggugcacuuuauggugucccaucaauuucugagguucuguucauuuuucuucauuauuuuuuaguuucuggaccucagacuggcuauucucaauuaaccuaucuucaaguuuacugauuuuuuuucuucuauaagcucaaaucugcuguuagagcccaaauagugauuuauguauuucaguuauuguacuuuuaaauuccagaauuuauauuuguuucuuuuuauaauuuuuauuucuuuauugacauucuguaauuggugggacaucauugucacacuauguuuuauuauauagacauaguuuccuuuaguucuuugaacauauuuacaguagcugauuugaagacuuuaucuaguaaguauaacaucuaggucaaggacaguuuauauggacugcuauuuuguguguguaugggccauacuuaccuauuuuucuuggguaucuuacaaucuuuuguugaaaccuagacauuguaaauaauauaauguggcaacucugcaaaucagauuuaccuucccuccucagguugcuguuguagcuauuuuguuuagugaauuuccugaauuaaaucuguguucccuguuguaugcagucacccaagucucuugguuaguuuauuggucagccaaugauuugucagaaauauacuuaagugucuugaagcaauaagucuucuacccuuugaggagaguguguuugcacauguauguuuguguguuggcgcacacuuccauugcuuaggaaguuugugacucugccauagucuucccuuccugcuugugcagggacucaaaaucagccagagaugagagacagaggcccucucacgucuuuccuccacaauggcauagcgcugcucaggcauauggcuuucuggaucucuaggaguauaucauggguuuucaaagcccccaguggauaucuccuuccccagaucugcaaguuuuggccagcucuuguuugccccaauugguaucacagcuuuaggcagcuguaauguuaaggaauugcugcugauuguuuuugacaaaugcccuggaauuagaucuuuuccugcagagugagcucugagucagaucaaauaugacaaugcucucucagugucuguggaagcacgggggauuaaaaaagagugggugggggagaaagagagaaaaagcaauguucuguaaaaggggcuuuuuuaagaaguugcaaaacagaucaaauuuuuacagugcucuaggaaugagaaucuuugagaaaugaauucauaccaagguauaugagcaaguucucaaggcuucucuagaugcggccuugucccccuuaccuaaucuuuaucuaaaugcuaaguggugacauggagguggguuaagguacccgagggcuuggucucaaggaagcagugugaaauguuggaagcucuggaagcuuggagcugggcugaccugguucugaauucuggcucugccaucuacuguuugugcagccuuuggaugggaugcuucucugagccaaagagggauaccuuugucuguaaauugggaugucucacuagguuguguuaagggaagaguuaaauuggccucuguguguaagauugcuagcacacagaaaaugucccaaaauggaaaugauuauuauuuggcuugaggcuuagguuaaaaugcuaaaaagugaugagaccaguauuguuuuguugaaauaaaagcauuuuuaacacauaaacauuaugcgucaagcccuguuuuaagcacuuucuauguagaguucauuuaauccucaugcuagcccucaaguggacuuuauuaauuguccuguuuuagagaugaggaaguugaggugcaauuuccugccuaaggccacccacggcugggauucccauaggcuaucuggcaccagagccugcgcucuuguaucuguuucauguuaauacuacacaacugagaagccggugugcacuuugagaaauagcaauggagaacaccaaaggacaauaagaaaagcagcauaugccauuugccaaugaaacuggcaacaaaaggccugggacauccccuagucaauccaguuuggaagaaguuaaaggucagauacaaacuuccccauuguggcuucagccuauccagguuccucucugagaaucagucaugcagagagccugcucaccacuggaguuccucuugagguagggcucugucccuggagcagccuccucccugcccacuaagucugcucaggcuguuguugagacugggggcuaauugggggagguggccagggacugcuguucuucagccugucacagucagauccacuugcgagcccacagaagcggcagagaggauuuuuaacucagugcucaucuugacaagcugguucagugcugacccuuacaggccagggccauucaggaccaggcaaccccacccugggauuuguucagucauuaugacuugaacagucaaugaugucauuaucaaguaucuggugcauucaugccuggcccagcauggacgcuccaguccucuucuggggacuuacgggccacuuuguuaugaugaguccugggcccuauggagccauuguugaggauuuccagcagcacccagucugcaucaacaacuucuggaagcagagagucccugaaccuuggagcaaggagagguauuugagauuagguuguuucugcuuccuccguuuaccaauagggagagucggauggagagaggccugcaucacccucuggggcacauggcuuguguggagggagcagcagcuccuugggaguugagggugcagaaucaggggcagcguggauggccuuggggucaggccacccugggcucaaauccugacuguugcugugccacugagcaugugccugagcucucugggccgcagucucaugcuggcuggaugaguggcaucucagggcugccgugugccacgaaggcaccgagagcaggacuugugcaggaugugcguccaccaguaccacacaccaucuuccugaugagggccagggcaaccaagguccuuuguagacaccagcaccuucuaacuuggugagguccuggcugccgugccgugcauggagucaccugccugcaaacagccacucucuauccugcuccaguccaguuugaaaaacaagcaaggucuauuccagugaagagccaccagggaagagucaaggagggcaucugcuguucaaacccugacccccucuugcuaaugauggcaucacgcuuacuuuuagauguaacauacagccucggagggguuggaggagagguccauggagaucaccuggcucagccuucucguuuuccagaugauuuuuuuuaguccaaagagacuaaaugacuugacuaaggccacacagcaugucagcgggccagcuaggacuccacccacagccccugagucuggggaucccugugcucuuggcucugagcaaggcugccucacuucauuuuaguuuagucugugugacuugagcacaaguucugcacacaaaacugugcaaggccacuaauagcacucacagagcagugcuaucccuuccuuccuuugaaaugguggagguggagacaguacauacaagaguuacucaagacaaggaugagggugcagggaggaagccgagcccuuccaugccaccucugagacagcuggagggcauagccgcuccauggcugcagcccgguuuagaaugugccagggguggggucaggcaccgcuuucuuaaaugaucuuuccucuguugucucaagacauuuuccaaguaccagacaggacaaaauggcuuagauguaagccucucuacuuugccgcaggccccagugcucucuguugucccaccuaggcuccugcugccugcccugaugucugcagauucacuuggucaagaggaguuccuucuaugccugcuguguuuuucagccauagcacagaacuguuuuauggggggagcaugcucaugcgcuaaaucaguggucucucacucagggaggaagagaggccaacauuugcugagggcuuacugugcccuggguucucagcuguccccacgagggggugcaaugcccuugguuuuaaagagaugaaaauaucaaggcuccaagagguaaaaaacuugccccaggccaccuagauguggcuggugaagcuauguuugaacccaccgcugacuaacuccaaaauucauauucuuuucucuucucucggcugucuuccaaguauccagaauggacugucuggaaagcguucuguuaguacuucuugacugugggacuacaggucuuugaguuucuccuaauaaagugauuucugaugaaaaucugagaacauccuuccuuccugugcccccuccuccaugacucgucgggcgucuucagagccuggaagucccuggaaauccggaguagcaggcacugaaaggaugucacggcccccucccuuuauucagagagccucuccuuuccaauaaccuucugggaaggcacugauaguggggaggauggggcugugcggggagggcccagcgagucugggggaaaugaggcuguggagccccggaagaggccagggucacccagcauccugcccugccucugcugugaggccccauuguccuggcuggagcucccaggcuggcccgccuucgacuugagcauucaugagccuggcucugaggcccauuccaaguuagugcuauuuguagaaucuucuuaaaauaccacaacagugucauucauggagcgucugcacagccaucgaugguagacaucagaacaaagcuccgcugugccuggcauccuguucuggccucugcuggagguguccccucugcuccacugacuggggauguugguguccucccuguccugggugcuccugagcgaugccccaugggguccagcagagacucuggucccccacgcuggccaggagcacauccugcgccaggcucgccagcugagugcaggauggcaugcugcacucugcaggugagaccacugcccuucucauggcuguccccacacccccagcucugacgucagacuucagcccagagccugcucagcuacaguuggguggacugacaaugagcaaagaauaacagggggaacccaggagaauaaagccuuuagcauucaguuucagagccgcgggcauucucugccuuccccugugggcagaccucuguuucccauuagauaacagugguauccucaccaacugcaucucucuccccugccccagugguacccacaaggcauccuuaggaacgcuugcuucuggcauguugauuggugucacuguuaguuagcaaugcauuuugugguaccugggauaaguggagcaguuucagggcuuucccagcuucuggaccugucagagccuuugcuaugugaauguacccugcccugggcagugccucccauacaauuuacccucaggcccuuccucacacagcugccuggcugggcagccugcuuuggccuucccuggcccugcaggaugcggguguggcuagagcuccuggcagugggcccaucuguucaaaggguuugaugacuucccauuuuuuugucuuuucccauggaucccuacccaugaguugcauaggcagccagacauggcuccaaaaggaggugacuuugcugguccuggcccaugccugaagacaagggccugcagugggccucacaguggaucugggaguggcugaugggacccccucccgggugggaaaggcuuaggcagccaggacacagcagcccuugcugggcagccaugccagccgcacugaaguggaguuuugaguuuucuaaaaguauagccacuugucgucagcagguccccaacauguccccaguaacagcuggucaugaggcacacauggccgcuaccugagcaguggugaggcuguuauacccaacugcagcaggaaaagugaccuuugauggggaaguucugccugggaguccaaauaugccuggggugaaagcugggccagaggcugaagucccacaggugguuuugggauucucaaagcauuaccauguaaugaacaaaacccgccucaguaaggagaguggccaccccagccuuugagcccugacacuuggagucugaccaucccaguggaaggcagggauggcccgagaagcaggugccuccaagacaagcagguccacaugacucagcagcuacagggcuucaggcaagggacuuggcauuucuauguucagauccccccccacccccacccccaccccacccccaccccccaguauuuccgagccucaguugcucacgguguaauuacugugucuggcugagugggggcuguuacugguggcuuccuauccuuaagcgaauuacaaaguaaaugggagguuuugugauuucuuuagccuguggccgcccccacuugagguugugagcaaauucgggauugacugcuuguuguccugguguccucagcacauggauacauggguggagacugucccaugaggacacaugaaacugcucacaggugccacuuugugggagaggacccagcacacagagguguggggcaggagggagacugacuuuucacuuuucacucugugugccugcacgguugacuuuuauguugauguugcucacccuuuccccaaaaggcuaaccuuucugaguccuggcauuuccuguuucuucucuugcugucagccaucaccuccugaugucagcauggcugccucugucagcucucccaauccuuuuuuaacugccuguucuaauuuacgcauaucauaaagcagugaacugcacuugcuagaaauguaugcaaaguaagagucagcaagccccaaguaaggcccucgaaggucagucguuuggcucauaggggaccuucaccuguuuggccuuucccaaucauuguuuugcguguccuuggacucuagauggaugagguugacagaugggugauuucuagauaaaccagguguuacugugaugcucuguguauggaagggacaggagucacccugggucuggcagcuuuucuggcucugcaaguucacauguggauggcuaagaugaugauggugcuugggaacaaggucauuuuuuagcguguuuuccaaaauuagugcugaacccuaucuugcugggguacugguggggggcgugggaggcccugagaggcuggaggaguucagguuuugcuccccagcccugugagcuuugccaaggggaauagcgcugaacuaagagucuagcagacaaagcauaaaauccuagcucuggccuucuugcuugagcaguuuccuucugcagaaaauggaaaaauaagaccuuccugaagguugucuacaggcuugaaugcgagaacaucuaggcccucgugucacauaacucuaggggcaccauucacauaagcuaccauguugccuccagagggcaccauugauuuagacuacagugagaguggcugccuuggugggggcgcaugcacuuagacuaccaugugaauggcugccuccugguguugugcuagggaauggugcuggaugacagugaaccugugaaacuucuauccuagcacuagcaaggguacuucuuacgugucuggaugcuuauaccuggccuccaggaaggaggcagcuuaugaaaauaguacagucaugugccacaucaugacguuuaagucaauagauugcauaugugacagugauccuauuauaguauuguauuuucaugguaccuuuucucuauguuuagauacaugaauacuucccaccguguuauuauugccugcaguauuccacacagucucaugcugugcagguuuguacuguaggagcaaugggcuguaccauagagcuugggugugcaguaccuguacugucuagguuugugugagcacacucugugggguuugcacaauggcaaaauugcuuaaugacauauuucucagaacguaucccugucacuaagcggugccugacuauauguuguuuuuauaagaaccuaaagaacuugagugaaaaagagugggaaggacauuugcugaggcccugaggucccacccagcugccgaggagggcccacugcugccugaccuuacaggaacuccucgugaagagggaaggagcgucggugagagauacgugguggccaaaucaaauuagggaaguuucucacaugccuauagauuuugugguucaacaaaugucugcgugacuagccagagagggggcagaacugggauacggaguauugggccgguagaacacggguguggagagccacaggcccuggcagccucugccauuugucaagccacuuucccuugggcugcagcuucuccaaccagcccuuacaggcuccuuacaggccuuggcuacaucuccagcaugccuccaccaggcagcccuccuggccuaccccucucuccaucccagccaggagaagccgucugaacacaccucuagggaggcaaaaauccucccaggggauccccauccacccauccuagguuuccaggaaggaacugggaauggccagccagguccugccccaaccacaaggaggaguucuggagccaccuccagccuggcucugggagguuuugugaugcagaauuggggauggggcucgguggcaggagagcagacagccuggcaggacagccaggagagcagagucaggcgcacgggacuccugcaucuguauuuuuggagcugcuggacguggucucaugguggggauggauuaggggagugggaugggaguggggcgaugccaccagcauauuuuguuugaugcuuacaauuacagacugauuuuuauuuauuuauuauauuuagucuaaaguguacaguuucccaaggcgggcagaucaccuaaaucaggaguucgagaccagccuggccaauauggugaaaccucaucucuauuaaaaaauacaaaaauuagcugggcguggugacagccaccuguaaucccagcuacucaggaagcugaggcaggagaaucgcuugaauccagaaggcggagguuggagugagccgagauugugccacugcaugccagccugggcaauagagcgagacuuugucuuaaaaaauaauaguaauaauaaaauguaguuucuggagacagagaaagcaggguguggugggacuuggggcacccccucuccccauugcuugcuugggccccucugccugccuaggcuccacucacacccaggugcuugaaccccaugcucucaaauuuccucucaauucaucacuaccgggacucuucccacccccucucucagcucacccccaacuuaugagcaaguucugcugagucucagauccagauaggcacugagccugggugccugucaccaccugcaucccagcccauguggccccagccucugcuucccuccccuggacaccugccagaacuuccuaucuaagcuccugacccacuccugcccuccucagcccacggagccccacagaagagcucaggaguuuucccaccucggggccuuugcaguucuccuguccaucugccaaccgccuccccugcucauccuuuugugcccagaccagaucugugcaagaaagccagccccugcuguuccugaguucucagccagaggauccccuccccagaguggcuuuuccugacccaccccauuucuguuaucccauccaucugagcucucccugccaccuugguuggcucccuguccuuuggcugguucuccaggagagcgggggccuugucucccuuguucacccacacaccccauccaggccaccccauaugucaagcacagcauccugcacacaccagagucuugggaaguaccuguggucucacuggaagaaucagccucccugcccuucagguuuccugcauggguccagcccucuggagaguggggagcuaagguuccagggaucacccuuggccauuggaugacuggagccaggggauccuuccuccccuuuucaucccaggacuggcaguccugacacacauuucaugaggccaaauggaguccccaggcccccagggcagcaggcagcuuauccagcuucccuguggggcucucccuccuucccaucccuccuuccccaucccgcacuucucccugggauagcuuccugaacaauaaccuuuuccucaggcuuugauuuuagggaacccagguuaagacacacuguuaguugggggaaaacguucucaauagcaacccaaaguagagaaaggcacaggccagccgggguucauaucugcuuccuauuaggccacauugcucggaguuacucauuuagcaaauguugauguguucacucauagcagagcacuccagcaggaguuaggggaggugcaggcaccacucauaccccaggaggcccggaaggggcacuccagguaggugccagcaggacuugggcugaggaggggacaucgaugcacauugcaguuccaucacuuaccagccuccuggacuugggagguucacccaguggccugggcuucucccggcaccaugggaugguagggaaggacagcgggauaauagccuguacuucccagaguugcugggagaggagcuucacaaagcauguacgugguguuagcagggugguggugccagugacgguagcagcaguagccgcagcagcagguguggggccucauuaaucucugagacugacaucguuuauaccaauguagaaauaaauagcccuccccuccacagagucacuggacagguugacacuggaagcuggcacugaguaggugccucauaaauguuaguuccuuuuuuguuccuuagaauaaugaguugagccauccguuauucccuccaggucacucagcaucaguuacaucagccaccaggccaccauucguccccacaaccccucucuugaacauuucggaacauggucuucagcugacaguuaacauauuccauuuaacaugcugcuguuuuaacuuauuuucuucucccuccaaauauuuuuacauuggugauggcaccacguuccuugguguuuuccagucucagccaugcauucuuacugcggaggccuggccaaguccuggcuucuccaaggucaggagacgagggggccucguccaaucagccucagagccaggcgagcccaagccguggguggagguggcugagaggaugcuguucugaauuuaugccuuuaucccugaccccaguaggcccccgggauccuuccuagcauugacugcuuugaguuuguugaugauguugguuaaugccugucuccgcuaccgggccacucucugagaggcagagacucuugcuuuugucacugcuguguccccaguauguggcacagugucuggcacaugguagaccaucaauaaauauuuaugggaggaagaaugggauauggaaauuugggaguggaugaagggcaacgguuggggaaggugagggagaaguagggauauuugagcugggucuugaugaaugaguaggaguuugccagguggccaggugggaaaggcaccagcaugugcaaacaccuggaggcaugaagaauguggugcuuccuggcaauaagcaagagggcagggcaccuggaguguccggugagauggggagagcuggcuggggcuggaaaggugcucuccgcucaucaagcaggagcccagugggaagcagcaaacugggacguguccugaagacaacaggguaaggccaugauguaagauucucaauggagaagggaaaguucugacugcacugcagagaccaccccuuggcagugccugggcauuccccagcuguucccacacucuucacuucugcaauugucccugggagaaaaaucagaguccuccuucccccacgagguacugcccagggcaagaucacacacugauccccuaaaagccccagcauccccagaaucacaaaggaagauucuuagggagaggcugguuuuaagaagugaaacucugcuaugauuauaagcuagugaaaggggaacagagcugaaaccauuuggaggacauuuggggcauuuuccuaaauuaaaaguacucaaaacacagggcuggcuuaacuucuccagcaccaaacacaaguuccugacucucucagcaaugaaaauaaacacaaucuucaaucaagacagucaucugugccugugagaauccaaugccagcacuucagagccucuccugagaggaagcugcuccuccccugcuccugagacccucccuucucuucugggagcuagccuggggcccaguauccagcuccuccuuccagaaauaggcaugcagaucuaugcaccucugaguauauaucauccauuuacuuuuuccacauaguaacggagcaucccguaucacuucacacaguuucaccaccuucuuuuuuuuuuuuuggauguacauaauuuaaucaauacauuauuuaauuugaugaaagguuaaguuguucccaguuauguuuacuaacuuuuuaugcacguguacaaauuuaucugaagaguaaauuucuaggaauagauugcugggucauuuaaaauguugauauaucucaaauuauucuuccaaagagauugucaaaaccaaaaucuacuucuagcaacagcucgaaggucugcccacuuuccucaccauccccaucagguguaugccuucagcugcaaccccucccuugagaugcugguaaaccagccaagagcaccucccauggggaggccucaggggcccugcacuggccuuacccacacaccuggaacacguggugugagaaggcucauuucaccugucacuuuauauuaaaccucauuuucauuuguuuuuuaaaauagguaacaaauaguacaacuaucagaaggcacaagccagucucccuguuucccugccuuccagccacucaccuucauccccagaaaaagccacuguucucuuucucuguccagagauacuuuguacauauucaaacaaaucugggcauaaaguacacccucauuuuuuaauaccugcaaagcaucccauuuuauggauauguagcugggcccucuccuuuugccauuugucuuuucacuuucuuuucuuugccuugcaacuauuuuuaacuuucauguaguuacauuuucuuuuguggucucuuguuuuugagucauacuuaggccuucuccaaaauuuuauacaaaauuucucccaugguugagccuggcacuuuuauaguuucauuuuucaacuuuaaaucuuuuuuuuuuuuuuuuugaggcggagucucacugugucacccaggauggagugcaguggcgucgucuuggcucacugcaaccuccaccuccugaguucaaggaauucuccugccucagccucccgaguagcuaggacuacaggugcccgccaccacgcccagcuaauuuuuguauuuuuaguagagacgggguuuuuucaccauguuagccaggcuggucucgaacuccuggccucaggugauccgcccaccucagccucgcaaagugcugggauuacaggugugaacuacggcgccuggccuuaaucuuugaucuauuguguauuuuuauuugguuguaaggugugacauaaggauucagcuugauuuuuccucauguggcucucccauugucccuaucccauuuauuagagaaucccaccuguccucaccccuuugaaagagcuccuuaaacauuccaaacucccauaugugugugagucuuucucuggucaugccacccagugcuguuuuaauuacugaguagcucuacucagguuuuuguuguuguuuuuguuuuguuuuguuuugagauagagucuugcuuugucacccaguuuggaguucagaucacagcuuauuucagcuucuugcucugcugaggucaaguuacccuccuaccucagccuccugcauagcugggauuacaggugugcgccaccacacguggcuaauuuuuuaauuauuauugucuacagagguggggucuugcucuguugccuagacuggucuggaacuccuagccucaaacagucuuccaacuuuggccucccaaaguauuaggauuacaggugugagccaccaugccuagccucuauacucucuuuuaauaauugguugggcuggucggacuucacuauguuuucuuucaaaagugcacuugcuauuuuugcuuaugaaccuuaagaaucaacuuaucugguuuaaaaagaaaugcuauucauauuguguuaaauuaauagaccaaauuagagagaauuggcaucucuauuaugcugcuggcaucucuauuuuccuacuuauauacauagaaugcauuucuguuucuccuaauuuacaaauagauuguucuuuuuauauauuaauuucgcacccaguugauuuacuggauucuuuuauugauuaugauggguuuucaguucauugacuuagaacuuccacacauauaaacaaguacccugaaaaauaauuuaacagcaggaguaauaacagcucacccuccucuccagcuuucauaguuuuccauucuuucucuugucugguuggugaacccuuccagggaaaugcucuauaccaggggcuucauuagacgugccuguaucguuccuggcuuugaugggaauggugccauugucucuccacugaaugcaguguuggcuuugaguauauccaggugaagaagccaccuguucucauuuaacaaagaauauuuaucaaaauggauguucaguuuugucaagugucuuuucagauuuccccuuagacuggugagcugcaggccgccagugugcaccagcaagccagcgaggccugcccaugccuggcagcuuggggaggagguggugcagcuaugugggcggccuguggcucucacgccaucuguaccauccugcuuccagcugcaggaaacaggaaagcccauguaaccuuccaaaaucaaaggagcuauguuauucuuacagaccaagaaacccagagggaggcagccccccgggcuggugauucggggccccagcacugucaaugaggacauggccucccccugccccuucacccgcuuuggacuauuggcucugcucgcuggccggaguggcugcaagaugaccaccaagcgaccaacaggcaggacacgccccuuccauggagaggggucucuugguggaguccuucuuagacaggagggagccuuucucagaugucccuccaagaagcuccccuugggucucgguggcugcaucucuagucuuagggcagccuguaaaauagaacugcuuuucauuucuuuccagaucuucuuuaaugagugauagguaugcaccucuuucaauggcugccugucauuccaucaccuuuguguauccuggugucccauuccccugcuuuggucaugauguugcuucugguauuggauuggcuuuugucauugccugcuuguuugggcauuuuggguucugaaauguugaguauggacucuguggcugcugcccuucuuacgccagcuagaauuguacuuuuggcucuagcgcaucaagaggugcuauugugugcagagcggguaugagaacuccacaaaggauagggcagggggccgggcagagggaggcugcagcggggccacugcuuggggaugcagagggcucuaaauccuugugcugggacugguggggguguugggguggcuuccucuacaugugggccacuucacuucacuggcuccuggcuugggcaaggggccagaagggccaucauguggagcaccuggaggcucugaggaccaacaggugccugguauuuuuguucaggggccuucauuguucgccagcacaccccaaggaggagagggacucaccagguuucuaggugcccugguacagcuaugcaguguggcugccguggucccugcagggaugcgagaguagguaaugggagacucaucugggccguguccugcucgggccagcuuucuccuuucaccacaggaucacaucuuucuucucagaaaacagagcaugugggcucgugaugacaggccaagguagauguuacccgcagggagccuuaugcaaguuggggaccggcccgaggcacugcauccucuuucucuggaguacacacacagcaacucuaagggauagacagaggcagagcccuagaggaaccauggacaccugaaguuucugcugcucucagucuaucgccuccccuccugauauucugcccuuuaucucuucaggccugcugggaggacccuggaauggcccccuucuccuaccccaugacagcgacagagucagggcccagggcccacugcagugcugcccugggggauggagcagagugagagggguccguuuauugagccccugggccuugcaguugcugcgaguggcaggagcugcaccugggacugagguauuguggccaagggggaccuggaagacagggcagguggauggugagaccacagguuuccuuggcuuuguuccuguguccccgguagugcccugccucuucuuuccagagcuguuuuccuggaggggcuccuuccuccccagacugcucagcuuguacugcagcacacugcgaggccucaaacagccgaccccuuacacagcguccgcugaccaccggcacucccucuucaacauccucuucccuccuuccccucugccuucugcaucuccuuuucucucugcauuuauggcaauaaaaacacuuucuggaaacauagaagugagucaucagccuccuccuaucccuggcugagcgcugcugaggaggaggcaggaagcagaaagcccagcugcccuggagaaccccaccuacucuucacccaugccaaggagacagagcuguggcccaaggccuacccuggggagacaaggucaggauccugcucuccuucaggagugggcuuugcuuuugcagcugaguaagcacaucuugccguuuugauaauuuuuccaugggagacccuagcccuguaugugcaggcaguggauuguccaggucccaugaucaccaccuaagagcaggugggaggugucaaaccccuaggaggucagcagcaugcaguuucuccugaccagccaugggcaguugggagagucaggguccagggcccagugcagugcugcccugggggauggagcagugggcccugggcccccugcacagagccccaaggaauccgguauacccauuucacucugagcuaggaccugagaaagccgagugugaguagcucacggcccaguggcaguuagggcaccuugguuccuaccccccaaucuccagagguguacuacacagcaccuccacagccagguuugugaacuccauagggcaagaugcagccccccuccauuacugcacugaacuaggagggggauuccauaaaguagcaaccggcacacggcaguacagacuuccuuaccuaguguuaccggcugucuuccuacagauauucuggcaggcaccaggcgauuguucagcaggcacccggggacaaggaucuuagguaagauccuagagaaggaggucaggucccagcagcuaaggugaagagagcggccagaacaggcagcccuggaggcagcagcucugggcugggaauucuugcucuuccaguucuuaccuaugugacuaugagcaacaaaguccaucucucugagccucaguuucuuuaucuguaaaaugagaaucaugacaccuaucucacaagcuauggagaggauaaaaugccauagucuaugugauugcguguauguggcacaugacuggcgcauaguaggcugcuguuguuauuuaauguuauuaccguccccaucuuuauugguacaggaagagaugugaggauuguauauccucauaccaccagagccccacuguccaggccucugaagacaaccgaccauaagggggaugguugugcuucaggcuauguuuugacaaaauggggauugcauacaucaccuuugcuacaucauagauuaccccccaagccuaguggcuuaaaacacaaacauuuauuaucccacagcucugugggucgggaauccggguguggcuuggcugcauccuguagcuugggggcucucacaggcucaucacagaauuggcugcaacugugggcucaucugaaggcuugacugaugggagauccacuucaagcugaaucacacggcuauuuguaagggacagucccuugagggcugcuggacagaccaccacagucccuugcuggcuguuucuggaggcuucucucaguuucucaccacgugggccuccgccucgggcagcucccagcagggcagccugccucaacacagccagcaagccagagaacaagcgagggaaugugagagggaagccacugucucuuugugaccuaaucucagaagugacauccugucaauuuuugccacauucuauucauuaaaagcaaguuauuagguccugcccaccuucacgaggaguaauuacacaagagucugacuaccaggaggaagguucaccgggggccauugcagaggcugcccaccaagggauggagccuggagcacccacucugcagccagacugccuggggcauucagauccucagcuauuaagagugggcugugaguggccagugcuuuaggcaccaguuggcaacuaauuucccuugggugaccgggggcaguugggaagauacaucuuauuagucaugugaccuucgacuaauuauucaaccuucuguagccucuguguucucaucuguaaaugggguaucaucauuguaacaccauaucaggugguugugaggacaucgagauaaaacacgaaagcuuuuaggaugaugcccagcauauggugagcacucaaucaaagcuggauauuuuaauuaagagagauugccuguuaccucccagagcccuccacaucccccucugugacugcugccauucacugaacccugagccuuuuccaggcacuagacuaguaccuggggacaccaggaagaacagucauacauuccuucauaagucguacauuccuuucacagagacaggcaguaaacacguaugcagacaaacaagcugcuuuccaaucaggauaaguucuauagagaaagucguguaagacuaauugggugggagggcgcagcuccuugacgaaggcucucacccagggaaggauucuguaauguacauuugagcugaggcuuuaaaugagagggagucagccaugcaaggaggugggagggcauuuggagcaccugagagaaugcaaaguuucuggugggaagagggugagcuugagggagagagggugcuagaguggcugacagcaggacaugggccgggggaggagaggugguccgagggaccuggaggcccacagucacaucagaguuggguuuuauuccaagaacaguaggcccucugaaggguuuccagcaguugugcuuugcccuuaaggggcugcuuuucuuugcuggagagguggacagauggguggauggauagauggguggauggauggacggacagauggauggauagauagauggguagacaaaugagcagauggauagaugggcagaugaacaaguggacagauggauggagaaaugggggagaugggcagaugaacagguggcaucggcacaggcguagccccuugcucuguacuuacugagcaaaguuuggugcucauugccucccucugcccuccagggcugccugaggugugagcuccugaaaccacauccugggaggggcgacugcugcuggaggagaggagaccaggcuaggugaaggagcugcuuccugcucccuuugucccagaggcaagggagacaccauaaaggcagcagcugacuggcgcacagaauccacaacagcugaguucaaauccuggcugugccauuucccagcguggugacccugggccacugaaagcucacggagcgucagcuucucugucugugacacagaccaugugucuaccuuagaggauacggaggugcuuaccaaguaccacgugcaggugccgugcccagccucuggcuucuuggucucauuccaucuucaccacaguccugggagguggguuuaguuauuggccuuguuuugcugaugagaaaauggaaacagaaagauuaaguaacuaucucaagaccauguggcauaagcacuuacaucaggcuucucccaugcauucauuaaucuccaauaccugguggguggguccaccuggagagaacccugaggcauaaagcuaguggcacugagcugggguucccacaugccagauaaauaggauggacacuccccccaccucagggagucaagaacacagcaggacaagugcacaggguggcaggcacagaugcggaugcagaacaaccacgccgaccucccacuggcggggaucccagcaaguccuucuugccccgccccagacagucccagccuucgggcacugauaaaugcagaaguuccccaggagagacaaaaggccucagccugaugcccacaggcagagcacacaggcagccgaguggccgcagcccugcaguggaggagugccucgugcaccuggugguuuucugcaccccaacaggugugucuggccacugcuccucucacugcagcccccgcugcuccacaccaugcccuucuggcccaucaggugucugaagaggagcaggcguaugcccagggguaaguggauagcuggagucacuggcaggcugugaggaccaggcugggagacuggggagggcgauuaacccuugaaagggaagugguguuugguggccgcaaccagguaaagagaaaugaaagacaugaaugaagacugggaggacagcagggagguucagccugguacaucuggcagggugaggccgccgcuagggauccugugcaggaaccuccagcuggcucauugcccagggcuaacaccacacacacaggcaggucucaggaugccugagagugugguuggcaaaauaauggcccaucaaaggcaacauacaccgccagccccaguccacacuguuccucacuguagccaccagccacauguggcugcuaagcacaugaaacguggcuaguccaaauugagauguguuguuagugcuaaauauacacuagauuuuuaagacuuuguacaaauauauguauaauaucugaauaauuuuaauugacauguugaaauuaaugcuacuauuguagauauauuggaauaaacaaaauauuagguuggugcaaaaguaauugcuguuuuugccauugaaaguaauuuauuuuuggcugagugcaguggccuguaaucccagcacuuugggaguugaggugggcggaucaccugaggugaggaguuugagaccagccuggucaacaugaugaaaccccaucucuacuaaaaauacacaauuuagcuggguguggugguagguacccauaaucccagcuacucgggaggcugaggcaggagaaucacuugaaccugggaagcggagguuguagugagccaggauugugccacuacacuccaguuggggcaaaaagagugaaacuccaucuugaaaaaaaaagaaaguaauuuauuuuguauauacuuuaaacauaaauacagcuguuccuuuuuacuuuuugaguguagcugcuaaaacauuugaaguuucacauguagcucacauuauaucucuguuggaucacacugcucuagacggcugcaucuagacacuuggccuucaccccugacacccagcugcuagggcccuccgagggcuucugugcucuaggcagccaggagagugacagugggcccugugacaaaucauacauugcugcugccacuuuuaaaaaauauuuuuuuaaaaaaaaguuuuaaaaaauauuuuucaauaaaccuugguaaagaaggguuaagucagauauauaauuugaucaauugacaacuuuuucaccugaacauaauggaauaagucccagcagcuuacaaaaugcuuucacacauaucaguuacccuuuuuucuuuuucuuaugaaaauguuuauauggaaaaguugaaagccaguucuuguccugcgaccccugcauuuucgagccucccccucuccccaggucucaaaaggaaauccuuaaguucaggagcucagaggggagaaagccuggcuggaaucaaaaagggcuggucaccuggggcuggugcccuugaacaagccacaggcagaagcagugagaaaagugggguucggauaggagccagacuucccggggucauaguucccugguacauacacacacagcucauaguuagagcuggggcuguuucuaaacauuucugggcucaguuaccucucuuuaaaaugggaauagugauacugcuucccucaagaucccacaaguguucacacuacucacgcucaucagucugugagugucaugcccgccuuacgcgaggguuucacgugugccagucuccuuuguucugccgcugccgcccucacuaaccuccuauucaucucaggcucagugcguguccucuccaugccaggcucugcuggcugugcuggaguugccuauaaaauagacagagucggggugggccaaccagaaacauuaugaauaagcaugucauguaaacacauaaaauacauacagaguguauugauugcaaucagugcuaugaaaaaauucaggccaagaaggaacaugggguguggugggugaugcauggugagccuuaaauaggguggucaggaaagauuccccaagaagguaauaucugaagaaagaccugaagggggccagugcugcaaggacagcuuucugggccacagcaggagcaagggaacagcagguccaaaaaccgugaagcaggagcaugccgggugugcuugagaacuggcaaaagcaaaggggaggggagccagagaugacgucgcaggaguaggggugaggggccuucaggcucacugcgaggccuuugccaagaggggccugcugggggauguugagcagggguuggggagcugguucaggccucuaccaggucucuguggcugcucaacugagaauagauugucgggauaaaggaaggagccuggagacuguacagcacucuagaugaggaguggugguggcccagaccaggugagcagugagaagugaccagauugcagcuauguucugaaggagaagcuacuagaauuugcugagaggaauggauaggagaggugagagagaguggagcaaggauguguccgguuucaacuugaguaaccagaagauggaguugcccucaccugagagcagaggguguaggcagaugggaggugaacuucccgcaggucuggaggucaggggagcagugaaucuggaugucucagcacgaggacagcauuuaacgccugagaacggaugggcccaccagggagacuggggucaguguaaaggugagggagaggaagaguccagggggcucccaacauccugccuugggcaccuagcuguggccaccgaagugggaacacaggaggagcuaguuugauagaagcggcacuuagaauucuuggacaugccacauugugccuacgggaagucacaggaugauagaauuguaagucauuuagacucauaggcaauagagaucuggcuguuccguaucaauguuucuuaacuggggcauuugggcuccaagggacauuugacaauguauggagacacuguuggcugucauagccugggagggagggagugggcagaggucagggaugcugcugcccauccugcuaugcacaggacaggccuccacaccccaugaaaaaugaucucacccaacaugucaguagugcugaggcugagaaaucccccucuauccuguacuuaaauaugauaauaaaagggaacacuuagacagugcuugccagcugccagggacuaagcuaaggggcugucccauuucauucuccugaugaggugggucccuuugguuucaucccccuacaggugcaugagucugacaguuggggaaauuaagucacugugcuccacauugagggagcugagguuugacccauagacguuggacccuaagcacuguuuaagagagccucugggccgggcgugguggcuuacaccuguaaucccagcacuuugggaggccuaggcggguggaucacgaggucaggagauccagaccauccuggcuaacacggugaaaccccaucucuacuaaaaauacaaaaaauuagccgagcgugauggcaggugccuguagucccagcuacucgggaggcugagguaggagaauggcgugaaccuaggaggcggagcuugcagugagccaagauugcaccacugcacuccagccugggcuacagugugagacuccgucucaaaaaaaaaaaaaaaaaaaaagaggcagccucagaagucugucauguguaaugggaugggguggaaacacaguggccacacagacaauuaaaaaagaggaaaaaccagaaacugugauaauagacacucaucuuucauaaugaauuuauuccugaaauauuugccaguguaauucuuauucauuuaaguaaagcuaauacuaauguuuccuaaguuacagagaagaaggucagcauaaaccauggaacacuguagaaaguccccaaguuuguuguaaucuuguaauccuccauuucaucuuccuugcacuccccuuuauugccauaaggaagauuuuauauugagaaaacagaaugaguuuaugggcaaacaaaccuguguuugaauuccaacaccuccacuugccuguucaugagcaaaguucuuaacuucucugagccucgguuuuuccaccugucaaauggggucaucaaugcuccuuccuagggugucuaugaagacugccugggacugggccuauuaagcaccuugcaggguguuucauauagaguaggcccuuaggcaugguaauaggguuuucacuucuggacaagauaaaguaacagggaccuauuuacccucccaccugaaacagccaaaaaaaagaaaagaaagaaaaaagaaaagcacaaaauauuugaaacaaugcuuucaaaauacguuagggaaggacuaugacccccaagagaugggaaacaaggugauucccuacaugugccccagcugacugccuggagaaaguuugcaggcuguaugcaggaaggggagacccagguggagcccguuggacucugugaguugaagagacagagcuaaaaguccagacagaccaaaacaucuagagucugcaggguagcugcugaggaggaaagagcugcacagagagaaaaaugccuugagaauugagccaugcacucgucaccaugugcacaugaggaaaacuaccccagguugggcaaagaacuaccagaaaggaucagaggcaacagcacccacgcuaaugccaggcaaagcauggcaccuguuccugccugcaagaccguaaaaccuaacagcuuguagggcguaggacagaauauacagaaggguuuucccucaguagugggaaauaauuagcucuguacugaguacucugguuccaccuaacaaaucuuagaggcaacaucuguaaggaucaaacucuuuccaagaaucuacguucauaccagaaaaaggcugaagaauauuuauggaaauacagaaacauucaucacccaaccauuuaaaaaucacagugucuggcaacuaauuagaaauaacaggaaugcaaagaagcaggaaaauguagcccauaaugaggagaaaaauaaaaagcaaucaauugagacaaacccagaaaugacacagauuuuagaauuagcaaagacauuaaaacaguuuuucuaacuguauucuauaugaucaaaaaguagacacaugaaaguuauuuuuuuaaaaagaccuaaauuaaacuucuagagaucaaaccuauuacguaugagaugaaaacuaaugcugggugggguuaauggcagauuagacacacuaacaugaaaagauuugugaagacauagcaauagcagcuagcuguauuaguuuucuauugcuguugugacacauuguuuacuauuuauuuauuuauugagacaggaucuugcucuguggcauagacuggagugcagugcaugauuacagcucauugcagauuggaacuccugggcucagacuccuuaguagcuggaaccacaggcuuggucaugccgugccuggcuaauuuuuuaaaauuauuuuucauagaguuggggucuugccauguugcccaggcuggucuugaacuggggcucaagcaauccucccaccucagccucccaaagugcugggauuacaggcgugagccacugugccuggugccuggccugugacauguuaccacaaacuuaguggcuuaaacaaugcaaauuuaccuuaugguucuguaggucagaagccugacacagguuucacugggcuuaaaucaaggugucaguaggccugaauuccguuauggagggucugagggcgaguccauuuuucuugagcuuuccaguuucuagagguugccugcauucaucagcuccuggcucccuuccuccaccuucaagacuaaaaaugacagaucagguucuucucacauuuuaucccuucugcuguagacacaucucucucuuacacuccucuucugucuuccccuccacuuuuaaauacccuuaugauuaccuugagcccacuuggauaaucuaggauaaucuuccuaguuuaaagcagccagcugauuagcaacuuuaauuccaucugcaaccuuaauucuucacuguguaaccuaaccuaaucacagguuccagggacaggcauguggaugucuuuggggggcuguuauucugcuaccacacuguacaaagauaaaacacacagagaaaaaaaauuuaacaaaaacagagcaucagcgagcugcaggauaaccuuaaguuguguaauauacauguaacuggaaucucaagcagggacaggggauggaaacacguauuugaaguaccaaucgccaaaauauuccaaauguuaugaaaacuauaagcucacaaaucuaagaaguucagugaguuccaaguauaggaaaccugaauaaaauugcacugaggcacgucauaaucaaauuacccauaacuagugaaacaguaaaaaagacacaaaacaucaaaaaaugaggaugauggcaaaauucucaugagaaacaaugcaaguagagcaacaucuuaacaguugugaaagaaaaacauuuccaaccuugaagacuuuauccagugagaauaucuuucaaaaaugaagaugaauuaaugauucccacacucaauagcugaaagaauucaucaccaauagcugcauacuccaagaaauguuagaggaagaccuccaggcagcaguaaaauaauaccauaugggaaucugaaucuacacaacagaaugaaaagcacugugguaacuacauggguaaauauaugcuuuucucuuauaauuuaaauauuuucaaaagauguuaagauuuaaaguaaaaauaacaugggaggucaaaacggguggaucaucugaggucaggaguucgagaacagccuggccaacguggugaaaccccgucucuacuaaaaauacaaaaauuaaccuggcguggugugcgugccuguaaucccagcuacucaagaggcugagacgggagaauugcuugaacccaggaggcagaggagguugcggugagccgagauugcaccacuccacuccagccugggugacagagcaagacccugucucaaaauaauaauaauaauaauaaaauaauaaaauaaaaauagcaacaauauauuaugagauguauaacaaaguauaccaguaaaagguaagauaaacauugcaaaaaaggucaggaaagaagacauggaaguauaaucuuguaagaucuuuauaucauacaugaagggguauaauaucacuuaauguagacugugauaaguuaaagauguauaccauaaacccuaaagcaauuccuacagcaugaagagagugagauuuuuacuaauaagccaacaaagcagauagaaugaagucauuaaaaacaaaaaacaaaaacuccauccaaaacaagacaagaaaagagaaaaaggacagauagaaaacagaagccagacuuaaaucuaagcaucccaauaaucacauuauaaauaaagcuuaucagauuggauaaaaagcaggacccaacuauaugccugauaaaaaaugcacuuaaaauguaaagacacaaauaaguuaaaaggauggaaaaagauaacaucauacugacacuaaucaaaagaaaacuggauggcuauauuuauaucaaggauuucagaccagaguaaaaaauaugacuagggauaaauaaggucauuucauaaugauaaagaggucaguucuucaagaggacauaacaguccuaaauauuuaugcuccauaacagcuucaaacuaccugaagcaaaaacugauagaaauacaaggagaaaauagacaaaucuaaaauuauaauuggagauuugaauagccuucucucaauaauugauagaagaaguagacagaaaaaucaguauggauauugaagauuugaacaaaacuuucaacuagaccaaauugacauuuauaggacacuccacccaaccacagcagaauaauuuuucucagugcacuuagcaaguucacugagcaagauauaccauauucugguacaauccccccaaauucggaaacuaacgcacuucuaaauaacccauaaauuaaagaagaaauccaaagggaaacuagaagguauuuugaacugaauuaaaaugaaaacacaacguauugaaaucugggagcugccucuaaaguaguaguucagggacaauuauagcacugaacucuggaagaaacuagaaaaagaccaaauuaaacccaagguaagcagaagaaaaaaaaauaaagaucagaguggaaaucaaugaacuaugacccaagucggcaaccuacaaccugcaggcuggcuguuuguuuuuguaaaugaaguuuacacagauacagucaugacccuucguuaacauauugucuuuggcugcauuugcacuauaguggcagaguaaaguaguugugacagagacuauauggccuaaaaaccuaaaauguuugccaucuaguccuuuaaaaacaaguuugcuaaccacaaaaacaaaaaagucaaugaagcaaaaggcugauuuguugagaucaauaaaauugguaauccuccagcaaggcugauugaaggagaaaaggaaaaagacagaaauuaccaauaucagggugagagagguaauaucaguacagcuucuucagauaguaaaaggauaauaaaggaacauuauggacaacuuuaugccaauucauucaauaacuuagaugaaacugacaaauucuuugaaagacacaaacuaguaaaguuuacucaagaagaaauagauguauauauuaaagaaauuguauuuguuauuacaaacauuuccacaaaguaaacuccaggccuagauggcugcauuggugaauuauaucaaauauuuaaggaaggaauaauagcaauuaucuacaaacuucuagguuugaaaacaagggaauauuuaauagcuuauucugugaggccaccaaaaccagaccaagacacuguaaguaaaggaaacugcaggccaauaucccucaugaagauacauaaaauauuuuuaacaaaauuuuagcaaaucaaaacaacaauauauaaaagggauaguacaucauuaccaagcgggauuucucccaggaaugcaagauugguuuagcauuugaaaauguauuagcguaauucaucaauuaacacacuaaaaagauauacugucauuacaauagaugcagaaaagacauuugacaaaaucuaacauccauucccaauaaaaacguggcucagcagccaaccaauuuuccacacaggugccaagaacauacacuggggaaaggacacccuccucaauaagugaugcuggaaaacuggauauccauaugcagaagacugagacuagaccccaucucucacauuucucuguacagaaaucaacuacaaauguauuaaagacuuacacauaaaacaugaaaguaugaaacuacuggaagaaaacauagagggaaagacuccaggauguuggucuagucaaagacuuuauggcuaaggcuucuaaagcacaggcaacaaaaacaaaaauagcuaagugggacuauauuaaacuaaaaaaucuucugcacagcaaaggaaacaaucggcagagugaagagacaacccguugaauaggagaaaaauauuugcaaacuguucaucugacaagaaacgaauauccagaauauacaaggaacucagcuggcaaaacaacccauuaaaaagugggcaaaggauccuauagacauuccacaaaagaagacauacaaauggugaagagguauaugaaaaaaaugcagagaaaugcaagucaaaaccacaaugagauaucaucuuacccuaguuugaaugccuauuauaaaaaacacaaaaaaaauagacacuggagaagauacugaaaaaagaaaacucuuauacauuguuggugggaauguaaauuaacacagucauuauggaaaacaguauggagauuucucaaaaaaccuaaaaguaaaaccaccaugugauccagcaauuccacugcugguauuuauccaaaggaaaggaaaucaguauaucaaaggaauuaacccauuuaugccggagguugcaaauuuuugggggaaaaaucagaccuuggcagugaccuugagcaguaggauaugcauaacucccacaagcuuagcauuccaauaauggaacacuuggcauaaauacguuaauguaccccaauguuuauugcagcacuauucacaauagcaaagauauggaaucaaccuacguguccaucaguggaugaauggauaaagaaacugugguauauauacaaaauguuauacuauucggccauagaaaaggaaugaaaucgugucauuugcagcaaugaauggaaccagcauauuaagugaaauaagcuaggcauagaaaaacaaauauugcauguucucacuuauauguaggagcugaaaagaaguuugucucauggagguagagauuagaaugaugguuaccagaggcugagaagagucaagcagagagggggaugaagagagguugguuaauggguacacacauagaguuagaauaaauucuaauguuccauagcaggguagaguaacaauaguuaacaacaauguauugcauauuucaaaauaacuagaagagaggacuugaaauguucccaacacauaggaauaauaaacacuugaagugauggacaccccaaauuccuagaguugauuauuacacacucuaugcauguaacaaaacaucacauguacuccauaaauauguacaaauauuauguaucaauaaaaaaaaccucucagcaaauuagaaauagaaaagaacuuucucaaccugauuaaggacaucuucaaacagccuauagcagauagacuuaauggugaaaagccgaaugcuuuugucauaagauacaggaaaaagcaagaaugucugcucucaccacuucuauucaacaugguauuugaggcucuggucagugucauuagaagaagaaagaaagaaacgauucccagcuggaaaggaagaaguaaacugucucuauuugcagauagcacgauugcacauggagguucacuggugucuguagagaaaugauagacuuuucaccaaguggggcuggaaugugcauaugcaaaagaaugaacuucaauuacaccuucucccauauacaaaaaguaacucauagaccuacauguaaauccuaaaacugugaaacuuuugaaagaaaaccuagaagaaaacuuuuauggccuuagaugaaguaaagauuucuuagauacaaugcaggaagcacacucaauaaacgaaaaaaaugauuaauuggacuuugcaaaauuaaaaacuucugcucuuggaaauacacuguuaauagaaugaaaaaagagagagacauggacugggagaaauauuugcaaagcaaauaucugguaaaggccuuauauccagaauaugucaagaacucucaacaccaauaauggaaaauaaauaaucuauuuuaaaaauaggcaaaagauuugaacagauauuucaccaaaaacgacacacagauagcaacuaaauacauaaaagauguccaauaucaucagucauuugggaaaugcaaauucaaacaccugcacaccuauucggauggcuaaaaguaaaaagucugagcauagcuaguguugguguguaugugggggucccagaacugucauacacagcuggcgggaaaguaaaauggaguagucacuuugcagaacaguguguggccauuuccuuaacaguuaugcauauauaaaaauauauauaaauacuuaaaaaguuagacaggcugagagcacguuggggcaggacccaggacaggggcacagcucugggcagggcagauccaaguuuuguggggccugaagcuugugugacuuggguggcccucuucagggaaaauaauuuucaaaugagaaauucaagauuagguacaaaagugaauauuuaggacaaaccaaguaaccacaaauuccuggagcuguggaucuccagguuccuuuuuuuuuuccaagucaucuugagauauuuuucuaggaaugcugacauagaaaagcuuccuggugacaucuggcuuccucucccuaucucgcacacucagccauuccagccuucguagcccaaaugcugugcagcacugcuguccccaaggcagagcugcuuccagguggcaaccucgguagguggcaaugcccacaguccugugagugaccacaccagccaaccgagcagccucugggguugggcuccacugucucagccuccagcuuccuuccuaccgaccuccacagcucugcugcccagcggcugccugagccccggcgagcagggcuuaucugcguagugaagggcuccagagguuaucacagagcccuggcugcuccucacccuccugagcguugggccccacggccucucccccugccuccccacgggcccgcuguggugcccucagccaggacacagccccacccucugccucagcccucagagcagccugcuugguuuccccaguucuuggcggagagauggcaggagggagagugggauggcugagagcccagagucgggacuugaaucucuggcugugccacucauucgcugugugcauucaacagguuacuuaauuccucugugcuucaguuuucucaucuguaaaaugugguuggaaauaguaccuuccucauggagucacuguggaggauaaagaaccccaggagggcauguguguggcagcugugcuuaccagaagugucccaggcacguaccaggugcucaguaagcgcugguccugucugcucuccaucccugggucacaggcuccagcaaagcguggcuugggcccacccaccccaugggaacacaggucuguggaucucacacccuacuggcagauaguccagggaugucgggggguaggauguauaaagacaaacucauucuugaaaacccuaaaauuaccugugaaguucaguauaaauaguuuuuuguauuucccaaagaucaauuugcuuacacaugaaaacuugagaaccaaagaggggaaagucaguucacaagcaacugucugaguuuuccgauccuucugccuuuaggugccgauccacugucuagccgugagaugggugugguggagaauucuggggugcugugcugcauccugguuuaacauccagccucugugaccuuaauauauacggagacucuugucuucaggauggggaagggaggcccuaaucuccgagccaaaguuaaaagcacauagugacguuuaacuguguucuuaaaaugggcaaaauugauuugaaacaaagcauaaagugaggccacccuggggcacugaaagucucugagcuggccuaacaucugcaugcuuuauuuucuaauaguguccuggagugcauuaaauuauuucuauuuuggcaugggaaaauagcaaagugagacgaagggaaaaaagagaaaaugggaaaagacuccaaagaaagagauaugaguugugaaagggauggacugugagauaaaagcaaagcucagcuguugcuggaaggacuuugggaauaucccacagggaguaaugcugacuagugccggcgguggagagugugcugcgggcagggacccugcguaagccugugucucccugucuugcagguggugccggggagcgggagaaggugccggccaaccccgaggcgcuccugcucauggccagcucccagcgugacauggaggacugggugcaggccauccgccgagucaucugggccccgcugggcggagguacugcccguagaucgcaugcccacccucuagaacccuugccuccagguaaucaugcccccugccuguccugagccccaaagacccugcucacugaggacuugcuggcugcauccugugcuucucacagcaggcuggcccuuccacugccagcccucgggagucacccaacggcugccguguacucacuuccuccuuuauugaaaacuguguauuagacaucuaaauguacuggauucuauuccaggggugaggaauucaugaggauaggccacaccuccgccuucccucaucuccauucucugugggagggaugguagacaaggacaugugucucgugguguccaggggugagacaugucacaaagccauugaagcucagugagaggacggcgggggugugguuagguggaguggccaagcaggcuuaaugcagcaacggggagccaggggcaugcuggggaagagcauuccagcagagacauggacacgugcgaaggccccgagguagggacgagcuuugggaacacgaggcaugucaggaaggccggggccccgagggagugaagaccaggcgagugggagggccugagguaagaguggucaccaaggccuugggguccugguggggauuuuuuauuuuguucuguauacagugggauaccaggagagcucagagcaggagacacacaggaccugagucagauuuauguaaaaggugcccuggccaccacaugaggaguggaccauagagggacagcaguagacacagcaggccaggagaguccauggggugggcaugcagcugauggugcaaaguggccagcugcagguguauccuuaagguggagcugccagguuuugccuauggucuggacaugggguaugagagaaaugaaaggugacucccagccgugcagucgcuaucucuaggucgguguccauaugaaguggucaugaaaagaucuuucauaaugggaucaccauggcauuggggccagggccaccgacucccugcugaauguggagacugggagucugaaagcuggcugggcucugaccacacaagcuauggacguccucuuucucccuaugguguuugaucagcacacagucugggcagggacucaccuuuuggggcucugggccagucuccagauuucacaagccacaugggcugagccccuuccuuugcuccucuguuugcccacucuccucucccaccccuggcuauggucuaccugaccaccuuucauugaaugauaaaucccucacaaggaagagucaauauaauguugagagugaaaguuguucucucaggcuucaugaaugauaucacacugucagccuuggucuccuugaucccugaagguugcagcacauuugacuuagggcccuagauuaauggccuggaaaggucugagcccacccagggauuucugcagccucacaguggcuuugguuccagguugcugaaagugaaccaguggaacagaauagagcccagaagcagaaucuuacauaguuggacuuugauguaugacagguggcacuuuugagcaccagggaaggaacauuaucauaaucuugggguagagaaagaauuuuuaaaugaguuacaaaaaaacacuaaucuauuaugaaauuguugauaaauuauauuuuauaaaaugaagagcaucuguuuguaaaagguagauuaagaaaaugaaaagauaagcuauacauugggugaaggcguuugcaacacauguggucaucaaauuacucacuccccaaacuccuacaaaugaaugaggcaaaaacagacaaggcagcagaagcgugggcaagagacuuggacagccauuuccuaaaauaagaaauccucaugaccagugaacauaggcuccugcgcacaaccucaucaguaaucagggaauugcaaauuaaaucacaaugggauacuuguaugcacccaccagaaugacuaaaugacugaaugaaaaagacaguuucaagucgugaugaggauagaaagcuauagaaacuugcacauauugcuagggaaaucagcagugucugcugaaguugaugcugugcacaccugugucccagcaauuccauaugaagcauguccuacauagaaauguguguacagguaugccaggagacuuggauacaugggauguucauggcagccuuauugaugauagccugacacuaacccaagugcccagcaacaauacaauggauaaauaacuaugacucagucuuacagugggaaacuccacaacaaugggaaugaauccacuacagugccaccuacaugcaugaaucuuaaaaacaauguggaacuaaacccaaacaaacaaaauaacauguuguauuaucuaccuauauaaaguugaaacacagggcagaaguaaacuuguuauuuauagauagauaggcaacagaauauaaagaaaagcaaagaaaugaaugcuaugaaagucaggauaguagggaggagggaagagguuaagaugggaugggagaggggcauacauaucuuaaauguucucuagcuuggcuuggguaguuacacagguguuccuuuuacaaugacauguuuaucugcauauuuaugcuuuaagugcuuuucuagaugugugcauauaaaaaauaaaugaaacaaagggagaaacuugggucaaagaagugagaugacuugcccaagaugacacagccagcaagggggcagaacugagaaguggagguggauguucuggccucaaagacugugcuugguccuggcccaaauagcccguccaagagcugcaccaagaccugcacccagcaggccuggcuccccggccacauguccaucucccucugugcuugcccagaauuggggaucuuuggcagaaucccacauagacccuagacugaccccuuccccaggccuggcauuuaucugccuucccaggcugugugcugaagaacucacaaccauuaaaacaggaacugccaucaaaggcgcuuaucuccuuucucccgggaguacagaggaaaugcagaaaucucaggaguuagcgaugccagacgugucugggcaugcauggugcuggcaggugggcucagucggccccugaagguuuucuggcagagcuguuauuagcuugcauccccugggaaggaggcuuagaggaucaguccuuuuuugacuguuuuguaacagagccccugagcccuuccuggggugcuuauucuggcaccggcaggccaccucugacagacaggaguggguggcgugccugcugcagaugggacagcccagccauccccuugagaagugggagcagccaguggucaggggagccucacugcugguggccugcccagcccaccaagcuguggccacagcuggagugccucucauuugggaauucaucuggucauucagccaaccugcaauggacucgcaaauguucuaggggcugaggagacagcagcgagcuggagggacaggcacuggccucaugguucucacgugcuaguagaggaggcgggugaccagcugagcaggcacauggcagguuagauggugggcacaguggggacagaagaggcagggaggggaacacaagagauaggguuaggguuuggugacuuuugaguagaaggaaagaaaggguggauaacagcacaggcagagguagggggcccaucccggaagaacagcaaggaggccaguguggccagagcagagugggcaaaggggaggagagagaccaaagaaugaauggccuugucaucaugguagagcuguuagcaccucauggcauggaauagagaaguggcagaaccuggcccaucuucuaccaggauccuucuggcugucauguugaggaaagaccaaagccaguuaggagcuccuuacacaacagugcaggugagaggugaggguggccuggcccaguggugguggcgauaagaagucauugaauucuugauuuauucugaagguagagccagugguauuccccugcuaagauggaugagagguguaugagaaugaaugagagaaguuaaggauaauucugggauguuuugaucuaagcaaugggaagcuaaugaguuagcugagauagaaagacuacgggaacugcagcuauuuggaaggaagauaugggccuaguuugagauaccuauaagaugcucaaguuuagaugucaaguaggcagguagauauuucagccuagaaaucaggagagaggacugggcuagagagaguauuuagggggccaucagcacauagaugggguuugaagucauaaggcugaaugagacagcacagagcgaguggagggacagcagaggggugagaaagagagcaagccccaagagggaggagagccagaagccacccugagccaagugaaggaacaagggcagugaucaacugcagccaagugcugcugauagaucaaccagaggaugaaagcugagcagucauuggugacuugagcaaaggggcuuuuguggaaugccugauaauagugggaaugagaaaggaugauaggaggggaauuggagugucagcauagccaacucuuucaaaaaguuugcagaaaagggaaagagagaaauggggacagcagcuggaggaggaggugagguaaagaggaaguugguuuauuuuuuuaaguuggaagacaaagcaucauugcaaaagauugaugguguaggagggacagagaauuauugcuggaacaccagugucucuuauggauauagauacaaaaaucauccacaaaauccuaacaugcugaauccaaagaauuauacgccaugaugaaaugagauuuaucgucucuaagaauggaagggugauuuaaugucugaaaaucaauuaauguacuauauuaacagaauaaaggacaaaaacacaugaccgucuuaguagacuagaaaaagcauuuuauaaaauccagcacccuuuaaugauuaaaacacuccagaaacuaggaauagaagugaacuucuauucuaucccuaggaauagaagggaauuccuaugauaaagggcaucuccaaaaagcccacugauaauaacauacuuaaucgaggaagacuggcuaauuuuccuccaagaucaggaacaagacaaggauucuugccuucaccacuucuauucagcauuguacuagagguucuagccaggucaauuaugcaagaaaaugaaauaaaaugaagcuugauuuaaaaggaagacauuaaaguaucucuguuugcagauggcgugaucuuguguacagaaaguacaaaaaaacuauuagaauuaauuaaaaauucagcaagguugaaggauacaagauuaguauauacaaaccaauuuuauuuguguacaguagccaugaacaaacugaaaacgaaauuaagaaaauuucaucuacaggagcauccaaaagaauaaaauacuuagggauaaauuuagcaaaaaaaaguauaaaacuuauauucugaaaauaacaaagcauugcugaaagaaauugaaaaagaucuaaauaagaagaaagacaucccauguucaggaaugagaagaguugauauuguuaagaggccaauacuccucaaacugaucucugaacuuccacgcccaguucagggaacgcagccccagaaggaugcauggcgcaguaccuccuugccagcucucucugagaggagagagaagggagacaauagucaccggguccccagggcugccucggcaucuggugggugcuugaacauguguaucccuugccugguugucugcagagagucugcaagcccccuuaaagccuggaauuuauaugcauaggaagggguuuagccaagcccauugcauugaagugugagaggaggcagagugaggcuuuggcaacaggcuugggucuaggugugauuuggcucugccacuugcuugcugcaugaccuggcacaccucuuaucuucgcuguaccucuguguccuuguuugcaaaauaggaagaauaauaucuuuuuugcaggauugucauaagaauuaagagagaaaauggacauaaagugcucagcgcucucugaguacuaaauaguccucagcguucucugaguacuaaauaguccucauucauucauuaaacacuuauugagaccugucacaugcaggcagaggacucagcagggaagaaagcaguguacaguguacaauucaguggcauuaaguguauucacacuguuguacaaccaucaccaccaucccucuccagaacuuuuucaucuucccaaacugaaacucuggcuuucucccuccagcccugggcaaccaccauucuacuuucugucuuuauaaauuugacugcucuaagcaccucauguaaguagaauccuguaguauuugucuuuuugugacuggcuuauuucauuuugcauaauguucucaaguuucaucuauguggaauauuggaauuucucucuuuuuuaagcucaaauaauauuccauuguauggauauaccacauuuguuuauccauucauccauugauggacacuugaguugcuucuguguuucaacuauugugaauaaugcugcugugaauaugagggugcaaauaucucuuugagucccugauuucaauuauuugggguauauacccagaagugggauugcuagaucauaugguaauucuauuuuuaauuuuuugaggagccuccagaccauuuuccacaguggcugccccauuuuauauucccacuggcaguacacaaguuuucuaguucaucuacauccucaccagcacuuguuuucuguuuuuuuugguuuuuuuuuuaauagccauccuaacagguaugaaguguuaucucauuguucauacgguguugaaagaggugagagagugagccaaggggacaucuaguggaagugugcuagacugacgccauagcuugggcaaaagcagaacaucugauguggucuagaagcagcacagaggcagaugggcuggagggagugaggaagggagccacaugggaguggccagaagguagaggcuuccugggccccuuuuaguacucuagcuguuauuuuauuuuauuuuguuuuauuuuauuuuauuuuauuuuugagacagagucucgcucuguugcccaggcuggagugcaguggcacaaucuuggcucacugcaaccucugccucuuagguucaagcaauucuucugccucagccuccugaguagcugggauuacaggcacguaccaccauacccggcuaauuuuugcauuuugaguacagcagggguuucaccauguuggccaggcuggucucgaacuccugaccucaaaugauccaccugccucggccucccaaagugcugggauuacaggcaugagccaccacacccagccgcuguuacucuuuuuuucuuuuuuuucuuuuuuugagacugagucuugcucugucacccaggcuagagugcagugaugcuaucugggcucaacgcaaccucuucccccccggguucaagcgauucuccugccucagccucccgaguagcugggauuacaggcacccgccaccgcacccagugaauuuuuguauuuuuaguagauacaggguuucaccaucuuggccaggcuggucuccaacuccugaccucaugauccacccaccucggccucccaaagugcugggauuacaggugugagccaccgcaccuggcccagcugcuguuacucugaaaugaggagggggcauuggagggcuuugagccgagaaaugucuugauguaauacaucauuuaagaggaccacucugccugcugaccagaguuguacaagggggagcuggagaugaauuugcaauaauccaggcaagagaagggggugcucucccuguggucaggguagugaaagugaucagauuccaaaucuauuuugcaaguaggaugauaagcucuccuggcuguggaugugaggaagggcgcaguggaggcuaacuccauggugucuggcugggcaucuggaggcuggaguuguuaugaaguaagaagggaagacuuagcacagagcugguuugggaggcuauggcaaggccauagcucuguuuggacacguuuagguuugaggugucuaugagucauuaaaccaguggagaugcugagcgggcaguuggauucagaagucugggggcugggacuggugcuaacuagcacugugguaacaguuccacuauggccagcaggcaccgccaagcaaagcccugaagcuguuugucccaaccuuaccaguggcagcgcagaaggcagucuuggggcuaggagcccagcugggaaaaggugucccugcccagagugacugcuuggugcuggggcggggcaugggggccggagacaggcaguaggccuguggucaucaucggaacugcacugcccuggccuggcugugugggaaucucacaggccucuggaggcuuuucucagacccccaggagucaacucuccugcccuuggguuccucuggaaucauggguggaaaaaagaagggagaaauacagcucccugaagcccuagggcaggacaugugacauggaaaaaaauccaaccuugggacaaccuggugggaugaaaugcaaccuuguuagcugguaguggucaucauuugauggaaugacaucucuaaaaggaagcccuggaggcauaaucagauucagagugaaaggugauuacccccaggccaggcugccagugguagagcccaagguccuaguggaccacuucuccccagcacugcuugcucuauaucccagcccuccugggagauucaagaagacagucuuauuucuaguuccugugaaugucaaccugccuggccagugggccugggcuuuuccaggcagcccuuccaaaaggggagagaaaggacucuugcagaccugggcuaggccucaggucacuaagccagcagaagggguacuugagacuaguucuggugccuuccauccauucuagugggcccuaaggguccauguacucaaguggagaagaugucccuauggaccuuggauccuguccaggcucauagagggcaggccuggccucuucuggguauagaggguguucagagcacacuugggccuccuuccccugcagcgcucaaggcuucuccccugccagagccccaggagccugagaacuuggauccccaaggcagaggaaauggccuccagccacagccacccucccccaccccugcugaugggacagccacagagcuguuuaccagaacaaaggcccgagcagcugccuuaucuagggagagccugguaagcuagucgggaugauuuacagggggcugucacuacugcuuccugcaaaggucaggacgcuaacguucaacacucuuuuaaccaccuugcugguucauuaagcccuuccuucucagcagcucugaugagaaaugcccaucagcuuggccaguuugguuucagucuggcuucaauagaccucagaucacagaaccagaaaagaguuugucuccauuauugauaagauggggaugaaccccuggggaccccagcauuuccuauccuggacucugugucccugcugagccugacaauagcccugugaaaccagucccauuauaucccacuuuuggugaggagacagaaucaaggaggcuccagcauuuuguccagaccacaaauaagugggaagcuggcauuucaaccuagucggcuggagugcagagccugggugcuggcugccugcuguagagagcaggaugccagaaagccucaggguguccuaggguugggaucuuugucucucagcuuguuccaaguggcccuggaggacuucagcccacacacccugagagaagaggaagggagcucacacuggcuaugggcugcccuugccaggaguuugguacaaucuggaggcagcagagacucagagguucagcaacuuaccuaacaacacacaguggggcugggggcagcgcagcccaccuccaggguaagcucaucgcuggaugcuguugccagguaggccucagcgcauucuacccacuagaucugaguugucuugguuggggaggggggcauaauuaagacugaaggaagaggcagucccuaagguccuggaucccagcccuagccagggagcuguuguacacacagcucagagacaaagaccauccagagugaagaggccaacuguuaacuggguugcuugugugauuggacagacucagguugucagcuccccagcccugcccugagaaggcagucucaugacugucucugcacucccauccccaacaggccccacagcuaaaaaccaccccugagguggggugggcauuggcagggccagggcuucaccuggagcucaauguggcagugccugccggagccuucuaauggguggugccugcaggccucuagccauguggggcuccuggguagggguggagggcacucugcagagacuggccagucugacucugaagacacaggcagggaaaccauggcucagagcagagaaaacaugugggcagcagacccugccugcccaccugagagaagccugccggccccugguuggugagagcuucugcugagcccuuggccccugcucuuuaacauggacagggcugcucagagcuggcaggucccugggccgugggaaugccaggcucuguugguagguggagggcagacauuccuuggcuugugacacccugcaccaaccugcccuggcacccucauguucaccugagcucuggggagggagaaaacagcuccgcggccccacucccaguuuugaggaccuuagcccccauacuuagugucagggccaggacuagggauccucacuggccuggggcacaaaauguaagggggcaccaaaaaaacucaguaaucaagauauuuuauuguaaucuuuuaaaaaaugaacaugaauacuaaaauauccuuauauuagguccacauugcagcucuaacaaacugccagaaauuuggcagcuuaaaacaacacaacgugauuaucuucuaguucuggaggucagaagucauaaccagucuucuaaggcuaaaauccagaugucagcaggacugguuucuuguaggacauggggagaagcaguuccuuguaucuuuaaccuuccaggggcuacagcaaggccuuggcugcggcuucagcacugcagucucugccucuguccugcccccaccgccuccacuguggucaaacuuccuucugccuuccugguaaaagaaccccuaugauugcaccuggccccuuagauaacccagguuaaccucuccagcccucaucacaccuacaaagucucuuguacuguguaagauaacacagccacagguuccagggaucaggacaucuuguggggaagggcauuauucagccaaccacauccauggucaaaugcaaacaugugaaauaaaggcaggaauguggugggauuggggugggaggcacucacccucaaggccugugcaagugcauagcugcuccuuucuguauugaaaacuuugaucuuuuguucaucaaagauuuuuugccuaauauuuauucuuaaaaguauuacaauaaaguguuuauccuaguuacugagugagguuuugggugccccuuaaauugugccccuguggugagugccuggcuuguuucacccuaggccaggcucugccuagaaugagcaagaggcgugacccagcucugcacguccagcuugaagaagggccccagccucuuccagccccagggccgcaaaucccucccuuaagaauucugcccucuaagcaacuuuucccagaguaagcaccuugcaaaugacaaagcuggucuuaaacucaggcuuagcucaacccaggcugcuuagcucuagcagguccuuacuagaaauuuccaauaugcaugcauuuauuuucacauacgauuuuuccagaguuuuggaaaauaauauucaauaaagaaagaagucacccugauuaucacuugacccauaacuugcugaaccauguuuucuuuuucaaguauuauauuccggacucacuaguaacucacaguauuuuucuucuaacaaguguuacuccaauuaugucugcaccuuuggucagcuacugugugaaauaaauauucaguacaagcuaaaaaaaaaaaaagaauucugcccuccuacccuugggacucccaucccugcuacuggcguugcauugccccuagccgugccucucuguccaccugccuuccugguguacccauuccagcccucacccuuuggaaguauggggauugugggcuggucucagaaaccuaacccaagaagaauacaggcuuugcagaaagaucauguagguguuaaugaagguccaucaccagcuguaugaccuuaggcaaaucacacaaccucucugauucucuguaauauagggaagcuaauaccccucagacugcucaggggcauacuguaugucaaguccaaaccaauaucucuggcacuaggaugcccaggcaggaagaggccagaagggccuggagccuggacccccacugugaagccagcaccuccuccuugcugggugacccagacucaguuaccuaaccucccuggaccuccauugccucaccuggaacaccugcuucccaggcgaaggguuaagcgggcgcuccaaagcagguccugggcaaagagggaagggauuccugcggugcccgggaacguggggcauuaggggaaagggugugaaguuugacaccggagaucccccacgggggccgacuucgggcguggcauuccaggcaacucacagauccugggccuucccucgccucaggguccgggccuggggcggcgcuggccggggcgggcgggcggcgggcaagacgcuaccugcgcgcgugccgggcauuccagccgccgccgcgccgccgcgauaggcgcgccaugggccugaugccggccgcgcgggccuacuccgggaugcagcgcuugcccgcggccgccuugccgcuugcccgcuuguugcgcgcccgccgccccagguaggggcgggacggggugcgggcgcccccgggcccgccagagaagcugcgucuccgggccauagaggcgcucgaagcugggaccggcgcagcgggcgagagcgccgcgcaugcgucucgcgggggucggcggggagccugggggaguuugggugucaccgcggaucuggugcugcgggacgguucccagggggcgagggucgugcguguccgagggaagaaacagggaccggaggcguccuucaaucuccugcuggcugugggcgucccgcauguagagacgaggacuuagagucugggggggggcgcagggacuugcaaaggaucccuccccaccccgaacuacggaggggacacagcgggauccgagccucgggcucugaccccaagccuaccugggccacaggaaggggugugggaccggcggccccaggaggagggaaucacuucugcccugggguggacugcccagggcaggacccuuccaggugagcuuagccucuacugugcuccuccaggccuggacggguggggagcaggagaguuuucagcugugccggcuggcugguggaucuuaccgcuuacagcccugggggcaauucugaagcucccuaauacuuagcgcagagccuggaagugacagaguuggccggccagugagucccugcacugacggacaaaggguggggugguugcauggaagauggugaguuuugggguacaggggacccgagagcagaaaggccuggagccaagagggaaacuguggaauuacccaauuacccaaaguuugggagucucuagagagaauuuuagaauuacuuuccucauugugccucuucccagacuaugucauugcccgcuccuguaagagugaaaagcaggcauaugacugaagcagaccugcugcgcagcugcacucugcuccgggaucagcuccaagagggaaucccaggucucccuucccugaugcggccuucggggugggacucaggggcaggcagaaccuguccaggaauugacccugcaagguccggagaaagccgcauuucaaagcacuugcuccugggugccugguguggucgaucucccguggacgcucacaccccggaagguggccaagcccagcucagagaggcuuaggacagugcccagggucauagaggacgcggauuggagccagcggacugcucugccugggcuuccucuccggugugggauucccggggaggggagugagggacggcuuugccaggggaacgcuggcgggggaggccuggcagcaaguucaucaagaggagaggcagccucugccaguuuccccugcgguggcagagccagugcucuguaaagagcaugggcugggaccucgaggaacccacacgauggcuggguuuccagggagcugacaaaccuacuggaacuaguuuuuggcaaggcuccccuccgagggugccaggagagcugagggaguucagccaggcgggggcaggcccugccaggcuccugagagacccugaugaggggagggauugguggggccccuaauaagggaggccgggcccagaagccccagcacagggugccucccacaggagggccgcggggaaggaagccucuugggaggcuaagcuggaaugagaccucacagcuccuggcagcuccccuccaaggguuccaguggccagcugggaauguggggccagucugcagccuggugguaccugggggcugggccucagggaagucucgcccucauagcacccccuaaagacaggugugauccucccauuuuauagauuucauagauggagagacugagccccaggaaagggaggcagcuccucuccucaguggguuagccaggacguccaccagaccagugcuggugcagacccagaaucuuugucucugugaccuuuggccuugaacaucgccuacuuucccguguccccaccucagccccaccaugccagggcagggugcugccaaccaugcuccuucaccccugcccucugacgcccaugcuccuccaucaugugcccugcacccccacccgccuaccuggcuucuuccugcucaucuuuagacguuggcuucagcaucaccuccucccugaaccuguucucucuagaagugcccaggacccuguggaugucccuuuccuggcucuuccaucccuguuuugggaaaguguucaggaaggcgccaugggggagcagaaggguagugguugugcuggggcugggagcugcuuggaugugcaggcacuguacaaauggugggcuggcccaggcucugcaccccuagggucugguggagggaguagggcagggccuugccugcuugccaaguuugggcuuuauccugaggacgaugugugugggggaacagggagcaggggaggccccagggagauuuauauguuuacagccuucagggcagcucucuaauuccuagaguggggccaggcacaaaguauagggguuauggaaagguggauggacagacagacagcaggaguuuuggggguaggagaugggacagcaggccgggcuggagccaagagauggcuggguggaauuacccaugcuccaugggcuuccagagagaauuuuggaauuuuuuccccauguaucucuuccuugacuguggccuucagucagcugugagcugaggguggggcugaacgcugugaguugagauggguggcggcccuggagagcucgguccccuccuucacuggcucuccuuggccucugcugcaagcccagcauguggcucugggcaguucagcaacccagcagaggggaguguccucacacugucuggaguaguggcaggcagggcugugacagaggggagggaaagcugaagggaggaucuggggcagcucacguagcagggacuucugagcuuucuuccaagggcuagugggaaauuugcccagaccgaagaggaaagcgcuacccagggagaaggcccuacccacucacaggcccaugaaggcagacggauucaugccacucaagcagugggcagagcuggaggaaaggggagggaggcaggaggcaggcggcaggcaccaggggcacugccaggucagccccuccccucaugggacccucugcccaugggcacuuccuccuggaugcccucugccugcucauuugagguccuagcagaggccucugguccugagagguguagcuucccauugcuaccuuuccuacuuauccuggccccaguguccuugggggaagucugugccccagaggucaaagcagaagaggugaacgaauaccugucaagaccacaugagaggagcaugggccagguuggaagugagaggggaugguggagacugcggagaaguagcaagugugaguccuaucaaaagggcacagaugcuacugagcucugcaauuguugcuuuuuuuggaacucaggccuggugucaccacgucuggauuuuuuaagagaagcugggaauccagauuuguauaugaaaucucuugauuauaaauaacuaauuuaaaaauguuucaaacaucaugugagcuaaacaggcacaucuguggaccuguguggcccacuguuaggcaucagauguugagcucugacugaggugagagacagcaggggcucagugucacuggaccagcccaggccacucuugggaugguggaaaggccaggacgcugucaguggugggcccuggagccuccucggacugguuucucacagcugucccuggcagcuagcaggccaagcuugcagcaggaucaccuccugugcucaaggcugaugaauggccccuugggucccauuucugggcaggggcgccuggucuugcccaccaggucccaggugggagcagcuuucccuucguguuaguauugcaaccucugccuguugucuguucacaugacccauguuuucaggaacugcuggugcuggauugggggaugccucacauagguaucuccacaccaacaugggugccaagcagccauguggcugaguacauucccuauaccuggagccagacugccuggguuggaccguugucccugucaugcaugcugagugaacuugggcacauucuuaagcccccaugccucuccguucaaacauccuacaaacugaacaggcaaaagucaagauaaugauguugaugguuacagugauagugacagucccuaaguuaucagauggguaggauuaaaugugcugaugaguguaaaaugcucagaacagcaccuggcaccacaacaccguguguagcuacuucggcacucuccucacacucaggugccccccccccaccccgaagugugcauacccaugcacacacaagcccacaagcacacauaugcacauacguuuauaagcgcacauccagcacaugugcacacacaugcacacacaagcccacacuacaugcacacaugugcguacacacuucucccuaaagcauugcugguauccagcagguguagcccacgcgggcauguguucucaaaggaagagucuucaccuuucagguuuuauacacuuuguuuuugggucaagcagggugaggaggagcauuuacuguguucugcucugugccaggcacuguaucagggaccgauguaucuuauuccaaaauagccccugggugggaagcuaaguaagacaaauggagccccacuuuuagcuggcucagugcccaggucucugagaagucccaagccuggacauggagcuuuggcaucuugccccuggaacaccccacaagccacccugcagggaaggucucugcacagugggugugaauaaugucagacacuccaaagagucaggcacgcaccuuguagagcuuaggggcuggcacaagucuguuucuccaguuacugugccgugguguagacagcuuuauggaucucaacuccuucccuucuuugccugggcugccaggaaccucuuagccuagugauauauuuaguuuucauagauuuucucagaaguuccucugccuccuuccucucucccucuauuccucauuuggugucuugucauguauuguuuuagaucauucucucucugauuucuuuucuuucuuuuugcuaauguuauuuaagaguaacaugcagaaaagcauacaagucauaaguguacaguucagugaauuuucucaagaggaacauaacuggguaagcagugcugggggagagacacaguguuaccaggaccccagaagccuuugagccccuuccagucacugacccaccaagggaaccaugucccggccuaacagcacagaugcguuugaccuguuuuuaacuuuacauacauggagucaugcagugugcacucugggguuuggcuucuuuuguuucugaugauuuuuuuugucuucuaauuuuuaaaacauuucauaaaauacacuuagcauaaaauuuccugucuucauuuuuaaagcacacaguucagcagcauuacauucauuucaauuaucgugcaaccaucagcacuauccaucuccagaacacuuuccaucuugcaaagcugagacucugugcccauucaauucuaacuugccaucuccccuguccccagcuccuugcagccaccauucuacuuucugucugugaauuugaauacuccagguucuucauauaaggggaauaacacaguauuuguccuuuugugaaugauuuacuucacauaauguucucagguucacccauauuuuaucacuugucugaauuucccuccuuuuuaagggaauucaggcuuaaggcugaaucaaguucuacuguaugcaaauaccacgucuugguacuccauucauugauggacacauggcuugcuuccgcauuucagcuacugugaauaaugcugcugugaacaugggugugcaaguaucucuuugagaccuugcuuuuaauucuuuuagguauauacccaggggagggauuauugguaauucugguuuuaauuuuuugaggaacugccauacuguuuuccacagcaacuacaccaucuuaucauccugccagcagugcacaaggaaggguuccaguuucuccacauccuugccaacacuuguuacuaucugaucuuuugauaguagccauccuagugggugugaggugguaucagauagugguuuggauuugcauuuuccuaauaaugauugaugcugagucacgacuaugguuuucacauuacuaugucaucugucuuguccagugagcugugccucauuuauucucauugcugcacuguguuccaugguaagaauagaacacaggagaucugcuguugaugggcacuggauggcuucucauuuggaaugacugcaaaaccaaucaaugacaggcauaaugaacgcucccaagggccauuugcuccuggcuugggcaagcuccauggccaggucacaccaccaucucacugcucccuccugcugucuguccacaggcagcccagggcccagccuccuggugugcauccucccagcauguguccgggcggccagggcacagccuucugguaugcauccucccaguguguaauuugcuuccugaggaggagccaccuuuagcccuaacagugcgccugcccuccauuguccugagcacccaacacugagcugggugguggagggugugacuagcuccucucugugcucagggaucuuugggcagcgccuagaggaaacaguccaccacgagcggaaguauggcccccgccuggcgccccugcugguggagcaguguguggacuucauccgggagcgcgggcucacugaggaggggcuguuccgcaugccaggccaggccaaccuggugagggaccugcaggauuccuucgacuguggggagaagccacuguuugacaggugagcuugugaucggggguaagguggagccauuuguccauuccuccugcaggggcuccugcccaggacaccagcuccagugggcaggggugggcuagcgacaggauggugggccagcccuccuagugggcagaguguagggcacacccucacuccgccagcccgggguccccucucaggauggaugccugccaugcacgaggccagcucacauccacacagccugccuccccugcacaugcuaauaaaccugacccaggcaggaagaaaaggaccucugcuggcucccaugugaggacugaccaggcgcagcugcauccggaccccaggccuucugcggggucugucucuuggccgugcuuccuccggugaccuacccccaggcucuaucaauggcaagauggcacagcagcucggcuccccuccuuuuggguucuggggacaggagagcgagucuccuccaucugcucuggggccggggccauguccauccuacccaucaugggggcuuacccaggcccuggaugccccuggguggagccaacuauacccccagccuagggccguuuggggauucuguuuccccugacagugcccccacccauuauggggcaguuuuuucauagaguucucucuacaucaggaaaaacuacccuccauggggcuuaugcccugucuucuuggaucugccccaggaugggcccaccaggaccugcaggcagcccuggccucccagggcuucuccucugggggcagaacacucagccccucagcucuuucccaggcccgucacugcagccaggggagggugucagcuccucuccuuagauguggaguccaggacugaccacuguucccuagcggugcuccacccagggagguacgggggacccuuccucuggagcuuugugaagcuccaucccaguguugacgcucagugagcuugucguccauucugaaccucagccagccaggccucuuccauccugugucucagcguuaggguugcagauugcuucaaauaaugucaccuggguaaggccugggagccgagacuuuuggaagcuccccaggaucagaugcucugcccuagugccugaugcuaccugaggggcuucugcagacacagaucagaccuugccacuccccuacucaaacucugcuggggcucccuggaguggcacaggccgucugcgccucacccacacugccaagcuucucccauccugcugggggggucuccaccugggcacaccugcucucccaaggugugguuccuggcaugcucagccuccuuucuccaccuggccugccugcugaagcccccuugagaggcagcugggcacccuaggguggguuccaugcagaccugacucucggccucccagcagccuggggcagccuucccuaugucuuggaggcccuccccugucugccuucucccucucuggcugcuucuacccugcuucuggaauugugucaggagggccaucuccauggugggcauguuggccuugucccuccacccccaucucagcagugacccccauacugccacgguggcccugggcuuugguuuccucucccuuuagaaacuccuccugggguaucugaggccauccuucccacuuucugccauuuccauggcagcuccucuggcucugcagcuguacccacagaggggcccuccccacccaccccugagggaggccccccuucccacccaaccccaacagaagguccccccucccuacccacccccaacagagggucuccuccucacccacuuccaacagagggucccgggauggagcucucuccccaaggccauagccugccugccugcugggguguuggcuucuguccuggccccuuccgcaggaagcccccuccucacuuuccugcucaucucuauaagaagguccccuuuagccccagguccugggcuucucuucugcuaaagccucaccaggccuggaagccucagugccuggagcugucccauacuugccccuucccagcacaguguccccugggcacugggcugucagucucccggguugccacccugcugcugagcucugaggacagccuccugugggccggagccuagggcugcauggacuccuggccgccaggcucuccuuacucccucagcugcuauccuuugagggagggagcacugggaggccuagggguggaggggcacccacaugcauuagaaauucuaaggggggugggucuugacagauaacaaguaaacaccagggacaccagucccgggccuagugguagggaaccucccagggugcugcagauggcagggcugggcugcucagggaggagcccugcggacacccagguggggugaagcaggcggcccggcuggggggcaggucgaggaaguggggaugggugaugagaaacggacucuaggggagugaggcgagucaggaccaggcuggaggcauggcguguucugcauagaugccgguguuggcgugggcgggggguucccuggguacagagaggugacgaggaaccugcagauggagggucaccuugcugcgggcugcacugaccaccagggccucuuuguccccagggcaggcaccucguccccugaccagcugcugcccuuucugccccaccccugcccccacccuccgccugcgcuaaugucgccgcaugcugggaggcccacaggcuggggaggcgcccacaggaccacgggcuguacagaguucuccuugggugcuuguuggaggggggaaggggacagcaguuuagggaaaagucucaagaaaaggccuggugacagcuguuggaggaaaggcacugcaguggggaaggagggagggagggagggagggacgaggaaaggaaguaagagcucagguacugagcggauagggggucaggcagggccaagcagcaggacccugcggggcagggaugcagccgggcaggucugcagaggagggguggcucuguguccacucacccagggcagaaaugcucccauccccccagcugcagaaaaggggaagacauacgggcuggcugccaaccacacuucccugccuccugcccuucccccagucucuugcgcuccacucaggcugccacugaagccacgggcucccaguggggaaggggccgcugggcucaagccuggguacccagggcaguuggccaggaacauggcccgggagaaggccgaggagggugugauagcagcaugccuggcuggagauggaaggagggugggaugggggcugccuggauccagccagaccaagagucacugagccucaggcaaggaggggccccagguauauggauuuggggugcauauggauacauggaaccccagaaucccaaaugucagggccagaagguauuuaucucagugagccuagccugggauucauccgggaucaggugauagcauaauggcacagccacagucuccuggccccgucucaucuuuccugagggaaaugcagcccaggguuuaaguccaugguucuagacaagcagaugaacaaccuggggcccauauacggcuuggaacgcaagcucggaggagaugccaaggcucucguuuaggaccugaacugcagaccccacacaggacccagggaaggacuaugccaggcccauugccaccaccauccacaacuggucuacuucugccuuggcagcuccgagccagagcgggagacugaggccuggaguggacuccuggggcacuggagagggggugaugagcuuagaagccuaggugucaccacuguggacaggaagagaggaaagggccugaccuccgaccugcuccugcuguugguccccggauaccugcuccccaacaaggagccagcagcccugcauugugggcgccuuugaugcagcuccucccacuccagccaaagucaagugcaguggagagggcaagcucgggcuggggguuggcagcaccuauggagggccugcaggauagcuguuccuaccgcagagcaggcagcucccacaucgucuugcaggggaccuugggauggccaccaggccuguggaaggggcucccuggcccaugucccagggcccuccccugugcaaccugaccugcaucacacuugauuccucuggcccagggcagcugcuaggguggagcagcugugcccugcagggcccuguggcuucacaguuccuggaguccuacgcagucuacgcaggacagguucuggacggacugacacagacaugagacucagggauucugagcaggugccuaggcaugauggguggucccugagcuggagcuccuggccauggauacuuagucgucccugccccagcucuauccacugcucccagaagcagcacuggccuuuccuugaccagggcagcuggccgcagaugcagcccccagugcgcccaagaaugcaccugagaccagaggcugccccuuggcgucagggcguaccagucaccccugaaguccccuggcaucccaggccucacacaccuguccucuucccccccacagcacaacagacgugcacacgguggccucccugcugaagcuguaccugcgggagcuccccgagcccgugguccccuucgccagguacgaggacuuccucagcugcgcccagcugcucaccaaggacgagggggaggucaguggcuccuggggauagcuccugggagaugggcuggcuggguggcagccuguagacucaggacacagacucugacuuuucaugaauuuucauggcacauggauccuguggaggccugcuguguuggggguguggugggggccuggagcauccugcuugggugggggaggggccagggcauccugcucaggucggggagggcuggggaauccugcugucuggagccauaccugucugcggccuuggucccugggagggguggguccggugugcccagcucuggcugucacaccaguaggugcucacacuccccacacccgacucaggccacucaggcccgucacaggcucagaaaccaggacaucuuuuauuuauaucuugcuuccuucccaaaagaauuugagcuggcucccaggacagaugagccagcccucccguccccacccgugcaggugcuggucugcagccccagguggcucagggccagggaaggacuguuugccuucccugcggccaugugggagaugagggcucacuaucuggcaaauauuugugucuugauaagugagcugagugcuggcccugacauuccuccacgggcccuguagaggcucaccccucacaccagcuccuuggaagcaaguuagcuucccaggaggucacagcugggcccuggccacuccuugaggggagguggaggugguggagcccucuggucuguuggggcugggcugccguagcccccaccucccuucucuuugcccaccccuccucgcagucagagaacagucagggcccucauugccgguguuugaaauucuguucuucauuccuaagggcacucuggaguuggcuaaacaagugagcaaccuuccucaggcaaauuacaaccugcucagauacaucugcaaguaagcggcuuggcaggagggaaccacacuuuccugcacuggcuccacgcucccccaaccccacagcgagacacgcaacucuuccuugucagaggggggcccgggucauuccccacccugcacagccucaacccagcguggacgaagcagggaguggaaaagcacagacccugaguucacgaagcuuacagucccaugggagcagcugguuuuaaacagaccuggguagauaauuccagaagggacauacccucugucccuccugggugccucuugccauccuguccccccggcaucugccccuugaccccaacccuucauguauccccauccuagacacugagaaggggaaugcaggggcggcgcugacuggggucugggacuucccagaauuugugcccacuacaauuugcagagucuuguccuccuuucacacaaauagcggugggcccuugucccagugacuuuuacuucugauggcccucuugggccccaggggaagccuucccucaucgagccuggcagaggcaggcuacacccagugggcaaaagcccacaggcagcagggcucagcagggguguggcggugcguccaggccgcacacaggagacugggcaucacaacuugcuucuuugaugacugcugcuuccuuacuuugcagguuucuggaugaaguucaggcauacucaaaugucaacaagaugaguguccagaaucuggcaaccguuuuuggaccuaacauucugcggccacagguagaggacccaguaaccaucauggaagguaagugggagguguaccugguggcccugggugcugccggggucugggcucaucuugguccacggcaaguccuuggaaccaucccagcccagggccaggccagcaggagggguggcucagguggcacaucuccaucucuggggacuuggcaggaacuucugcagaccucacccccgacccccaugagguucagcuauaagauaaaaaaggaacuuugcccugcgaugggcagcagcaggucacugggugcaauuagaauagccagggguuucuguggauggaagaggcuggagggaugggagaggucagcacuuuugcccuugaacacagacauguuugcuuuucuuuuacaauuaagcaauugucauagguuccuggaugucagcuuugcaaacccuggagaauuucucuaugauaaauaacaauaagugauuaaaaauagcagcaacagcagccgcuuucaguaagcuucuaccaagugcuuuguuuguaucaucucauuucaggcuuuacaaccagccugugcugugguaaucgcccccacuuuacagaugaggaaacugaggccaagagaggcgaggggacucaccagaggccagucagccagacuuagcaaagggcacagguguaggcugccauagaaaagacagcccaccucauagggcccauggaacacuguccccaguggaguaugcaugagagacgugcugcucagacaggaagcccacagcugaggcuguucuugcccuuaucccauguugagggacguggcggagugcuuuugcucaaguccgcacuuuggucagcccuggcugggucucccaccccagggccccuugaggccaggaaaacacaagcuccuaccugccuggugguacagaugcuugagggaggaggccugcccugccugcuucauggaguuccugcuucaccuagguucuuggccucagaauuccuuccuugacuucuuccaggauuccuagucaacuucagugggagaguccacccuggcacucagcccucccuccuaccgggggaccuccuagcgucgggccuuuguggugaggguggcaggagggaaugaggcagcuggauagaugcccugguccuuccugcacugcccaccuccgcugcaggcccccaccccaccaccguaggaacugaguccccaggacugggggcugcaucucaggggccuuggccuagacacgggggauugugugugugcgagauuauauguaugugggauucuggggggugagcagggugcacuaugugugcaguuguguaugggggaauuuggggaggcugcggagggugcauugugugugcaauuguguguggcggauuuugggcagugggugggguucauugugcgauucuguauggggggauuuggggaggcuggguaggggauuuguguguucacuuguguguguguaggggcuuuggggaaacuggguagagugcauuguguguguaauuuuaugugugugggauuuucgggagugggcauuguaugugcgauuguguguugggggauuuggggaggcugggugggugcauuguccaguugugugugugugugggacuuuggggguggauggggugcauuguacgugugauugugggggguauuuuagggggugggcggggugcauugugugugcaauuguaugugugugcccccacacaggaaagauggcucuauucccugucccagagcccuaugcucccagaguguggacauucaggcauggcaguugucagcagcacagaggggugacguggggcagccgagagaguucuggcaucucaggucccagguuccaguuccaaccugccaccugcucaccgugcagccuuggugccugcuuccucaccccaccccagcuggagggcgugagcgcaggcacagugcuuccucccugcuugcggcucugugccugaggaaggcgguucugcggccccauccugcuguccugccuggaguuggagggugugugguccuuuccucugggcggaugaaggcucccuugaggggcggccuggcucuggggacagggccagcucccacgaagcugcagcuucuccaugacuggcagagcgagccugggccgaguggcuggcagcaaggcccuucuccgccucucuucccggcaggcacuucccucguccagcaccugaugaccguccucauccgcaaacacagccagcucuucacggcaccggucccggaagggcccaccuccccgcgcgggggccugcaaugcgcagugggguggggcuccgaggaggucaccagggacagccaaggagagcccggcggccccggccugcccgcgcacaggaccucuucccuggacggggcggccguggcggugcucuccagaacagcccccacggggccggggagccggugcagcccugggaagaaggugcagacccugcccaguuggaaguccuccuuccggcagccgaggucccuaucgggaagcccgaaggggggcggcucaucccuggaggugcccaucaucuccuccggcgggaacuggcuuaugaacgggcuguccucccugcgcggacaccgccgggccucgucgggagaccggcucaaggacucgggcuccgugcagagacucuccaccuacgacaaugugcccgcgccgggccugguccccggcauacccagcguggccaguauggcgugguccggggccucguccagcgagucgucgguggggggcucacucagcagcugcacggccugccgcgccagcgacucgucugcccgcaguucccugcacaccgacugggcccuggagcccuccccgcuccccagcagcagcgaggaccccaagucccuggaccuggaccacagcauggacgaggcgggcgcgggugccagcaacagcgagcccagcgagccggacagccccacccgggaacacgcgcgccgcuccgaggccuuacaggggcuggucacugagcucagggccgagcugugccgccagcggacugaguacgagaggagugugaaaagguaacuugcugccccguggagccuccugugacggggcggagccugcagggagagccgugcucuuggcacaugggcgucggccccuaaccucugggccgcuggcccuggaagccagccucagagaggggaauccuagcucugggaaagcccuaggacuggcagacuuggcacacagucagucuggcacgcagucagucuggcacgcagucagcgcugcagaggccugcugacuccacgcaagugggaaugccugcccagccugccggggaccuuugcugcagggguggaaacagagucagugugcagucugcagccagggagggggcggccccuggaggcaggucccaggcuugucccaguacaagggcucauagccuggaugcugagugccaggaagugcccaggccccaggucagccaggcuggaagugaggaccccuuccuugaugggaucagaauccaguuucccugcugaaccaagcccucguguccgcccuugucacaggaugguugugcugcacccugaggcuuacaaucucacuaacagagggccagaguuccagccucccaugaggaccgggguugcccucugcagugaggaaccucagcuccuggagaccagguucuccagcgcagggcguuucccucagcaucucagacuccuuggucccucuggcugcagguccccguuagcuggccgaccuguucaccugggucccacccacuagcagggaauuccuuuauccauuagaggcaguggauggagguggaaggcauuccugcugcccacucugagccugugauuuccacugggagcuggaauggcagcccuugcccuuuugcucugcugacagcuguucccugggugauggagagugccaggcauguacaggcaccaugucugcaaaaggaagagaaggagagggaccuugagggcagaggccucugccaugggggaagucacagcaggcagugccugagccagggcuggaaggacccauaggauggagccgagaaaggaaauagcaucaguagaacccaagggccuccagaaauauaguagaagaugcuaucugcugcagaugagcucacagaccaaacuacaggguacaugggaacucuuaccauacagaaggcuguccaugcagaaggcugggcuggaccagcugcgccaguugugugcugagugccuggagcuccucuggccugcucugaggccugguuucucaagggagaugcagggcucuuugacuccaggucagacuacuuggauucuagucccagcuccaccagggauuggcugagugucccuggcaggaucuuugggccccagugaccucacccauuuguccugaguauuaagugacucacaguggaugagagcgcucgggaaacuuugcugcucgcauugacuccugccugguggcuggagguaagaugagguucccagaggaaaagggauagcagugguagcccuuguggagggacuguacucgcuagcagaguggucugggucguugucuugguuagagggagggucuagagugaggaaggucucugagcacaggaaggaaggugagggcauuagcaccuguccuguccagcaggugauuggggaauguguguccuguucucuggaaguaugggccaucgggugggggguggggugaggcuggccuuguccuggcucccaggacucuggucagagccccuccccagggcccugcugggaagucagccuuccuucgugcauucccaaaagagaaccuguuuucugugaaguaccagaugcugugcagguggccacaguuggggugaaaacugaucaaaaucucuguccccauucuuauuuggguugcagggagacaaagaccauaagcacgauacauuuuuaaaaauacacgguguguuaaaagggagaugaaggaggggaacauagagcagcauggaggggagcggagaggagccucaggguagaagguuggagggcccugggaaggagaccccagagcugcagccagcacugaccccaagaccccuguagugggggagagucaggggcuggggacuggagauguguggggagggggcaauggguggggccuuuuggccugggcaaugcucugguuuuucguggagugagaugagaaugaagugagaagccgcuggagggucuuggcacauugggcacuuugacaggugcaccugggugccaugccgagcagagcuugccaggggacaagggcagaacagaccaguuaggaggugugggggucuaggccugaccuaugggggguguggcccuauggggcagcagguggaggugggggaagcggccaggugcugagcauauuuugaagguagagccaaaagguuuugcuaacugaucagauaugggaccgagaaaaagaauggacuuaggggaggacaucauuguucagcugagcagcugagggaagguguucaccaagagugcaccagggcugcggaagaguggucuggagaugagggucaggacccuuuaagucagagaugcugaugaaauggugcagggucaucagcguguaguuggggcuuggagucuugagccugacagagaaggaagaggggagguccaggcccgagccaggggcagcaguggggagguggguggcuucucucugacagcugucugugauccugguagggagggcucaggccaugcuucaagcucagugaugaggauggaggcuucguuuugguggguugaggaauccguguuuauucaucaugcaccacguaccaggugcugugcuggccccuggcauguuccaguccaugguuaccagugcucugaggagcaguuacccucugcauuucacuguggcuuguguccuguccacagccauguggcucagaggucaccaggcugggcauuaaaauccagcauauguucccaggggcugggcucaggugugucccuucggaaagacagaagcugguugucuggucaaaaagauggccaugccaaccuuggcacacugcagcaugagccugcauggaagcgugugguauaggcucugguggcacagaggagcaccauugugaccugcuggggaggaucacaggaaguagcaucauggagggggcgcuugagcugaacaugacgggagagcaggaagggaagugacuaccccacaggaucuucugugggucaccacguguggcuggaucauggggacaguguggggagcugcagggagcugugggaggggaggccacagcacaggagcaaaggccaggggacaguccgagucccaacccuccccaugcaggggccuguacuguuccuaccagcuggcagggaucccauacugcacuggaggggcaaaugcggacccagggaggcaccgaaggcauggaucauuguguuggcauuucgggaucacaggcccagaggagcuaggggagcuauggcagggggcaauuugcucaugggugaaguacugggguucuugugaggagcagaugagccaggguuuccuccugccgccauggcuuggccugaccccucaacccacagugagcacaagcaugguauacccaugggacagugaaccuggcccgcagagucucaaacagcaucucuccuugacuuuucagaaucgaagaagggagugcugaccugagaaaacgaaugucccgguuagaagaagaacuggaccaggaaaagaaaaaauacaucaugcuggaaauaaagcugcggaacucugaacgggcgcgggaggaugcggagaggaggaaccagcuguugcagagggaaauggaggaguuuuuuucgacccuaggaagcuugacuguuggggcaaaaggugccagggccccaaaguaaaaggaauggcagagcucacuucuguaccacgucugcuggucuccagccuuguauggaguuagaagcgucuguaucucuggagcagccaggcgcucuggagccagcuggagagagagagauccugauaccucuguggggacuguggggacuuuugggaccccacacacuccaggugggaucagaugcugcuccaaccaugcaguuccuggugagggucagaaggggacgguaccaagaguagcgcuuagcccuuacccaggaaauauccuucauggccacagaaauggagggcgcccaggauccaggcagccaccgggaacagucagcuuucuuuauuaaaugugcucacaaagca

SEQ ID NO: 192480 - RNA, 96270 nt, Homo sapiens
acgggcggccggauuugcccggaggccgcacccgccuccggcggggcucucagguaugugcgccgcgggggucccucagggggguuggggguagcccagggaggucggggucgggggcuggccucuguagggcgcucagaggccgaguccccccgagcgccgcgugggugaggcuuggcggucuggucggggaccgggucaugugagucacgggcgccccuccuuuccgcccgcgcgcccucggaacgggcggcccacccuggccuguccucuggcggccucaggccggggccgggcgugcaggggcugacacgugggcaggaaagcgaggcagagccgccgccgcguaaggccgggcugagggcucggcgucaccagccagggcugcagagagcggcguggcacccggaguuggauuaugcguggcuggcgugagcuggaagggagucacucgcccacaagcucucaccacgcgagcuuuuauugucccguucaacugcuccgcaguguggagaucgcauaguuacgcacgucgugguugugucgccccacaguacugacugcuucaccuuugcagacagaggcuccggcccggcgcgguggcucacgccuuuaguccuagcacuuugggaggucgaggcuggaggauggcuugagcccaggaguucgaggcugcagugagcuacgauagcuccacugcaccccagccugggcaacagagggagacccuaucucccucugaaauagucuaaaauaaggaaacuagaaaugcgauaaugcccccaggaaauucuuucucaggaauauauguauuuguuaaaugguucaguauaugauuuauuuuuuauuuuauuuauuuauuugagauggaaucuugcucugucgcccaggcgggaguguaguggcaccaucucggcucacugcagcuuccaccucccuggguucguucuagcgauucuccugccucagccucgggguagcugggauuacaggcccgcgccaccacgcccggcuaauuuuugcauuuuuaguagagacgggguuucgcugugcuggccaggcuggucuccaacgccugaccucaagugauccgcccgccuaggccucccagaaugcugggauuacagacgugagccaccgcgccuggccucaguauaugauuuauaagcuuuaugcuguaugaggguucaguuauguauuuauacauacuugauaggaaaugcuaaaguucacauuccuauggauagcuuuuggugcuuuucaaacuaacgaggcuggcacgguggcucacgccuguaaucccagcacuuugggggccaaagcaggcugaucgcuugaggccaggaguucaagaccagccugggcucgucucuauaaaaagaaaauaaaaaauaaagcucuaaugacagucauuaaaacuagcugccaaacaccacauuacuagcguuagcggucucaguguacuugggugguuuuaaaaugacacccauuggaccugcaaaacgauggugcuucccgauauguucauguuauucaucuuuuagaauauggaagagaaaguucuuaguucucgaaauauuguguaaaauauaaggugacaaccuggaucuguuaaaugacauucaucuaaguguacucucaaagucaaaauuaucuuuucauacagguggaacuuauauuuuaccuuacuugcuaaauaagucauugucauuaauuguauuugcacuguguuuuucagugaaaaauguacucugaccugaauccugaauuuuccuugauggucaaaagauuaagguaucaaauuuccuuuuuucuggauguauuaucguuuuacucucuuacauugcaaucccccacuccugcaaaaaacccacggaguuucagaauaaaaugauuagcaucaguaaacauggaaauauuuuucuuuuuggauuaaauuauuuguuuauguucugaggaaaaaucuuuaaaagcuuaguuuuauuguuuuuguuguucuuuauaaccuuagccuucagaaaaauaaauguuuaacuuugcuucuucugugacuuguucaccugaauucaagaagguggaauugggccuaaggagguggcucacgccuguaaucccagcacuuuaggaggcuaaagugggcggaucacuugaggucaggaguucgagaccagccugggcaacacagugaaaccuugucucuacuaaaaauacaaaaauaagccaagcgugguggggggccuacaaaaauuagccaggcgugguggcggggaggggguugggcagugcuuguaguuccagcuacuugggagaaccacuugaaccagggagagagguugcagugagccgagaucgugccauugcacuccagccugggcaacagagcgagucuucaucucaaaaaaggaaaggcagaauugaagaagcuuuggaagaggugaggaauagagcuguggaaauuacuauuuuuuuuuuaauugagaaucuccuguguguaggugccuuacaaacuggcuucaugaguacccuauaaaacagauguuuuuauuuuuaaaaucaucaugguuuuguuuuguuuuguuuuuuugagacagucuugcucuguugcccaugcuggagugcaguggugcaaucucagcucacugcagccucugccucccagguuccagugauucuccugccucagccucccgagcagcugggauuacaggcgcccgccaccaugccaggcuaauuuuuuuguauuuuuaauagagacgaaguuccacaguguuggccaggcuguucucaaacuccuggccucaaaugaucugcccgccuuggccaccgaaagugcugggauuacagguguugagccacugcaccuggucauuauguuuuaaaauuacauacaaguuguuaaaaaaauaugaacagcagaaauagauuuuagaaaaacagaaugaaauuauccaucucuucccccauuuagugaauauuuggaguauuucuuuucacacuguagguauuauaauuccugauuuauuagaagcagggaguggcugggcgugguggcucauaccuguaaucccagcacuuugggaggcugaggcgggcggaucaccugagguugggaguucgagaccagccugaccaacauggagaaaccccaucuguacuaaaaauacaaaauuagccuggugugauggugaaucccuguaaucccagcuacucaggaggcugaggcaggagaauugcuugaaccugggaggcggagguuucagugagcugagauugcgccauugcacuccagccuggguaacaagaaugaaacuccaucucaaaaaaaaaaaaaaaaacagggagugaggcccacagaaaccaaacaaauuguugaugaucaccaagcuuguaaauaggguaagauucaaaccuguguaucugacuccaaaguuauacuauuuauacuauuccaaggaguauuuuaaguauuuguuccauuuaguuagaaauuauuuacugugauauaaagucuaaugaauuucaacuuuagauuuaugauugcuuuuguaaaauauacagauaauuugcaaaguaagguuuuuuuuuauuuuuauuuuucgagacagggucucacugugucacccaggcuggagugcgguggcacgaucacaguuuaccacagccuggacuuccugggcucaggcaauccucccaccucagccuccugaguagcuaggacuauaggcaccugccgccacucccggcuaacuuuugucuuuuugguagaggugggguuucacuauguugcccaggcuggucucgaacuccugggcucaagcgauaugcccgccucugccucccacagugcugggauuccaagugugagccaccaugccucacacaauaaaguuuaauuauuuguaguaauuucccauucaaacgaagaccaaaauucagcuugaagggaacauucaauagcauuccacaaagucaaaugaguuuucugccuuagaguuuuccuuagcugguuuaaaauuccaggucuguuuuucuugauccauagcaugcuuuuuucucucuuaaaaauauuuuagaagaagauuguuaggauuuagaaaaacauagcauauaaauucuugaaccauucauuuuuaaaaauaauuuaauuugaaagguaaaaauauacuuucuacuuucugucucacuaaaucagucuauucuggacuuuuccuauaaaagauguauguggcccuuugugaccgucuucuuucacuuggcagaguauuuuaaagguuuaugcguguagcauguaucagguacuucauuucuuguuauggcuacauaguuuuuguuguaugacuguaccacauuuuaaaaaucuauucaucauugauggacacuuggauuauuuccacuuuuugacuauucugaaugaugcugcggugaacuuuugugugugcauauguuuucaguucucuugggugcguuuauaccuaggaaugguacuuccauauuuaaauuuuugagguacugccaaacuuuuccacaguggcuacaccauuuuaauucuuaccagcagugaaugaagguuccaauuucucuacuucuucaccaacacuuguuauguguguuuuuuauuauaaucauccuaguggguaugaaguauuuauuugcaguuccuugaugacuaauaaaauuuagcaucuuucaugugcuuauggaccauuuuuaugucuuauuuggagaaaugucuauucagauccuuugcccauuuuuaagucagguugucuuuuauuauugauuuguaagaguuuuuuuuuaauauguucuagauguaaguuccuuaccagauuugaaaauguuuucauccauucuuuagguuauauuuucccauuuuucauagugacuuugaagcacaaaaguuuuuaauuuugaugaaguccaauuuauaaauguuuucuuucgauacuuaugcuuuugguaucauauguaagaaaucauugucuaauuggacuucaugaagauuuacuccuuuguuuucuucuaagaguuucauagguuuagcuuuuacauuuagguuuuuauccauuuuguguuacuuuuuccgagaaaaggauccaguuucauucuuuugcacguggcuauccaguucauuugcucaaaagacuauuucuuucccauugaauugucuucacacucuaugaaaaauaaauugaccuaaaugugaaaguuuauaucuggacgccaguucaguucauccauaugucuauccuuauaucaguauacauugucuugauuacgccaguuuuuuuuuuuuuuucgaaauggagucucacucuguugcccaggcuggagugcaauagcgcgaucuuggcucacugcaaccucugccuuccagguucaagcaauucuccugcuccagccuccugaguagcugggauuacaggugcgugccacuacgcccagcuaauuuuuguauuuucaguagagaugggguuuuaucauguuagucaggcugaucucgaacuccuugacccaggugauccgcccgccucggccucccaaagugcugggauuacaggcaugagccacugugccaggccgauuacucuagcuuuguaguaaauuuugaaauugggaaaugugagucuuccaaauuuuuuuuuuccaagauugguuauucuaucuccauaugaauuaggaucauguuuccaauuucugcaaagaagucagcuggaauuuugauagggauuauguugaaucuguagaucaauuugggaauuagugucauuuuaacaauauuacaucuucugauucauuaacaugggauaucuuucuguauauguaggucuuuuaaaacuucucucaggacuguuuuaucacugucagaggauaaguuuugcacuucuuaaaaccaaguaagcuaaguuagcaauucccaaaaauuauaugagaugguaacucccgaaauucuguggcauaacaagauuauuuccuuaauggcaagcauauucuggccccagaauaauuuagaaucaaguauagaauucaagagaaucaaggcugcagcaguaauacuuugagucuauacccuuguguauauuuggcuuaaauguuuuaggagaauuggccuuugaaaauuuaagauauuuguuauuucaaaauaaaauguguaaucaacuaauacaaagcaaguuuuguacuuuuuguugaauuuauuacuaaguauucuuuuugaugcaauuguaaguagaaauauuuauuuauuaagagauagggucuuacuguguggcccaguauggccuugaacuccugggcuuaagacauccuccugcugcagccuccugaguaacugagauuacaggugugcaccaccucgccuggcucagaaugguuuucuuaacuucauuuuuagauuguucacugugaauauaucgaauuacaauaguuuaggcugggcaugguggcucacgccuguaauccuagcacuuggggaggcugagguggguggauaacuugaggccaggaguuucagaucagccuggccaucacagagaaaccuugucuuuaccaaaaucacaacaaauuaauuagcugguugugguggugcaugcuugcaaucccagcuacuggggaggcugagguacgagaauuaccugaacccaggagguggagguugcagugaaccgagauaguuccacugcacuccagccugggcgacagaacgguuuuuguaugcuucaaccuuacugaacucauuuauucauucugauauuuacuuuaguggauucuguaugauuuucuauaugcaagaugcugucauuugcaaauagagauaguuuuucuuuuuuuguuuccaaucugaauguguuuuauuucauuuucuugccuaaugcuccucauuaguuuucaauguugcauaguauuuuauugcauggacgcaccauaauuacuuuuaccaaucucuuauugauggacaugaagguuauuuccaaacucuugugguuauaacaaugcuguaauagauaaccuauuacaaagaacaguucucaacucuuuuggucuugggacuacuuuaccuauuuauguauaaguuucaaguuugggcuuagaaagaauuuaauaaucaugcuaauuuuguuuuguuuucuuuuuuuuuacuccuggacccaagcggucuucccaccucaaccucccaaguagcugagacuacaagggugaaccaucacccuggguaauuuuuaaauuguuggcugggcacaguggcucacgccuguaauccuagcacuuugggaggcugagacaggcagauuaccugagguugggaguucaagaccagccuggccaacauggugaaacccugucucuacuaaaaacacaaaaaaugagccaggugcaguggugcgugccuguaaucccagcuacucaggaggcugaggcaggagaauugcuugaauucaggagguggauguugcggugagcugagaucgugccacugaacuccagccugggcgacagagcaagauuucauuucaaaaaacaaaaagaaaaaaauuuuuaaaaauuguuuugaagagauacgguuucccuauguugccuaggcuggucucaugcgauucuccugccuuggccucccaaaguguugggauuauagacaugagacaccacaaauuuaaacaaggacuuuuuuuauuuuuuaaagagauuacuuuuucugaguaaacaaggacuuuuaaaacaagguacuaaaaaucuggcugggcgugguggcucgcuccuguaaucccagcacuuugggaggcugaggugggcggaucacgaggucaagagaucaagaccauucuggccaacauagugaaaccccgucucugcuaaaaauacaaaaauuagcuaggugugguggugcacgccuguagucccagcugcucaggaggcuaaggcaggagaaucacuugaacccgggaggcagagguuguagugagccgagaucucaccacugcacuccagccuggcaacagagugagauuccgucucaaaaaaaaaauuuuuuuuaauaaauaaauaaauaaaaaucuugaaauuuuuauuagguccugguguuucuaauuuuaauaugauuuaguucucaagugcuaguuaauacuucauuaaucagccagauggaaguggggauacuauggaaacagcauaggcaaagcuuaaagauaaaugagaccaugguuugaaaauauaggguggcaugcgcuuugguucaaggcaauuugaucaucacaacaauuuggcuuaaacagcacuuugguugaaaaugaauauccccuaguuauguguuuuucaaguauuggucauuuugguauaucaugaguuguuuugcaaacuuuugugccaaaguuuucaggaaaacuuucuaauauuugcuuuuguguuucuaacugauuuucagagaaguuguaauuuugauguuuuuuccuuuuagugagcaugcuuuaacaaaaaacaauaacagaaacugugucaaagaaaaggaccuguaaucuucaggguuuguagucuuuuuccucuuaaaaaacccuuuuccuaauuaauggcaguuacaucugcauggcugguuuggguaagucuucauuuuguuguauugcugaguaacagucaacaaagguuuaucaacucuugguuaaggguuccuuucauguugugaguaaacaugaacaauauaggaucuuauccuuuuaagcuaucaugcaagaaacaugugaggucucuuaaaaauucacugugcuggccgggcaugguggcucacgcuuguaauccuagcacuuugggaggcugagguggguggaucacuugaggucaggaguucaagaccagccuggccaacauggugaaaccccgucucuacaaaaauacaaaaaucagccgggcaugauggcgggcaggugcuuguaaucccagcuacuugggaggcugagacaggagacucgcuugaacccgggaggcggagguuguagugagccgagauugugccacugcacuccagccuggaugacagagcaagacuccaucucaaaaaagaaaaaaaaaaaaaaauugugcuggcugggcucaguggcucacaccuguaaucccagcacuuugggaggccgaggcggguggaucaccugaggucaggaguucaagaccagccuggccaacauggugaaaccccaucucuacaaaaauacaaaaauuagccaggcauaauggcgagugccuguaauccaagcuacuugggaggcugaggcaggagaaucgcuugaacccgggagugagccgagauggcgccacugcacucuagcuugggugacaacagcaagauucugucucagaaaaaaaaaaaaaauuaacugugcuuauaaaugggagcuaaauuaggaaaaaaauaaaaaguaaaaagaaaaugaaaauaaaaauuuaaaaaauauauuaacaaauuaacuguacuaagguaggauucuuuuuuuuuuucuugagacggagucuugcucugucgcccaggcuggagaggaguggcacaaucucggcucgcugcaaccuccacuucccggguucaagugauucuccugcuucagccucccgaguagcugggauuacaggugccugccaccacgcccgccuaauuuuuguacuuucaguagagaugagguuucaccauguuggccaggcugcucuugaacuccugaccuugugauccgccugccuccgccucccaguguugggauuauaggugugagccaccacacccagccacuaagguaggauucugaucucaccuguauguuauuuauuaugccucucuuaaucuuuauuuuaaaauagaggucagguuuuuuguuuucuuuauauauaaaguauggcacauucaguuguucaucauucaagaugccuugccauucagcucuguuuaaugauguggaccacccucuagaaaagaaaaucuuuauccuaucuugagcauuuugguuuugaaaguuuuagaucaauuguaauuucgguaugguguuagaggauaauaagaagggaaguguaagguaaaaauuggggcacaucuauaaugcuguuaaaaacagacauaacugaaaaauacaccagagaagcaaaaaguaccuucuccuugaccauucuagagguguugcagaagaaacagacuuuaggugaagcauauaugugaguauaauuauguugcgcuugcuucuuaaugaaagacaugucaaugaaggacuaggcacaagguagagacgcugauaauguugagucagcucaggaaauuggaccugaaguaagaagauagagauuccuuaggaugccuugacccucgaguagcaauauccaaauaaaaauggcuuaaaggaaagccauaaaccaagauaacauuaucuaacaagaagucugaaggcagggcuuuuccauugacaguccaaggacucaaugauaccaucagauaccuacucugcucuucucucuguuacacauucagccaguuugugauaucuuuccuaaggguuuuaaaagggcuucagcaguuccagaggucacauguagccauaacuaaguucuauggagaaacagcaguuuccuccugugcauaucccgguauuagugaagaaaccuuuuccaaaggccugccagcuaccuucaacucucuuagaccccaguagcuaggauuggguugguuacaugccacgcccuggcuguaagggaggcuacaaggaagacuuacuggcacuuuuuggccucugaaguacaggcagacugugccagccaggaagaaagguagaaaaggaauaauugguuuuguuuguuuguuuguuuugagacggagucuugcucuuguugcccaggcuggagugcaguggugggaucucggcucacuggaaccuccgccuccuggguucaagugauucuccugccucagccuccccaguagcugggauuacaggcaccugcuaccauggcugacuaauuuuuuguauuuuuaguagagacgggguuucaccauguuggccaggcuggucuugaacuccugaucucaggugauccacccgccucagccucccaaaguguugggauuauaggcaugagccacuguucccggccagaaggaauaauuguuagacaacucacagugucugccauauuugccacagaaaauaacugacuugcucucugcugucuuacugugauaauauauuuuuuuaacgcaauuuacaaaagggggggaacauucuuaaauuugaaacuaggaauuaugauauuugcaguuucauauuguauacaguaaacagucuucaaauucuaguucuccuugagaucuuauacaaugauaacaguuuuaaaauuaugccuucuguuuuuugaacagcuuuuuacuauugacagcuuuuaaggaaguaguuuucauguugucguguuuacucucuuacuagacaggaagacagaacagaaauccauccucaacuucuggggauaaucugaggauuauaaugaaauaucagaugcuuaaaugauuucaacagacuuuuagaugaaguugccauuagcaccuuguuaucaucaauguaacacauaggcaaguggauuaaaauaagagggcuaaacuggccuuuauguugaaauuagaaguuucguuguccuacaggcagaaaugacaguuucauuggauucucuauguuauaguaauauaucagaaggauagcuugagaugagacuauuuugaagauacaugggguggauauucaaagugccuuuuacauaguuacuguccuccacaguuuccccauuaaauguggaauccuugugauugcauucuuggagggccaucgaaaacuagugaagcacagagagacuauuuuuuuucuauagauauuaaucuaaagcaauaauuggcaaaaaaaaaaaaaagagauuuaaaauguaggauaaaggccaggugcaguggcucaugccuguauucccagcacuuugggaggcugaggcagguggaucaccagaggucagaaguucaggacuagucuggccaacauggugaaacuccaucucugcuaaaacuacaaaaacuuagcugggcgugguagugcgcccuuguaaucccagcuacuggggaggcugaggcaggagaauugcuugaaccugggaggcagagguugcagugagccgaggucuugccacugcacuccagccugggcaacaagagggaaacuccuucucaaaaaaaagaaaagaaaaaagaaaauaauauggugcugugcuaugggauaauggggaauaccuacuuuauauaggguguucagagaaggccuugaaaagaagaaacauuuaaacugaaauuaaaggcugaguugaagcaaccuauuaaagagcugugggaaaggcauccuaagugaaggaaauggcguguggaaaaacugugauacagaaaagaccuugacauguuuuaggaauggacagaaauccagugugacugugguuguccuaguggagaauguugugauuuuggacagguggauaagcagucagaucauauaggcaagugcuuuacauuuuuaccuuuugugcaguggaaaacccaauuggaaguauaguaggcauaaauuuuguagacuacauacuuaaauauacaaagauguaauuuucuuucuuucuuucuuuuuuuuuuauuuuuagagaugacuuuuuguuuguuuguuuuuuguuuuuugaggcagucucacucugucaccaggcuggagugcaguggugcaaucucagcucauggcaaccucugcuuccugguuucaagcaguucucgugccucagccucccaaguagcuggaauugcagguacacaucaucacaccuggcuaauuuuuguuuuuugcuuuuuugagacggaguuucgcucuuguuauccaggagugcaauggcgugaucuuggcucacugcaaccuucaccucccagguucaagugauucuccucccucagccucccaaguagcugggauuacaggcaugcgucaccacaccaggccaauuuuguguuuuuaguagaggcgagguuucuccauguuggucaggcuggucucgaacuccggaccucaggugauccgcccuccuuggccucccaaagugcuaggauuacaggcgugagccacugcguucagccuaauuuuuguauuuuuuaguggagacgggauuuugcuguguuggccaggcuggucuugaaccccuaaccucaagugauccaccgccccuuggccuaccaaagugcugggauuacaggcuugagccaccaugcccagccuagagaugaggucuugcuauguugcccaggcugaucuccaacuccugggcugaagugacucucccaccccggccuuuuaaaguacugggauuacaggugugagccauugugcuuggccaacuucauuucuaaauaacuaaaauuuccuuagcucuguuucuacuagguaauagagaacaauccugcuaaacaaucuugccacuuuaggauaaaaagucaguagcuucuggcuuaacuaaauuaauuacauguuaaucuaaacccuugguaaauacuugguccuuuugguaaauguucaguuuccucacagagcccaccccuucccuuuuuuucccuaugguagaugguauugguagagaaaucuuauaauuuuuccuggcauuaagggagagucaucuuaucuuugugcuguccucuguccuucugagccauugcaaaugacuggcuuggucuugaaugggauugucugccucugccacuucugaggaugaugucccugcuacuacuguagccccugggcaacacaucugugcaugcuggguccuccuuaaucccaggcuguuuuggguauacuggcccaguggugagugcugauaugcuugggacccuaauaaagcagcuuuucaggaauaugguuugggcaugucauuggcuauuaugccuuuagcaaggcaugauauuguauuaggugcaagguuuuacuaaauggcuacagucccuggaccauaacuugggaaagggaaacacaauuauuucccauucuggguccuuccccacaaacacuggagauuuuucuuacccuuccgcaaauaagauuuuuuuuuuuuuuuugagacaguuucauucuuguugcucaggcuggagugcaauggcucgaucucggcucacugcagccucugccuccuagauucaagcgauucuccugccucagccucccgaguagcugggauuauaggcgcuucuaccacacccagcuaauuuuuuguguuuuugguagagacaguguuucgccauguuggccaggcuggucucgaacuccuggccucaggucauccacccuccccggccucccagagugcugggauuacaggcgugagccaccucaccuggccccucaaauaagauuuagcuccagauaggacaggaggcaaaaauucuaaauuuacauccacucuuucuuuuaacucuuguuuuucuuugaacucuucccccaaguuuuuaugucaucuugaucagugugagagaacuguacuuaugucaucaccugccuuuccucugugcuggagucuacaugacaaauucugccaugaaaguuuucuugauuugguuggugauaguuaaaaucacaguuuuagaauuuaaaaagcugucuuggccgggugcagugguaugguucugaggauuaauuuuauauacacacauauaaacacucacacacacauuugaguucaaaauguauguuacuacauuuuacaaaggaauaagugauuucauagauucuguaucaauauuaaaucuuggcugggugcagagccucaugccuguaaucccagcacuuugggaggcugacacaguuaagaucacuugagcccagaaguuugagaccagccuaggcaacauagugagacccugucucuacaaaaaauacaaaaauuagcugagcauguuggcacacaccuguagucccagcuacucaggagacugaggugggaggaucgcaugagcccaggagguugaggcugcagugagcuaugauucuaccacugcacuccagccugggcaacaagagagagacccugucucucaaaauaaguaaauaaauaaauaaaaaguucucuuuuggccaggcacaauggcucaugccuguaaucccagcacuuugggaggccgaggcgggcggaucacaaggucaagaguucgagaucagccuagccaacagggaaaccccaucucuacucaaaauacaaaaaauuagccggaagugguggcgggugucuguaauaccagcuacucaggaggcugaggcaggagaaucacuugaacccgggaggcagagguugcagugagcugagauugcaccauugcacuccagccugggugaugaugugagacuccaucucaaaaaaaaaaaaaaaaagcucucuuuucucuuaagccuguaggucuuaugauugaaauucuuagcuuucaagaauuaucauuuuaauggaucaaagaccuaaauauaagaacugaaacuauaaaacgcuuagaaggaaauguagguuuaaauauucaugaacuuggaucaggcagguuucuuaaauaugacuccaaaagugcaaaagaacaaauagauaaauuggacuuuauuaaaauuaauuuuuuuuuuuuggugagauggaguuuugcucuguugcccaggcuggagucaguggugccaucuugguucacugcaaccucugccucccggguucaagcgauucuccugccucagucucccaaguagcugggacuacaggcgcgcaccaccacgccuggcuaauuuuuguauuauuagaagagaugggguuucaccauauuggccaggcuggucucgaacuccugaccucgugaucugcccacuguggccucccaacgugcugggauuacaggcaucagccacugcgccuggcccuuaaaauuaaaaauuuuuuuaaaguuuuuauuuuuuugagacagggucucaucauguugcccaggcuggaguacaguggcgccaucauggcucacugcaguuucaaccucucuagacucaagcgguccucccaccucagccuucugaguagcugggacuguaggcaugugccaccacaucccaguaaguuuuguauuuuuuguauuauagaaaugggggccaggcacagugcucacuccuguaaucccaacacuuugggaggccgaaguagacggaucacuugaggucaggaguucgagaccagucuggccaacauggugaaacccccucucuacuacaaauacaaaaauuagcugggcaugguggcacgcgccuguaaucucaacuacuugagaggcugaggcacgagaaucucuugaguccgggagguggagguugcagugagcugagaccaugccacugcaccccagccugguugacagggcaagagucugucucaaaaaaaaaaaaaaaaaaaaagaagugggguuucaccauguugccuagacuggucuugaauuccugggcucaagcaaccugccugcuuuggccucccaaagugcugggauuacaggugugagccacugcaccuggccaaaauuaaaaacuucuauguuucaaaggacaucauuaagaaagugaaaagacaaccuacagaacgggauuaaauauuugcaaauuguguaucuguuaagggucuaguauuuagaauauguaaagaacuaucacagcuccauaagaaaaaagcaaauaauccaauugaaacaaugggcaggccaggugcgguagcucacgccuguaaucccagcacuuugggaggccaaggugggcggaucacgaggucaggagaucgagaccauccuggcuaacauggugaaaccccgucucuacuaaaaauagaaaaaaauuagcuggguguaguggcgggugccuguagucccagcuacucgggaggcugaggcaggagaaugguuugaacccaggaggcugcaguugcagugaauggagauugcaccacugcacuccagccugggcgacagagcgagacuccgucucaaaaaaaaaaaaaagggcaaagaauuugaagagauaugucuccaaagaaaaugugcaaauggccaaauaaacacaugaaauaaacacaugaaaagguguugaaaucauuauucauuagggaaaugcaaauaaaaaucacagugaggccagguguaguggcucauugccuauaaucccagcacuuugagagacuaagucaggaagaucacuugagcccagaaguuagagaccagccugggcaacauagggagauaggcguggugguuugugccuguaguuccagcuagucgagaagcugaggugggaggaucugcuugagccugugccgucgaggcugcagugagcagugauggugccacugcacuccagccugggcggcagagcaagacccugucucuaaaauaauaaaugauaauaauaauaauaauagagauaccaauucacacccacuagaaugacuauaauaacuuaaaucucaaaaaaaaaaaaaacccaaaaaacaaaaccccaacaacuguuggugaggauguggagaaaugggaacccuuauaggguuccuuacugauagggauguaaaaugauacagauacuaugggaaacagucuggcaguuccucaaaaaguuaaacauacaguugccauaugacacagcaguuccauuccuaggucaucccaagagaaaugacuacauauguccauacaaauacuuguacaugaguguuaauagcagcaauauucauaauuguaaaagagugggaacaaccuaaauguagaucagcugaugaauggauaaacaauaugugguccagccgggugugguggcucacaccugaaaucccagcacuuugggaggccgaggcagguggaucaccugagguuggaaguagaagaccaccugaccaacauggagaaaccccaucucuacuaaaaauacaaaauuagccgaacaugguggcucaugccuguaauuccagcuacuugggaggcugaggcaggagaaucgcuugaaccugggagguagagguugcagugagccgagaucaugccauugcacuccaaccuggucaauaagagcgaaacuuugucucaaaaaacaaaacaaaacaaaaacaaaaaccaguaugugguccauccauacaauucagccacaagaaggagugaaguacagauucaugcugcaacauggauaaaccuuaaaaacauuaugcugagugaaagaagccacgaaagaucacauauuguaugaucccacuuauaugaaauguuuagaacaggaaauccauagagauagaaaagagauaaaugguuucuaggagauggggagggaggcaauugggaaugacuguuaauagguaugggguucuuuuuaggugauagaaauguucuggaauuaguguagaugguugcaaaaugugaauacacuaaaacuacugaauuguauacuuugaaaugguaaauuguaugcuaugucaauuaaaaaaaaguauaggccaagugcaguggcugaagccuguaaucccaggcuuugggaggccgaggcgaguggaucacuugaggccaggaguucgagaacagccuggccaacauggugaaaacccaucucuauuaaaaaaacaaaaacuggcugggcguguugguacaugccugucaucccagcuacuggggaggcugaggcacaagaauuauuugaauccaggagguggagguugcagugagccaagaucacaccacugcccuccagcauggucaacagaacgagacugucuugaaaaaaaaaaagauaaauuaugguauuugcuuuggaauuaaauaauuaguaacuuuuaguaagguuugguaaagguuuaguaaccuuuaguuaacccaguuaacuucugugucuuauauuugucuuuguacugaaguaguugaaugccacugacccacagaaugaguugccagagaacuggagcaacauucuguuugugggaaagagaauacucuguuacuaccuuaauauuagauucccagcauaucaauugaaggguuuuaaauagugagugauguguuucaauuuauauuuauauuauauuuacacuugaucuuagccaaaaggcugagaaagcgauuuuauauuauauuuauaaagaucacuuuagcuuucuccuggagacuggauugguagggacaaggugacauuggugaacuugguuagaaagucagucaagcccgugugcaguggcucacgccuauaaucccagcacuuugggaggccaaggcagguagaucaucugagguuaggaguucgagaccagccuggccaacauggugaaaccccuuaucuacuaaaaauacaaagauuagccaggcauggucgugggugccuguaaucccagcuacucaggagauugaggcaggagaaucacuugaacucgggagguggagguugcagugagccgagauugcgccacugcacuccagccugggcgacagagcaagacucagucucaaaaaaacaaaaacaaacaaacaaaaaaccagucaguacucuagggaagaaauaacaauagcuauauuaugacauaguagugaguugaagauaacugaauagccaaaauauauuuuggagauaguuugauaugagaggugaggaaaaguaaguagucauguguggcucuuuguuucuggcuuuaauaacuccaguaguucuggaagagacuuagugggaaacauuuuggauaaacugaguuuguccaaaugggguugccaaguggagaguugaguaaaugaagcuagagcucaggaaagauguggaccagaguuauaagucauauuuauuuauuuauuuauuuugagacagagucgugcucugucgcccaggcuggagugcaguggugcgaucuuggcucacugcaaccuccgccuccggggucaagugauucuccuaccucagccuccagaguagcugguauuacaggcacgggccaccaugcccagcuaauuuuuguauuuuuaguagagacggggguuucaccaugcuggccaggcuggucucgaacucccgaccuuaggugauccuccugccucggccucccaaaguguuuggauuacaggugugagcuacugagcccagcauaagucauauuuaaaacaaugggaauggguaggaacaccuagagauagagugugggaaauagaauaggguccaguauacagcugugccaaauuucacauguacagguuagauaguggagugggucaguucuguugggaaugcccugaaaguuugaauaaugauaagcacguccuuuuaacaucaugagguaguggugacguuguaagaggaguuucaguguaguggguugucauggguuaaaacguucagauugucauggguuaaaacgugaauuggauaugaggaaguggagugcacaaagauaguuuucugaaaguuuuacuuggaagaggacaaaaaauugagacgacaguuugaggaggaugaaaggucaagaauucuaagcuagugauaaaaauuucgucaacaucaaugaauagguaauguaaacacauuaauccugggauggaugugagaagagcaaagaaaggaauccugggggaauaucagcucuaaagguugaguagagaaggaaggagugaucugagagguggaaggaggaguaggaauuaucauagaaacuuuaagcuucuugagggcuugugacugugucauguucaucauuuuaucugaaguucuuaucaacaaaguagcuuucaguaaauauuuauuaaaugaagauaaaaauuuuaagagccaucugcaaugucaaauguagcccacaguugaaugaauaugaggacagggaagugucccuugauuuugguguuaagcagcugauugccaccuucuguagaacagcuucaguggagucuccauaauagaaauaaaugccagguugcugaggacuaagcguggauauuuguugagaguggagacaguaagugcaaacauucuuuucagaaagcuuugcucuuuuugaagcuuugcucauagggagauacaagauaguagguagaggggcaggcuguguuuagaugagagagacuucagcauguuuauaugcuaaauggaaaaaggaaaaaggaagggagaaguugaagauguagaauaaaggaggugugugugaaugauuguacauugucuuugagguuagugggaauggagugaagauacuggguugcaguacagaugagaauacaguuuccacugaaguaggaauaaaggaacaauagauggugcagauggggaaguguuuggguggcaggugagaauucgggauaugaacacuuuauuuuuuucagugaaggggggauaaggucauccacugagauaguggggaggaaaugaugauuguaggggacugaggagaaaaggagaauuucaagaaagccucugagggaggugagagggcaagcugagugggaauacuuagaaaaaauggaaucauggauuuuucacggcugugguauauauauuuguaugaaugaucuccuccuucucucagggcucagcagccugggugaacacacaauugaacaguuggauugaucuuggccuggauuuuaugugucagugugacagagaggguaaggaggcaagauauuucaguagcgagaguguuugaaguggugggccauugagucuaggcugaauagggaacaaaugaaaccagaagguggcugcugggacaugaagugguugguguucaagacuggauaguggaauugaagauugaacgggaggagcaguugcugguuaugacagaguacaggauccagcuauggaguggguuuaugaaguagagacaacguucccaagucuuuagugaacaucagagagugucaucuguuagaacuuuagcugcggccgggcaagguggcucaugccuguaaucccagcacuuugggaggccgaggugggcggaucaccugaggucgggaguuugagaccagccugaccaacauugagaaaccccaucccuauuaaaaauacaaaauuagcugggcgugguggugcaugccuguaaucccagcuacucgggaggcugaggcaggagaauagcuugaaccugggagguggaaguuucggugagccgagauugcaccauugcacuccagccugggcaacgagugaaacucagucuuaaacaaaaaagaacuuuugcucaaaggcaggugguagcagauaagagauaaggaaaauuuagugaagaaaaauucaguuuuuaaaaacguuuuaggcugggcgugguggcucacgccuauaaucccagcacuuugggaggccgaggugggcagcuggcuugagcccaggaguuugaaaccagccugggcaacauggcaaaaccuuguuucuacaaaaaauacaaaaaauuagucagguaugguggcaugcaccuguagucccagcuacuugagaggcugaggugggaggaucucuugagcccaggaaguugaggcugcagugagcugugauugugccacugcgcuccaaccugggcaacagagggaaacccugucucaaaaaaccccaaaaaacaaaaaacagcauuuuauuuuggugauggaauucucuauuguuucgaagaguuuuguuuguuuuaaagacauuaaccaguuuucucgagggauauucuaugaaaaaguggguuccaucauccaauaaguuugagaaacugcaaacucuaucccauugguaauucacaaugaaccucaacuuagauuaauaaaggcucugggaaaugauguuacuauuaaugauuuaaccuuuauugagcacugucuaaggcucuguucuaaggcucccacgugcauuauuguuuccagucuuuacagcaacuaucucauuuaaguuacacugcuaagcuagaauggaagagcugggauucaaauccagaaagacuugcuccauaggguucucaagccuauaaccaguauggaaacaggcuugacauuaaauccagcauuuccccaucuuguuugguuauggaaccuuauuaucuuuuaguauuuauagagagauuagucaguuguccacggcauggacccugggaaguguugccugagucaguuuacacuggugacugcagucuuuuaaacagcauuguuucagacuauaacuaguuuuuucuaacuugguucucuguugauaauacuuaaauguuauauuuauuuuucuauuugagagccuuauauuuugacuucaaggcauuuucuauucccuuucacaaugaccuucccaggaaucaaagauauugucaccaccacacauuacauuugaguuacuaaaacaguuuauaauccaaauagcuauuucacuuucuuuucucuggucuaagauuaucucauuguaauuuguuuuuuaaauuuagagacagggucuugcuauguuguccaggccagucucaaacuccugaguagcugaaaauauaggcaugugucaccucaaccaguuuauuguaaaauuuuaauguuuagagaucuuggagaucaucuuuuauuuuuaacaguauuuauuuaguuuugcagguagagaaaaugacagcuguguagugcuguggaaauuauaauaauucauauccaagcuugaaugucagcuccaccucuuuacuauagcuguggccuuagaaaaccuacuucauuucuugaaacuuguuucuuccucuaaaaagaugaggauaauaucuugcaggguggcuaugaaaauuaagacaguucauacaguaucuggcacauggaaaguucucaauguuaauuacccauuuuuuucuguuuaaggaaauagucucaauccuauaccaugaaugaauuaugaaaauaguuggaaaggaaacaacaguuuuaaauguaaacugucucagucuuaugcugacaucagcuacauuucugguaaagugauggugucaugauacagguuauauuaagaguuaaaaccaguuuccuucuggcuuuccaacugacauaauaagcaaaaccugccugggcaaacauagaccuauuuauuggcucacuuauuauuaauguuaaacuagcuuuggugcugacuucuguucuuguuuuaaaauuucacuguugucauuuaaaaucugacagaccuucagaagcuucauagaaugcuuaaugguuuaaaucgucucuagaacaugugaaguaucuuuuccaaagugguuuucuccaucugucaguauguucaaaaucauguguauagggccgggcgccgguggcucacgccuguaaucccagcacuuuggaggcugaggcggguggaucacgagaucaagagaucgagaccauccuggcuaacauggagaaaccccgucucuacuaaaaauauaaaaauuagcuagccaugguggcgcgcaccuguagucccaacuacucggguagucccaacuacucggaaggcugaggcaggagaaucacuugaacccgggaggcggagguugcagugagccaagaucgcgccacugcacuccagccugggcaacagugcaagacucugucucaaaaaaaaaaaaaaaaaucauguauauaggacagaauugcuuauauuuucacaauuacuacuggaugccuguuugguuuucauagcaaucaacuuuuggaguuuaugggcaguacuuaacauauauaaccuaaguguggauaauuauuuaaaauaaggcuacuggaagaaaaaucuauagggauuucucaguuuucacaacagcauccugagcaaagaaaaaauagguugguuugaguuguaugugaugagauuucuaauauucuauucgaaaugcccccuaguaagcacuagugauagguauuaaugagcugaauuugauuucuaguuccaacucugucccuugcaacuucgguaaccuugaagguuugucuacguuucaguuucuucauauguaaaagagauuaccaauauuucccucccaaggcugcuguaacagugaaguguugagguauuuauuuauuuauuuauuuauuuauuuauuuuuuugagacagagucuugcucuaucgcccaggcuggagugcaguggcaugaucucggcucacugcaagcuccgccucccagguucaugccauucuccugccucagccucccgaguagcugggaauacaggugcccgccaccacgcccggcugauuuuuucuauuuuuaguagagacaggguuucaccguguuagcuaggauggucucgaucuccugaccucgugaucugcccgccucggccucccaaagugcugggauuacaggcgugaaccaccgcgcccggccguguugaaguuuuuaauauagccagcacagcauguggcacauaguaggcacacagccauugcauguuucuuccagacaucucacugcauuuuucaguaauauucuuuucaaguacguucuucuuucucauuccuuaacauuuaaaagcuguauugaagagagaauauuaauguuugcgaaguaaacugaaaauauuuccuuugcagcccacacuugaguguuuuaggccgggugcgguggcucacgccuguaaucccagcacuuugggaggccgaggugggcggaucaccugaggucaggaguucgagaccagccucaauauggagaaacccugucucuacuaaaaauacaaaauuagcugggugugguggugcauaccuguaaucccagcuacuugggaggcugaggcaggagaauugcuugaacccgggaggcagagguugcggugagccgacauugcgccauugcacuccagccugggcaacaagagcgaaacucugucucaaaaaaaaaagaguguuuuagcaaaaaaugauuuuauguaugacauaccuugguuuaaauccuggcuuuuuaauuuuaauuuuuuauuuuuugagacagggucuuacucuguggcccaggcuggggugcagugaugugaucucugcucacugcaaccuccgccucccaggcucaggugauucucccaccugagccaccugaguagcugggaguagaggugugcuccacuaugccuagcuaauuuuucuauuuuuaguagagacagaguuucaccauguugcccaggcuggucucaaacuccugggcuuaagugauccaccagccucggccucacaguguugggauuacaggugagagccaccaagcccggccugaauccuggcuuuugaauguaauaguguugugaccuuaggcaagcugcuuaaccuauccauaaauauuaugaggcuaaagugaguaauaguauguguaaaacaucuaguucauugucugguuuguauauuuccaaaauaaauguuauuauuuuaaguggaaacuguuguuuaauuugauaauucauauaauucauggcuuuugagagccugcucuacucaaagcccguuaagagcaggcaggaacauugugaacgaauguugggcauauuauuaugcaagugacugaauuuggcuuugccuguaaucagguucagcaaaagugguauuuucuuucuuucuuuuuuuuuuuuuuuuuuaauugagauagucucguccugauggccagacuggaguacaguggugugaucucggcucacugcauccuccgccuccuagguucaagcgauucuuccaccucagccucccaaguagcugggaucacagguauaugucaccaugccuggcuaauuuuuguauuuuuuguagagaugggguuucgccauguuggccaggcuggucuugaacuccugaccuacagugauccgccugccuuggucucccaaaguucugggauuacaggcgugagccacugaaccuggccaaaagugguauuuucuauugcauuugagguaacagaaauugaugggcuuguuauugcauuuggcguggcugguuuuuuuuuuccauguugucuuucuccacugacugucaaaaaaaaaaaaaaaaaaaaaggcuacauucaugagugccacaagagagauucaugauucccaagugcuacagcagaccaagguaucuaaaaaguuuuucaucuuuugcugaucuuguuuauuagaaauaaauauguuacucuccuguauuaaaauuuaacacaauauuggcaagcuaaauuuaaucaaauauucugcccauuuuaaaauucacuuccuagccuguccauccuuccuuuuauuuuguuguuguuugauuuuguuuuauuguaugcuuuuagcagccugaagccaugguuuuuaguuucugucuguagugauaaguggaaaggagggaugaggaaggggcuuuacuggcccaaccagaaauagaaacuaagaacccaggacuguauuaucucccuuggacacccaacacuauauaaaauugauuccugcccuggcagacuaagcguuggaaagcuggugcuaagaguguuaugagaauuccuaauaaauagaaaagcucaaggauugacacuauaguaaaagauuucauuuugacauguuuauaauuuacuuaucaaguuaacaauaagguguuuuuauuuauuuauuuuuguuuauuuuuauuuuauuuuuugagacggagucucgcucugucgcccaggcuggagugcaguggcuugaucuuggcucacugcaagcugugccucccggguucacgccauucuccugccucagccucccgaguagcugggacuacaggcaccugccaccacgcucggcuaauuuuuuauauuuuuaguaaagaugggguuucaccauguuggccaggauggucucaaacuccugaacuugugauccacccgccuuggccucccaaagugcugggauuacaggcaugagccacugcaccuggccuuuuuuugguauuuuuaguagagacggaguuucaccauguuggcuaggcuggucucgaacuccugaccucaaggccugccuuggccucccaaaaugcugagauuacaggcaugagucccaauaagauuuuuaaagggauaccaaaauaaucaacauuuauuuuagaaggugacuuucuucaaugagaugucaaugucuacuuucuguuauauagugcuauuguuucuuuuuucuuuuuuuucuaagugagggucucacucuaucacccaggcuggaguacaguggcaugaucucgggucacugcaaccuucaccucccagguucaagcaauucuuucaccucagccuccaggguagcuggaacuacaggugugcaugccucgcuaaguuuugcauuuuuagcaguuguuggccaggcugguguacuguuucuuuuauugauugaguucuauauuuacacagcaugaaagucucaguugcauuaaguacauucgcauuguuaugcaaccaucaccauuaucuaguuccagaguuuugcugucacccuaauagagcuuguauauaugucuccaccaaaucuuauguugaauuguaauucccaguguuugagguggggucuguugagagguguuugggucaugaggcagaucccucauggcauaguguuguccucgcaguagugagugaguucucacgaucuccuuacuccauccaccugcuucuccuaaaacuuugaaauaugcuuggaauugaaaguguuuaguuugaggauaguuaucuaaaagugacauacagggcuccugcuuugcucuuccuuaguaaauuuccuauuuuauuacacaguuuacuaauacagaggacuagaguuuuguuauuuccauggaaaacauuauugaaucuaaauuuaacuagagauguguaguucagggagggagagugguuuuauaauaugaaucuuggauuugaaaugaacuuaaagcaaaugaauaaaaauuguuucauuaauuauaaugucugaaauaaugcauguuuuugugaauaaaaauugauauaauaaaguuuaaagugacaggaguagauauaacuaauuguauuuauaauuucuuggauguaaaauaacauuuuugaaaaauauuauacaaugaccucacauacagugaccucacuuaaucuaugugaggcuauacacaguggcucaugccuguaaucccagcacuuugggaggcugaggcaggugauugcuugagcccaggggcuuaagaccagccugggaaacauggugagacccugucucuacaaaaaauacaaaaaucagcugggcauggugaggcgcaccuuuggucccaacuacuugggaugcugaggcaggaggaucacuugagcccaggagguugaggcugcagugagcugugaucgcaccacugcacuccagccuggguaacagaaugagacccuaucucaaaaaaaagaaaaaagucuauguggaagauaccacguuaauuguuuugggugguuuagagauguuucugucuccuucacugaugaccaugugucucugcugcugucgcucacuggugauuaucaacucaacuucuuacauuuguuuuaacaaauauuuauacacccuuuguaaauuugcaugagauaaagucauuauaguuaaaaaaauuguuuuuuuuuuuuuuuuugagacagaaucuugcuccauugacuaggcugagugcaaugacaucaucauggcucacggcagccugaaccuccugggcucaauugauccuccuaccucagccuccugaguagcugaaacuacaggugcaugccacuaugcccagcuuguuuuuuauuuuuuguagagacagggucucacuauguuggcaggcuggucucuaacuccuggguucaggugauccuccugccucggccucccaaaguguuaggauuucaggugugagccaccaugccuguccuaugaagucauuacaaagaaauuaaauuaauugguuucauuggcaguauugaauuucaaagcagaaggggugcuuaagagaaauaaugccuuuggaguaauuucugaugcuagaugaaacucauaucucauuuaagguguccaucugaauuuuauguuuggaugauuaugaauuauuccuuaaagcuugaagugaacucuggcucucuaggacaaauuaaucuuuauuccuuuaaucuuuauucccuuagguauauauuaaagggaucaaauuuuuuuuuagaguaauguaaaauuaagggacuucuuuuguuaggugaauuucucagguuuuaagauaucaguaucauuguggacauugacuacauugucuacuaaauucuguaauuuuaacuuauaauucucaguaauuggcugggugugguggcugacgccuguaauccuagcacucugggaggccaaggcggcagaucaccugaggucaggaguuggagaccagccuggccaacagggugaaaccccgucucuacugaaaauacaaaaaaaugagccgggcgugguggcgggugccugucaucccagcuacuggggaggcugaggcaggagaauugcuugaacccaagagguggagguugcagugaguugagaaugcgccauugcacuccagccugggugacaagagugaaacuccauuucaaaaauaaauaaauaaacaauaaaaauaaaaauacaaaaauuagcugggcgugguggcgggugccuguaaucccaacuacucgggaggcugaggcaggagaaucgcuugaacccgggaggcggagguugcaaugagccgagaucacgccacugcacuccagccugggcuacaagagugagacucugucucaaaauaauaauaauaauaauucucaguaauuuuugcaauuuuuuugguaccuaaaauaauuucuguuauuguguuggauaacuuugucaacuucacuuugggaauaucuaaauauagguagcugcauucgagccagaggaauauuggguuuuuuuguuguugcuuauuuuugaggcagccuuacuuugucacccagacuggaguacauuggcacaaucauggcucacugcagccuugaccuucugggcucgugugguccucccaacccagccucccaaguaguugggacuaaaggugugcaccaccaugccuggcuaauuuuuaaauuuuuuuguagggauggaauuuugcuaugucaccuaggcugguuucgaacuccuaggcucaagcaguccucccaccuuggccucccaaagugcugggauuacagguaugagccaccacacccaguugagcaauacuggguuuuaaucaagauuauugucugaauauugagucuuaaugacuuuuuugauuuuguuuuuuuggccauaguauuaaguuugcaguugauaaccuucuguacuaacuagaaguaguauagaaacugcaaauuaaaaaaaaaccccagguaaaauguugauggcugcuauuuuuauuuaagguauuaguaaaggaaaagaagucagggacauuauggaggucaaguuuuauauuauuaaaacucaacuucaugauuuauacauacuuagaaauagucugagugaugugugaccaaaauaugauuucuaggaggaaugauuguuacauccguggaauagcugcguacacuuuauuguucuuggugcuuaaacuuuaguuguccugcuaagauaaaggaagacauucuuucaguuggaaaucauaauguauuucuccauugaaacaguaugguuugaacagugcuauauauucuuacucauuauuauuccuuaaaugaauauuuuaagcuccugauagaaggcagguacuguguuauaugcuguugguguuaccagaauacaaagaugaagagaacaaaguauuacacaauuccuaaucucacauaaaugcuauuuuuuuuacuagcuguggggagcacaaaauaagugguugaaagucaucugacacaguuacauuuauuccuuuccuuuuccauggcucuuaggaauaaauuguucuacucuauggauuaaauugcccuuuguuuauugccugggaucccaacuuuauuucauaauuuuauuucuuugaggaaacguuucacaaguuuuauaacaaaguauaacucaauuuggagagcacaaucugugcauaaguuggaggcuaccuauugugaaauggaaaaaugcuuguccuagcauuacuaaguuaauguauagcugguagaaaguuuucacuuuuaauugcuaacuugccuagugagagugaaagauugauuacggcaacuaaaaaguauaaaaacuacugaguaguuuuuagguacagucaguucuucaguagaacaagaaucuuuagaaauaacuuucacuaauucuuuacuaguuguuuuuccuauuucucuuggauauggaucaucagaauguuuuuugucccucuuacccgcccccccccaccccgucugccaccccccgccucccacuuuuuuguugggaggcuuaugugagagcauuagaggccuugaauguuuggguagacaagguaaguauucaaauaaacauuucaagaucauugugacagugaaauuauuugauaugaaaaaggaucucaguuauuagaaaaaacacaacuguguuaauacugacagccagcguugcuauaaguguuuuaugugcauuaucucacuuaagcuuuacaacaguccuaagagaggaaugcugugguuauuacacccacuugacagaccagggagcagaagcacagaaacccaaggauuucugccgucagugucaugcauuuggcuggaguuaugaugucgugcaaguaauguuccuucuuuuucccucuaauucauuuuuauguuuuucuuuuacagggcaauuuuguaagauuuaguuuccaggggucagguuuguuuggguuuuauguccuugggaaauccucaguaccuuauuucccauauuccauauuuuuuaaccuuaauuuuuuuuccccucaaauguuauacaguuuaaugagucaaguggucuuucagggauuguuaaaacaaacaguaauucucagcuuccaccuucauuuccuccucucauagguaaccauccucaacucauagguauuuggaauuuaccugugguuuuucaagaaacauuuaaaaaauugauuuacuugaauuuucagguuagaacauaaauuauuugcaugauuugcuguguccuugugacuaacucaaacuaaacauucuaucaguuguccaaauuucccauuuucuuucaaauuucccauuuccuucacuuacuuugucaguuucaucaucuugaagaagccuuuuccagagcacagugcuccaacauggaguagucucuguuuucucauagugcccagcaauuauccuuggaauucucuuuucuuuucuccugcauuggcacuucuguuucuucuccucuuaugucuuccuguuucaugggaggcaaauauuugauaccuuauguuuuuugaaaacacuuuauuuuccucucacccuucauuagugguuucacuguauguaacauugagauugaugauuuugcuccauugucuucuagcuuguguuaugccuguugaaaguacaaaaucauucuggaagcuuaucuauuguuagcuauuucccucuucuggaagcuuguaggaucuucccuuuguuuccacuguucugaaacuuguaaaugauaugcuuuaauaugguuguacuguauuuuaaacaauuaugcucugcacucaguguuuuuuuguuguuguuuuuguuuuuuaauuuuuaaauuuauuuauguauuuuuaaauuuauuguuuuuguuuguuuuuugagacggaaucccacucucgcccaggcuggagugcaguggcaugaucuuggcgcacugcaacaaccuccgccuccuggguucaggugauucuggugccucagccuacccaguagcuggaauuacaggcgugcaucaccacgccaagccaauuuuuguuuuuuuguuuuguuuuguuuuguuuuuuugagacagaguaucacucuguugcccaggcuggagugcaguggugcgaucucgguucacugcaaccuccgccuacuggguucaagccauucucaugccucagcuucccgaguagcugagauuacagguguaccaccacgacuggcuaauuuuuuuguauuuuuaguagggacgggguuucaccauguugggcaggcuggucuugaacuccugaccucaagugauccacucacuucggccucccaaagugcugggauuaugggcguuagccaccgugccuggcuucacucaguguuuucaguuaggaaacuuacauuguuuaguuuugggacauuuucuugaauuauuucacugauuuuuuuuccucucuguuuucucccguggauuccccauugcauagaugcugaauuaucuugacuggaccuccaguuuuuucuucuuuauucuguugccaucucuuugauuccuuauucuuucugauaaauuuuccuaaguuuaauuuccaagggcucuuuggaaaaguaucgauuuuuuuucauggauggaguaucuacucuuuugacacagggucuugcucugucguggcucacuacagcuuugauugcucaggcucaagcgauccuccugcccuagcccucccaguagcugguacuacaggccugcaccgccaaaccuagcuaacuuuuuugauuuuuaguagacaaggucucgcuguguugcccagacuggucucgaacucuuaagcgccaagcauuucucuugccucagccuccuaaaauucugggauuacaguguaguaucuucuguauucuuuccauggacacuaaugaugggguauaaaauuccuuuuauuuauuuauuuuuuuauugacaucagaaauuccugcuaauaaaauucuuuuuaaauuuuaaguuuuuuucuucccacaguuguccguguuuccuccaaguuccuuuucuauuuuuuguuuuccuuuguuuucuuuuugugguagaugcuuuccucagaugagugguaauccuugacuauuugcaguuaugccucuaaaagcugauuggaagcucuuaguaccucauugguacuuguugaguagaguucacucuggggugaucuaucugugucauuugcuggggcacccuucaugucagcuucugauuacuuuucccuuuucugaaaagggagaggucuuuuaauuuccugucuggugggaggaggucuguaugccacuucugugggagagugagggaaguagggcagugaggauuucaguauucaguacauauguguuuucuuaaggcuucuguuuucauuaagccucccccgcaccaaugugcuuuauguuucccugcucugaaauccuccugagggaauaauccucuagaauuuugccuuggugggaaaagcguaguaaccuaaccaugugguauuuaggaagguacugagagauugagcguuuccuaaggagcuuucagccagccuucuuuauuuagugcucccuucacaccuguuucuacaggcgcuaucuguuaccaguuccugagccuuuugaggauucuguggacgaagguugguuuuuggcuuuccauacugcugguuucuuggaucugcuaugucaguuaccauuuaugcauuugcuuucuagcuuuuaaauuuuguuuaugccuuaaaaauaccugaugagggccaggcgugguggcucaggccuguaaucccagaauuuugggaggucgaggcagguagacuccuugcgucugggaguuugagagaagccugggcaacauagcaaaaccccaucucuacuauagaaaaauuaacccagugugguggugcacgccuguggucccagcuacuugggaguuugaggugggaggaucgcgugagccugggauguggagguugcagcgugcugagaucaugucacuguacuccauccugggugacagaaugagaccccaucucaaaaacaaaaacaaaaaccccccaaaaaccuuauuaguauuuuagcacaauuuggggaagaaaugaaguuaaauauauguauguuccaucuucucuuuacccagaacuuauuucuaauuuuuuuuuuguuaagcaucuuuuuuguugugguaaaauauacauaaaauuuauuauuuauaaguauacaguucagugacauuaaguacauucacaauguuuuacagccaucacuacuuucuaguucuagaacuuuucuaucacaccaaaaagaaaccccauacucauuaagcagucacuccccauucccucccucccucagccccuggaagccacgaaugugcuuuuuguuucuauggauuugccuuuuguggauauuucauauaaaugaagucauucaguaugcggccuuuugucacauguuuucauuuaccauaauauuuuugugguucaucuaugguauagcauagaucacugcuuccuucuuuuuuauggcugaauaauuuucauuguguggauauaucacauuuuguuuaucuguucaucaguugaugaacuuuuggguuguuucugcuuuuucuggcuauuguaaauagugcuguuaugaacacugauguacaauuuuuuggggugaacauuuguuuuuauucuuuuggguauauaccucgguguggaauugcgggaucauauaugguaauucugucuuuaacuuaaugaggaacugccaaucuguuuuccucagugacuguaccauuuuauauuccuauuagcaauacacaagugucccaauuucuccacauuuuugccgacacuguuuuccauuaaaaaauuuuuauuguagucauucuaguggguguaaagugguaucuuuuuguuuugauuugcauuuccccaguaacuaaugacauugagccuuuuuucaugugcuuguuggccauuuguauaucuucuuuggaggaaugucuguuuaaguccuuugcccacuuuaaauuguguugucuuuguguuguagaguuguaagaguucuuuauacauucuggguacuagacaugauuuucaaauuuagauacaugauuuucaaaucuuuugccucuagauguuuuuuacuuuuuuauuuuugauccuugaacucaucuauauucuaugguugugauguaaugaugucagaauuggugucauuuguguuuauuuaccagguuauuuggaaggauuauauuuuaggugcucuccucucccccaguaaaugguauuaugacacaaggguuauaaaggacugauaagaaauuacuuaagacagaaagggaaguuggccugcuuccaaaauauggucccagcagaagugaaguuaguuacacaaauaacuacagucaaaaagcuauuuuuauccaugauaauguauuuguuguuauuaauauuaaagauuauauuuugccaggugcaguggcucacaucuauaaucccagcacuuugggaggcuuagguggauggaucacuugagcucaggaguuugagaccagccagggcaacauggugaaaccccaucucuacaaaaaaugaaaaauuaaccaggcuugguggugcgugccuguacuccuagcuacuugcgagucugaggugggaggauagcuugagcccaggaggucaaggcuguggugagccgagaucguagcacugcacuccagccugggcaacaggacaagacccugucucaaaaacaaaacgaaacaaaacaaaacaaaacgacuauauuucugcauuaaguggggguauagaauccuaucuaauauuugagauaauaauuguuauaguauuuuauugagcuuuuauuggguaccagauguguucuaaguuuuuuucaugaauuauuuucguuaaucuuauucauuguuguguccugaaugaguacucacauauuuguugaagggcucaauggucccuaaaaccuuacaugcuguuuuggaagguuaacuugccaaaggucacauaguuggcaaaugaugaagcugagauuaacauuaagaucugauuccaaaguagucuuucuuaacuauauugcuuuauguggaguuuugucgcugauaucuagacagaaagucucuagcaauggaaaaaaaauaauuuuuaauuaauuuuaauuuuuuuaguguuuugcuucuuuuauuuuuuuuauuuugugagccaccgugcccaauugguuucuuuuaaaagacuaguuagcuugugcuuuaggccucuugauuacucugagguauuuaauuaauaucuuugaaauccuacgauuuacuguaucacuucugcaauaucuaaauuuuuccuucuuacuuauuucuguucuccuucuacaguccuuucuauuauguuuaaucaucaaaacauuguucuuguuuucuacugcagucuaauuuuuaguguuaugcuguuuccagaugccauuugggucauuuucaaaaaaagaugaguaauaauuagcaaguaaugaauauuguucuuuuuaccauucauuaagaacaauuguuaauugucuuauucuauugugaagaauaucuguaauuccugcuuagaaccuggguugauagcaggaucucaggaagcacgaaguguacacagaacgauauagcuggaaaaaguauauauguuaaagaauaauauguugucuaaggacagaauggaacugaucacacagguucuuuuuugguaagcuucaaaacuucuuaucucccauaaaaguacuuuuucuuuuauaauaugcaacaauaacuuucuguuuaguuaauuaguuuuaaagcaagcuuaaacuuauaauuuauaaagaaucauauuugcucccuaucauuguuuuauagcuggggcuauacugacaaauaagaaaaauaaaauuccugcccuuguggaggagacaguuaaacaaugagacaaauacauuucagauggaaaugaggacaauggaagaagaguagagcaggaugaaggcaugaagggugacugagagcuggucaaucuuuagauaguguaauacaggaaacugcuuugaaaagaugacuuuugagcagagaucuuaauguacugagggagugaaccauuugaggucuggggaaagaauucagcuuccucuucagauguacaaaauuauaagauauugccauucuuguaacugaaaaccuauaaaagcaggauaagaaguacgguuucuaaaaacccaucuaagagcugaggauacaagggaaccuaaaugaaccaaacuccagaaaguaaucaaacuuucguaguagagaagaaacccgugguugcucuaggauggaacaaccaaaggaauaggaauccaccauagaugaggggaaaggagaaaccagccacauuuuuuuaaaucagauuuuuaauggccacguaugggcugguuugacagguuaggauccugagaagcccuagcaacucuagcaccaaagagcaaguaugcacccacacuccagcuccuacccacagauguucacugaauguucaggaguaguaagccaaaagccugggccagugacgaacuggcauagauaauaccugaggcauuuggaaccucucccagguauagggcaaccacccuuagaaggcaggauugcugagagaaauccagcagaggcacuccaggcuuucaguucuggaaugcugcaggcaggggaagagcuagagauaacucucaccccacacucuggcaguccauguuuucagccaccaaggacuggggacagggcagaagaggugagugaaacugcucuaauucauuucaggccuucacagaauguaaggaagcuggccuccagaaggcuggcuggagaggaggagcagggcugcacgagggcaccugagcuucagaaagcaaggugugcgacuggagagcaaggagaaucuagcaaaccaaacucugaccgucgugcuuaaugcagagauagagcuccuacaguuuuuuuuucuuucuuuuuuaaaauauaaacuugaauuuuugaaauaguuucagauuuaaagaaaaauugccaagauaguauagagaguucccauagaugcugccucuaguuuuuccuauuuuuauuuaauuuauuuuuuuuuuaguuuuuccuauuuuuaacaccuuauauuaguaugguauauuuguuauaauuaaugaacuaauacugauauauuuucauuaacuaaaguccauacuuuauuuaccuaauguuuugggaucccauuuagcugucacaucuccuuaggguccucuugguuuuggcauuuucuuagacuugagcuucucaucucuuguuuuugauaacuuugacaguuuugaggaguauuguucagguauuuuguagaauguccuucuauugauaucuguuugguauuuuugucauuguuacagugagguuuuauauuuuugggacgaagaacaugcagguuaaguacaauuuucuuuccuuuuuuugagacagugucucacucugucacccaggcuggagugcagugguaugaugacagcucacugcagccuugaacuccugggcucaacgcgauccacccuccuuagcuuccugaguagcugggacuacagaugcaugccaccacaccuggcuaauuuuuuuuuuuuuuuuuuuuaauagagacagagucucacuguauugccuaggcuggucuugaacuccuaggcucaugcaauccucccacuucagccucccaaguaguugggacuacagacaugugccacuaugcuuggcaguaccauuuucaucacaucauauuaaggggacauacugucaauaugacuaaucgguguugcuauugaccuugaucaucugguugagguaguguuuguguauuucuuuacuacaaaguuacucuuuuuucuccucuguuuacauacuguacucuuuggaaggaaguuacauaugcgcagccuacacuuaaggcauggggaguuaugauaccccuccucaagggcaaagugucuauauaaauuauuuagauuucuucugcaugggagauuugucucuucuuccucauuuauuuauccauucaauuuuuuaaauauuaguauggacuuauggauauuuuauaccuuggguuaaaaucuuauuauugcuuuauuuauuuuauuggucaaguuguuccagcuuuggccacugggagcucuuucaguugguaugacuuuuugauauaccacugucaguguauguguguguauguguguuugcacuuucucacuuucuggcacuacaagaugcgcuaguauauuuagagacuaaagcauguaguauaugcuuuaguauaugcuuuaucuaguauauuuuucugucucaauccuagaauuagccauuucuccauggagccuugguuccuuuuacuggagaauggagaaaccaagaucuaggugcuaggugcacauguugcuacugggguguuguugcuuguaggccaucucagcugacagagccagaaaauguauguauuuauacuacccuguauauauccacauaucuauaaauauuucuauauguauccaucuguaucuaauuaagcuaaacaugaguuuauauugauguauucgguuccaguugaaucacuacauggaugauucuaacuuccugcccuugcuuaucuaaaaacuccugcuccaauagugagaaaucugucuccuaccaucagccacccauuuacuuaaucauucuacucuagcauacauguaagguacucccacaguuuuaaaaauugguggcuuggcuaugaaacacaagcaggucucuguaauuuuaccuaggcucagaucccagaccugcucaagugaaggacuugaucucaguccuuaaauauuugaagccagugauuaacugucaaauuacagcugcaucauagcccacacccagcucaguuacauauuggauugacucagacucccuucuaguguccuaacagaaaaauugucgugucuuuuucuggaaguaaaauauuacuuaauuuaauaaguaaucuauuuuuauauaaaaugucugguguguaauaaaaaguuacaagacacaagaaaagcaagaaaaugugaccaaaggucaagagaagaaauagucaguagaagaagacccagagaugauccagauuuaucagaauuaucagacagggauuuaaagauaauuaugaaaaaaaugcuggaugauugaaugauaaagguuaacaauaugcuugaaaagauggggauuucuguagagucauggaaauuaugccaaagaaccaaguugaaauuccauuaaauagaggugaaaaauauacuagcagagaccagagaaaacaaaaaaaggaaagaaaagaaaaggaaagggaagggaggggagggaagggagaaagaaaaauauacuagcagaaaugaauucauuacaugggcuuaacaguuuauggacauagcagaagaaagaaucagugaauaugaagacagauuggaaagagaaaagacagaaaaagucagggagggguagaaaagagauuuuagaucugugggauaauaucagauggucuaacauauauguaauuggaguuucagaaggagagaagagaauguggcagaagacauauuugaagagacaaugcucaggaacuucuaaaauugaugaggucaucaauucacaaauggaagaaguucagcaaaucccaagcaaguuaaauacaaaacaaaaauaagccaacaaauuuaaaaaucccauauauaggcauaucauaaucaaacugcugaaaauugaagauggaagagaucuuacaagcaacaggagagcaacaggagaauaaaggcacauuaguuaugugagaauggcaacauggguuauggcuaauccauguuuucagaccagaaaaaaauggagucuuagcugagcaugguggcacauacuugaacccaggaguucgaguccagccuggguaaaguagugagaccccaucucuauuuaaaaaagaaaagaaguccaggcaugguggcucacaccuguaaucucagaacuuugggaggugggcagaucacaaggucaagaggucgagaccauccuggccaacaugguaaaaccgcgucucuacuaaaaauacaaaaauuagccggguguggcggugcacaccuguagucccagcuacucgggaggcugaggcaggagaaucacuugaacccaggagguggagguugcagugagcugagaucacacgccacugcacuccagccugucgacagagcgagacucagucucaaaaacaaagaaagaaaagaaaagaaaaaauagaauguuaaauacaaugggaugacauccauaaagagcugaaagaaaaaaaaaaaaacaaccuguuaaccuagauuucuauggccagcagaaauagccuucaaaaauaauggcaaaauaaagacuuuugggacauaucaagaagggaaagaauuuguuuccagcagaccuggacucaaaaaacauuaaaacauacacauuaacaagauguggguuuuacagcauauaugugauuauacaaccaugaaagaacaaaaaggaggagauggaauuauacugucauauauuucuuacucugugaaaggagacuguaguaacuucuggaugcauauguaaucucuagaacaagcacuaaaaacacaaacagggauaccauaaagucaguacaucugccuaagagggauuaacugcuacaagaaucauucuccuacaguaaacagcuagaaaacaggacaaaaauacaugaaacaacuguuuucagacauuggacaacaggcagcacaggauagugaucccugagagaagggaaauaacugauaugaacccuacagggguuccuauaggcaguuuccagauuguagcacagaguaggggaauccaaauagagcccaggagaguuuggagaagucaaggcaacuagaauuuguggggcagaaaacaauaaaaggaacuacacagaaaucuauagaaguaagagaaucuuugauuggacacucaucugcacaugcaaaguguggaagucagcagugcuggagaaagucacacuggaaaucagaacacugaacaauuccaggagcucacacagagcugggaauaguuuauguuuccauuaggcauaguggagagacuguuucauacaaaggacauuggcuagagucuucaaagugggguuaaauuagcuauagacuaaaggccuuucuaaaccuacccuaagcuucaaggcagguuuugaaaggaccaggcugauucuaaguaacucaauuaugugccaaaacuaaacucuuuuaaagaauacaguaaaagccagcaccuaacaauuaaaauguucagcauuaauaauauauuaaugaaagauuacuaggcauacaaauaauaagcaggaaaaugacccauaaccaggagaaaaaucaauagaaaagagaccuagaaauguggaauuauuagaaauaauucugaugauugaauuaucagccaaauauguuaauacaaguauuauaaugacuaguagagaaaugaaugauagauaaaaagacacaagccagauauggugacucacgccuacacacuugagggugggcagaucaucuugcccaacauggcaaaacccugucucuacuaaaaauacaaaaauuagcuggguguggugggaugugccuguaauuccagcuugggaggcugaggcacgagaauugcuugaaccugggaggcagagguugcagugagcugagaacaugccacuguacuccaaccugggugacagagugagacuuugucucaaaaaaaaccaaaagacucacaaguaguaucuaaagaugaaaaauaccagauauaauauccaaaacugggggaaaaacuggaugugauuaacagcagauuagacacuguggaaaaaaagaucauuaaaugugaagguauagcaguagaaccuauucacauugaagcacaaagagaaaaaaaauacuagaacaaaguuaauagaacaucaguaaccugugggacaauagcaaguugccuaauacauguauaauuggaguuccagaaaaguggggaaagguagaaagcaauuacuuuaggaaauagugucuggguggccggguggguggcucacacuuguaauccuagcacuuugggggccgagaggggugcagaucauuugagaucaggaauuugagaccagccuguccaacauggugaaaucucuucucuacuaaaaauacaaaaauuagcugggcuugguggcaugcgacuguaaucucagcuucuugggaggcugaagcaugagaauugcuugagccagggagauguagguugcaguaagccaagaucaugccacuacacuacagccugggcaacagagugagaaccuaucucaaaaaaaaaaaaaaaagaaaaaaauaagaaaauaguggcucaucaugguggcucaugccuguaaucccagcacuuugagaggcugagaugagaggauuuuuugagcacaggaguucaagaccagcuugggcaauuuccuuaaaaaagaaaaagaaacagugacuauaaauuuuccaaaucugaugauaaccauaaacucucagauccaagaaacucagugaacucuaaauagaauaaacaaauauaaucauaccuagguauguaauaauaaaauuagugccagucaugguggcucaugccuguaauccuaacacuuugggaugcugaggccuggaguuugagaccagccugggcaacauagugauaccccuaucuuuacaaagauuaaaaaauagaaauauaaaaaguuagccaggcaugguggcacuugucuguaaucccacuuacuugggaggcugaggugggaggauuguuugagcucaggaggucaaggcugcgguaagccauaauuguauuccacccagggugauaaagcaugacgggagauccugucucaaaacaaaacaaaaccaaaaaaaggcgaggcacagugacucacacuuguaaucccagcauuuugggaggucaagguaggaugaucgcuugagcccagaaauuggagacaagccugggcaacauagugagacccugucucucaaaaaaaaaaauuuaaaaaggggggcaugguggcaugggccuguaguccuaucuacucagguggcuaaggugggaggauugcuugagcuugggagguugaggcugcagugaacuguguucgugccacugcacuccagcaugggagacagagcaagauccuuucucaauaauaacacauaaaccaauguuacaauuagaagaaauaaauucugguguucgguguuuuuuuuuuuuuuuuucugagauggaguuucgcucuuguugcccauugcuggagugcaauggcauagucucggcucacugcaaccuccaccuccuggauucaagaugauucuuuucccucagccucccaaguagcugggauuacaggcgcgugccaccacacccagcuaauuuucauauuuuuaguccaccacguuagccaggcuggucucaaacuccugaucucaaauucugguguucuauugcacaguggggugaguauaguuaagaguaaaauauuauuacaaaauagcuggaagaggggcuuuugaauguucuuucacaagugagaaaugcaggaggugauggauacacuaacugcucugauuggaucauuaugcaacauggauauguaucaaaacauugaauuguggcccagcacgguggcucaugcugguaauuccagcacuuugugagucugagguggguggaucaccugaggucaggaguucaagacuagccuggccaacauggcgaaaccccgucucuacuaaaaauacaaaaauuagcugggugugguggugcaugccuguaauuccagcuacucgggagacugaggcgggagaauugcuugaaccugggaggcagagguugcagugagcugagauugcgccaucgcacuccagccugggcaacagagcaagacuccaucucaaaaaaaaaaaaaauauaucaaauuguaccccauaaguacguacaauuacaauaugacaguuuaaaaaauaaauuucaaaaaauucucuuguacuuaccagcugaauaaaaaauaaauuuuuaaaaggagagaagucuuaaaaaccaguuauuuaccccaucauuaaguuauaaugaacuuucuuaugggaauucuuugauaaggaagcuccuuuacgcugaaguuuuauucuuuucauaccucuuuagauaaaucagugcuuugggagcauaugucauaugacucaauggcaguguucuaacuuggauucuagcuccacauugugcaaaggcaaaaaaccagagagucagugugguaguuaagaacuuauguuuugcuguuugauuuccuacaugccaguacucccuccacuaccugcagucuuccugaccuggggcaaguuccuuuuguaaacucuguuuucuagggggauggugguggaagaaggauggugauuugagccaggcaguagcagguggagguggagaaaaguggucaaacccugaaugaacguuaaagauaggaccaaaaggauuugaugagaaauuggaaguagagcacggggaaaaagaaagacaucagugaugaugccaagguuuuuuggccuggggaauugggauaguggaguuguuauuugcugaguaugacuuuucacaaaggaaugucaaggcguaaguagcaaaguucuuucuuuuuuuuuuuaauuuuucuugauuguguuuguuuuguuuuucaucuuuugugggagguggguggagaugaaagcaagcacagggguuggcaggcauaccccuggcaccuaccugugaguucaugauuacuagucuuaaauucaguccuuuuuauuuuuacuuuuuuuuuuuuuuuuuuuuuuuuagagacagugucucacucugucauccaggcuggagugcaguggcacaaucacggcuuacuguagccuugaccucccaggcucaggugauccuuucacuucagccuccugaguagcugggacuacaggcacauaccacccuacccagcaauuuuuuuuuuuaauuuuuuguagcgacauagucuuaccauguugccuaggcuggucucgaacuacugagcugaagcaaccugucugccucagccucccaaaguaaaguacuguaauuacaagcuugagccacuaugcguggccaaauucuggccucuugauguugcauggcguggauggggaggugaagugugauauuuuaggaauuugaggauuucuucuucgaccuuaggcgugacauuggacaaaugacaucugggcugagacauuuucuauuaauucugaauccaaaaaacucuuaucccauugucucauagcuucauuacacagaccuggcagccaugauccucuuuuuuucccccuuaguugucaaacauggguucucugucuuaccucauuugagucuuaccucagucuugagagucucaaauguauaucauaguuuuuagacaaaauucaaccuuauuucaguuaguauuucauuguuauuuaaauauuuuaacaggaaaacugagcaauguuucccuuuaccuguuaauccuguuauaauauuuuagauaaaguguauuagaaggcacauucuucauuaauagaauauuuauucauguguuuauaugguucuuaacuaggaauaccauauagucuaucuccaacccuuugagaaggaaaaaagauacugacuaaacaggacaccagaagagcaugccuaaacuaggacuguucugggcaaaucagaaggcauguucaccuuauucuuuuuauucuuucuuuuuuuuuuuuuuuuuuugugacggagucucacucugucgcccaggcuggaguacagugacgcgaucuuggcucacugcaaccuccaccuccuggguucaagcgauucuccugccucagccuccugaguagugggacuacaggcacaugccaccaugccuggcuaauuuuuuguguuuuuaguagagacggggguuucgucguguuagccaggauggucuugaacuccugaccucaugaucugcccacuucggccucccaaagugcugggauuacaggcaugacccacugcaccuggccucacccuauuccuaaggccagaaaaccagcuagaguaaaguucacuuucuguuugagugcuuggacuuuauugggagaaggcaaaugcccuggaacaagagugaaagggagaaauucccguuguauugcaagccagaauaagagaggcucacccgcacuggccuaaggcaucucaguuguugaugagaaugugauuacagaugucucacuugaauaccaaagacaauugcaaaggaaauuaaaaguuaugcaaagagaguugagaagucaguugucugcucacagguuggcuuuaguggcuauuacuuugagauacuaaaugagcaauagcuuuaaacuucaacugcuuuuguuucugaggaaaaaaaucaucuuauauccuuucauaagucgcauaaaauguggacauuuucuauuauuuuaaagaguaaauuuagguacaagcauuuacuaauuuuuuuuuuuuuuuuuuuuuuuuuuuugagauggugucucgcuuuguugcccaggcuggaaugcaguggcgcaaucuuggcucacugcaagcuccgccucccugguucacgccaugcuccugccucagccuccagaguagcugggacuacaggcgcccgccaccacgcccagcuaauuuuuuguauuuuuaguagagacgggguuucaccauguuagccaggauggucucgaucuccugacuucgugaucugcccgccucagccucccaaagugcugggauugauuacaggcgugagccacugcucccggccuguaauucuuuuuuuuuuuuuuuuuuuuugagacggagccuugcucuguugcccaggcuggagugcaguggcgugaucuugguucacugcaagcuccgccucccggguucacgccauucuucugccucagccucccgaguagcugggacuacaggggcccaccaccacgcucggcuaauuuuuuguauuuuuuaguggagacgggguuucaccguguuagucaggauggucucgaucuccugaccucgugauccgcccuccucagccucccagcauuuaguaauucuuaaaagaguucggcaugaauauacacaguacguggguuauuaguacuguguuguuaacacaaaugaacuaugauagcaaauugaauuugguucaaucaggucaaagaauaaaaggaugauuuucuuuaaccaacaagggauaguauaaugaaccccaugcaacuaucacuuaacuucaauaauuucaaguuugaguaaguugcagaguaguaauuugaacccacaucucucuuguuccaaaucccuugcuuuuaauuacaaucccauguggcuucuuugucauuugaugcuauugagcaacuuuaugauuuuuuuugguguuuuugguaaaauagacaugaaaaggcauuacuacagggaguuuuuucacucccugguaauaagaggggaaaagcacucucuuuuaaugauacauguuuuguaauaagcauuuuuuuuaguugcaguguucugcaaagacaaaaccugcugauacaguucauccuguuuuagaaaucuuugacccauucaucagacucugaccacucuaaagauaaaggauuaugguuguauugguuuuuccgacugaagcggcuuucugcagauugagaaauuguauaauuauuaacugcgguaauggagauguacuugcaaguuucaucugguaucuuaaugagcuuuaacccucugaauacaccuaaaacauauccuagaauuauugaaauuaaucaguuguccauaacuuuucugucuguauaauuuggcuaucauacauauuuuguuucccccugcccuugccaguuuccauccuccuacucacauacucacaacuccuauaaauuggaguauuuaguagcaguagccuuugguauaaacacuuuuuaaaaauuuacuauuuuuugauuuaauagggccacuuucuagucaaauuuuuuuuggggguggugaggaggguaggguaacaguuccacacuuacaaggguauuuguuuagacgaagcuuguucaacccacagccuguggggcugcaugugguccaggacggcuuuaaaugcaacccaacaugaguuuguaaacuuucuuaaaacauuaugaguucuuuuugagauuuuuuuucgagacagagucucgcucuguuguccaggcuggagugcaguggcccgaucuuggcucacugcaaccuccaccuccuggguucaagcgauucuccugccucagccucugguguagcugggauuacaggugugugccaucacuccaagcuaauuuuuguauuuuuaguagagacgggguuuuaccauguugggcaggcuggucucaaacuccugaccucaagugaucugcccaccuuggccucccaaagugcugggauuauaagcuugagccaccgcgcccagccugcgauuuuuuuuuuuuuaagcucauuagcuaucauuaguguuaacuguauuuuauguguggcccaagacaauucuccuucuuccauuguggcccagggaagccaaaagauuagacaccccugauuuagacaaauaagugaaggcacacugaaauaacaauuauauauaauaaccuugugccgcccagcgugguggcucaugccucuaaucucagcacuuugggaggccgaagcaggcggaucagcugagguugggaguucgagaccagccugacuuacauggagaaaccccaucucuacuaaaaauacaaaauuagcugggcaugguggugcaugccuguaaucucagcuacuugggaggcugaggcaggagaaucgcuuaaacccaggaggcagagguugcagugagcugagaucgugccauugcacuccagccugggugacaaaagcgagacucugucucaaaaaaaaaaaaaaagaaaaaaaaaaaaaaaacaaaaaaaccuuguguuuuauggaucucacauucaucucagauauuucuugcccugagagauccucugaauucucaggauugcuucauguugauucuacugugauccuaucaaauauaguaaugcuagaaauauaggucugaaguuugggagagagauuggcucaguauagauauguaaagcacaguuggauaugugguaguuauaugaaugggauuggaugaaauucucuagagguguguggaauggaaagagguggcccaaggaggaagagagagagagagaaauuggagagguagaacaauuuaggaaagaguaauguucuagaaacuaaggagagaguuucacaacugcaguggugaagcacugugaguucuuauuuggcaauuuggacuucauuauugucuuaucacagauaggaaaugaaagguugcagaacauuuaggagaaaauauuaagugaggacacagaagcgguaaaugucguauacaccuuuuaaacauuuuggagauuacccauaguaggccugucccuuggguaaggcaauuagggcagcuuuccugggcccuauuuugggguggggaaugacucggggacuuuauuauaugacuuuuuuucugaacauuaauaaaauucaguuccaaaauuuugugauuaacuguaguccuaagagccuacgaaaaaugcagauaaugggcaguuccacauugguugaacugccccaggcuucucucuucuagaguugcugucccuuccuuuuaauccuguaguagcuccuaucacuuuuuuuuuuuuuuugagacagagucacccagacuggagugcaguggugugaucucagcucacuguaacuucugccuccuggguucaagcgauucucaugccucagccuccugaguagcugggauuacaggugcgugccaccacaccuggcuaauuuucguauuuuuacaggauuuuaccauguugccuaggcuagucuugaacuccugaccucaggugauccacuugccucagccucccgaaguucugggauuacaggcgugagccaaggcuccuggccuccugucacuuuuuauaauugucaguuuguuuuuccucucagaaauuaagcuccuuaaagcucucuauuauuguuuugaauucccagggccuagcauaaugcccagcacguaauguugaauguuuguuacguaagugauugaaggaauaauccaauacauaucugucuuaaguacaaaagaauuccaauaugguggucucacagagucaaaaaagcggaauguuucagaaaagagggauugauaaacaguuucaaaugguaguaaaaguauugaaaacugaccuuuggauuuggcuucuagaaggucauugguuuccauagugaaaacuuuuauagcaaaaugguuggaguagaagugguugaagauuaaaggagaaaugagauguaagaaacaacaaacaaguuugugggggggcggggguugguuuuauuuuuaaagauuuguagcugagcgugacaguauguaucuguagucccagcuauuugggaggcuguggcuggaugauagcuugagcccagcagcuugaggcugcagugagccaugauugcaccauugcacuccagccugggugacagagagagacccuaacucaaaaaauaaaauaaaauaaagauuugaaacuaaagggaagaaaccauuggagaagaaagccaaagaucugacggaggagaauucauuaucaugguaauguuaugcauuugauuugcauauaucuaaguauucccaccaacuuuuuuuuuuuuuuuuuuucugaggcagagucucacucugucacccaggcuggagugcuggagugcaguggcaugaucuuggcucacugcaaccucccggguucaagcgauucuccugccucagccucccuaguagcugagacuacaggcuugugccaucaugcccugguaauuuuuguguuuuuaguagagaugaaguuucgccauguuggccaggcuggucucggacuccugaccucaggugauccucccacuucggccucucaaagugcggggauuacaggcgugagccaccaugccaggccccaaccaacauuucaagauaauauauuucuccuuccacuuggguuugauauauuaauguauuuugaacuugaaggcuuuugcugugcuauuuggggccccuagugguaaaucuaauaaugacaugcaauagaacagcuaauauaccaguuauuccuuaugaagguuauucuuucuaugaggauuaaaugagguuggaauauguaguuauagcaauaguagugauucuuaaucauuuuuuuaaagagagggucucgccaggcacgguggcucacaccuguaaucccaacacuuugggaggccaagguggguggaucacuugaggucaggaguuugcgaccagccuggccaacauggugacaccccaucucuacuaaaaaaacuaaaauuagcugggcguggugguagauggcuguaaucucagcuacucgguagguugagauaggagaauugcuugaaccugggagacaggagguugcagugagcugagaucacgucauugcacuccagacugggugacaagagcaaaacucugucucuaaauaaauaaauaaauaaauaaauaaaaggucucacuuuguuacucagacugaagugcaguggugugaucauggcucacugcaauguccgccucucaggcucaaguaauccucccaccucagccucccuaguagcugggacuauagguguuccacuacuauguccagcuaauuuuaagaaauuuuuuaguuuuuaaauauuuuuguagagaugguggucuuacuauguuguccaagcuggccucgaacuccuggucucaagugauccucccaccucggccucccaaagugcugggauuaccggugugagccaccauggcuggccaaaaaugaguaauuuuuuuuuuuuuuuuuuuuugagauggagucucgcuuugucgcccaggcuggagugcaguggcgagaucuuggcucacugcaaccuccuccuccugaguucaagcgcuucucuugccucagacucccaaguaacugagacuuuaggcacgggccaucacagcuggcuaauuuuuguauuuuuaguagagaugggguuuugccaucuuggccuggcuggucuugaacuccugaccucaagugauccacccccuuggccucccaaagugcugcgauuacaggcaugaaccacugugcucugccccaaaaugaguaauuuaaaggugacuguaauauaguuaaacaaaugccucuuuucccauucuuuacuaacuuguuauuuaaauggggcaaguuuuuacaacauaagaaauaaacaggccaggcgcgguggcucacgccuguaaucccagcacuuugacaagcagaggcgaguggauuucuugaggucaggaguuugagaccagccuggccgacauggugaaaccccgucucuacuaaaaguacaaaaauuagccgggcgugguggcacagacuguaaucccagcuaaucagggggcugaagcaggagaauugguugaaccugggaggcggacguugcagugagccuagauggcaacacugcaguccagccugggcaacagagcaagacuccaucucaaaugaaacaaacauacuaaaaaccuauuuacuuguuugaugugagugugcuuagcuuuauuccccuuaaagagagucuuuuuuugagauggagucucacucuguugcccaggcuagagugcaguggugcaaucuaggcucacugcaaccuccgccuccuggguucaagcgauucuucugccucagccuucaaguggcugggacuacaggcgugugcuaccacgcccagcuaauuuuuuguuuuuaguauagacggcguuucacgcuguuaggcaggauggucucaaucuccugaccucgugauccacccgccucggccucccaaagagcugggauuacaggugugagccacugcgcccggccuaaagugagucuuuaggugaaaaauuuuugugaauauugugauuucuccuuaauaauuucuuguguauuuaugaauuuuauauaauuaaauggcauaucaaaaaaaucaccuauguuaauuauguuuuugacucaguuauauuuucuuuugguacauuauuaaguuaauauccauaugcaaaaauaugcugacaauauauuaauuuuggauuuuucauuuuuaucagaaaucaugaguggaggaucucaaguccacauuuuuuggggugcuccaauugcuccacugaaaaucacaguaucagaagacacagcuucuuuaaugucuguugcugaccccuggaaaaaaauucagcuuuuauacagucaacauucuuuauaucugaaggaugaaaaacagcacaaaaaucuugaaaacuauaaagucccagaaucuauugguucuccagaucuuaguggucauuucuuagcaaacuguaugaauagacauguucaugugaaagaugacuuuguacguucuguuucugaaacacagaauauagaaucccagaagauucacuccucuagacugagugauauaacuagcucuaauaugcaaauauguggauuuaaaagcacaguuccgcauuucaccgaagaagaaaaguaucaaaagcuucucagugaaaauaaaauuagagaugaacagccuaaacaucagccagauauaugugguaagaacuuuaacacaaauuuguuucaguugggccauaaaugugcagcuguguuggauuugguuuguaguacugaaaaaauuaauauagggccugaagugguacaaagagagugugugccaacagaauaucaugaaauacaaaaccaguguuugggauuauuuuccucgaacgcaguagauaagucaaggucugaagcagcaguuaggaaggucucagaccuuaaaauaucaacugauacagaauuucucaguauaauuaccuccagccagguugcuuuuuuagcucaaaagaaagauaaaaggcggaguccuguaaauaaagggaauguaaacauggagacugaaccaaaggcaaguuacggggagauaagaauaccugaagagaauucgauucagcuugaugguuuuacagaagcauaugaaaguggacaaaaccaagcauauucccuugaacuuuuuaguccuguuuguccuaaaacagaaaauagccgcauucacauaaacucugauaaaggucuugaagaacauacaggaucucaagaacuuuucaguucugaagaugaacugccaccaaaugagauacguauugaguuguguagcucaggaauacuguguucccaacuaaauaccuuccacaaaagugcuauuaaaagaagcuguaccucugaagauaaagugggccagucugaagcucuaucuagaguccuucaaguagcuaagaaaaugaaguugauuucuaauggaggagauucugcuguagaaauggaucggagaaaugugucugaauuuaagaguauuaaaaaaacaucauuaauaaaaaacugugauucuaaaagccagaaguauaauuguuuagucauggugcuaucuccaugccaugugaaggaaauaaacauaaaauucggaccaaauucuggcucuaaagugccuuuagcaacaguuacaguaauugaucaaucagaaacuaagaagaagguuuuucuguggaggacugcagcauuuugggcauuuacaguguuucuuggagauauaauuuuacucacaggugaggucauuaugguauagugguagcuuauuuuauaaagcuaaguuuuguuuguuuuuguuuuucucccacuuagucuuugaagacucuuuagucauuugccucuucugagcgcagcauaauugaucccuuuaucgcaucugcauuguucuccuuuccauuguccacucuccugcccauugccacuucugggccucuguucuauccuucucagcucugucccuucuuuccacuuauccccuccuuuaauaagccuucccuagucagguggagugggucacacuuguaaucccagcacuuugggaggcugaggcaggaagauugcuugaggccaggaauuugagaccagccuuggcaacacagaacccgucucuacaaaaaauaaauuaagguuugcgugccuguagucccagcuacccaggaggcugacgcgagaggauugcuugagcccaggagguugaggcugcagugagcuuugauugggccacugcacuccagcccgagcaacagaguuagaccuuucugcuucuuuaccuaaugucuaauaaugcugugcacauuguauuuuuacugugggaacaguuauugauuucuauugccuuauuaucaaaauuauauuaauuacacuuggaaauauggaaaggaaaaaacugguauuauaccaacuucauauaaccaccaauagaguucuagaguguugccuuccaguuauuuucucuguucuccuuaaaaugugugugcauguguguauauaucacacauagaagcucauauuuauugggagcuuaguuugugagacccuguuuuagauuuuacaugcauauuucauuacaacaaguauaugaggaagguacugauuuuuaucccuacuuuucaguugaggaagcugaagcccagagaaguaaaguaacuuguccaaugucauacaucuaggaaguggcaaagcuauaguuucuccuagacuccagaauuuauacucuuacuauauaguuguaaccauaaagaacauuuuguuuuuuuaauuuuuaauuuauuuauuuuuaagagacagagucuugcuauguugccaagugcaguggguacucacgggcacaaucccauugcugaucagcaugagaauuuuuaaauuguuauuuuuaauuuuuuguuuguuuguuuaauagggacagggucucacugcauuacccaggcugaucuccaacuccugggcucaauugauccuccugccgcagccucccgaagugcuaggauuacaggcgugagccaccgugcccaugguauuuuuaacaugcccuuguuuccaaccuggaccaguucaccccuccuuagggaaccugugguccuccacucccaggaggucacuauauugauggcaagcuuagugcagacaccugaucggcuacaacucugaacuccugggcucaagugagccuccugccucagucucccaaguagccaggacuacaggcacgcaugccgcugcacccagagagaauauuuaauauuuuuuuuuuuuuuuuugagacagucuugcucugucacccaggcuggagcgcaguggcacaaucuugacucacugcaaccuccgccuccugggugcaggugauucuccugccucagccucucgaguagcugagauuacagguguaagccaccaugccuggcuaauuuuuguauuuuuaguagagacgggguuucaccauguuggccgggcugguuucgaacuccuguccucaggugauccgcccaccuuguccucccaaaaugcuaggauuacaagugugagccaccgugccuggccagaauauguuuucaccgaacacaucuaacauuguguuacauguucuuuguugauuuaaaauugacacaugguguauuagagcaggaggaaguugauuaagcuuaauaaaauaucuaaagaaagaaugugauacagaggagguauuuagaagaagaaaacuucgaagcaauauugauaauccuaccaaauaguuuacaggaggaaugagaaccuuagcuaauguaccuugguguuccuguaggauugucaaguacaaucuuuuuuguuuuuuugagacggagucuggcucuggcacccaggcuggagugcaggggcgcgaugucugcucacugcaagcuccgccucccggguucacgccauuuuccugccucagccuccugaauagcugggacuacaggcgccugccaccgcgcgcggcuaauuuuuuuguauuuuuaguagagacaggguuucacuguguuagccaggauggucucgauauccucaccucgugauccgcccgccucagccucccaaagugcugggauuacaggcgugagccaccgcacccggccgaguacaaucuuuuauaaagagguaaacacaagauuguaaugaacaggcuuagcauagccacaucccacuggcaguauuagcuaauauuauuuauaugugauuauauuauuggagauucaauucaccuaacucccucuguucugauucagugcuugcugaauaccucuuugcuugugauuuggcuuucuaguuguagagcugcccacagcaugagaacaggcugaaauacuguuuuuuugggcaauuaaugccucauuguaaaugaaaaaaaaauuuuuuuuucuuuaauuuguuucauuaguugauuuaguaugagcuuauguugcagagcugaaaucuaguuuuggaguguuaacaaaauuaaguuucccagacuguaaaagagggcuggauccuggaccauggucauuuuaccgaggcaauuaaugucagcagggaccucucaggggccuuuuccuuuuuccuagguagguguaaacucaacucugcaaucucuguauuuuuuccuaacaucucuauaguuguuaacaacgagguaacauucucucugguggcugaaaugcaauuuacuuaaccauuuuccuauuauaagacauuuagaugauuucuaugaacauuuuuuuuaaaaaucagauuuuuuugucuuuuuaagaaaaagaggaccuaguucacuuauuucugaauaaguuucuuuuguguggaacagauggaaauguugggaaaaaaaagaaaucuacacuuuucuguuguccuaaugaggcagugaacuuaguuggauagccuggguaguucauacuaccuauugauauauacccccaaacagaaaucuuccuuuuuuuuuuuuuuuuugagauggagucuugcucuguugcccaggcuggagugcaguggcgcgaucucggcucacugcaaccucugccuccuggguucaagugauucuccugccucagccucccaaguagcugggacuacaggagcccgccaccacgccugacuaauuuuuguauuuuuaguagagacaggguuucaccauauuggccgggcuggucucgaacuccugaccuugugaucugcccaccucggccucccaaaguucugggauuacaggcgugagccaucgcgcccggcccaaacugaaaaauuuuaaguaacagauguauuccagaccuuguugaauaccaacacagcagacaguuugcuauuauaacuucuagcaauagaaugaagagaugccaaaaauaaggauuaccuaagggagacuacugacuagaauuagaagaagaugggaggcuuaacauugggaaacaacaguguuuaaaggacaaacagaauaaggacuaggagcuggggcaugucagugagaggguaggaaggagccaggaggccagggcgggcuacccauccccuccaugcaccacuagugauuaccaugucacuaauccaacauaugcuucacaguccuagcuuucagaaugcucuccuugaaauuucucgucuguuccuuuuuucugaagaacaugcauccugaauguuggaucaugaaaagucuugaaugcuguacuagcucuuccuggcuaggcaguggggaaccacuguuuuuuaguaagucaccugaacucauuaaugcucugauauaucacucgccugaacucauuaaugcucugaugaaugacucauuagcauuguaagaaauggguugcaggcgggacaagcaccuguugggagggaaaggaauguguaauguaaaacaguaguagugguggggcaugggcacauuuaagcagcagagggguaggugggggcugguggcaaggagugggaagggagaggcaagaugacuucagauguuaguuuacuugauuagcagcauagcgucaacaaaugaguugggcgcuaugaaaggaaaagcagguuuggacauugcugaguuuggggagccaauggaauauccaggugggaauuuccauuaggcaguuguagguaaaagguucaaaagcugaggaaagggucuggaaucuaaaucuguaaguaaucacuuggaauuuauacauccuugguuuucuuuccuauuaucucuacauuauuucacuauuguuaauauauguuuauaccucugacacuguaugcugauuagauccugccuuagagauagcucccuuccccucuuucucuuuacagcucacacguuuugcucuaccuacaauuguuucuaccuguugguauguuuaguucuaccugauucuacucuauccgucuuagauauacagcucucucuuuccaauuggaaaauguucccuaccuccaaagucuuucacuuuuaacuuauguggaagauaauuauagugcuauuuagggaaaaauaaucaaguguguuaagaaugccuuauauucagauauauuuauaguagaagggaccagugcauacugaauauuauuacucuccuaggcacuacggcuuuggaaccacuacuuugccuucugguccuaaaaaaaauuauuuuuaauguaucagaaauauacaugauaacauuuuccuuauguaaauaaaaacuauuaagccuuuuuuauauagagcaguggacuuccauacugcuaucauuugaauauaaagaagcaauuuuguuaauuuaccuagauuuagauuuuagauuugcuguuuucuuauuucgugccuuuaggcagguuauuuaaccuauuugaucucuacuugcuugguauaugggaggcaugcauaguauuuuguugugacuaguagguuaaccacauugugaaggaauuuauggcaugaucagaacguuuuuucucucucuagauguuguuauucaugaggaccaauggauuggcgagacaguacuacaaucaacauuuagcagucaguuauuaaaucuugggaguuauucaucuauucagccugaagaauguaaggcacauuuuaaaugaaguaauguaguaguguuuaaaguauaaaaacauacuaggaaagauuaggguuaaaaugguucuuuuacaaaauguuuucuaaacaguuggagaguauugguuucuuuucauuaguaagaaugaaaauagaauuuuaagaaaugaacuuguacauuguaaaucacauuuauuuuaagaaguauugggucucauguuucguuuucuuaggccaucaguauaguggugguucuucaccuuuuagggagucagagaccucuuugagaaucuauagaccauuucuccagaaaacuggacuuauguagauaggcacaaaauuuugcuuauaauucuaaagcauuccacggaccucugaaguucuucuguggaacuucugagccucugauuaagaauccuugagguaauaaaaauguauuggucucguauucagacagcugugguuugaauccuuauucuccugucuaccacugcuaagaaaagcuaucuuucuucuuuaauguccaguuuucucuucuuuaaaagaagcuguuuaaugaggaaacuagcagcuaucuccuccucuaggaaauaaaauaacauaaaaaaaagaaagaaaacaaaguaagggaaacaguauaaacuugugguuauggucacuggacucagauagaccaggauuugaauacuggcccucuuacuuccagucuuugucuuuaggcaauguauuucacuucacuauacuuuugucuccuuuucugugaaauggagauaaaaauacauauauaccuuauaggguuguuaugaagauuaagugagaaaaugaauauaagauguugaaccugcacauaauguaguaguaacauaguaauauuagagggagaaauaauaagcuagcaaaauauauuugauaaaaugcugaaauaucauacaagaaaauagcuagagaaauauacugauuauacaagaagauaacuggaauaauaggaaaguuauaggauauauauauggaagauagagcauggaauuccaaucuuugaauucuuaaagaaaggcagagcaaguagaagggaagagcaacaauuagaauaacaagaacuguguuuggaaugggcaagguuucauuauauacuaggguggcccaucagcagaaaaccaacucugacauauuucauagacaacuaaaauagaguucuucaucuauccaauauauauuuauuauguguugacauuguuucaggcacuguguuuacuguacacuggggguacaauggugccuguccuccuggagcuuauguucucauguggaagacagaccaaaaaaaaugaaugaaacagacauauaaguaaaauaugugcaggugauaaugagugcuaugaaggaaacuaacaaaggguuaagauacagaaugccgugguucuaguugagaaggauugaucauggaguagaaucaggguuaggaaguuguuacaauagcugcaguugagagauaaugggaggccaguggagcuaaagagcugagauauauuuguaaauagaguuaauaggauuuucugaugaugugggucuggggaucagggaagagggacaaucuacugcuacugaauuacugguuuaaguaacuagguagccuuuauugggaaagacugagagggaacugguuuguggggaaaaggacuauguuucaaggcauguuaaguuuuagauaucuuugagauauucaaguggaaaugucauauaagaacuggaaacaaaguucaggacucagaagacagguuuaaaauuaagaggcaaauuuuagaguuauuagcauacagauaauauuucaaauuuaaaaguuuuuuaaauaauaaauaucuguauaauuauagaaucacaggggauugcaaaaauaauacauaaagucccaugaacucuucuucuagcuucucccaauggugauaucuuauauaacuuuaguacaauaucaacaacaggaaaucaacguuuguauaauacuguuaacuaguaauauacuaggauacuuucccuuucaguaucaauaaauauaguaucagccuggcacaguggcuuaugccuguaaucccagcacuuuggguggcugaggcaggaggauuacuugggcccaggagcucgacaccagccuggaugauauggugaaaccucaucucuacuaaaaauacggaaaaauuagccagguguaguggugcacaccuguaguuacagcuacuagggaggcuuaagugggaaagaaaguugaggcugcagugagccaugauuguaccacagcacuucagccugggugaccggagucagaccuugucucaaaaaaauuuuuuuucuuaaauaaauauagcaucaauacagcauuauaauaugauuaauacuauaucaauaaaauagauacuuaguccuaaugccaaugucuuauuuaauagaaaagcacucgaggcauugucauuaaaaccaggaaaaagauaaggauguccacuaucucugcaacuauucaucuuauacuagaauuaucagcuaaugcacuuagacaagaagaggcaucuggucuggugcgguggcucacgccuguaaucccagcacuuugggaggccaaggugggcggaucacuugaggccaggaguuugggaccagccuggccaacauagcaaaacccugucuguacuaaaaagaugaaaaauuagccaggugugguggugcaugccuguggucccagcuacucaggaggcugaggcaugagaauugccugaaccugggagguggagguugcagugagcaccacuacacugcacugcagccugagcgacagagugagauucggucuccaaaaaaaaaaaaagaaagaagaggcauuugaauggauaaagaagaaugaaaauuauuucuauuuacaaaugcucugauaacauaccugaaaacuccagggaaucaaaguuaaaacaaauuuaaauaauaagauaauucagugauauaacagaaugcaaaauuaguguuaaaaaauaucauuaggcugagugcagugguuugcgucuguaauucuagcccuuugggagaugaaaguggguggacagcuugagcccaggaauucaagaccagccugggcuacaaaaaagaaaaagaaaaagaaaaaaaagcugggugugguggcacccaccuguggucccagcuguuugggaggcugagguaaaaggauugcuugagcccaggcugggggaugagguugcagugagcugugauugcaccacuguacuccagccugggcaacagagcaaggcccugucucaaaaaaaaauaauaauaguaauuagacuuaauauacacaaauaauaaacagagggcauaaugauagugaaaaacucauuuacuauaguaauaaagaagauaguucaaaauacaguuaacaagaaauaugcaaagccuauaugaggaaaaaauuuaaacacuccagaaagaaaugaagacaugaagaaauggaaagacauucccuguucuuggauaggaugacucaacauuauaaugaugucaguucuuccuaaguuaauauguaaauucaauguaguuccaaugaaaauauauauguuauggcauauaaaaguugauacuaaagcucauaggggaaaacagacaugcaagaauagcuaggaaaagacugacaaaggaaaacuacagaggaggggaacuagcuuuaccagauguuaaaacauacuauaaagccucuguaauuaaaacagugaaguacugaugcaugaauagacaaguagaccaguggaacagaguaagaagauuagaauuagacccaccuacauauagcaauuuaauauaugacaaagauaguaucuggaaucagugagauaaaagcuaacuucuuaauaaauggugcugagacaacuggguagccauuuggaaaaaagggaaaauuggacacauaucucacaacaaacaguaauaaacaccauauggauuaauagucuaaauguaaaaaauaaaaucaugcaacaacaagaaagaaaccugaaugaauccucuguaaucuugguguagggaaaggcuuuuucuuaauauuacucagaauccaggggcaguagaagauaaacugauacauuuuacuauagaaaaauaaauuuugcauaaccaaaacacuauaaacaaagucaaaagacaacugacaaacuuggagaaaauauuuguaacauacaacaaaaggcuaauaucccuaauauauaaagaacuuuuaaacccugagugacaaaggcugggugugguuguucacacugguaaucauagcauuuuggaaagcugaggugggagaaucacuugagcucaggaguuugaguccagccugggcaacauagugagacccugucucuacaaaaagucaaaaaaucagcccggugugguggugcaugccuauggucccagcuacguuggaggcugaggcaggaggauuguuugagcccaggaggucgaggcugcagugagcuguauucaugccacugcacucuagccuggcaaaagggaaaaugugaaaaagagaugaacagucaguuuucaaaaaaagauauaaaaauggcuaucaaauauaacuuauuagagaaauucaaauuaaaacuacauggagauaccauuucucaccuaucagauuggcaaaauuaaaaaaaagcacauucuguuggcgcaacugugagguaaugugcccucuuaauacauuggugguaggaaugcaaauugcuacaacccuugugaagggauauuuggcaauaucuaacaaaauuacauauguacuuagcuuucaaccuagcaaucccacuucuaggaaucuacccugaagcuacaccuccaacaauaugaaaauacauaucacaagguuauucauugcaguauuguuuauaauugcaaaauauauaggagaaugauucacuaaguuaugcuacauucacauaguggaacacuauguacuaugcagcuguacaaaaagaaugaaaaagaucucuaugaacugauauggagugauucccaggacauacuguuaugugaaaacauaaaccccccaaaacuguauguaguaugcuguccuuccuguacgaaggaauggagguauaagaaaauaccucgguuuauuuguggaaagaaaaugcaggaaggauaaaccagaaacuaaagagauuggucaccuacagggggcacauaggagagggguggaagaaaguggggaaugggaacaggauagcaggggucaggaggaagugacacuaacaaaugaauguaauauuguuacaagugaaccuaauauuguuacaaaugaauaaaauaacuacacagaagcggguggggaagaaaagaacaaaccuaaguagcuguggaaaagaguauauugacuggauucuauaaggcuaaugacagaaaggacuguacauaaaugcugcaaucuaguuagaaauauguuucucaaaggggaauggcuuagcaauaaccuuauguacauacuagaaugaacaaaugaguacauagauuguagauaaggaaagcuggauuucucacuguuggagaaagaaauuauaaacaagggaagguuaaaacgaaccagagguauuguuauaaacugaggauuuuuaauauagauaaauggauacagaaauauaggcauguguauaugggugggauaguacacauacauaaacaucuccuaguucuguccauugagcgagcacagcacagaugcaguuacuccccaguaauaaugagcauaccuggugcccagaucuucaucuguaaacauuuucuuuucuuuucuuuucuuuucuuuuuuuuuuuuuugagauggacucuuguucugucacccaggcuggagugcaguggcgugaucuuagcucacugcaaccucugccuccuggguucgagcaauucuccugcuucagccucccaaguagcugggacuacagguacgugccaccacgcccagauaauuuuuguauuuuuaguagagaugggguuucaccauguuggccaggcuggucuugaacuccuaaccucaggugaucugcccacuuuggccucccaaagugcugagauugcaggugugagccacugugccuggccucucuuuuuuuuugagacagggucuggcucuguugcccagucuagaguacaguggugugaucucggcuuacuccaacuucugccuccugggcucaagccagccucccacuucagccuuccaaguagccgguaccauagcugugcacuaccacgccuggcuaauuuuuguauuucuuguagagacuggauuucaccauguugcucuggcuggucucggacuccugggcuucagcaguccacccaucuuggccucccaaaaugcugggauuacaggugugagccauugugccuggccaacauaguucucuaaugaaaggaaacagcucugcuaaaagugguugauuacaggacugggucagggcaaauucaggauaagccuggaagucuaguggugccagacaagacauguugaaauaaugcaagagccaaccugaaggaacaccuacuggcuaaagcugaagcaauuugaguaagaaaauaaugauaguauuggauuagaacccauagauuaaaaucuuuacaaauccuuacugacauaaagauauauguauuucauuaacuaaccagaggggaagagagagcucuuccuuccaauggaauuccaauuaauaaaucugagagaaaagaaaaaaaaauagagaauuacuggccaugcucagugguucaugccuauaaucccagcacuuugggaggcugaggcagguggauggcuugagcccaggaguucgagaccagccugggcaacauggcaaaaccccgucucuacaaaaaauagaaaaauuaaccagguuuggaggugugucccuauagucccagcuauucgggaggcugaggugggaggauagauugaucccaggagguugaggcugcagugagcugugaucaugccacugcacuucagcccgggcaacagagugagacucugucucaaggaaaaaaaaaaaaauacaaaacacaaaaauagagaauuaccaucaggcagagaucacaauaauaaauacugcacugacacaaaugcacugauagaugcuaaaauuaguaggugaaaguuugaggagagagagcauugcauagucucaaaguaucuccccaagauaccagcauacuagagggaaaauaauaaauuuauaagaaaacucuucagacaccaaguuaacugagugauugggauaaauaucaccaguaauaagauguaugguaucauaaaugcuuugauauuauccauugagaaggauccaccauauuuuuuguggaauugccaaaaaugcauaacuucauuccaaucauaaaacacuggagaaacccaaagggaaggacguucuacuaaauaauugaucaggauucuucauaagugucaagguaaugaaaaagaaaagacugagaaacucuuauagacuagaggagaccaaagagaaauaacaacuaaauaugaggugggaucuuggaugaaauccuacauagaaaaaggauauuaauaggagaauugauaaaauuuaaauaacaucuacauuuuauuuaacaauauuuaauuaacauuaguuuccuguuuaagauaauuuauaauaugugagaugcccacauuagucgacauagugaggaauauaagguaacucuguacuauuuuugcaacuuuuuuguaagucuuacguuaguucaaaacagaguuuuuaaaaaagcuguauacgaucaucucaauagguacaaagaaagcuuuugauaaaauucaacacuuguucauuaggaauagaauaaaauuuuccuuaacuucauaaagagugucuuuagaaaacccagaacaauuaucauccuaauuggaaaaauauuagaagcauuccuuuuaaaauucaggaauaugacuaggauacuacuauuacuacuuuucuucaacaccguauuagaguuauuaaccagugcaauaaacauggaaaaauagauauguaaagauuggaaagguagaaauaaaacugccauuauuauagaugguuuacauaccuuuucccucugaaaacuacaaacaaauuauuagaaauaaugugaaaauuuagcaaaggagcuggauauaagauuaacauacaaaagucaaucacauuucuagagugacuaacaauaacaaaggaagcugccauugacaauaauauuauuuuguacuaauaguaauaaauguaacaaaguaugugcaagaccuaaaaaaggaaaaauuuuuaaaugaagaaaaacuaacaaagaaugaaauaaacauauacuuuauucauugauuggaagauuuaacauugugaagauuucaguucuuuucaaguugauuuguaaauucagugcauguucaauaaaaauccucguaagauuucaagggcucaguggcucaugccuguaaugccagcacuuugggaggccaagguaggaggaucucuugaggcaaagaguucaagaccaauaagauuuucauguaauuugauaagauuauaugauauuuauguagaagaguaagugguugaaaacagcagggcauuuuaagaagaaaagcagggaagaauaauuugcccuaucagcuaucaagacuuaguaugaaccuauaguaacugagauggugugguuuugcccaguugaagucaguuaaauuuuaauuuugagauuucuguaaaagauacaaguuuagucuuuuauuauguauauuugaagguguuacauuuuggaaaguguguguguguguguguguguguguguguguauaaaugauagcuaaauggcuucuaaguaaaauucagcauaucuuguauauguugauagaauagaaggggaaggaauguuuugaaauaaugaaaauaacaugguaugcaaaugcuuugcaagagauuugggaaauguagauaucucugguuuuaaggaugaucuagauucaaguaauaguucaguaauuucauaaaacucuuaugacaaaauucuggauggagaauauucuaugaauccccuagagaguuucagguuuuuguagaauuaugugaaaaaucuugaacuaauuagauaaucuuuagaaguuacuucacaaucuuuguuuuuacacauacacaggaauuuauggugcuuuauuuuuuacagguuaguagcuaaauaaaguauauucuaaaguuuuuuauugauguagggaaauggcuaccaguggacauuuugagaauauugcaguuguuuuucuucugaaagaguaaaccaauuugguuacucauuuuaccaauuugguuuugauuuugcaagugguuacaacucaugagaggauucuuauuucugaucaauauauuguguuuuuggaaaggacuucugggaaauaauuaugaugaagcccucgagcaauugcaacaaaaccaaaaauugaaaagugggaccuaauaauacuuuuuuaaaauuuauuuuuuagagacaggaucucacucuguuacccaggcuggagugcaguggccugaucauggcucacugcagccucagucucccaggcucaagagauucuucuaccucagccuccugaguagcugggacuacaggugcaugcccccaugcccagcuaauuuuuguauuuuuuguagagaccagguuuugucauguugcccaagcuggccuugaauuccugagcuccagugauccucuugucuuagccucccaaagugcuggaauuacaugugugagccaccacucccagccccagaacaacuauuauuaaaaagucaaaaaacgacagauguugguaggcuguguagaaaaggaaaugcucauacacuguuggugcgaauguaaauuaguucagccgcuguugaaaacaguuugggguuuucucaaagaaguuaaaacugaacuaugauuugacccagcaaucccauuacuagguauauauccaaaagaaaacaaauuguucuaccaaaaagacauaagcacuugaauauucauuguagcacuauucacaguagcaaagucaugcaaucaaccuagguggccaucaguggaggauugaauaaagaaaaugugguacauauacaccauggaauucuacgcagccauaaaaaggaaugaaaucaggauggugcaguggcucaugccuguaauucccacacuuugacaggcugaggcaggcagauugcuugaguccaggaguuugagaccagccugagcaagguggcaaaacccugucucuacaaaaaauacaaaaaaauuagcuaggugugguggugcacaccuguggccccagcuauuugggaggcugaagugggaggaucaccugagcccaggagguggaguuuacagugagcugagauugugccacugcauuccagccugggcaauagagugacaccuugucucaaaaaaaauaaauaaauaaauaaauaaauugcagcaacacagaugcaguuggaggcaauuauccuaagugaauugagggaggaacaggaaaccaaauaacauguauucucacuuauaagugggagcuaaacacuggcuacucauggacauagagguggcaacaauacacacuggggacuacuagagggagaggguugaaaaacuaccuguuggguacugugcucaguaccugggugacaggaucacuuguaccccaaaguucaguaucacgcaguauucccagguaacagaccugcacauguacacccgaaucuaaaguaaaaguugaaaagaaaagacuucuguucuuucaucuuuauagugagguguuacauguuuuacaaaccuaguucugauaaugugacaggaauauaaauuuaucuugaauauuauuaaauauauaagucaaagaucaacacaauguuuccaugagguagacuuuuuuuggaaucuaaauaaccauguguuuccauguaaauuuuuaugaaucagggacaaauauauaauuugauguuagagauguuuuuguuccccaaaagcucuaucuuguucaugaaaaacgaagcccagagaaguuauguacaaguucacagagcuuauuauugacaaaaccagaauuugaauacaacucuucugauuccagauuugcuggaaauacugugaaagaagaacucagucugguaguauuacgugugguuuuaauuuuuucuuuguaacuuuaguuugaauuuuaugugugugugagcaucugcauuuacuuuuaaaaacuuuuauuguaaaagccuucaaacauauacaaaaguagagaauacaaagcauaaugaacuuaaguaccuauuagccagcuuauuaaaacauggucagucuuguuucaccuguuacaucccuuuucuuuuacugucuaaaggaaggaaagaagaaacacaaaucaguuuauggagucugcuuucuaaaaaguacuuaaguguuuauugccaauaucuuauuuuggucagcaaucaaucacguacucaagcauacuugucuuaccuucagagaaauuaaaauuuaaucagcaaaacucaucagccuguacauuuaaaauauaugcauguuauuguacagaaacuauaccuuaauaaaaagugagaaaaaaaaugagacaggaaagagaaaaacauuuaaaggacauaguaacugaagaauuaaauaaccaauccaacacuugaaaaauauuacaauguagcacgugcucaaaagcucucugagcucagggaacaaagcagcacugugaaucuauagugguaaucauucuaugugguauuggguaggacaagacagccuugcagcuggaaauuggugaggacggaggccucgcuguggaaagaguaaggcacacucagggagagaaccagugagguggcucugagccuguuucagaaggggcuugaggaagaacggcagaggauaggauaguugggaaagcaggaucaaaucagacuccagggacuggggaaccaauuggcuguuacagggugguggagucaaaaaagaacagaaauuuucuguuugguuaauugauagaaaaugauauuauuaacaaaguaaagaaguaugggaacagcacaaguuuuuuggggauaguaaauaauuccauuuccauugauuaaaaauaucaaguuuguuuuuacaucuaaacugauucaagacuuagcuauuguacauguuuuagagaaagcaaaacuauauuuuauaucuaaucauacuuuacaacauaaaauacaguucuaaaaaauauuauuugugaagaaaaauauaauguugccaucuuuugucugucuguauguuuuuuuucccuuagauuccaguguaguuagugaaguuguacuucaagacuuacuggcauauguguccucaaaacauuccuaccucagagaucuuccuccgaggcagccucagagggugaacaguauagacuuuguagaauuggagcaccuucaaccugauguauuaguccacgcaguacuaagaguuguugauuucacuauacugacagguaaauauuuugacugccuccuuaauuuuagauuaugaaaaaauuaagauacaagaccaucuuaguguaccauuugguuaucacuauauauguaucaucagcuauuaaaguaugguaucacgugugauagaguaaugccaacuaagguacucauuuuccuuuuccagaggcaguauacaguuauagaggacagaagcagaaaaaaguuauguuaacaguggaacaggcccaagaucaacauuaugcgcuuguauuaugggguccuggagcagccugguacccucaacuucaaaggaaaaaagguaaauacaccaaaaagcauuuaaccuauuuauauuucgguaaaugauuaauguuuaugagcccaagauggagaaaaucuuaagagacgagacagcauuugaaauacaagugaucaugauugaauauucuucugcaaauuucuucuguuaaaauuuuguaccucuuguagcaauucauuuaucuaauaagucuucauuaauuaaugguggugaaauaaagucuuaaauuuauucccagguauacuacuuuacccuuuuagugaagaucuuaccuccuucaaauaauguucuuuaaacauuuaauucuggagaagcuucuacaauuuuuuuucagccagaguacucugauaaaugcuaugguuauaaggcagaugucaagggaguuaccuuaacucuuucaagucacaauuaauguucaauaaauuacuguuucauauuuuuauuauaguuguuuuaaaagcaugcacuguuagccaucccuagaauguucaguguuaaaauaugacccaugauuacauuuuucuuuaaagcauaaauuauuucugguauauugaauuaaauggaauugauguuucauuaaaauaguauagugucuucccuuugcuauugugagauccuuuaguuguaacaaagacaguuucauuuguggcuuaugaguuauuuuucccugcuaaauuaauuuagagauugauucaguauauuauuauuuuuuaccugaaagaguuaaugucucuccaaacuucugccuuccaaauaguuauuuguagauaggagcuaucacauugucucucuuaaucauuaauagcuaugacuaggauuugagauaagucuaacuuuggacuuuuauguuaagaucaaacagggacagauguuuguuugguugagcaagcugacaaacauguaucagugauagacuaacuaugaucauugaccaccauagccuggcugagaacaugagucuagugcaugcuacacaagaauguaggucacagguauaguggagccguaacaaagcagauugcuccauguuuaaugugaauauucuuuuaaaauuaauaguuuuuugguuaauagaagagaaauuacaguugucucuaggugauucuaugguguuuagguuaguauugaaaacauaugaauccaggaauuaagauguuguuguucuuuguacauucauucauccagccccccuuauuuauaaccaucauuuuaaaguuuuaacaucuacuucaauaccucacaucagucuuuuuaagauaaaaaucccaauuuugaaggauuacuuaaguaauucuauuuuccugauuuuacuuuucuuuucaagagaccaaccccauuuccaaauucccagcaaagagaaucugauugcccagaguaaauuugauucaaaaaacugugaucaggaagacaaggucacacaauacaaauaugagagcuugagcuuauuucaguggaugggaaaacaguuaagggagucauuugugaucugggugaauacauaaagauauucacuaccaaaaauguguauguucauuagcuuagaaagauauauguaauguauuauuuaguuuaaaaaguagauuauaggccaggugugguggcucacuccuguuaacccaguaccuugggaggcugagguggguggauugcuugagcccaggaguucaaguucucaucuuaaaaaaaauaaaaaauaaaaaaaaauuggauuguaaaacuucacguauagaaaauauguuaucauauaauaaauauuuuuauguuuauauaaguuaauacauaaaaauuuucaagaaaacccuuuauauauaauaguaucucauuuuaauaaaaauguaucuauaaguacauaugugcauuugaaaaccuggaaauaugcauguauagcaaaaugcuagcagugguuauuucuguaugguaguauuauaugugcuuuaauuuuuucuuuauaccuuuaguuugaauuucauaugugugugagcaucugcauuuacuuuuaaaaacuucuauuauaaaagccuucaagcauauauaaaagcagagagaauacuaagcauaaggcacuuuuuuuuuuuuuuuuugagacagaguuucauucuugucacccaggcuggaauguaguggcaugaucucugcucacugcaaccuccucaaguuauucuccugccucagccucccaaguaaguggaauuacaggcaugugccgucaugcccagcuuauuuuuguauuuuuaguagagacgagguuucaccauguuggccaggcuggucucgaacuccugaucucaggugauucacccgccucagccucccaaagugcugggauuauaggcaugagccagccaccgcacccggccagcauaaugaacuuagguaccuauuagccagcuuauuaaaacauggucagucuuguuucaccuguuaccucccuugucuuuacuguuuaaauauuucacaauaaauauauuuuauuuuauaauuaaaaauaaaauuaaaaccuuaugcuuuuuaaaauaaaagaauaguuaauguuuggaaaaucuagcuaacaaugugagaaaaaauagaauuaaauuuauacuuuauguuugugccaauauaaauuucagauacauuagagauucaaauacaaaaauaaugaaacaaugaauaguagaagaaaauauaggcaaaauuauuuguaaugcaaagguugguaggguaaauaaaauccaggaacaaaaacuauuauacauaaaaaccaccauguacaaaauugaaaggcaaccaaaaaaaaacagaaaaaaaauuacauugucagaaaauaaugcaguaagcaaaagacacauaucuauagagauaaauggggaaaggauaugaguaggcaaguccccaaagaagaaauaaaaauggccaauaaauauauggaaaaauuguucuuacaaguaauugaaaacacacaaaguaaugaugauagaugauuuuucuuuuaagaaauugauagagaagauaugggaaaacagcuacugucaucagcuauuggaaaugcaaacuggcagaaccuuucuugaggauaacugacaauuaauaugaacaaauuggggguacuuuuagcccaauaauuuuagcuauaggaacuuaucauaacuauguauaaagauguagcugaaaauggguuuaucaugguaucauguauaauugugaaaaauaaaaaacaaccagagucccucaaaauagagguuugcuguaauaauuuuuaagauuuugguguaucuggacaauggcauauuauguaauauuuaaaagcaauguagaauaauacauacauauaaaacuauauuugacuuauuaagucaaucccaauaaauaaaaucccaaacaacugguuguccgcuaaaauguuaacugcuuauuuaggguguugagauuauggcugcuauauguuuauuuacuuggcuucucuuagcuuacuuuucuaaucagguauuuuguaauaagacaagaaagcuauuuuagugauugguuuuaagcaguaacuuggaauauaugcuuuaguucuagcuagugaugcucugucuuuacagauuuacugagauguuugaugauuuuccaccaaaaaaaaaaaaaaaaaaucucuagugaaagaaacuaaggagaugagcagguguaguaaauuagauuuauggccugaagugagaaacuaaaaagacagcugauguuaucagaaaaauuagugcuaagaaacccucuuuuguuuuauuauaguuuugaaguugaauuuacuaauacagaauaugauaauacagauaaguugaauuuacuaauagagaauauaacaguaauaaggucuguguuauuguggcuuuaaguauuagaauuguggccggcgugguggcucccgccuguaaucccagcacuuugggaaaccgaggcgggcggaucaugaggucaggagaucgagaccauccuggcuaacacggugaaaccccgucucuacuaaaaaugcaaaaaaauuuagccgggcgugguggcgggcgccuguagucccagcuacuccggaggcugaggcaggagaauggcuagaaccugggacguggagcuugcagugagccgagauugcgccacugcgcuccagccugggcaacagagcgagacuccaucucaaaaaaaaaaaaaaaaaaaaauuguuacugagaguuaaaaauaaguacaauugugucuaaaugcuuuuuguucuagaaaaguuaacuaaaauaacuauugaaauaugagugaaauauuagacuuggguucauuucaguguccuuucuuuaacaaaacaaaacacaacuuugccuauagauagauacaugagaauuuucuuuacagaaagcaguugguuauuauaaaugaugaccguucaggagggcaaggaaucuuuagaaaauauuuuauuaaaauuaucucugguggcccggcacggaggcuuaugccuguaaucccagcacugugggaggccgaggugggcggaucaugaggucaggaguucaagaccagccugaccaacauggugaaacccugucucuacuaaaaauacaaaaauuagccgggagugguggcacgcaccuguaaucccagcuacucaggaggccgaggcaggagaaucacuugaaccugggagguggagguuucagugagccgagaucacaucacugcucuccagccugggcaacagagugagacucugucuuggaaaauaauaauaauaauaauaauaaucucuagcaugcuucuguugucuuaaugcaucauucauauuuugucucuguuuacccaaauucuuuagugauaaaagauuagauucaacugacuuaaucagaucaaucuauuuaaucugauacuaagccuagauuuuuuuccuuuuuggugacuuuuguuuuuacuguuuuuuuuaagguuauauuugggaauuuaaauaucuuuuuguucagugcaauuacacacuagaaaaccuagaauugcauacaacgccuuggucauccugugagugcuuguuugaugaugauauaagggcaauuacauuuaaagcaaaauuucaaaaaagugcacccuccuuugugaagauaucagacuuagcaacccaccuagaggauaaguguucagguaagaucuuuauauacauaaauucugcuauuuuuauuucuuuugaaacagggucuugcucuguugcucaggcuggaauacaguggugugaacacagcucacugcagucuccaccucccagguuuaagugauucuccccguucagccuuucgcguagcucaggagggaagggaaggcuagugcauaccaucagugcaugccaccacacccagcuauuuauuuauuuauuauuuuggcagagacagagucucccuauguugcccagucuggucucaaacuccuggacucaagugauccucuugccuuggacucccaaagugcuggaauuacaggcaugagccaccacacccagcccacugcuaguuuuaauauaagcaaaaaggcuaccacuugugguaaaaauguauaauucuauauaaaagugaaauauaaaucuuugcaaauaucugaacuagauuccaguaguuuuaggaacuaugugccaggaaccagggacaaagagcaaauaccuauuuuuuauuauaugacaagugggagcagaaauucaguuccuuacuuuaucuuggccaaaugccagauuaaaauguuacuaguuggguuaauucacauauauguauaaauauguuuuccaauauaugauugaagguuagcauuguuauaucauaaaacuaugcuaaggagaauacaggcagaaaacaaagacaauaccucucaaaaaacccaacuuuuaauugaauacagagauuucauucucaaagaagagcuccuuauuccuaguucuacacugaaacauuuacuaauaccagcagauaguuuaaauuaauaauauuucuggaagguaaacacagaugauagaaaauuuauaagcuuuuauacuauaaaaauuucauacuauuuucaaaaauggaaguugccuauggucauaaaagacucuagauuuauacuaacugguaaaaucuugguaauguuauagcaucauguaaguuccuaagccaguuuuauauuuaugugccccucccgugcucugcuucuccaacuucacagacauauagagguggucaccacaggaaggaaugccagacacaguugaggggcuacauuacuuugcagagacguuuaguuuggugccauggagaagucaacucuguuauuuacugcuuacacaaaacaguuaucugcugggauugaagucuagaauuagguuuaaaaauaaaaauaaauaacaucauggacaacaacaaaauaggaggccaccaugcugaugaugaaagauucugaggcuauagccccacuuguuugaggacgcagccaggaauugugcauguucuuggaaguccuggaggugugcuccucauuagcaagccaugccaaaacugugccauuaaaaucaguccuucagaggcuuuguucacagaggccuguuuagccucuuucauucucuuuauguucagcuaugagggcugaauucauaguuucugucauaguguauguguuuuuaagacaaaaauggggagagaauaugaaaacacaaggaacuuuucccuaaccuauuuuauaguuaaacaaaaggagaaagagagaucagcaugggagcauuuccuagaagggucugcuugcucaacaaaagccagagggggaugaggcuaggccugaguccuuguaaagaaaugaagacgcuuacccaguaccucaucuuaccgccagcagaauuucagugcucagccggagugacccccuugaaagcaaaguccacauucagcaugaccuuuuaauucuuuucaagaguuguguaaauuuacaaaaugauaggauuaugugaacauucuuuuaaaauuauugaauuauuaagaauuuuuuaggcugggcaggguggcucaugccuauaauuccagcacuuugggaggccgagguggguggaucauuugaggucaggaguuugagaccagccuggccaacguggugaaacccugccucuacuaaaaauacaaaaaucagccaggcaugaugucgggugccuguagucccagcuacuugggaggcugaggcaggaaaauugcuugaacgcaggaggcagagguugcagugagccgagauugcaccacugcacugcagacuggguaacagagcaauacucugucucaaaaaaaaaaaaaaaaaaaaaaaaaaagacuuuuugaguggagggaggagagcaaggguuuaaaaacuaacuguuggguacucugccuacuacaggagacucuacuugggugaugauaugcccauguaacaaaccugcacaucuacccucugaaucugaaauaaaaaucgaaauuuuuuuuuuuacauaauuuuuuaggccagacacauuggcucaagccuguaaucccagcauucugggaggccaagaagaguggaucacuugagcccaggaguuggagaccagccuggucaacauggcaaauccccaucuccacaaaaaaauacaaaaauuagccaggugugguggugugugccuguagucccagcuacucaggaagcugaggugggaggaucacuugugcccagggagguugagacugcagugagucaagauugcaccacugcacucuagccuggacgacagagugagacugucucaaaacaaaaaaaaauaauaauaauuuuguagugauuugacaugucuuuggaaagaugugguauugaaucuucuacaguuuguuacauauucgaucgcuacacacuccugcuaacucauguagggauaugugacacaauuggaagagaugaugaaaccaucuuugggcauugaaagacuaaagcaaaugaaguuaagaacagaagacucaucauuaacuggacucugaaagagauaaccagaaaacaguaggagacuagagugauuaguucuugaccuggaguguucuuacuucuaaguggaugaagaagaacaaauuugaaggcuuaaggcuuaaagaagccuuuaaauugacuauggagaaagggagaauaaugcucaggaaaacucauagaccucaccaguacacaguaagacgaaaguaaauuaggaaaaaauaaugucugggagauaguagauauucaguauuuguuuacuggugaauggaugagccauuagcagugaauuaugaauaugcuugagguuucuugugagucaccugagaaacgauuaauaaaugagaacuuuuuauaacccacacccagaguauauagaugauaauggugagcggaaaguuggaaaaaaguuuaaaagagaacaggcuauugauauuuuuagguagagagaagaagaaaaguucaccuccuauuuggcuuuuuuuuuuuuuugagacggagucuugcucuuucgcccaggccggagugcaguggugcgaucucggcucacuauaagcucugccucccggguucaagccauucuccugccucagccucccgaguagcuaggacuacaggcgccagccaccgcgccuggcuaauuuuuuguauuuuuaguagagacaggguuucaccauguuagccaggauggucucgaucuccugaccucgugaucugcccgcgucggccucccaaagugcugggauuacaggcgugagccacugcgcccggccccuauuuggcuuuucacuaugaucaguuuaagagaagacagggcaaggagagaggacauguuagcuaguuucaaguauucgaagggauuucuucuaaaggagguauugaacuuauuuugccugauuccagaggauggggaaggaaggaaacaucacauguucagccaaauuagccaaguaaaccugcucucaguugcagccagacaucccugcccuuagauucuaggaaaauaguaaagaagacgaagaacaagaccucaguguauccuuuuacuacaagugacuguaaaucaacuauaaaauuagccauguuuguaaauuaaaguuauaauuuuggcccaauaauuuauaauauaucuguuuguuguuuguaggagugguucugauuaaagcccagauuucagagcuggcauuuccuauuacagcaucucagaagauagcgcuaaaugcucacaguucucugaagaguauuuuuucuucucuucccaacaucguauauacugguugugcaaaauguggauuggaacuagaaacagaugagaacaggaucuacaaacaauguuuuagcugcuugccauuuacuaugaagaaaauauauuauagguaaggcaacuaagcaagccaauuugauggaaaauaauuauuauagaucuggaaaaauuagucuguaaacccuuacuuucuaaaaauaauuaacuagagcuagucgaagagaauaaaauuuuccgagugauagauagcuauuuauggaagcaaaaauuacccaggaaucguuauaggaauuucuuaaagauaggaauuucuuaaagcaguaauugggagauuuuauugucuucaaacagcuguaccaaagaaacauuuuccuugguuuacuuuuuaaccaaaaucuaaaugcucauaaauaacucauuuucccaccuuaacauagaauuuaagggcuaaaaguaucauaugaucucaccucugaguuguuguggaagcuaguaagacauuuaagguguuuucccaccuuuaccuuagaaauuaaagcuagcaaauaaauguuguaugguaaaacugcuaaucagcucagugaaaaacacauuguuuuuugaauaauagguagucaaaagcucagauauuuuucucuuuaccucauaaauuacauguguuuacaaaauagcacucaguguuuuaugcuccuuaugauuauuucuaaauauugcgguaucuaaaaaccaaauucagauauauuccacauguuaucauggcauacuucaagaaaaguuauagaagcuuaauuuguaaaccuuauuucucuuuacagauauuauguuuguuauaaauaagugaauaaauuuugcuauuacugugaaaguugcuuuuguggaaaagaagauugaauuaagauguaugguaggcugggugugguggcucacgcauguaaucccagcacuuugggaggccgggguggggggaucgcuugagcccagggguucaagaccagccugggaaacauagggaaaccccaucucuaccaaaaaaaaaaaaaaaaaaaaagcugggcaggugacauaggccuguagucccagcuacuugggaggcugaggcaggaggauuguuugagcccaggagaucgauuguuacagugagcuauguuugcaccacugcacucuagcuugugcaacagagugagacccugucucaaaaucaaaacaaaaaaugcaugguauguaacaaacaacauugauuuauuaauaguuaaggccccucaaaaguauguauaggugacuuauuuaugucauuccaaauguuucuauucaauauaagcauuuauuggacaaaaauguugcucaauacuauuccuuauggggaggagggccuuugaaucuuuaguuuacaaaaugacuguucaagagaaggacuucacagaucaguaucaccugauuauggcauaacuaguaugagguauuuaagaucucuuccuaaacuauaccacauuaaagauguagugcuaguuuguugucuuacuagaauguugaauggucauguuaaggcaagaauuauuauuuuuuauuuauuuacaagccuuuuuuuuuuauuuuuugagacagaguuucgcucuuguugcccaggcuggagugcacuggugcgaucucagcucaucgcaaccucugccucccagguucaagugauucuucugucucagccucccaaguagcugggauuacaggcaugugccaccacgccuggcuaauuuuguauuuuuauagagacaggguuucuccauguuggucaggcuggucucgaacuccugaccucaggugauccacccgucucagccucccaaagugcuggaauuacaggugugagccaccaagugcagccuaaaagccuuuaaauuguuauuagaguccagauuauaugguuuccuugaaaagaaaauauugaaauuaacaaacucccuucaaguuaucaaguaugugacuccaaaaucaucuacauaaaucaaucagcaaacugaauaagagaaaacucucauugauuauuuuucuaagacucagucaaauauuuauuaggaauccacguauguucacauaucacauauguacuguggauguuauacuaguugaccuaaguagacuuauugugcccaagaagcuugguaguccauuuaagaaacacuuaaugaacauuuguguggcauaacagucccagacuaugaguggguugaucauauuuuacauugguuguaacuuggagcugauuuuccaauggaagcaacauuagauauugcauuggagucucauacgaggccacagacauuuauuaaauuaacauguagauagcauaguuccuguucuucaagcuaucauaaaacucaaauaccauuuuuaacaauguuucuacagaauauucagauuuacauuuuuggaauacaagaaauacauuuauuuuucuguacuagaagcaaaaaaccccagcaggucaaaccacaauuaaggcuccuauuuaggcagcacuaggaaauguuugggucucucaagagguuauagucaagguguaggcuggggcugcagucaucugaaggcuugacuggggcuggaggauucauuuccaaaguggcucauucguauggcuggcaaguugaguuccucuucacuugggugucuccacgggcugccugaauguucucacaaaguggcagcucauuuccucagagcaggaaaggcaagaaagagaguuccagguggaagccagccuuuuugugaccuagacucagaagucauguggcaucacuucuaccaaauucuguucaucagaagugaguuagcugugcguuggagaguggauuagaaugaagcuagugcagagaagcgguaagaggcuguugccuuauuuuggaggggagaugaugguggcuugacuagagaggaagugguaggaauaaaaagaaguggacagauuugagaauggucggaaaauaguuugcaagauguagugauugguagguaaagagagagcacagguacauugcaaaucauugacaguugggugaacaauaagauuauuuauuaaaacaaguaaccuugggagaaauguugaucauauugagcuugaguuccugagagguaacaaguuggaaagugguuagauguaaagaaaugcaauuugcaagagaagucugggcuaggcuuauaagguuauuugugguaauugaacuuuugcuugguuucugcacccuguuuuguuuuuccuucuuaaucuucagugauuaccucucauaauggauuauucucacuagccuauaaagacacucccauauuucuuuuauuaaaaaacaaacaaaaucauccauuaacauuacaucucccucuugucccuucguuuuucuauucuguuuuauacccagccaaacuuuguuaaagaguuuuaaauauacucucucuccccuauuaugucuucaguuucacuucaguuauuccauucuacuccuaccaugcugcagaagcugcuuuugucaaaguuacacuuuugauguugccugaggcauggauacuucuuuccucacucuaacugcucucaguuauauucagcaugucaguccacuuccuccuucuugaaacagccuccuccuugcuuucuaaccugucucucaggcccuucuuucucagccucuucuacccccucuuuaaaugcugggguuaaucuugagcucucgucugcguccuuccucuuauucuuucuguacauucugccuggaugaucacagcuguuuucguauuuguacuuaacaucuucacccugauuuucuccuccaggcuccaguagucagguaucaaauucuuugcuugacguccaucucacauuuaaacauacccacaauagacucuuguuuuuccuaaccacacucaaaucuaguucucuucauuuuuauacuuucuggaaaauggcacaccaucuacccaauuauuuaggcuggaaaccugggcacaaucgucgcaucauuuucucuucccuaccuccccuaucuaaucuauuagcaaguccuaggaauuuucauucagaacuauaucacaaauucauccacuuuuuuccaucuccacugcuaacaucuuaguccaguguaucucagcaggggcauuguugacauuuuucucaggacaguuucucauuauguaccauaucccacaugcugcggggcauguggcaucccuguuuaccuuccccuagcugaaccucaauuacugugaaaccaaaauggaaagucagugccugcuggucuggaaucacucaggccucaucugagucccuacgaccuguugcgcaaaccagcacaccagcagucucuugguggggcuccuccuggccuugccuccuccccuuuauucucuacccauuggcagugugauuacccuuugccuuugcuucacccaucagucgucuccuuaugcuuguuuccucugcagucucaucugcugccacuccccugucguccagcacucuagccacguggccuucuuucaguucuucauuuugauuuuucuccuuaggauguucucgaaugucuuccuucugucugacuccacaaggcugguuucuucaugucuuagauuaaaugcugcuuuaucagagaggccuuuccuaaccacucuucuuuauuuucuguuauaguagccugggugugcuuacuguaauuuguaguugcauacugucuuuucuagaaaacauuuuuacugaaguuaaaauucauauaccaucaaauuaaucuucugaaauguacaauucaauggcuguaguauauucccagggcuguguagcuaucaccacaaccaguuaggacauuuucgucacccagcccuuuacaaagccucauacucauuagcagucacucuccauuccccaugccccucaaccuauggcaacuacgaaucugcuuucggucucuauagauuugccuguucuagauauuuuauauaaauauuauauaauaugugaucuuuugugacuggcuucacuuagcaugauguuuucaagguccauccauguuguagcauguaucacuacuuccuuuuuauugcaaaauaauauuguauuguaugcauauaccacauuuuauuuauccauucaucaguugauggacaauuggguuguuucuacucuuuggcuauuaugaaugaugcugcugugaacauuuguguacaaguuuuuguguggauauguguguucauuucucuuggguauauauuuaggagugguggaauugcugggucauaugguaacugucuguuuaaccuuuugaggacuaccaggcuguuuuccaaaauugcugcacaauuuuacauucucaucagcaauaugaggguuguaauuuccccauauucuugccaguacuucuuauucuguauuucuuuuuguugcaugugcuuucgggucguaucuaagaaaggugucauuucuaagccaagguuauggagauuugcucccguauuuucuucuaagaguuuaguaguuuuaccuccuacauuuagguuuauuaucuacuuugaguuaaguuuuguaugugggauaaggaagggguguaauuuuauuuuuuggcauguggauaucuaguugucccagcgugaauuuuugaaaagacuguuccaucccuguuuagucaucuuggcaccacuguugaaaagcuuauuuucuuucuucuucuuuuuguagagaugaggucucauuguguugcccaggcuggucucaaacuccuggccucaagcaguccuccucaccuuggcaucccaaagcgcugggauuacaggcaugagccaccgcgcaugcccaauuucuuccuaucccucuacaguuuuacguuccuugagugacggaaccagauuugucuuuuucacuaguggguacccagcacuuaccacaguccaugauagauacucaguuuauauuuguugaaauaaauaauggagggagagagaggcugaggaaagaguguagagugaaaagaggaaggaacauagagucaucgugugaauaaagggggaaguggguuuuuagggggaaaaucaguaguuauguuuuagcucugucacauuaaauucccccgcuaaugagccuguuucugaauucuguucucaauuuauuuuuuaaaaaucaauguaguuauaaaauagguaccacaugccaugauuaaaaugcacacuacauaggagguuacaaaacaaagagugaaagucuccuucaccauccaacccucucucaccagugcugcuuccauugcuggugagaagguuuuuuguauguccuuccagugauuuauuauguucaucccagcacauguguaucccuuucuuuagaagcauguggacagaagaauauuguucauguuguuguucccuagagucuauccuggugcuccuucccuaauagcacuugcaaauguucuucauucuuuuuaucagcuacauagcauuaagauguaggaugcacugaaaauuguuaauccaguucccuguuuauugauaugcaaaacaguuuauuucugauaggaaagaauucaguugaaaaaaguaacuugaaauugugauugugaaauaugugauuauuauuuuuauuuucauuucuaaaaauaauuuauaaaacaguuuaauauauuuuuauauuaguaucugaaauuuaaaaauggauauagaauaaauaaaauguaguaauuuaucauuugaagcucuuggggaaaaaaaaaaaccuuuuuuuccuucuaggaugucacagaacauccuagaguuguuuuaggcauucaaauuaauccugcauaaaaaccaagugcuuuuuggaauuauuuuucauuuaagcauuucuuuuaucugaaaaucuuuuugaaggucguguguuguuuacucuuuuguaggccagcguuaaugacugccauugauggaagacaugauguuuguauccguguagaaucaaagcugauagagaagauucuucucaacauuucugcagacugccucaacagagugauagguaauauaucagugugccaucaagaaguuguuuuauucaggaguauaaaugguauaucggaacagaaagagcacuguacuuuaaauuaagagcuuuucuguccauaugaaaaccgaaggauaauuuagcuuaagugaaauauaagccuauguaaguuagaagguugacuugcuuuacaccuguuaguacaugaacagcgggaggcaccuaauuucuucuuaaccuacauuuccuguugguaagcaaaaacuauuuuacuuaacucuaguuuuauaagagugaagucaaugagugugugacauaauauauaugaagauaguccacugucaguggaauggauuugcaagaucuucaaccgugaugucuuaguugucaguggcuaagaauaaagcaaagauaauauauuugucagguauucaaacuccauuccuguucucauuagccucagauccucuaagcugaugagcuaaucugguuccgugauugcuuuaucuuucaauaguagauuguuuuucguguauuuuuuuaguugggggugucuaguaauuuuggguugaaugcugaacauugcauauauuaaguagaacaguacaaacugagguaaauaguauuuguaccuggaaacaggcaugccucucgguccuuuacuggaggugaggggugagcaggauggucagucuugucauaaguugaguuggauucagguuuuguuguuucucugguuaccuucaggucaccacugguuucaaauuaucuugugcuuauggugggaagugguuccccaguauuccugcuccaccaucagcauagcccuccacucugcaccugggccucagagaaaguuucuuuccacguucuugcaccuccccaaguugcacaagcuuuuguugguuguuauuuggugcauccuaaccuggugggcgggagcaggguuguuccucuuugauucugguccagccccagucuuauacaggauguugaauauggcgcuuucuugguagcccugucccuuauguggcauggcagcugagcucugucuugugccuuuagugggucuugugugguccuggcccugccccagcaguaggggaccacuaauggucuugacccagggugguuuuucaguccucccccaggauggagggguuuuuuuucuuuuuucuuucccccaucuguacugguuccucaccuguacccuggggcaacaggauuuggugucccuccuccagcaguugaaggcuuuuguuccuuaaaggggaggccagauggugcuuuguguuuuguaguuggaagcuuucucugaugucuugcccugcccccagucuuaugagcaccugguggaggugagacuacuauguggaagagccugugaggaugcagauguuccuuauguugcugacacuggcaguucauuggcuuuuugcaauuaauuuauuaauaaaaauuaaucacauucuucuuuccugccuguauggaggaccugucuucuucccaaggccugccccaagggaaacugugcuccuguuccaucucccuggaggcaccugucuccuuauguuucagucuuuuuggcuguuuuacaaccuugguucucauguguauucaagaaaaugaugauuugauauuuauucaauuuuuuccaguaacuguuaggguaggagccacuuuuuccagcuuucuacaucuuaauuagaagccucucuccguuuuuuucccccauuuucuuuauuucauuuuuauucuuuuggcuauuuucauuccuuuucuuaauguuacuuauauauuuucaguguaaucucuucuuuuuuuuuuuuuuuugagauggaguuuugcucuuguugccuagacuggagugcuguggugcgaucucaguucaccauaaccucugccuccuggauucaagcaagucuccugccucaguuucgcaaguagcugggauuacaggcaugcgccaccaugcccggcuaauuuuguauuuuuaguagauaugggguuucucuauguuaguuaggcuggucuugaacucccaaccucaggugaucugccugccuuggucucccaaagugcugggauuacaggcgugagccaccguguccggccuaucucuucuuuuuugcauaauguaaauuagucuuuaucucuuagagaagcaucauucucauaucacauauacuucaguguuuuguccauucuugagacaauuaaaguuguacuacuuggcauuaauuagauugugaucauaagucaaaaugucauugguuauaaaguggucaucagaccaugcagacuauuacuaauauugguuauguuuuaguuuauugcagugaaaauacaaaauuuaaaaguuauuguagagaauuaucauaccccccaaaauaugucauugguccuccaggacucuguaguccccauccaagaaagacugugauaauugucaagggguuaguacggucugagcaugguugauggugcucugucauucugguauugaacaaccugccaaaugucuugauuacauguccuaaaaaagugaggggaagaguguaggacaaaugcaaaauaaaauaacacauuuagcuauacuuuuaguauuuuuuauuauugagauucaauauuuaagugaccgauucaagauucuuuuauauaaaaaaugaauauaugcauaaguaacugugauaagaacuguggauggauaagagcacuuuucugauguacugcagcauaaccagaacugcugucggucugaacgguguguuaucugggccuguuucuugugucagggggaucacaugccgucacucuggagugccucaauagcuuguaacuagaaagagaagguauagaaagaguaguuuacuuaccuguuuauuuauuuagagacagagucuugcucuguugcccaggcuggagugcaguggcacaaucucagcucauugcaaucucuaccuccuggguucaagcaaaucuccugccucagcuucccgaguagcugggauuacaggcaugugccaccacucccggcuaauuuuuguauuuuuaguagagacaggguuuuacuguguuggccaggcaugucucgcacuccugaccucaaguaauccggcugccuccgucucccagagugcugggauuacaggugugagccaccgcuacuggacgggaggagaaauuuaaaauggguuugagacuugaggaaccaaaagaaacaaugaaaccauucaaugugugugcuccugucaagcuagcagcgaucuugggagcucuguguuuuugucuuuugcaguuccuuccucagagaucaccuaugggauggucguggcagaccuguuccacuccuuguuggcagucagcgcagaaccuuguguauuaaagauucagagccuuuuuguguuagaugaaaacagcuauccauuacaacaagauuucucccuccuggauuuuuauccugacauuguaaagcauggagccaaugcccgucucugaggccagaggaagaaauugcaggcauuucaaggaagaaguacugaaaugauuugucuuuugaaauaaaugaaugacagggcuuuugcuuuggauuuuuuaugaaauauauuuuacaaagagaauugcacuagauauauaaauuaaaacuuuuuucuaagaaaauccugugagguuuaaaaagauuguuuuugucuuuugguuucuuacuuucuccuggagaaaugaucuaccagucaaggcaauauguagcagaucccugggaauuaaagguuugcccauuuguucacuguauuuagucccugcuacauuccaggcauuguacuaaguauggggaaccacagagaagacauucccucagaaacugcugcagugcuuucgcuuaucccuaccuaaaaaaccgucaaugugaaaucauuuccuugauuauaacuauaaugauaauggauuaguuuauauaaaccuauguuuagacaaguucaagacaagcgugucuuucuauaaaaaguauugaaaaugaaggaaaugagaucauguuucaauuuauuaaagcagggaagagcguucugugcuuaguucgugucuaggauuugagugccuuacugaaugcauuuaccagcaaacauguagcaaucuguucucucauugugauuguggaagaagcucauguaaaaugauagucauuaaugaggaaguauggcgugguacuuauucuguaaguucagaguaugcugaguguuaauagauuaucauauugccugaaaauaaauucaugaugacaugaa

SEQ ID NO: 192481 - RNA, 44818 nt, Homo sapiens
gcgcugccgccagcgaggcccggggaggccgcggcggaggcggaggcccggcgcccugggcggcgcccuguccccgaaguccguccuccccguuagguggcgagcgcccgaggggaggggacagccgggcaagcaggaagcugcggcuuaaaagggcaacccgcgcgggacccuuccucccuagucgcggggagucugagaaagcgcgccuguuucgcgaccaucacgcaccuccccuccgcuuguggccauguaccgcuaccugggcgaagcgcuguugcugucccgggccgggcccgcugcccugggcucggcguccgccgacucggccgcguugcugggcugggcccggggacagcccgccgccgccccgcagccggggcuggcauuggccgcccggcgccacuacagcgaggcgguggccgaccgcgaggacgaccccaacuucuucaagaugguggagggcuucuucgaucgcggcgccagcaucguggaggacaagcugguggaggaccugaggacccgggagagcgaggagcagaagcggaaccgggugcgcggcauccugcggaucaucaagcccugcaaccaugugcugagucucuccuuccccauccggcgcgacgacggcuccugggaggucaucgaaggcuaccgggcccagcacagccagcaccgcacgcccugcaagggaggugagcgucggccgggccccgucccgcccucccugccuccccugcggcccuccccuccggccuccugccggugcggggccgcugcucagcccagcccagcccagcuggagcgggccggguccccgcccgggucaccccgccucggauguggccggcucuguggauggugauuuuuccgccuuaaaaucaucaugcgauuggccugcccccucccccgcgccgucaccccgggccucuguauaugcugaucuugcaugcagaguagacgcugcaccggucuccuuuuggucccggugucugugucacacacggcggguccugccgaaaugcacuucuaggaaagggaaugaccugcccgugugauaaugccucgucaguguucuugggcuuuugugagucuccccuaaaugcaagcugucaaauuauuuucugguauuuguucacuccuguuccaauagugacagaugauauccgaacauagaaaaugacuuggcuucuaaguuugaaaucuagacaguuuuauuaaccaaaggaauuuacuaaucacgcguuaaucguuucaauuaaguaauuuucccauucugacaaguucuguuuuauaccaaaaaaaaggaaaaacacaaaaaaaucacaagcaauguaauaucucugacaaauaaacaccuggcguccugacaguaaauuuacagguuguaggcugcggauggccagccagccaauggaaugaaauagcucuggggguguguacugguccuggcuagcccugaauuugagcuucaggaaaaauauaguacgugaagaaaggggucagauaauguuugguagucacuggguuauccugugguuuaaaucauuuaaugucuguagauuuggccucuguagucagauugcuuucuucgagcaaauaagagcuuuuuuccccccaauacauugcaucauaccucuuuaguaacauaaaauggaaaggacaaaccacuuuugucuacuguaaaaaagaaaaauuauauggaauaaagagcccagggaggcgaggagucuuguuggagguggauuggcugagaagcacagaggauguugggcuagacccaugucucaguaaaccugguucuguggucuuucaguuaugcccgcugacuuaugaggauuuuuagaaauccucucuguaccggaaaaaacuugagcggugcugguguucccagcaggggggacaaagguuguuuuuaaagauuuacuaaauuugcauugaccccgcccacuucuaggacuuaacuuuggagcuuaauuauccccuagcucugguugccucagccaaaaccaauguuugaaccacuuugaccucugauuuccuuucuagcuucaaaauuguauaaaauguacacaccgucagucuccuacauuugccugccuucuuccuaccacucccuuauuauccaaaccaggaaaacaaguucagacuccaaagaaaggcaaauaaggauguuggaggaaguucaggcaauguuuagcaaauauugaguugcaucguuuucuuaaaacggacaucaaguuuauuuuuuacuaucuugcuggcagcauuugccaguccuuuaaaagguguacagauaaaucaguguaugugguuuucugcaggaugauuuggucucugaaauccuuuuucuucgauucuucagaugcccagcucucuccuguuuuuauaagucgcagcuccgcaaacucacugaagcaacucguuuaccauaguuugugaguccucuuucucuuguugccacagcaguuuuaaugccaaaauauugaaccuagcaacaaauugggucagccauaccaaagcacuguuacuguagcacuugcuuguacuagaguguaagauacaauuuucuguuccguuuaucccauuuacaaaaaaacaugcuauuaacccccagcauauaaacagggagaaacugaauuguuacuaguaaacuguugcaagcauugauagaacaucaaagaaaauuggccucuacaaagugacaaauuuauuaucuucaggaauuugaaaggcuuucuggauuggggaagauuacauagcuaugaaagcccuuaaauauuuuaguuugcuuaauaaacaguauacuaaacagaugaucagcaaaauuuggguacuauagccuuccaugcuuuguguucaagacauccccagaucuaucuacccauuuaucacccuuguuugcagagaaugugcauuguaagagagacaggucuucuuucuuaaagcuuuuuuaacgucuaagaaauuguuaaccuuuguagucccacucuagucuuagaaacacagaauauauuaggugauugagauuuuuuuaaaugcuuuggauaaucccuaugaaauucugucuuucccucuuaaacauauuuuaacacguucuucuuaccucuccccacuaaccugucuucucucccauugguucuuugccaaaaaaaaaaaccucaucugccucucuccacccuuuuaccaaccuucagcuuucuguaucucauuuucccucaagaacaaccuuaucccugaguuuucuaaauuaaaauucuugagguugaagcaaagcaacaaucuagcaauaaucucuaagggaaacagaugguuauaagacuugguggcugauguguacuuuuuccaaguaaauauuuaauaauacacacuguuuuugugcuuuucuuuucccaguuacuacauguaccugaggccguuagauuugucuguguuaaggauuugaaaggguaagcuaaaggaucugaagggaaguuuaagugaggccuuaaaaauauuuccagcaaaggggcauagugugagaauaugcgacugauuugagaagacugguucaaaaguucugguggguuuggaaauauuaucaaagauuguucuauuaacuuucccagaguaaauuaucuguauuucauuugcuaugguucugccugagaccagucuaccuuuuuagaaggaaguuuauuguuuuaaagucaguuuggagggaaaguacagauugauaauagcaauuuauugaugguaggagucaauuaacuuucucuuccagucugcccccccccaguugucuugauauuaaaacuauuaaaauucccuaucacugaugcuacuaucauaaaauuuucuaaaauuaucauaauuuacauauaguugauggaccguagauggaguucucucauacauugacccuaagucuuuuaauuacaaauauuaguacccaaaaaaguguacccuauauuaauccaguaacuaguuuuuaaaagucaaaaugccagaaggaaacaguggaaucuugaugacauaaugcaagggaagaccggagucaaugcaguguuaaagacgcccucagccucugggaugucauuguuuagcgcuuaagggaagacuauagaaagcacugauacugauuuaaaaugagauauuucucugccuucacugggggaaaaaauguuucugacuuauuuugcugugcucaauugacaaccaucaaaacuuagguaacuuuuaauaaacucacaguuucuaauauuuuuaaguggcugugugucugcaucugcugccacagauaaaauauaaccuuuguaggugaauuuaauuuaggacuuuucugaaaguucagucagaggauagguaauuugugugucuuuuaaaagcacuuagccccgagguuguuguuuuuaauacaucuuauuuaaauacggaaauguguugcccuuaugccuuuuuauuucauggaagccaaaugcgucuuuucucccaaaguauacuagaaaaugaagacgcuugguaaugguagugaucuguacaucagauuucagucuuucugucacuugcguguaugaauccauuuagcaaguuugcuuuuggcaguaaagccccacgugcaggaagacaaacagcugcucacucauuauccaaaguauacuuuguaagaauuagggcaucaaaaauuggauccuaagcaccaauauauauuaaaguucaguacaacuuguaguguuuaaguacaagaaauaaaaauugagccugaacuuuuggcauauagugggaagaaauuagguuuaccgcuguuaauaauucagagugcuuaggaaaaucgguuuuuauuuacuuauguuaaaaauacuaaggguucuguaaccauuaaaaacuaaaauacuaaccuguagauguugaaaaaauccuagacacuagucucugccacgugacuguucuucuuuucuauuuauuuuacccaauaauuaggcuuuuacaauguaaguaauaaagagaaaaaucucuaguaucacuuuagagcacauugauucauaaauagcccauaaauuuuguacucagcaacccauaaaauacacaugcaugauucacauaaucaaauaguaacgaaaguuacaaaaugaaaagugaagcagcucuaccccaaguccuucccccaauauaaccaugaacagucuuaaaucuaaugccgcugucuaaaacugacuaguuauucaaaugaaucaauauuuuccccuuuccagaggcagaaauuaauacagauucaaguguucacuaucaagucggaauuguuaauaugugaaauacuacuguuaaaggcaggaaaggcuuuauuaaggacaagaagacaaacuaggagaaggagcuacucaagaccuuccgauuaucuuuacaaaaaggcaacuacaccuagaagauucugcagccacacacauucugccuucacuugaggucaacugccuucaccaaggucagauauuagcaaaggcuaacauuuauucagcucugugugugccaggcauuuuauuaagaacuuuucaugcaucaucaguucuaugccuuauagcaacaaugcauguaagaacuuuucauguaucauugcuuuuaugccucaugcaauacacuguugucccugauuuccaaauguggcuacuaagguugaggagugaaguguccuuuggcagggugacacagcuaguacguaguggaguugagguucagauucugggcaucugauuccagcacccaccuuaaucauuguugucugggauuuauuuaugcaaaaaguuacaaauuguaucuuaggcuuuuaauuguaagcgcugauugagaaccacuucaugccauugacacaaugcuuccuaauacuuuggaucauagauaccuuugaaauuucuguuaaaagcuauuagaagaccuaccuucuuccuagaaaaauacauauucaaacagcuuugcauauaaaacucagcauagaugauaucucuagagguccauuuauucuaauugcuaaggaaaugaaauaaccuuuuuccccuacacccaacuccgaagaccugaaauaacauuuuaaacaguuuuccaucaaaagagguuugaagacuuugguguuuaagagauuaauguguuagccagaacaacucauuucucuaccaguguguaguccauuuaucuuuaaagauuuucuauugaauaauuuugaaauuacuuucuuaguuuucuucauuaaaaacuaagaaaaugcuuuguuuauuaugaauugcuauuucucuugauuauuauucuuggagaaagucuaucagacguaauucuucugauuugcuucuaggcuagaggaaaaugugaaagaugacaaaugaaaauuucaaagguugucaguaguaugacuucuuuuaucguuugucauuaucacaaauauaucaacauaggacuuuuaaaagauauuuuguacauauugggccuuaguaggauuuugcaugaauuuuuuuuuucuuuuaugccaagagagaaagagcaaagaaauaaccaagggugauguacucguauugaagguuuaccaaauaaggacugcuuuuauuaugaacuauagucuauauucuaaguaaaucaauuuuucuauuauguguuuuuuguuccugcaggcaagaucucugaacuuuaugcagaggguucuuuuaaaaaaacaaaguugaauuuuuuuauuucuuggaauauuuuuuuucauugauuucucccaaguagagcagauucaaaucuccuuuguacccuaugucuuuuuuguuuugcuauaagcucaguauuccauuucuacauuuuccuuuccuagaaccagucaauaaaugacaaaaaaaaaaacaaaacaaaguaaaucauguguuguugcaguaggaguucaaggaaaccaaggacaaucuuguuuguuuauuuguuuuuuuguuuguuuuuuuuuugaaacagaguuuugcucuuguugcccaggcuggcauacaguggcgcgaucuuggcucacuacaaccucugcuuaccagguucaagcaauuuuccugccucagccuaccaaguagcugggauuacaggcaugcaccaccucaccuagcugauuuuuguauauuuaguagagacaggguuuugccauguuggucaggcuggucucgaacucccgaccucaugugaucagcccaccucggccuccuaaagugcugggauuacaggcgugagccaccgugccuggcagacagacagucuugaugugggaacagagaaggcuggauaggaguuggauaaggccauuucagauaaagaggggguggcuucacccaaggcaggaaguggaacuguguguaagggggucaugaggacaaacuacauuuguaaauaaugagaaauaagggcuugugacaguaaauauauuuggucucuuugccugguucccaacacagagcuccugaaugucgcaaauuccugagugauaggagcaucuuuuguucuaacuaggacacucuuaaugggcuucuggguagcuucaagguggggacuagucaccaaaaagaccaagccauaauuagaaauuuggaacuuucagucccacccuuugaccucuggagauuggaaaggggcugaagauugaguuuaaucagcaaucagucaugcccucauaauggaaccucuauacaaacccuaacugauggcuggaguauggggagaguucagagagcuuccagguuggugaaugcauccauguauggguagggugguacccuccaaauuccaggggaacagaagcuccugcaguggggacauuccagacauggcccuguguaccucuucauguugcuguugauuuguauccuuuacauaaguaacguuucccugaguccugugagccuuuauaacauuauugaaccugaggagggggccaugggaacccccugguugguagccaaguuggacagaagugugggugcccugggcacccaagacuuggaacuggcaucugaaguagggaacagucuugugcgacugagcccuugagcuguggggucugugcuaacccugguagucagugucauaacugaauugcaggacacccaguuuguaucugcagagaacuggagaacugcuuaguguggaaaacccacacauuuggugucagaaaugugugagaaaaaacaauuuuuuccuuuuuuuuuuuuuuuuuuucuuugagacggagucucgcugucucccaggcuggagugcaguggcgcgaucuuggcuuacugcaagcuccgccuccuggguugaugccauucuccugccucagccuccugaguagcugggacuacaggcgcccaccgccacgcuggcuaauuuuuuuuuuuuuuuguauuuuuaguggagacgggguuucaccauguuagccaggauggucuugaucuccugaccucaugauccgcccgccucggccucccaaagugcugggauuacaggcgugagccaccgcgccaggccaauuuuuuccuuuuauguuuguuggaugaauaaugaugaaucuagcagggcacagaaagcuaggcagcaguggaacugagaaugaaguuauaguuaauagcagagaaugaaaaagaaaagacagauaaaacauuuugaagaaaggacaguaauguauucccaacagguaggauuuacaggaugaaggagagaagaggcaaagauaaccacaaaauuucuagccugagagacugguagaaaaaaauggugguaucagggacagaugggguuauuaaggaaaaggauuggauuuuuaaaauaaagaagaucugguguaaaauuauccuuagggaaauuggaaauccaggcacguacuucucuccaucaugcccuugaauagugcagucccucugccuguccaugccucacuucccccucccuaggauuccucugccucucuuaagacccaucucaaauuaucacguagacuuguaaauaauuuauaugaaacuggauagcugagguuucaagccuuuaucccuuugaaacuuuuuaauaacaaguuauuguuaccuuuuacuaaauccaacuuuauauucaccauuuuaacuagcaucauuuccgauuccaagaccuguuuggugugaaagugcagcuaaguuacuguuaaucaagaucagaauaaaagaaucuaccaagaaaaauuaacaaaaucccccuuuuaauguauaaucuuccaucugucaggcuguaaguuaaauaacacaaaacaaagcuguauguuuuauggauauguacauauauaauugcagggaacaugauuuggaaggauauacacuuacauugcuaagaauagucaccccuaaggagaagacuggggucauaaguggaagucaagggagucuucagcuuucuuuuuguauuuaaauuuugauagaaauacauacauauguguuauaauuuuaaauuuuuaaugaaaaaaguauucuuccguuuuuucuuugaugugucaauagguuauauuuuucuaauaucagcuaaacauuugcuucccagaaagcuuaguuaccucuucaaaauuuauucagguuaaaauaaaagauuuagacuggauuaaaaaucuaagaugguauuugccuacuuuauacaaaacaguacauugaugcugcuaaagcaauuaaaguauaauuuuucugguuuuuuuuuuuuuuuuuggagacggagucucacucucugucgcccaggcugaagugcaauggugcaaucuccacucauugcaaccucggucucccagguuuaagcgauucuccugccucagccuccccaguagcugggauuacaggugugcaccaccacgcccagcuaauuuuguuguguguuuaguagagacaggguuucaucauguuggccaggcuggucucgaacuccuaccucaaaugaucugcccaccucagccucccaaagugcugggauuacacgcgugagccaccacgcccagccuaaaguguguacuuuuucuuagcuccuauaugcagugcuccuucccaugcugaaugucugaauuuuuaucugagacguaguauuucagguggucauuacuuguggguggucauugagaguuccucccugcuucuaaccuuccucucuucauuuuaaauuaaguuacgcuacauuauuguggguuagaagguacauuaauauuaagugaaaaaauauaaucugaugaguaaguggcaagaguguuaacuuauaaauauuaagaguuguucugaggcauuuuugcuuuucuggugguucugugcuucugguagaacucuugguuacugaauaaauaguuccugaaaagugagagagugcagcuggaaauuagauuucugaugaauaaaucaaacccuauuaagagaaccagguucaaguaauuuuaaaaccacuugaauuuucauaaauguuuuguuaaugacuaauuauaaaaaacagugacuagcuggaggcuuuuguguuugcuuuugagucagcuaggaaaaggaaaaaaaauucaagcuuagucaauugugguuuucacugaaucuuuuuuaaaguaaugagcugguuuguuuucuucaucacuauagcaacuuaagcuaguuucugcuuuugauuuuuauuucuccuagagaaacuuagcauguacugcucauuagacuugagcauacuaaggaauaucugugguaauuaaguuaaaaaucagaucagugcuuuguacuguauauaguugcagaugucugcauuucacuaauauucuuuggaaacaucuggauaccaguuaacauaaaauaacuguuuagucaguuucuguucagaauagaaggaaugauuuaaaaguucccauuguaguacauacgucauucuauccccugcccuuccuccagcuuuacugagauugauaaauaauaaacgucauggguggugugucuuuaguuuccucuggugagcugagugcacagauuacuuugucagcaggguggccuugauuuuuaggccauguuucuaauggcaucaguucuguggcugacaccuguguaccaagcccauucacugucuagcuuagccagccguggacuccugcucuuuguuaaaaguauuuaccuucauuccuacuagcacaguugaccaaagacccaguugaucccaaacacuaguaaugcaucaauggagucuaacagaguuuuaagaugcggugugugcguguguguguguguguguguguagagaugggaucucacuauguuguccaggcuggucuuaaacaccugagcucaaguucuucugccucagccucccaaugugcuaggacuacaggcaugagccaccaugccuaacugucuaagacuuugggauacaaaaauauaauuuacuuuccuccauuucuggaauaaaacaucucuuccuuccuccuucuaguuucuguucugugccccuguuugaucucuguugguccuguucaccuucagccuucucugcugaaggaggaaaggcuugguuuuauaaaaagugacaauauucagaucacauaagauccuucuugcuucauuuuggcuuaaauauuuuaagauuuucugauuuucuuguauguguauguauuuuccuauuauuugacuuuuuugaacaacuucaaauugaguauauuugaacgagaguaggcauucaaaagugcuaggcuuucccugccuuucagaacuuugagguauaugucacaucauuuuguccuucacauucuccaguugugcuaauuuuucccaauccauugaguuaaguagaguaccuuccuuuuugcagucauauucuuacuuuuuuuuuuuuuuuuaauuuuuuugagacagucucaaacuguugcccaggcuggaaugcagugguacaaucucagcucucuguaaccuccgccuuagccuugugaguaugggacuacgggaaugugccaccaugcccagcuaauuuuuguauuuucaguaaagaugggguuucaccauguuggccaagcuggucucaaacuccugaccucaagugaucugcccagcucggccucccaaagugcugggauuauaggcgugagccaccacaucuggccccuacauaaaucucuucgugucccuuagaauguaguuaagacuuauuuucaggugacaguauauuuuugauaguuaucuuugguuuccaaacccagagaaggaagaguaacuggcuucuucuguguguggguacauugugucuuauuggagauuguuuugucucaaguauugcugcagaguauuuuauuaaugggugcacuuuaaaauuuuuuguuuuucagacuaccaguuuagguagcccaguacucaauauuugccaauuucuagaauuaaaaacauguaugaaucacugguuaacuagaaauuuaaaaugaaaauguuucuucuuuagcccaggcaauaucacuugcauucauuucuauccccucccugucccuguucuguuggcucuggggcuucuuccacuaagcugguacuuucuuuauagcuccuccugugcuuccauucacuaaaccuuuauugguucauagccuacagaaaaugccuguggugugagagguaauuugugaaacugcuucucuucacuguuuagcaguugagcucucuaaauggguguagcugggaaagaaaacuuaacuuuacaaacaagaauuccuggguuccauccagcggaacaugucuuuuguuauacacacacaguuucugacucaugucauuccaugacuuaugauaaaauggacauuuuguuuacacuuguguggaaggaggggucugguuucuaauuuuuaauaacaucuauuucuagaauauuaggcuugccauuugaaugcuucuguuugauuuaugaauaucauugguuccagcaguuuuuagcuccccacuaaaugcaaguuaaaauuuuuaaguuucuaaguuaaaagaaaguaacauuuccuccacuuaagaaagcaaggaaaauuaaaaauaauguggugaugacuuccacaggcucuaaaagagcaauggaaaaagugauuuaugugugggagaagaaauacuaguucuuuuuuuuuucuuuuuuuuuuuuuuuuuguauugaucauucuuggguguuucucacagagggggauuuggcagggucauaggacaauaguggagggaaggucagcagauaaacaagugaacaaaggucucugguuuuccuaggcagaggacccugaggccuuccgcaguguuugugucccuggguacuugagauuagggaguggugaugacucuuaacgagcaugcugccuucaagcaucuguuuaacaaagcacaucuugcacugcccuuaauccauuuaacccugaguggacacagcacauguuacagagagcacaggguugcgggguaaggucacagaucaacaggaucccaaggcagaagaauuuuucuuaguacagaacaaaaugaaaagucucccaugucuacuucuuuccacacagacacggcaaccauccgauuucucaaucuuuuccccaccuuuccccgcuuucuauuccacaaaaccaccauugucaucauggcccguucucagugagcuguugggcacaccucccagauggggugguggcugggcagaggggcuccucacuucccaguaggggcggccgggcagaggcgccccucaccucccggacagggcggcuggcuggguggggggcugacccccccaccucccucccggacgggguggcuggccgggcagaggggcuccucacuucccaguaggggcagccaggcagaggcgcccccucaccucccagaagaggcggcuggccgggcggggggcugacccccccaccucccuccuggacggggcggcuggccgggcagagggacuccucacuucccaguaggggcggccgggcagaggcgcccccucaccucccggaagaggcggcuggccgggcggggggcugacccccccaccucccucccggacggggcggcuggccgggcggggggcugaccccccaccucccucccggacggggcggcuggccgggcggggggcugacccccccaccucccucucggagcggcuggcugggcagaggggcuccucacuucccaguaggggcggcugggcagaggcgccccucaccucccggacggggcggcuggccgggcggggggcugacccccccaccucccucccggacaggucggcugccgggcggagaggcuccucacuucccagaugggguggcugccaggcggaggggcuccucacuccucagacggggcggcugccaggcggaggggcuccucacuucucagacggggcgguugccgggcagagggucuccucccuucucagauggggcggcugggcagagacgcuccucaccucccagacggggucgcggccgggcagaggcgcuccucacaucccagacggggcggcggggcaaaggcgcuccccacaucgcagacgaugggcggccgggcagagacgcuccucacuuccuagaugggauggcggcugggaagaggcgcuccucacuuccuagaugggauggcggcagggcagagacgcuccucacuuuccagacugggcagccaggcagaggggcuccucacaucucagacgaugggcggccaggcagagacacuccucacuuccuagacgggguggcggcugggcagaggcugcacucugggcacuuugggaggccaaggcaggcggcugggagguggagguuguagcgagccgagaucacgccacugcacuccagccugggcaccauugagcacugagugaaccagacaccgucugcaauccuggcaccuccggaggccuaggcuggcggaucacucgcgguuaggagcuggagaccagcccggccaacacagcgaaaucccgucuccaccaaaaaaauacgaaaaccagucaggcguggcggcgcgcgccugcaaucgcaggcacucggcaggcugaggcaggagaaucaggcagggagguugcagugagcuaagauggcagcaguacaguccagcuuccgcucggcaucagagggagaccguggggagagggagaccguggggagagggagagggagagggggagggagagggggagggggagggggagggagagggagagcacuaguucuuaauuaauacauuguuuuacuauuuccugugaauuuauguagaaguaaugaaaccaagguuuauuaagucauuuuuucaaacuccugucaguuuagacuuuuuaauugcuuuguuacaugccauuacuuuguaauacuuguuauagcagugguaauaguugagauuugccuguuugaccacuugcagggcaccgugccagauuccccaugugcgauguuccucgcagucgugacacccauccuaggagaguggcauuagcaccccuccaugcaagcggauggugcaggcugggucgccugggcacagcgccuuaccauuucccuggcuuaguguaguuaucauuaaauaauaugugguauuacuuagaagcauuuugaauaauuugaaaagcacauuuuaguguuuaaacaauuuuuuuuuucuuuuuucuuuuuuuuuuugaggaaaggucuggcucuguugcugggguuuagugcagugaccugagcguagcucacugcagccugcaacuccugggcucaagugacucuccugccccagccuccugagcaucuucgacuacacgcacaugcccccacgcccaacucaauuuuuuuuuuuuuuuaagauacaaaugauucaucuuaauauuauuuacaguuuuuuuuucccuuuucugugggcuuuaucugacuggaaauucuuuuuaaauuuuuuauuuuuuaaauugacaaauuguagauauauauuuaugagguacaaaguaauuuuaugauuuaugaauacaacauugcauaauuaagucaagcugauuaaccuguucaccacuggaaacaauugcaaauaauuaucauuuuuucuggugaaaacaucugaaauuuacucagugauuuugaaaugugcaguacuuuuuguuguuguuguagaaaugaggucucacuauguuggccaggcugguuucaaacuccuaagcucaagugauccucccaccucagccuuccaguguugggauuacaagcaugaacuaccauguugggccaaauguauaaucuauuauuauuuacuguauucaccaugcugugcaaucuaucucgaagaaacuuauuccuucuaauugaggcuuuguacccuuugaccaucaucuccccgucacccccauucccaguuuuguauacuuugaguccuuucaugauagguauggaggcuuaugguaaguuauuuaaaacuuaacauguaugucaaauauuuuuguggccauagcuuuucuuucuuuuuuaaauuuuaagagucagaauauucguauauuaauucggcauguauuugagugccuaauauaugccauuuucuauguuaggaaccaggaauuaaagcagugaacauaacaaagucugcccucguggugcuaacuugccagguagggaagccagauaauaaacacauguauaaugcaaagucaguaauaauaaacgauaugaagaaacaagguaggagaggcaggaaagugggagugagaaagaggugcucuuuuaaauacaguggucaaggggagccucucagaaugaaguuuuuaacagagaccugaaugaaaugggggagugagcuauacagauaucugcugugugcuggaaaaauuaccuguaauuuugcauuccaaaaguuuaauaaugacuacauuuauuucacaauuugagaaucaguuauacacaagauauaguucuaagcacauacuccucuaaauaugauuuguuuguacaguagaccaaauaaguauguucagcuuagaauaugcucuuuauggucauguguacaauaaauaaauuaucuuaaaacauuaucaauauuaagguugauguuuucagaaacauguaagaaagcuagcuuuuaaaauugacuagggaaguucucucaaacugccaguccaugagauauuguauauuuucuaucugaaaaacuuuuaaucucagaauucuuuaaaagagcucucccuggggcucccauuacuuacuugugacucccaguggaaaucguacccagccccucgagaggggcugaaucuguugggagugggaggguagaaaaaaugcugcagcuucuuguggguauccuucacacacaaacacccagugccccaagcacugugcagucaaacaucaaccccacucagacuuuccuccuugggauugagaagcaauggauuauagagaaagaaagguggauuagcacuccaaaacuuugaagaguaauugaccaagacccccaaagccaaagcugugggcauccccacuuccaguauacccuguaccaacacguaauggcuacuagauacaggggcacuaguaccuaccugucugcuuggcuaccugcccucuuugcagaaguggugaagggaaucacucaaccucagaaagggaaaauggcuuucucauuuucagauugaaagagguuggcagugggugaggagaauaacagguaaggaucucuuuuaauauacccauuugaagccaaaaccucuguuuagacauacgguauuuugaaccuggugauuauucauugcccauguuugugaauuaucagaaagcagaauucuugccaggcauaguggcucaugccuguaaucccagcacuuugggaagccaaggugggaggaucacuugagcccaggaguuugagaccagccugagcaacauggugagauccugucucuacaaaaaauucaaaaauuagcugggcaugguggugugcacuuguggucccagcuacucaggaggcugaggugggaggauuaccugagccuaggagguugaggcuacaguaagccaugucugugccacuacacucagccugagcaacagagcaagacccuguuucccaccccuacccccccaaaaaaaagcaaccugaauucuugaacucccugcaaccaggucacccaaaccaaagguaaaaggaacauaaaaaagccuucuggaaaguguacagaaauucauugcagggugauuuuugucuugugaaaucauaguuacuguuauuagcagguuuuuuuaacguuuuauauucauuuuucaugguguucugauguacaagcugcuucaaguguuuuuggacauagcuuggauguaaaauguaaaaaguggauauuuucaauuuguagcuuucuuuuuugaagcuuacuuaaguuuguucuaaauauaaccccuucuuucucacccaccccaacacauuuuuuuaaaaacaccaccagguauccguuacagcacugaugugaguguagaugaaguaaaagcuuuggcuucucugaugacauacaagugugcagugguugguaagugaucgccuuucuugcugccuaaugagaacucuggggaaauauguuuacacacauguuacuguuaagaugcuguagaaauauaccuuaucagaacugauuuuuuuucaaguuguaaucuuuaagaccugcaucauuuuucaauuagucuaaauuaagauauagccuuuuuuuuuuacaugggggauuuuuuaaaauaggagauaauuggauuuuaagucuagaucuuuguuuucaauuccucaacacauucuguaaauaagaccaaauuauaguagaaggagaguaaauaagcuauuaucuuuuagaagugguaaagagcacugauuaaauauauauuagaacuuggcuagccaauuuuauugaacaauuucuguucaacaaaauguuguuuaaaguacaguuuagaaaaugaugguagguuuauuucuugaauuuucagaaauucaagcuuaaagcaucacguuucucuaauauuguguggugcuuucugucauuuuacuuuuuuaacauuuauauggaauagcaaccaucagccuucucuuucagaugugccguuugggggugcuaaagcugguguuaagaucaaucccaagaacuauacuguaaguaugaaagugauauuuguuuuuuauuguuguuguuguuuuuguuuuucugagacagagucuuccucuguuguucaggccggaguacaauggcgcaaucuuggcucacugcaaccuccgccucccggguucaagcaguucuccuugauccaguaacugggauuacaggugcacgccaccaugcccgacuaauuuuuguauuuuuaguagagaggggauuucaccauguuggccaggcuguucuugaacuccugaccucaggugauccaccugccuuggccucccagagugcuaggauugcaggcaugagccaccgcacccggccucaaagugacauuugugcacacagugcauuuaugaaggacuugaaauuacugggcuucucuguaucccccacuaucagugagaucaguaguccccauugcuuuucaaauggaauagaaaaauguaaagaauuaacucauagcguguuuugccauauaaagaucaccuacuuaauaucuauauccuuuaucauuuucuguuucauuugguuuuguuuuuaugagucuuuuguuuuacuuuuuugcuuuuuguuuuauuauuuucuuacuuaguuaaaacguaauuaauaucuucacuuauauacuuauacccauauuuauauaaugucuucacuuagacacuuauacccauauuuaagaaauacugugaucugauuagccaggcauaguggugcacaccuguaaucccagcuacucgggaggcucaggcaugagaauugcuugaacccaggaggcagagguuggcugagauuucaccacugcauuccagccuggguaacagagcaagacucugucucaaaaagaaaaaaguauuacugugaucugaaguuuuuaugucaggaucugauucuagugacacauaucuuaacuaagacuauaaaaaccuuacuuuuuauccagucaguuccaaguuaauucaaacugauugucacaaugcuuuacauaauacuaaauuaucuauauacaaacauaaaugcaugauuuuuauucucuuuaaaauucaccauuuaaauggaauauaauuauauuuaaauuaaucuuaauuaagauuuaguguauuuuucaguggggaauuaauagaaugggaauuugagcccuaguucuacuaucuuguuuuuauaaccuacuuuuuugaucccuuauuuugucaccuuuaaaauggcaaugccuacuuuaugaguuguucuaaggauuacaugagaagacauaugaaaauguacuauaaauagaaaauaagaugcuagcuauaaucucaagcgauuuuuauaucaauuuuuucuuuuguuuuuguuuucuuauuuuacaggauaaugaauuggaaaagaucacaaggagguucaccauggagcuagcaaaaaagggcuuuauugguauguguagccacauaguuuuugguauaaagugggaacaucuaaaaauuuuuuuuuuuuuuugagacggagucucacucuguugcccagacuagagugcaguggugcgaucucguccgccuccuggguucaagcaauucucuugucucagccucccaaguagcugagauuacaggcaugugccaccacacccagcugauuuuuguauuuuuacuggagauggggcuuugccauguuggucaggcugggcuugaacuccugacaucaggugauccacccaucucggacucccaaacugcugguauuacagauaggagccacugugcccggccuccuacuauuuguuauaggagcuuuugccaaacauacaacauuucugaagauauuaaucuuuguuugcuugauguuuuuguaucuuacuauuaucuguguuuauauuuucuuugugcacaaucugaauauucuuuuuaugauauguaaguauuugucauguacccuuuaauuuucaagcaguuuaaaccuauauuuuuuuuaaucuagaaggcuucuaauuuguuugaauagaauaugcauaacuacuuaauagaaugcuugcccuaucaguauaguuaauagaauguuaauacuuacugccgagcgugguggcucacaccuguaaucccagcacuuugagaggccgaggcagguggaucacgaggucagaucgagaccauucuggcuaacgggguuuaguaggaaucccaucucuacuaaaaacacaaaaaauuugccaggcguggucgcgagugccuguagucccagcuacucaggaggcugagacaggagaauggugugaaccugggaagcagagcuuccagugagccaagaucacgccacuacaccccagccugggcaacagagcgagacuccgucucaaaaaaaaaaaaaaaaaaaaaaaaaagaauguuaauuguuacuuaauaauagaauacuuguccuaucaauaucaguauaguuaaacaaaauaaggucuacuuaaauagaaaauaaaguguauuuuucucuacuuuccuuucuuagcauuucccccacaaguucccaugaaauuaaacuauaaaggcugggcaugguggcuggugcuuguaaucccagcauuuuuggaggcugaggugggaggaucacuugagcccagaaguucgagaccacccugggcaauauuacaagaccccaucucuacaaaaaaugaaaacauuauccaagcgugauggugcaugccuguggucccaacuacuaagaugggaggaucccuuaagccugggggguugaggcugcagugagcuaugauugugccacugcacucuggccugccacacucuggccugagcaacaaaacgagaccacaucucaagaagaaagagaaaugaaauaaagcuauucggauucauuuuuaggaaaaaaaagucaugaaauaaaugucaugaaauaaccuaauauagaaauacaguaaguauagguaacucuaaaacuugacuagauuuggccugucuuugauaauaaaaggcauuugggccuuugaugugccgcauacccagcacuacugugaacuugugcauccuuacauggagucuguuaacguaaguuaauaugaguuaacuaucucgcucacacuuuuauaggagugccuacugauucugagauauggugaauugaagucaucuucagccuguuaauagccuucauaauuuuuaaaaggucuuuccucuuccccuaaaucucaaacacauuuuauagucuugaaugguuucagacuuuauucagucauauuugucacccauaucugcaauaucuccagcuuaauuuuaucagacuugacaaguaccuaauaauuccaaaggucaaaaagugauucauuggaauacugaaagaaaacacagcuuaaacucuaguaauuugauuuauuugcuuaaugugcaaaagccucauugacccaggaugcaguuaaauugacgucuuggcccagaaagcuuugaagccuaggagguaggcaaagggaguuuuuucucucacuccucggcaaaccuucaaauuugauguuauuuaucuguuauuuccugacugcccauuccacagagagugucagauugaggcucagaccugagccugaacccugauccugucacauguguguuuagcaucagcuuguaaauuucugcaaaacaaaagaaaaaaagaggcugggauuuuuauaggaauuucauugaaucuguacacuaauuuguggaguauugccaucuuccccacccuccccaaaaagguuuuguccuuucacccaggcuggaguaccagacagcagucacugcaaccuugaccuccugggcucaagcaauccucucaccucacccucccaaguagcuagaaccacaggggugugcaacugugccuagcuaauuuuuuaauuuuuuguggagacacggucucaucacguaucccagacuggucucaaacuccugagcucaagcagucuucccaccucagcuucccaaaauucugggauuauaggcaugagccacugcaccugaccaguauugccaucuuaaccauauuaagccuuccaaugcugaauaugagaugucuuuccauuuauuuaggucucuugauuucuuucaaugauguuuuguaguucucauuguagaagucuuacauagaagucuuacaacuaaauauuuuacuccuuuuaaugcuauuguaagugacauuggucuauaguuuucuuaugaugucuuugucuagucuuuguaucaggacaauucuagccucauggaaugaguugaggaguguuccuuccucuucugcuuuuggaaaagcuuuugaaaggucaauguucauucucuugugugaguguaaauaucaccuaaguucugcaggacccugaugucuccacccuucucauccccuuauaucucuguguaccaaaauuacccuuucaucuccuacucuauagucacaugcuguuagaaaaguugcuuuuuuaaaaaagauuaacuucugccucauaccuguucucuauauaagaauuuaucuguuaggccaagcaugguggcucaugccuguaaucccagcacuuugggaggcugaggcggguggaucaccugaggucaggaguucgagaccagccuggccaacaugguaaaaccccgucucuacuaaaaauaaaaaaaaauuagccaggcagguaccuguaaucccagcuacucaggaggcugaggcaggagaauugcuugaaccuggaaggcggagguugcagugagccgagaucaugccauuguacuccagccugggcagcaagaguguaacuccuucucaaaacauaaaaauuaaaaaaaaacaaaaagaauauaucuguuauucaggaacuacuuguuuuuuguuuuuguuuuuguuuugagacagagucuugcugugucacccaggcuggaguguaguggcacgaucucagcucacugcaagcuccgccucccggguucacgccauucuccugccucagccucccaagaagcugggacuacaggcgcccgccaccacgcccggcuaauuuuuuguauuuuuaguagagacaggguuucacuguguuagccaggauggucucgaucuccugaccuugugauccacucaccucggccucccaaagugcuaggauuacaggcaugagcaccgcacccggccucaggaacuacuuguaaucugugcaucccuauacauuaguuuuguauggaguagaaaacucauaagccuaauaacuaauaccuugugauuuuguuuuggauggcagaagcuguuucacguuuagcauguauagacuguuuuugagaaggauuuuaucauuacguguuucugauuuacaaaccauguguuucagacuugccacuugccagagcccuucuccaauuggaauuguuuuuuguuuuuuugauuuugagacagagucucgcucugucaccaggcuggagcucaguggcgugaucucggcucacugcaacgucugccucccugguucaagcaauucuccugccucagccucccgaguagcugggacuaugggcaugugccuccacccccagcuaauuuuuguauuuuuaguagagacgggguuuuaccacguuggccaggauggucucucucucuugaccucgugaucagcccaccucggccucccaaagugcugggauuacaggcgugagccaccgcgcccagccgguuuuuuguuuuuuaaauguauuguuuaaucaagacaggaucucacuauguugcccaggcuugucucaaauuccuggacucaagccauccuccugccucggccucccaaagugcugggauuacaggcauaagccacugccccggccuaguuggaauuguuguuugagguaacaagcuuauuuaauccuaaagcaagcauaauccuuuuguaguuaccucuagaaagauucaggaccaauuugucauuuguacauugggagaaaaggagugguuaaacaaaguugugcugaccuccagcagagguaugucacuaaaggaauggaaagugagcaaauaggagcuggagagcgccagagagcccuuuugucaguggaugaggcuagaauauggcauuaaucuuuccaagugcaguggggauuagacuucacaagauuuuguuguuguuguuguuguuguugucgucauugacuucaugagauuuuuaaggugacuaagggaagggugcuaagacauagaguuacagauuaggugggagguggagagggucaggguauaaaaagcgauccuugaccauuucaaaguuaucuuauacuagcccuguauccauuacaucacagcuuguucaaaaaaguuuauuauuuaggccuugggccccugaguuauagaaaaacauuacaauauacugauucuguugacuaaaaaguaaaauuuauaggaauaauuggguacagcccuuagaacuuuaauuauuuuauggggagacauaauaguuuaauaguuuaacuuuuuuuuuuuuuuuuuuugaaacagagucuuacucugucgcccaggcuagagugcacuggcgcgaucuuggcucacugcaacaccccccaccuccauucaagcgauucuccugccucagccuccggaguagcugggauuacagacaugugccaccacgcccggcuaauuuuuguauuuuuaguaaaggcaggguuucaccauguuggucaggcuggucucaaacuccugaccucgugauccgcccuccucagccucccaaggugcugggauuacaggcaugcgccacugugcucagccuaauaguuuaaccauuuuuuaaguugcguuuuucguuuuguaaaaacgaguuuguauuuuacaguugaaauaauauagaaaguuauaaacuauauauauggcagggaagagaaaaaaauuauaagugggaacauguuauacaugcuguaugaaaccugccuuuuuccauauguauguucaugauaauuccaaguaauuuacauggauauaaguuacccuuuuuaauggcuguuuaguacuuugcauagguauaccauauuucauuuaauuggcauacaagauaauuagguuguuuuuauuuuuacuguguuugagaggaguauuucugcaccuuuacagauuugagugagcaucacuuaacauguuuuuaucagagaucuuacuguagccgucaguaguaguauagucagugauuccuguuauugccuguaagcuaauuuauuagccuaaaccuuuaauuuccuaugaucugaggaacugaaagcuaaggccuaaaaccuuauaugugcugaaugucgaauaauaggucacagccacauucuuccacaaguaaaaauaauauggggcuuaacacaauugcuuuagcaauaugaccuucuccccuuuuucucuacuugauaaggagggcuuauacccccacuaagcagcauguuacucugcuaucucauacaugucaacucccuaaccauaauaauccugcuuauauagaacacaaugguacuguuaucucuaauugcauguuagugaaaugaggucaagagaggcuaaacugauuaaccucuggucgcacacucagaaauccuauggaguggcuuauaucuguugugcauagcuaacuuccaaacauacagcaaguaaaugccagagggagaaauuauuauguaauguuguaugugucugcauuuuauagugaaacauuuaaugaauauuucuaugacuuugauuagcuaccuaaaugagaucuaaaguuuucuagccaugguaacuugguuauuacagagacuuacaaggaucuuuguguucgagaagaauuuuucuuaaaaacuggugcacuccucuuucccugugcccccgcagguccuggcauugaugugccugcuccagacaugagcacaggugagcgggagauguccuggaucgcugauaccuaugccagcaccauagggcacuaugugaguacccacuggaagccccgaggcuucugcauuugcugucuacaagaauuaacaguuugacugauuauaucaaaaguugagaaucccuggguuuuucucucauucaaucauaaucuugaugugcauauuauuuuaugucuacuugucuauucuuaaaucguaaugaacacagauugagcuuuacuuauaugcugcccuauacuugucacuggaacaggaccagggcagcccacugugcuaagacacuagaacguacaucaagaagcauccaauucugauuuuucccucagagggcuuccauuuaaagaggaacuaaggugcauaagcagauaagguauggaaauaauguaauacaacaguggagauuaugaauucugaaauaagacuuucuagaggagauauuugggcuagaccuugaaaauggguagaauaugaacauuuagagauuuggaggauaagaggaagagaaacaauagcguucaguuugucugaagguaaggcauauuuauaaagguaauagaaaguaagagugagggcuggaugcaguggcucauucccauaauuccagcacuuuggguggccaaggcagguggaucacuugagcccaggaguucgagaccagccuggacaacauggggaaacccugucuuuccaaaaaauacaaaaauuagccaagcguggugguauacaccuauaaucccagcuaccugggaggcaugcuugagcccaggagguugaggcugcagugagcugugguugcaccacagcacuccagccugggcaauagagugagacccugucucaaaacaaaaaaaaaguaagaaugaagagguaaaugaaccaggacaaaaacaccaagccccaguguuuguguuuuacaugguagucaguggagaaauuuugcugauccuuccuggggaagaauaggcuggcagcaguguccagcugugcuggcgccaggagagaaccuccuauggugucagugccuuuccaccaaguccaggagccagaggaccaggagaggagcauugcacaugugaggcacaugacagagagacucagcaaaacuggauuggauauauguggaauuaaggaaagggaccaggcugagucacagagaaccaggagaaccugagucuggggacugagcagagguaguaccacagaacugaacaugagaggaaacuuaacuccugucccugaaaggggugcaaccuuaaaaaaugaaacauuucaggaguaggaagagaaacagagucaaaaaauacauuuaugccuacuacaugcagggccauguguaagcaagguauucacuacaauugggauaaauugcuagaaguuguuuugaagcuaugaaaaagaaucacaggcccauccaguccuuucaguccuuucaagguaaggucagaaaaagccuccuaggagauaaaaccuucuggucugcacuuagacggguguguggacauggacuaggguagggguaguggcaaguguuuggaacagaaggaauuaccugagggaagguucugaaguucagaagcugggugaacuugggaggauaaggacugacuacuguggccagaguugagaaagagaaaggugggauaagaaaggccaguagaaaaaagggucaggccagguuacugcuugguaggugaccaugagaacuuuggucuuuguccugaaaacacagggaaacagcaaagagcugguuucaagcaggugugacucagcuaagugugcauuugaagacuugagggcaggagacuacuacaggggcccggacugcaaggggauaugaagagggaagcagggcaugaaauauagccuccaacuaagaaaaauggcaccggagagaagcagaaagaagacagcuugaaaaguggcuguuacccagagaaaaagguuuuuuuugucuuuuggcauguuuauuggcuguaagacacagauuuaccggugcaagagauagacaaugcugaagagaugcaggcugguagagguagugaagucccccaggggaaugaaggccuggggaauucuuuucauagugaaaagaugggccuuggagaagaggaagaauguggaaauggggacauuuccugaagugaugucaugcuguggcugggaacaugggcagaccaccugaaguccaacccuggcaccuucacccaucagugcugugacuugggagucucugugccuccauuuccuccuaugcaaaaugacaguaguaauaguaccuacuuugugagacucaugagcauuagaugaauaauaaucuaaugcaccuagaacuguacauagcccuuaguaaguaucagaaaauaaauaucuguagguauuacaucagguaaauuauacaacccccugaaauaaaacaggaacgauauagacccuucaaauaauugugguuucaacugcccuucccaaaaggacaguuuuccaccugucaccuuuuuaugcauccuucccuuagcccuugauuuuagauuucuuaucacuugaaggaaaacuguucaccaguauaguucaaggggccgugcuucacaggacuuucucuugcuguuagcacugagaaugagcuacaaauaacauacugcccauugguuugcacuauucaauauagugucuugcuuaaaaagaacaagagaccagcugggcauaguggcucacgccuguaaucccagcacuuugggaggcggaagcagguggaucaccugagaucaggagcucauuuagcaaugagcucugggugugguauuuuuuuuuuuuuuuuuuuuuuuuuuugagacggagucucacucugucacccgaucucaggucaccgcaaccuccgccucccggguucaagcaauucuccugccucagccucccaaguagcugggauuacaggugccugccaccaugcccagcuaauuuuuuuguauuuuuaguagagacgguguuucaccauguugaccaggcuggacucaggugaagcaacuauacuggugaacaguuuucccucuuuaagugauaagaaaucuaaaaucaagcccuaaaggaaggacacaguuguuuuuguuacucauuucuagaugugaacugaaacgugccgcccucuuuguccuagccccaccuagaagugcaguguaggugggagaauguauucuucucugggcuuucaggaccauuacguaugcuggggagccuggcaguuggcgccaggccugaccccagacaguauuuccuucagcuccagcauuugcauucucacuguuuaaaagcauuuggcacucgguuugcauuucuguauucauaaguguuaauuauucaugaaagcaaacugugggaaaacuacuaauucuauuaaucacucuacuagacugaguuuuucuuccuugcuuucauccuuuuuguugguaauuacacaaauaauauaauucuaaguucucuguguaaaaauauuuaaacaauacagauaaagaacagaucacuuuuuaauucagccagcuggaauguuagggauauguugggaguuagggguuuggugugaaguagggcauuuuauuuuguuuacauggaaagcaaauugcuucaacaaauuuauuauuuuauacuuuugccacugacuuaaaauuuuauaugaauuuucauuuuauauugauugccuauacaaaauaagacugucucuaguuucuccugcuccaccgaugaguuuacucugcaguguucucguggccgugcuuauaguauaguugaugucuuggaagggaagcccuacuuagcccaauucuucuuuuuucuaauuacaccuguuucuguuucugaacaagaauauacacacaucuucaauugaaagaggacaggccaggcgcgguggcucacgccuguaaucccagcacuuugggaggccgaggcggguggaucacgaggucaggagaucgagaccauccugacuaacacaggauguuacucucuacuaaaaauacucuacucuacuaaauaccccaucucuacuaaaaauacaaaaaaauuagccgggcgugauggugggugccuguagucccagcuaucgggaggcugaggcaggagaauggcgugaacccgggagauggagcuugcagugagccgaaauugcgccacugcacuccagccugggugacagagcgagacuccgucucaaaaaaaaaaaagacaaagaaagaggacagaaagauggauggugaagacuguuaacccccaucuccacuuugcagagcuaaccacugcuaccaaagauacucugcucacacagaagcacaggacucuuacccacacauaccuuuuuaaaaauacuucauuaaauacuuucguuacucuacucuuagaugaacuugaaugucauguuauauuaaguaucaaguuauauuaaaaacuuccuuuuucaaaaguggcagaauacaacauugagucuucccauccaagacaauuguaaagccucuuccugucucaggcucuguuuuggugacaugcucaagucuuauaguagauuuuaagacacucaugaaugggauguguauguaccuugauuuaguagugcuuaaauacuuguugaaggaaugauagcuuuaggcugagcuagcucuacuuuugugauguuauuuguacuuacuugauguucaaucccuacacucuuguuuuuucugucagaaaauauggucuacuuugccgggcgugguggcucacgcuuguaauucuagcacuuugggaggccaaggcagggagaucacuugaggucaggaguuugagaccagccugaccaacauggagaaaccccaucucuacuaaaaacacaaaauuagccgggcgugguggcacgugccuggaauaccagcuacucaggaggcugaggcaggagaaucgcuugaaccugggagguggagguugcgaugagccaagaucucaccauugcacuccagccugagcaacaagagugaaacuccgucucaaaaacaaacaaacaaacaaacaaaaaaaaaaacagaaaauauaguauauuuuauuguauuuucuaggaacagaaagcugaaaaagugagucuugucucuauugguaaaaguauaccuuaaauacauucauacacacacuccuaauuagcauauuuuugauuaaaugagaaugugcuuugacuuuaauucauuauguuccuucaacagagaaauuggacuugacauuucauucuuucaauuacccccucuuacaggauauuaaugcacacgccuguguuacugguaaacccaucagccaagggggaauccauggacgcaucucugcuacuggccguggugucuuccaugggauugaaaauuucaucaaugaagcuucuuacaugagcauuuuaggaaugacaccaggguuuggagauaaaacauuuguuguucagguaaaaacaaaaacaaaaaaaguuuccuuaauaacugauagacauuaaguaaaguuuucaauguuuuuagaauuguaauuuuaaaauuaaguuaucucaaaucucuuaaauuuuagaguggugguuuucagaguaauagauauuuuguuuuuugaaccuugguaugauucauguaacuagaacugauuuaaguaucucucaaguacaugugaaacuguuaccaacuucaaccaaacuaucaccaaauucaaccaaaauauugguuaguauucaaacuugaaauuauagcuagaagggcaagucucuuaacauaauuuucuaaguuuuguaaguauauagaaagguuuacacacugacccaaauuuguuucauguguuaacauguauuuuacuuaggagaaucuuaauuaaguugaaauuacuugaaaauagaagugguggcuggacacaguggcucaugccuguauucccagcacuuugggaggccaagacggguggaucacuugaggccaggaguucgagaccagccuggccaacauggugaaacccugucucuacuaaaaguagaaaaauuaagccgggcgugguggcucacgccuguaaucccaucacuuugggaggccaaggugggcagaucacgaggucaagagaucaagaccauccuggccaacauggugaaacccggucuccgcuaaaaauaggaaaauuagcaggguguggugguacacgccuguagucccagcuacucuggaggcugacgcaggagaaucacuugaacccgggagguggagcuugcagugagccgagauugcgccacugcacuccagccugggugacagagccagacucugucucaaaaaaaaagaaagaaaaauuagcugggcaugauggcggcaccuguaaucccaacuacucaggagacuaaggcaggagacucacuugaacccgggaggcagaggcugcagugagccaagauugugccauugcacuccagccugugugagagaaugagacucggucucaaaaaaaaaaaaaaauuguauuucuccaaauuagugacaucccuuuucacaacauaggacaucugaucaucaaggacugaggaccuggugguguacuuaacaccacugccauuuauugauugauugagauggagucucacccuauugcccaggcuggagugcagucucggcucacugcaaccuccaccucccagguucaagugauucuccuaccucauucucccaaguagcugggauuacaggcacggaccccaugccuaauuuuuguauuuuuaguagagacgggguuucaccauguuggccauggcugaucucgaacuccugaccucaagugauccaccugccucagccucccaaagugcuggaauuacaagcgugagccaccaugcccgcucaucacauucuuaaacagagaauuuuauuguugaagagaaaccaguuaguacauuguuucuuuuggcaaaagaauuuugagaauugcuucuaaauaaacagaguauggauuuacauuggucaaaauaugacucuugcugucuauaccaggacuuuaauuuuuguguuauggguaauuguucuucacagggauuugguaaugugggccuacacucuaugagauauuuacaucguuuuggugcuaaauguauugcuguuggugagucugaugggaguauauggaauccagaugguauugacccaaaggaacuggaagacuucaaauugguauuaauacauuuuuauagcauagacacuaaauauaaauauuuaaaacucuggugcagcuauuaauugugauuuucaaucaauggcagcaacauggguccauucugggcuuccccaaggcaaagcccuaugaaggaagcaucuuggaggccgacugugacauacugaucccagcugccagugagaagcaguugaccaaauccaacgcacccagagucaaagccaaggugacaacauuauagaaaccagaaccaacauuaucaaugugaaugacguuaggggggucauagaagagucugauugaguuuucucuuucuuuuuagcagcuuuauuggcacauacugcacauaccauacaguucccccauuuaagguacauaauuuaauggcuuuuagcuaccggcacagaguugugcaaccauuaccaaaacaaacgcaucugccugacacuccuguaaaaaaaaaaaacaagcaaacaaaaaaaaaaccuagauaaauagaaaagugaaagguaguuuuauacacuuggcagagaaaaauaaccucuauuuaacuuuaacugaaacugugcuucuccccacagccccuuguucauauaugcacaucucuugcccucaguggaggggauuugacggugguguucgcauuucucuauguuccugacucucuugcagaucauugcugaaggugccaaugggccaacaacuccagaagcugacaagaucuuccuggagagaaacauuaugguuauuccaguaagucaucuauauuuauuaggcuuuauauguacuuagaaucauaauagucuuuugcaaggaauuuggaggaagagaggaauuauuagucuccaagcucuagugaauucaucuuuuucacuuuugagaaaauauaguagaagcaugguuaauucuaagccuguuaauuuucacuuugaucgaaacauuuauuccaauuucaggcucuuuacugaaugucuuuagccuucuaagagucugguuauauaaauguguacuguguuagaaacacuauucuaacuaaagcucuuaagauuuucuauaugauuccuaaccuuaugcauuucaagugcccuuuccagcuuuacucagaaaacuaauaugaggaacacgugcucagguuuuuuagcaaguaaaaaugagucuacaccaaaaaguuacuagaaauuaaugugggcuuggaauauauuuuaaagaacccccuuugcugaaagcacuuaagacauuuaauguaacugaaaugggcuacccuuagguaauaggagaaagaauccugucuucugagaggcccuguggacaguccaguccaacugguuggugggcaagccauuuagucugagaacuaacuucugguagagaagaggcuccaaccaaagauuauuaacuuuccuugauuaauaagccaaaaaaugauuuuuuuuuuuuccuaaauagaaaaagccuuagauggaauugggugggaugggaaggaguguuaauuaagugugaaauuccugauacuggcuaaaauauauuugcgauauuuaaaguccagucuaccuugguauugaaauuaaggucuuagguucauuuucagcuuuuacgaaaaccaucaucuucuaauuucuuugucuuauuuuugugcauaggaucucuacuugaaugcuggaggagugacaguaucuuacuuugaguggcugaagaaucuaaaucaugucagcuauggccguuugaccuucaaauaugaaagggauucuaacuaccacuugcucagugaguaucgauaaucuuguucgccaaaacucaucuuuugagccagcugaaaggcuguaaaaagguccacuuaagagaacugaucccuuugggaaagaauugagucucagaaaagaaaauaauauuuugucucaugaaacuuagaccaaaaaugcacaaugucuuucuggauauuaacucucccauauauuauauccagaguuuuauucugugauguaauauucacagaauauaaucuacauuuuuuuuuucuuuuuuugagagggagucucgcuccgucgccgaggcuggagugcaguggcacgaacucggcuuacuguagccuccgccucccagguucaagcaauucuccugccucacccucccaaguagcuggggcuacaggcacucaccgccacgcccggcuaauuuuuguauuuuuaauagagacgggguuucaccauguuggccaggauagccuugaucuccugaccucaugauccgccugccucagccucccaaagugcugggauuacaggcgugagccacugugcccagccaauaauauuuuuuuaagugugauuuuaaaacuccacugucgauacuaauuucugucucugguugcucuuaguaaaggccuaucuagugucaagaauuguuuuugagacuccugaugagaauacuuguuuuucuuugacuagaguaagcuccacaguuaagaguagaauuucucaucuaguugaaauaagaccaagaccuccuacugagcuucuguacucagcccacugugagaaucugggugaaguguuccaucuauuuccuuuucuuuuucccccagcguuuucuuuuuaauagagccaaggaaaaacccugguaauggguguuauggaaacagagcagugaccuaaauucacauuuauauaggaaauuggcaauguguuuuauuccuuccugacugaguuuuaaaugauuaacccuuuuaugucauuaaaacucuguauaaggccaggcgcaguggcucacgccuguaaucccagcacuuugggaggccaaggcagaugaaucacgaggucaggaggucgagaccauccuggcuaacacggugaaaccccgucucuacuaaaaauacaaaaaauuagcugggcgugguggcgcgcaccuguagucccagcuacucgcaaggcugaggcaggagaauggcgugaacccgggaggcagaguuugcagugagcugagaucacgccucuacacuccagccugggugacagaccacgacucugucuguauaaguuuuuggguuacaguuauaguuugggacuacuuuugauucuacuuuuuuuuuuuuuuuucuguuagcaauaucuugaucucuuguuauuuuuuuguagugucuguucaagagaguuuagaaagaaaauuuggaaagcaugguggaacuauucccauuguacccacggcagaguuccaagacaggauaucggugaguguggugaccccacaguuguacuucacacaugcucccugcucuuuccuucagacagagcugguuagauggauuucaucugcggcauagucuuuguaauuagcuugacaguaagugcgugacauguguguuuuguaccuuuccuuuucauuacauucuaaaacuggaguaagaauccuacugacuacuaacaaauauaaaauaaauaaauuugguauuuuucacgcacguguuuuaacagugaaggauuauuauguauuuuaauuauuuuaagcuucagagaaauaggaagaauugaaaagcaagcauuagauugaacuauaugggaguccaagaguuugagaccaaccuggggaacauagugaguccccaucucuacaaaaauaaagaaagaaacaagaggccaggcaugguggcacacgccuguaaucccagcacuuugggaggucaaggcggguggaucacgaagucaagucaucgacaccauccuggccaacauggugaccccgucucuacuaaaaauacaaaaauuagccaggcguggugcuacacgccuauagucccagcuacuugggaggcuaaggcaggagaaucacuugaacccgggagguggagguugcaguuagccgagauugcaccacugcacucuagccugagcaacagagagauacuccguucccgccgccgccaccccccuccccccgccaaaaaaaagaaaggagggauggagggagggaaacuucuuuaccaguaaaugauggaagacaggaaaaacaaaaguccauaacacauaagccugggggaaaaauuuaaccucauuguuaaagaaauacaaauugaaaaagaguuuuuuuuuuuuaauguauuaacaaaaacaauggaucuuauguucuccauauauguggugaaacaguuguaccuuuauucuagugacgguguagauuggugcagcucuuuggaaaaugugaaguuauuaaaguguuccugcccuuuggugcuaugacaaucuccccucugggaauuuauccuaagaaaauaauucaaaagaggaggaaccacuccaugcacgaugauguuauugaaacuauguguaggccaggugcgguggcucacgccuauaaucccagcacuuugggaggccaaggcagguggcucaccugaguucaggaguucaagaccagccuggccaacauggugaaacuccgucucuacuaaaaauacaaaaaauuagccaggcaugguggcacgcaccuguagucccagcuacucgggaggcugaggcaggagaaucgcuugaacccaggaggcagagguuggagugagccaagaaaugcaccgcugcacuccagccugggcaacaagagcgaaacuccaucucaaaaaaaaaaaaaaaaagaaacgguguaaacaguuuuuaaauuugguuuuauuuaaaguuuaggagcagggaaauggcugacuuauaucuuauaauacaucuuagguaauauucacucauaguuuaagaauauauuacaauggguaaauuauaucuucuuuuuuuuugguuuuuuuuuuuuuuuuuuuuuuuuugagacagagucucgaucugucacccaggcuggagugcaguggugcgauuuuggcucacugcaaccucugccucccagguucaagcaauucuccugccuuagccuccugaguagcugggauuacaggcgcccgccaccacacccagcuaauuuuuuuguauuuuuaguacagacgggguuucaccuuguuggucaggcuggucucaaaccccugaccucgugauccacccgccucggccucccaaagugcugggauuacaggcgugagccaccgcgcccggccgucaauauaucuccuuaugaaauauucagugauggaaaacaguucugagacuauauugcaacaugggaaaaaguuaaagauuuuguuguaaagaaagaaaaaaugcuuuacccauucuagguacuaaccguuccccucaguaaacuuccuauuuccuagagugaugucuuuguucugguccuuuuaucuggaauacacugaucuccucccugcuuaagugucacugcaguucuguggcucucucugaaagucuccugugugccacuguuucguacauaacauccaucccaaguggcuagcagugcaucggaaggacuugcgcugcuacugucccugccagagggcuguucaccccucccuuuggucaccccacugcccagcauaugccuugucaguuaaaaaaauaaaaguuuucucaagcucucucccucuaguuucccccugccccuguuuggcacuaucaggacccacaucaugacccugccauguuuccacugucccucauccccccagugcccucacuucccuccuuaucuaacuuaaauuccgugcuccaucauuacagucacuccccagucuuguuuccuuugucauacuccuuuguuaacaccuaagcccugauuaaaucccagcagcccugauuaaaucccugauuaaaucccgugccucuacccuguaggaggcccugcuggcaguucacacccugaccacuaaccucaaguaggcgcucagagcugcccagcagucauacugcuuuuccguguuucauucauucuccccgucuccugagugauuacaucacauuuucuccucuucucacugcccugcauuccagcucaugaccugcuaucuguucacagauaaaacugaugcagccugggagcuuccgcaucuacccagcuccugguaccuguacccaguccugugucaucucucuucgaauagaucagcucuuugugcuuucauuucuuagguccaguucuuguugugggcauuggaugguuuuuccucagauacacugcucuagcaagucugcuccucucuccuacaucagcaguuucccucugagucauuccccucagcuuaccaaaugcuguuuuaaaaaauguauaaaucuuaaucccacuuccccuuccaguauugccauuuguuuccuguagagcaaaccuccuuggaagaguuguauauacucagccuccaauucuucuuuacuugaaccuacuccaccaagacuauucuugucaagacagccagugacaccagcauugccaaauccaguagcuauuuuucaguccucaucuugcuugaccuaucagcaguucuuguuacaacugacacucccaccuugaaacauuuucuucucuuagcuuccaggauaccacauucuccugguuuucucccuaccucacuaaacauuucuucucaauugccucuugcugguaucucuucaacucuucacucuccuaacauuggaaggccugcgucccuaaaccacuucucuaucuagauugaaaacuucaaugauccacuuagccuugugguuugaaguccauguauauacacucucuucccacuacaauauaaagucugugagaacagaauuuugauuuuauucucuacuauguccccuaguaccuggaagaguauguacucaguaaguguccaaacuauaucagugacccauuuuaaguuuuuaucgggcauauguguuuuguagcucuguaugucaccuuaagagugguagugaguuaauuguccuuaauuuuuuagaaagcauuccaagaaacaaauuaggaaagagagaacugacuugaugguggaggcccugagucauaucccagcucugaaaauagcuaucuguaaccuuggccaucuucucugguccuuaguuuccucaucaguaaaauuaaaacgcugcugagaucuacacagcuuuaaaaguugcuggcacuacugaauagauacacagaauucuaccccaaagccgcuaugggguuuaaucagauuccuuucuguguucuguguggugucccuguucucuggggagcugaggcgaacgcaccguggcaugaacaguguaacacauugcucagugcaucugcgucuccaugaguggagggugcucaucucacuccaugcccucaugucucuagguccaaaaacugucuucauuguuguacuauaaucuuauuucaugaguauuuguuugcugucaaauauaauaaaaauaaauugugaucaacaagcaacugcuucaguaaguaucaagauacuguaucuuugauacugugcagaaaugacauaucuuagcuaaaagacaaaaaauucugucugguuguauauugacuugagaauccuuugucaucuuauacagggacacaaagcaggucuuugugguuuuguuaaacuuguguucuuuucccuaauagggugcaucugagaaagacaucgugcacucuggcuuggcauacacaauggagcguucugccaggguaugugugcagaugcuguuugccuuccagcuagucacaugaagugcaacucaaccaugcuaucucagccgccagacuguaugugcugauagaaaacaucaaucuguucaaugguccucauuuguguguagcaaaacacauguuuuuucagucucagaugauaagcaauuuuuuagagucuucaaauauguuuuugaggcuuuggaaagaaauaauaaggcugauuuaggagguaaugauguuggcagcuagcccaguauggaguaguuagccaaacuggauuguagcuccaugugccacuauguuauagcuacgggagucuaccuuacuauagaauuugguauaagcaaaacuuauuuugacugcuugaucccuacuuuaaggccucaaccacaguuugaguccaguuuuccuaauuucuucuuggguucagauucuaucugcuuggauuuaugaugaaauagcauaagcagauauuggugaagaagguggugcuucuuagggcuguuguuuuucuuguuaauuuuugaucgagauaggguguaugugguauaaauucauccuuucaaaguauuaaauucggcauccuuuauuauauauuugagccaucaccacuuuauaauucuagaacauuuucaucacucccuuuuuuuuuuuuuuuuuuuuuuuuuugagacggaguuuugcccuguugcccaggcuagagugcaguggcgcacuuucagcucacuguaaccuccaccucccaaguucaagcaauucuugucccuuagccucccgaguagcugggauuacaggcaugagccaccaugcccaacuaauuuuugauuuuguuuucauuuuguuuaguuuuuugagauggaguuucgcucugucacccagcuggagugcaauggugcaaucucugcucacugcaaccaccgccuccuggcuucaagcaauucuccuuccucagucucccgaguagccgggauuacaggcgcccacccccacacccgguuaauuuuuuguauuuuuaauagagaugggguuucaccauauuggucaggcuggucucgaacuccugaccucaagugauccaccugccucagccucccaaagugcugggauuacaggugugagcaaccgcaccccugccuaauuuuuguauuuuuaguagagacaggguuuuaccauguuggcaaguccggucuugaacuccugagcucaagugaucugccuacgucggccucccaaagugcugggauuacaggcgugagccaccgcacccagccaccccauuguuaaguccagagaauuaggcccuccugccuagagguucugcugcuagaguaguuugucuuuggcugcccaaguccugccuugaaacaaugagaggguaacuuggaccaggccugucugggccuuguguguuuauggccuggccacuugagucaggaucaucuucacugcauuuucucuuucauuucagcaaauuaugcgcacagccaugaaguauaaccugggauuggaccugagaacagcugccuauguuaaugccauugagaaagucuucaaaguguacaaugaagcuggugugaccuucacauagauggaucauggcugacuuccucacuauccucuucacauguaacuucugcagaccuaucacaaguuuacauguaaccacagaaaucccuuucucuccugacucauuaauaauggauaccauucucaacaagucaauccaagucagcccguuaaggagaaagaaauuaagguuagcggaucauguacaagcugagugugaaaguagaaaucaccuacaccagagagccauuuugguauuuugccuuuaaauaaaaagccuccuuuaucuggcugugcagccuugcucuguggcuuuucccaacacaaucagugcuagugcuggggaggaacagucaagagcagucaguugcuugcuuauuuuuucuggaugagucugggacacacuguaacuuuaacacauuuaagaaguagguguguggccuuuucagaagguggcaugguccucaagugaguucuuaguauuuuauaucagcaaaauaauucaauuuugcagguugcaaacaaauauaaaaccuguuucuguuuaugaauauuauucuuuuagaauagaauaaguacaugcugcuguaauaaaauugccuuuaaucacuuaacaagccuaaccuugacucaaacagugaaugccuauagaaauaauaaaugaaaaaaacuaguauuuuuauaucauaaaacaaugucauuuauagcuuaucauucauguauuguccagcagacauuaaaagcccuguggauaauuaaguuaucuucauaccugcaaaaugguggaggcuauuuucauuaaaacugucagaauuugcuuacuauaauuaugauacaguccaaagaaugcagucacuuuuuaucauguuaacuaauuguucucuuuugaagaucuaugguugacuaauuaaacaauaauucaaguagagugucccagaaaaaaaccacuugggcucccuguuuggagucuggcuggcucugagcauugccaauggccccuacucaccugacuuuguauccucuccuuuuagaggcuuugcauucugcacccagcuucacuaacagugggcugaaaacauccuuggguugaguguuucauuugggaguuauuuggccagggccuuuugaacaguaguguccccaugaagugcuagauaauauauguguaagagucagcuuuuuuuuuuuuuuuaacucuaacacccuucagaaauuucuaacuacuuuguaacugcauggcuuaaccuggugauaaaagcaguuauuaaaagucuacguuuuccaaaacuuacguuucuuuucuguguuuuuacaugugguaguuucucuuuucauaaguuauaauacugcaauuggauuucugaaauguuuauagcgaccaccuguauaacauuuccuuccacuuuauugugagcugcccagauuuuauucuugaauuguuuuuuuuuuuuuuguucggugcuuuacacguucagagaaacuucccgaguaacgaacuauagaaaugaucccugaaagcauagucuuuauucucgaauuauuuuguauuuuauuaaauaauaugaacagcu

SEQ ID NO: 192482 - RNA, 44818 nt, Homo sapiens
agcuguucauauuauuuaauaaaauacaaaauaauucgagaauaaagacuaugcuuucagggaucauuucuauaguucguuacucgggaaguuucucugaacguguaaagcaccgaacaaaaaaaaaaaaaacaauucaagaauaaaaucugggcagcucacaauaaaguggaaggaaauguuauacagguggucgcuauaaacauuucagaaauccaauugcaguauuauaacuuaugaaaagagaaacuaccacauguaaaaacacagaaaagaaacguaaguuuuggaaaacguagacuuuuaauaacugcuuuuaucaccagguuaagccaugcaguuacaaaguaguuagaaauuucugaaggguguuagaguuaaaaaaaaaaaaaaagcugacucuuacacauauauuaucuagcacuucauggggacacuacuguucaaaaggcccuggccaaauaacucccaaaugaaacacucaacccaaggauguuuucagcccacuguuagugaagcugggugcagaaugcaaagccucuaaaaggagaggauacaaagucaggugaguaggggccauuggcaaugcucagagccagccagacuccaaacagggagcccaagugguuuuuuucugggacacucuacuugaauuauuguuuaauuagucaaccauagaucuucaaaagagaacaauuaguuaacaugauaaaaagugacugcauucuuuggacuguaucauaauuauaguaagcaaauucugacaguuuuaaugaaaauagccuccaccauuuugcagguaugaagauaacuuaauuauccacagggcuuuuaaugucugcuggacaauacaugaaugauaagcuauaaaugacauuguuuuaugauauaaaaauacuaguuuuuuucauuuauuauuucuauaggcauucacuguuugagucaagguuaggcuuguuaagugauuaaaggcaauuuuauuacagcagcauguacuuauucuauucuaaaagaauaauauucauaaacagaaacagguuuuauauuuguuugcaaccugcaaaauugaauuauuuugcugauauaaaauacuaagaacucacuugaggaccaugccaccuucugaaaaggccacacaccuacuucuuaaauguguuaaaguuacagugugucccagacucauccagaaaaaauaagcaagcaacugacugcucuugacuguuccuccccagcacuagcacugauuguguugggaaaagccacagagcaaggcugcacagccagauaaaggaggcuuuuuauuuaaaggcaaaauaccaaaauggcucucugguguaggugauuucuacuuucacacucagcuuguacaugauccgcuaaccuuaauuucuuucuccuuaacgggcugacuuggauugacuuguugagaaugguauccauuauuaaugagucaggagagaaagggauuucugugguuacauguaaacuugugauaggucugcagaaguuacaugugaagaggauagugaggaagucagccaugauccaucuaugugaaggucacaccagcuucauuguacacuuugaagacuuucucaauggcauuaacauaggcagcuguucucagguccaaucccagguuauacuucauggcugugcgcauaauuugcugaaaugaaagagaaaaugcagugaagaugauccugacucaaguggccaggccauaaacacacaaggcccagacaggccugguccaaguuacccucucauuguuucaaggcaggacuugggcagccaaagacaaacuacucuagcagcagaaccucuaggcaggagggccuaauucucuggacuuaacaaugggguggcugggugcgguggcucacgccuguaaucccagcacuuugggaggccgacguaggcagaucacuugagcucaggaguucaagaccggacuugccaacaugguaaaacccugucucuacuaaaaauacaaaaauuaggcaggggugcgguugcucacaccuguaaucccagcacuuugggaggcugaggcagguggaucacuugaggucaggaguucgagaccagccugaccaauauggugaaaccccaucucuauuaaaaauacaaaaaauuaaccgggugugggggugggcgccuguaaucccggcuacucgggagacugaggaaggagaauugcuugaagccaggaggcggugguugcagugagcagagauugcaccauugcacuccagcugggugacagagcgaaacuccaucucaaaaaacuaaacaaaaugaaaacaaaaucaaaaauuaguugggcaugguggcucaugccuguaaucccagcuacucgggaggcuaagggacaagaauugcuugaacuugggagguggagguuacagugagcugaaagugcgccacugcacucuagccugggcaacagggcaaaacuccgucucaaaaaaaaaaaaaaaaaaaaaaaaaagggagugaugaaaauguucuagaauuauaaaguggugauggcucaaauauauaauaaaggaugccgaauuuaauacuuugaaaggaugaauuuauaccacauacacccuaucucgaucaaaaauuaacaagaaaaacaacagcccuaagaagcaccaccuucuucaccaauaucugcuuaugcuauuucaucauaaauccaagcagauagaaucugaacccaagaagaaauuaggaaaacuggacucaaacugugguugaggccuuaaaguagggaucaagcagucaaaauaaguuuugcuuauaccaaauucuauaguaagguagacucccguagcuauaacauaguggcacauggagcuacaauccaguuuggcuaacuacuccauacugggcuagcugccaacaucauuaccuccuaaaucagccuuauuauuucuuuccaaagccucaaaaacauauuugaagacucuaaaaaauugcuuaucaucugagacugaaaaaacauguguuuugcuacacacaaaugaggaccauugaacagauugauguuuucuaucagcacauacagucuggcggcugagauagcaugguugaguugcacuucaugugacuagcuggaaggcaaacagcaucugcacacauacccuggcagaacgcuccauuguguaugccaagccagagugcacgaugucuuucucagaugcacccuauuagggaaaagaacacaaguuuaacaaaaccacaaagaccugcuuugugucccuguauaagaugacaaaggauucucaagucaauauacaaccagacagaauuuuuugucuuuuagcuaagauaugucauuucugcacaguaucaaagauacaguaucuugauacuuacugaagcaguugcuuguugaucacaauuuauuuuuauuauauuugacagcaaacaaauacucaugaaauaagauuauaguacaacaaugaagacaguuuuuggaccuagagacaugagggcauggagugagaugagcacccuccacucauggagacgcagaugcacugagcaauguguuacacuguucaugccacggugcguucgccucagcuccccagagaacagggacaccacacagaacacagaaaggaaucugauuaaaccccauagcggcuuugggguagaauucuguguaucuauucaguagugccagcaacuuuuaaagcuguguagaucucagcagcguuuuaauuuuacugaugaggaaacuaaggaccagagaagauggccaagguuacagauagcuauuuucagagcugggauaugacucagggccuccaccaucaagucaguucucucuuuccuaauuuguuucuuggaaugcuuucuaaaaaauuaaggacaauuaacucacuaccacucuuaaggugacauacagagcuacaaaacacauaugcccgauaaaaacuuaaaaugggucacugauauaguuuggacacuuacugaguacauacucuuccagguacuaggggacauaguagagaauaaaaucaaaauucuguucucacagacuuuauauuguagugggaagagaguguauauacauggacuucaaaccacaaggcuaaguggaucauugaaguuuucaaucuagauagagaagugguuuagggacgcaggccuuccaauguuaggagagugaagaguugaagagauaccagcaagaggcaauugagaagaaauguuuagugagguagggagaaaaccaggagaaugugguauccuggaagcuaagagaagaaaauguuucaaggugggagugucaguuguaacaagaacugcugauaggucaagcaagaugaggacugaaaaauagcuacuggauuuggcaaugcuggugucacuggcugucuugacaagaauagucuugguggaguagguucaaguaaagaagaauuggaggcugaguauauacaacucuuccaaggagguuugcucuacaggaaacaaauggcaauacuggaaggggaagugggauuaagauuuauacauuuuuuaaaacagcauuugguaagcugaggggaaugacucagagggaaacugcugauguaggagagaggagcagacuugcuagagcaguguaucugaggaaaaaccauccaaugcccacaacaagaacuggaccuaagaaaugaaagcacaaagagcugaucuauucgaagagagaugacacaggacuggguacagguaccaggagcuggguagaugcggaagcucccaggcugcaucaguuuuaucugugaacagauagcaggucaugagcuggaaugcagggcagugagaagaggagaaaaugugauguaaucacucaggagacggggagaaugaaugaaacacggaaaagcaguaugacugcugggcagcucugagcgccuacuugagguuaguggucagggugugaacugccagcagggccuccuacaggguagaggcacgggauuuaaucagggauuuaaucagggcugcugggauuuaaucagggcuuagguguuaacaaaggaguaugacaaaggaaacaagacuggggagugacuguaaugauggagcacggaauuuaaguuagauaaggagggaagugagggcacuggggggaugagggacaguggaaacauggcagggucaugauguggguccugauagugccaaacaggggcagggggaaacuagagggagagagcuugagaaaacuuuuauuuuuuuaacugacaaggcauaugcugggcaguggggugaccaaagggaggggugaacagcccucuggcagggacaguagcagcgcaaguccuuccgaugcacugcuagccacuugggauggauguuauguacgaaacaguggcacacaggagacuuucagagagagccacagaacugcagugacacuuaagcagggaggagaucaguguauuccagauaaaaggaccagaacaaagacaucacucuaggaaauaggaaguuuacugaggggaacgguuaguaccuagaauggguaaagcauuuuuucuuucuuuacaacaaaaucuuuaacuuuuucccauguugcaauauagucucagaacuguuuuccaucacugaauauuucauaaggagauauauugacggccgggcgcgguggcucacgccuguaaucccagcacuuugggaggccgaggcggguggaucacgaggucagggguuugagaccagccugaccaacaaggugaaaccccgucuguacuaaaaauacaaaaaaauuagcugggugugguggcgggcgccuguaaucccagcuacucaggaggcuaaggcaggagaauugcuugaaccugggaggcagagguugcagugagccaaaaucgcaccacugcacuccagccugggugacagaucgagacucugucucaaaaaaaaaaaaaaaaaaaaaaaaaccaaaaaaaaagaagauauaauuuacccauuguaauauauucuuaaacuaugagugaauauuaccuaagauguauuauaagauauaagucagccauuucccugcuccuaaacuuuaaauaaaaccaaauuuaaaaacuguuuacaccguuucuuuuuuuuuuuuuuuuugagauggaguuucgcucuuguugcccaggcuggagugcagcggugcauuucuuggcucacuccaaccucugccuccuggguucaagcgauucuccugccucagccucccgaguagcugggacuacaggugcgugccaccaugccuggcuaauuuuuuguauuuuuaguagagacggaguuucaccauguuggccaggcuggucuugaacuccugaacucaggugagccaccugccuuggccucccaaagugcugggauuauaggcgugagccaccgcaccuggccuacacauaguuucaauaacaucaucgugcauggagugguuccuccucuuuugaauuauuuucuuaggauaaauucccagaggggagauugucauagcaccaaagggcaggaacacuuuaauaacuucacauuuuccaaagagcugcaccaaucuacaccgucacuagaauaaagguacaacuguuucaccacauauauggagaacauaagauccauuguuuuuguuaauacauuaaaaaaaaaaaacucuuuuucaauuuguauuucuuuaacaaugagguuaaauuuuucccccaggcuuauguguuauggacuuuuguuuuuccugucuuccaucauuuacugguaaagaaguuucccucccuccaucccuccuuucuuuuuuuuggcggggggagggggguggcggcggcgggaacggaguaucucucuguugcucaggcuagagugcaguggugcaaucucggcuaacugcaaccuccaccucccggguucaagugauucuccugccuuagccucccaaguagcugggacuauaggcguguagcaccacgccuggcuaauuuuuguauuuuuaguagagacggggucaccauguuggccaggauggugucgaugacuugacuucgugauccacccgccuugaccucccaaagugcugggauuacaggcgugugccaccaugccuggccucuuguuucuuucuuuauuuuuguagagauggggacucacuauguuccccagguuggucucaaacucuuggacucccauauaguucaaucuaaugcuugcuuuucaauucuuccuauuucucugaagcuuaaaauaauuaaaauacauaauaauccuucacuguuaaaacacgugcgugaaaaauaccaaauuuauuuauuuuauauuuguuaguagucaguaggauucuuacuccaguuuuagaauguaaugaaaaggaaagguacaaaacacacaugucacgcacuuacugucaagcuaauuacaaagacuaugccgcagaugaaauccaucuaaccagcucugucugaaggaaagagcagggagcaugugugaaguacaacuguggggucaccacacucaccgauauccugucuuggaacucugccguggguacaaugggaauaguuccaccaugcuuuccaaauuuucuuucuaaacucucuugaacagacacuacaaaaaaauaacaagagaucaagauauugcuaacagaaaaaaaaaaaaaaaaguagaaucaaaaguagucccaaacuauaacuguaacccaaaaacuuauacagacagagucguggucugucacccaggcuggaguguagaggcgugaucucagcucacugcaaacucugccucccggguucacgccauucuccugccucagccuugcgaguagcugggacuacaggugcgcgccaccacgcccagcuaauuuuuuguauuuuuaguagagacgggguuucaccguguuagccaggauggucucgaccuccugaccucgugauucaucugccuuggccucccaaagugcugggauuacaggcgugagccacugcgccuggccuuauacagaguuuuaaugacauaaaaggguuaaucauuuaaaacucagucaggaaggaauaaaacacauugccaauuuccuauauaaaugugaauuuaggucacugcucuguuuccauaacacccauuaccaggguuuuuccuuggcucuauuaaaaagaaaacgcugggggaaaaagaaaaggaaauagauggaacacuucacccagauucucacagugggcugaguacagaagcucaguaggaggucuuggucuuauuucaacuagaugagaaauucuacucuuaacuguggagcuuacucuagucaaagaaaaacaaguauucucaucaggagucucaaaaacaauucuugacacuagauaggccuuuacuaagagcaaccagagacagaaauuaguaucgacaguggaguuuuaaaaucacacuuaaaaaaauauuauuggcugggcacaguggcucacgccuguaaucccagcacuuugggaggcugaggcaggcggaucaugaggucaggagaucaaggcuauccuggccaacauggugaaaccccgucucuauuaaaaauacaaaaauuagccgggcguggcggugagugccuguagccccagcuacuugggagggugaggcaggagaauugcuugaaccugggaggcggaggcuacaguaagccgaguucgugccacugcacuccagccucggcgacggagcgagacucccucucaaaaaaagaaaaaaaaaauguagauuauauucugugaauauuacaucacagaauaaaacucuggauauaauauaugggagaguuaauauccagaaagacauugugcauuuuuggucuaaguuucaugagacaaaauauuauuuucuuuucugagacucaauucuuucccaaagggaucaguucucuuaaguggaccuuuuuacagccuuucagcuggcucaaaagaugaguuuuggcgaacaagauuaucgauacucacugagcaagugguaguuagaaucccuuucauauuugaaggucaaacggccauagcugacaugauuuagauucuucagccacucaaaguaagauacugucacuccuccagcauucaaguagagauccuaugcacaaaaauaagacaaagaaauuagaagaugaugguuuucguaaaagcugaaaaugaaccuaagaccuuaauuucaauaccaagguagacuggacuuuaaauaucgcaaauauauuuuagccaguaucaggaauuucacacuuaauuaacacuccuucccaucccacccaauuccaucuaaggcuuuuucuauuuaggaaaaaaaaaaaaucauuuuuuggcuuauuaaucaaggaaaguuaauaaucuuugguuggagccucuucucuaccagaaguuaguucucagacuaaauggcuugcccaccaaccaguuggacuggacuguccacagggccucucagaagacaggauucuuucuccuauuaccuaaggguagcccauuucaguuacauuaaaugucuuaagugcuuucagcaaaggggguucuuuaaaauauauuccaagcccacauuaauuucuaguaacuuuuugguguagacucauuuuuacuugcuaaaaaaccugagcacguguuccucauauuaguuuucugaguaaagcuggaaagggcacuugaaaugcauaagguuaggaaucauauagaaaaucuuaagagcuuuaguuagaauaguguuucuaacacaguacacauuuauauaaccagacucuuagaaggcuaaagacauucaguaaagagccugaaauuggaauaaauguuucgaucaaagugaaaauuaacaggcuuagaauuaaccaugcuucuacuauauuuucucaaaagugaaaaagaugaauucacuagagcuuggagacuaauaauuccucucuuccuccaaauuccuugcaaaagacuauuaugauucuaaguacauauaaagccuaauaaauauagaugacuuacuggaauaaccauaauguuucucuccaggaagaucuugucagcuucuggaguuguuggcccauuggcaccuucagcaaugaucugcaagagagucaggaacauagagaaaugcgaacaccaccgucaaauccccuccacugagggcaagagaugugcauauaugaacaaggggcuguggggagaagcacaguuucaguuaaaguuaaauagagguuauuuuucucugccaaguguauaaaacuaccuuucacuuuucuauuuaucuagguuuuuuuuuuguuugcuuguuuuuuuuuuuuacaggagugucaggcagaugcguuuguuuugguaaugguugcacaacucugugccgguagcuaaaagccauuaaauuauguaccuuaaaugggggaacuguaugguaugugcaguaugugccaauaaagcugcuaaaaagaaagagaaaacucaaucagacucuucuaugaccccccuaacgucauucacauugauaauguugguucugguuucuauaauguugucaccuuggcuuugacucugggugcguuggauuuggucaacugcuucucacuggcagcugggaucaguaugucacagucggccuccaagaugcuuccuucauagggcuuugccuuggggaagcccagaauggacccauguugcugccauugauugaaaaucacaauuaauagcugcaccagaguuuuaaauauuuauauuuagugucuaugcuauaaaaauguauuaauaccaauuugaagucuuccaguuccuuugggucaauaccaucuggauuccauauacucccaucagacucaccaacagcaauacauuuagcaccaaaacgauguaaauaucucauagaguguaggcccacauuaccaaaucccugugaagaacaauuacccauaacacaaaaauuaaaguccugguauagacagcaagagucauauuuugaccaauguaaauccauacucuguuuauuuagaagcaauucucaaaauucuuuugccaaaagaaacaauguacuaacugguuucucuucaacaauaaaauucucuguuuaagaaugugaugagcgggcaugguggcucacgcuuguaauuccagcacuuugggaggcugaggcagguggaucacuugaggucaggaguucgagaucagccauggccaacauggugaaaccccgucucuacuaaaaauacaaaaauuaggcaugggguccgugccuguaaucccagcuacuugggagaaugagguaggagaaucacuugaaccugggagguggagguugcagugagccgagacugcacuccagccugggcaauagggugagacuccaucucaaucaaucaauaaauggcagugguguuaaguacaccaccagguccucaguccuugaugaucagauguccuauguugugaaaagggaugucacuaauuuggagaaauacaauuuuuuuuuuuuuuugagaccgagucucauucucucacacaggcuggagugcaauggcacaaucuuggcucacugcagccucugccucccggguucaagugagucuccugccuuagucuccugaguaguugggauuacaggugccgccaucaugcccagcuaauuuuucuuucuuuuuuuuugagacagagucuggcucugucacccaggcuggagugcaguggcgcaaucucggcucacugcaagcuccaccucccggguucaagugauucuccugcgucagccuccagaguagcugggacuacaggcguguaccaccacacccugcuaauuuuccuauuuuuagcggagaccggguuucaccauguuggccaggauggucuugaucucuugaccucgugaucugcccaccuuggccucccaaagugaugggauuacaggcgugagccaccacgcccggcuuaauuuuucuacuuuuaguagagacaggguuucaccauguuggccaggcuggucucgaacuccuggccucaagugauccacccgucuuggccucccaaagugcugggaauacaggcaugagccacuguguccagccaccacuucuauuuucaaguaauuucaacuuaauuaagauucuccuaaguaaaauacauguuaacacaugaaacaaauuugggucaguguguaaaccuuucuauauacuuacaaaacuuagaaaauuauguuaagagacuugcccuucuagcuauaauuucaaguuugaauacuaaccaauauuuugguugaauuuggugauaguuugguugaaguugguaacaguuucacauguacuugagagauacuuaaaucaguucuaguuacaugaaucauaccaagguucaaaaaacaaaauaucuauuacucugaaaaccaccacucuaaaauuuaagagauuugagauaacuuaauuuuaaaauuacaauucuaaaaacauugaaaacuuuacuuaaugucuaucaguuauuaaggaaacuuuuuuuguuuuuguuuuuaccugaacaacaaauguuuuaucuccaaacccuggugucauuccuaaaaugcucauguaagaagcuucauugaugaaauuuucaaucccauggaagacaccacggccaguagcagagaugcguccauggauucccccuuggcugauggguuuaccaguaacacaggcgugugcauuaauauccuguaagaggggguaauugaaagaaugaaaugucaaguccaauuucucuguugaaggaacauaaugaauuaaagucaaagcacauucucauuuaaucaaaaauaugcuaauuaggaguguguguaugaauguauuuaagguauacuuuuaccaauagagacaagacucacuuuuucagcuuucuguuccuagaaaauacaauaaaauauacuauauuuucuguuuuuuuuuuuguuuguuuguuuguuuguuuuugagacggaguuucacucuuguugcucaggcuggagugcaauggugagaucuuggcucaucgcaaccuccaccucccagguucaagcgauucuccugccucagccuccugaguagcugguauuccaggcacgugccaccacgcccggcuaauuuuguguuuuuaguagagaugggguuucuccauguuggucaggcuggucucaaacuccugaccucaagugaucucccugccuuggccucccaaagugcuagaauuacaagcgugagccaccacgcccggcaaaguagaccauauuuucugacagaaaaaacaagaguguagggauugaacaucaaguaaguacaaauaacaucacaaaaguagagcuagcucagccuaaagcuaucauuccuucaacaaguauuuaagcacuacuaaaucaagguacauacacaucccauucaugagugucuuaaaaucuacuauaagacuugagcaugucaccaaaacagagccugagacaggaagaggcuuuacaauugucuuggaugggaagacucaauguuguauucugccacuuuugaaaaaggaaguuuuuaauauaacuugauacuuaauauaacaugacauucaaguucaucuaagaguagaguaacgaaaguauuuaaugaaguauuuuuaaaaagguauguguggguaagaguccugugcuucugugugagcagaguaucuuugguagcagugguuagcucugcaaaguggagauggggguuaacagucuucaccauccaucuuucuguccucuuucuuugucuuuuuuuuuuuugagacggagucucgcucugucacccaggcuggagugcaguggcgcaauuucggcucacugcaagcuccaucucccggguucacgccauucuccugccucagccucccgauagcugggacuacaggcacccaccaucacgcccggcuaauuuuuuuguauuuuuaguagagaugggguauuuaguagaguagaguauuuuuaguagagaguaacauccuguguuagucaggauggucucgaucuccugaccucgugauccacccgccucggccucccaaagugcugggauuacaggcgugagccaccgcgccuggccuguccucuuucaauugaagauguguguauauucuuguucagaaacagaaacagguguaauuagaaaaaagaagaauugggcuaaguagggcuucccuuccaagacaucaacuauacuauaagcacggccacgagaacacugcagaguaaacucaucgguggagcaggagaaacuagagacagucuuauuuuguauaggcaaucaauauaaaaugaaaauucauauaaaauuuuaagucaguggcaaaaguauaaaauaauaaauuuguugaagcaauuugcuuuccauguaaacaaaauaaaaugcccuacuucacaccaaaccccuaacucccaacauaucccuaacauuccagcuggcugaauuaaaaagugaucuguucuuuaucuguauuguuuaaauauuuuuacacagagaacuuagaauuauauuauuuguguaauuaccaacaaaaaggaugaaagcaaggaagaaaaacucagucuaguagagugauuaauagaauuaguaguuuucccacaguuugcuuucaugaauaauuaacacuuaugaauacagaaaugcaaaccgagugccaaaugcuuuuaaacagugagaaugcaaaugcuggagcugaaggaaauacugucuggggucaggccuggcgccaacugccaggcuccccagcauacguaaugguccugaaagcccagagaagaauacauucucccaccuacacugcacuucuagguggggcuaggacaaagagggcggcacguuucaguucacaucuagaaaugaguaacaaaaacaacuguguccuuccuuuagggcuugauuuuagauuucuuaucacuuaaagagggaaaacuguucaccaguauaguugcuucaccugaguccagccuggucaacauggugaaacaccgucucuacuaaaaauacaaaaaaauuagcugggcaugguggcaggcaccuguaaucccagcuacuugggaggcugaggcaggagaauugcuugaacccgggaggcggagguugcggugaccugagaucgggugacagagugagacuccgucucaaaaaaaaaaaaaaaaaaaaaaaaaaauaccacacccagagcucauugcuaaaugagcuccugaucucaggugauccaccugcuuccgccucccaaagugcugggauuacaggcgugagccacuaugcccagcuggucucuuguucuuuuuaagcaagacacuauauugaauagugcaaaccaaugggcaguauguuauuuguagcucauucucagugcuaacagcaagagaaaguccugugaagcacggccccuugaacuauacuggugaacaguuuuccuucaagugauaagaaaucuaaaaucaagggcuaagggaaggaugcauaaaaaggugacagguggaaaacuguccuuuugggaagggcaguugaaaccacaauuauuugaagggucuauaucguuccuguuuuauuucaggggguuguauaauuuaccugauguaauaccuacagauauuuauuuucugauacuuacuaagggcuauguacaguucuaggugcauuagauuauuauucaucuaaugcucaugagucucacaaaguagguacuauuacuacugucauuuugcauaggaggaaauggaggcacagagacucccaagucacagcacugaugggugaaggugccaggguuggacuucagguggucugcccauguucccagccacagcaugacaucacuucaggaaauguccccauuuccacauucuuccucuucuccaaggcccaucuuuucacuaugaaaagaauuccccaggccuucauuccccugggggacuucacuaccucuaccagccugcaucucuucagcauugucuaucucuugcaccgguaaaucugugucuuacagccaauaaacaugccaaaagacaaaaaaaaccuuuuucucuggguaacagccacuuuucaagcugucuucuuucugcuucucuccggugccauuuuucuuaguuggaggcuauauuucaugcccugcuucccucuucauauccccuugcaguccgggccccuguaguagucuccugcccucaagucuucaaaugcacacuuagcugagucacaccugcuugaaaccagcucuuugcuguuucccuguguuuucaggacaaagaccaaaguucucauggucaccuaccaagcaguaaccuggccugacccuuuuuucuacuggccuuucuuaucccaccuuucucuuucucaacucuggccacaguagucaguccuuauccucccaaguucacccagcuucugaacuucagaaccuucccucagguaauuccuucuguuccaaacacuugccacuaccccuacccuaguccauguccacacacccgucuaagugcagaccagaagguuuuaucuccuaggaggcuuuuucugaccuuaccuugaaaggacugaaaggacuggaugggccugugauucuuuuucauagcuucaaaacaacuucuagcaauuuaucccaauuguagugaauaccuugcuuacacauggcccugcauguaguaggcauaaauguauuuuuugacucuguuucucuuccuacuccugaaauguuucauuuuuuaagguugcaccccuuucagggacaggaguuaaguuuccucucauguucaguucugugguacuaccucugcucaguccccagacucagguucuccugguucucugugacucagccuggucccuuuccuuaauuccacauauauccaauccaguuuugcugagucucucugucaugugccucacaugugcaaugcuccucuccugguccucuggcuccuggacuugguggaaaggcacugacaccauaggagguucucuccuggcgccagcacagcuggacacugcugccagccuauucuuccccaggaaggaucagcaaaauuucuccacugacuaccauguaaaacacaaacacuggggcuugguguuuuuguccugguucauuuaccucuucauucuuacuuuuuuuuuguuuugagacagggucucacucuauugcccaggcuggagugcuguggugcaaccacagcucacugcagccucaaccuccugggcucaagcaugccucccagguagcugggauuauagguguauaccaccacgcuuggcuaauuuuuguauuuuuuggaaagacaggguuuccccauguuguccaggcuggucucgaacuccugggcucaagugauccaccugccuuggccacccaaagugcuggaauuaugggaaugagccacugcauccagcccucacucuuacuuucuauuaccuuuauaaauaugccuuaccuucagacaaacugaacgcuauuguuucucuuccucuuauccuccaaaucucuaaauguucauauucuacccauuuucaaggucuagcccaaauaucuccucuagaaagucuuauuucagaauucauaaucuccacuguuguauuacauuauuuccauaccuuaucugcuuaugcaccuuaguuccucuuuaaauggaagcccucugagggaaaaaucagaauuggaugcuucuugauguacguucuagugucuuagcacagugggcugcccugguccuguuccagugacaaguauagggcagcauauaaguaaagcucaaucuguguucauuacgauuuaagaauagacaaguagacauaaaauaauaugcacaucaagauuaugauugaaugagagaaaaacccagggauucucaacuuuugauauaaucagucaaacuguuaauucuuguagacagcaaaugcagaagccucggggcuuccaguggguacucacauagugcccuauggugcuggcauagguaucagcgauccaggacaucucccgcucaccugugcucaugucuggagcaggcacaucaaugccaggaccugcgggggcacagggaaagaggagugcaccaguuuuuaagaaaaauucuucucgaacacaaagauccuuguaagucucuguaauaaccaaguuaccauggcuagaaaacuuuagaucucauuuagguagcuaaucaaagucauagaaauauucauuaaauguuucacuauaaaaugcagacacauacaacauuacauaauaauuucucccucuggcauuuacuugcuguauguuuggaaguuagcuaugcacaacagauauaagccacuccauaggauuucugagugugcgaccagagguuaaucaguuuagccucucuugaccucauuucacuaacaugcaauuagagauaacaguaccauuguguucuauauaagcaggauuauuaugguuagggaguugacauguaugagauagcagaguaacaugcugcuuaguggggguauaagcccuccuuaucaaguagagaaaaaggggagaaggucauauugcuaaagcaauuguguuaagccccauauuauuuuuacuuguggaagaauguggcugugaccuauuauucgacauucagcacauauaagguuuuaggccuuagcuuucaguuccucagaucauaggaaauuaaagguuuaggcuaauaaauuagcuuacaggcaauaacaggaaucacugacuauacuacuacugacggcuacaguaagaucucugauaaaaacauguuaagugaugcucacucaaaucuguaaaggugcagaaauacuccucucaaacacaguaaaaauaaaaacaaccuaauuaucuuguaugccaauuaaaugaaauaugguauaccuaugcaaaguacuaaacagccauuaaaaaggguaacuuauauccauguaaauuacuuggaauuaucaugaacauacauauggaaaaaggcagguuucauacagcauguauaacauguucccacuuauaauuuuuuucucuucccugccauauauauaguuuauaacuuucuauauuauuucaacuguaaaauacaaacucguuuuuacaaaacgaaaaacgcaacuuaaaaaaugguuaaacuauuaggcugagcacaguggcgcaugccuguaaucccagcaccuugggaggcugaggagggcggaucacgaggucaggaguuugagaccagccugaccaacauggugaaacccugccuuuacuaaaaauacaaaaauuagccgggcgugguggcacaugucuguaaucccagcuacuccggaggcugaggcaggagaaucgcuugaauggaggugggggguguugcagugagccaagaucgcgccagugcacucuagccugggcgacagaguaagacucuguuucaaaaaaaaaaaaaaaaaaaguuaaacuauuaaacuauuaugucuccccauaaaauaauuaaaguucuaagggcuguacccaauuauuccuauaaauuuuacuuuuuagucaacagaaucaguauauuguaauguuuuucuauaacucaggggcccaaggccuaaauaauaaacuuuuuugaacaagcugugauguaauggauacagggcuaguauaagauaacuuugaaauggucaaggaucgcuuuuuauacccugacccucuccaccucccaccuaaucuguaacucuaugucuuagcacccuucccuuagucaccuuaaaaaucucaugaagucaaugacgacaacaacaacaacaacaacaacaaaaucuugugaagucuaauccccacugcacuuggaaagauuaaugccauauucuagccucauccacugacaaaagggcucucuggcgcucuccagcuccuauuugcucacuuuccauuccuuuagugacauaccucugcuggaggucagcacaacuuuguuuaaccacuccuuuucucccaauguacaaaugacaaauugguccugaaucuuucuagagguaacuacaaaaggauuaugcuugcuuuaggauuaaauaagcuuguuaccucaaacaacaauuccaacuaggccggggcaguggcuuaugccuguaaucccagcacuuugggaggccgaggcaggaggauggcuugaguccaggaauuugagacaagccugggcaacauagugagauccugucuugauuaaacaauacauuuaaaaaacaaaaaaccggcugggcgcgguggcucacgccuguaaucccagcacuuugggaggccgaggugggcugaucacgaggucaagagagagagaccauccuggccaacgugguaaaaccccgucucuacuaaaaauacaaaaauuagcuggggguggaggcacaugcccauagucccagcuacucgggaggcugaggcaggagaauugcuugaaccagggaggcagacguugcagugagccgagaucacgccacugagcuccagccuggugacagagcgagacucugucucaaaaucaaaaaaacaaaaaacaauuccaauuggagaagggcucuggcaaguggcaagucugaaacacaugguuuguaaaucagaaacacguaaugauaaaauccuucucaaaaacagucuauacaugcuaaacgugaaacagcuucugccauccaaaacaaaaucacaagguauuaguuauuaggcuuaugaguuuucuacuccauacaaaacuaauguauagggaugcacagauuacaaguaguuccugaggccgggugcggugcucaugccuguaauccuagcacuuugggaggccgaggugaguggaucacaaggucaggagaucgagaccauccuggcuaacacagugaaacccugucucuacuaaaaauacaaaaaauuagccgggcgugguggcgggcgccuguagucccagcuucuugggaggcugaggcaggagaauggcgugaacccgggaggcggagcuugcagugagcugagaucgugccacuacacuccagccugggugacacagcaagacucugucucaaaacaaaaacaaaaacaaaaaacaaguaguuccugaauaacagauauauucuuuuuguuuuuuuuuaauuuuuauguuuugagaaggaguuacacucuugcugcccaggcuggaguacaauggcaugaucucggcucacugcaaccuccgccuuccagguucaagcaauucuccugccucagccuccugaguagcugggauuacagguaccugccuggcuaauuuuuuuuuauuuuuaguagagacgggguuuuaccauguuggccaggcuggucucgaacuccugaccucaggugauccacccgccucagccucccaaagugcugggauuacaggcaugagccaccaugcuuggccuaacagauaaauucuuauauagagaacagguaugaggcagaaguuaaucuuuuuuaaaaaagcaacuuuucuaacagcaugugacuauagaguaggagaugaaaggguaauuuugguacacagagauauaaggggaugagaaggguggagacaucaggguccugcagaacuuaggugauauuuacacucacacaagagaaugaacauugaccuuucaaaagcuuuuccaaaagcagaagaggaaggaacacuccucaacucauuccaugaggcuagaauuguccugauacaaagacuagacaaagacaucauaagaaaacuauagaccaaugucacuuacaauagcauuaaaaggaguaaaauauuuaguuguaagacuucuauguaagacuucuacaaugagaacuacaaaacaucauugaaagaaaucaagagaccuaaauaaauggaaagacaucucauauucagcauuggaaggcuuaauaugguuaagauggcaauacuggucaggugcaguggcucaugccuauaaucccagaauuuugggaagcugaggugggaagacugcuugagcucaggaguuugagaccagucugggauacgugaugagaccgugucuccacaaaaaauuaaaaaauuagcuaggcacaguugcacaccccugugguucuagcuacuugggagggugaggugagaggauugcuugagcccaggaggucaagguugcagugacugcugucugguacuccagccugggugaaaggacaaaaccuuuuuggggaggguggggaagauggcaauacuccacaaauuaguguacagauucaaugaaauuccuauaaaaaucccagccucuuuuuuucuuuuguuuugcagaaauuuacaagcugaugcuaaacacacaugugacaggaucaggguucaggcucaggucugagccucaaucugacacucucuguggaaugggcagucaggaaauaacagauaaauaacaucaaauuugaagguuugccgaggagugagagaaaaaacucccuuugccuaccuccuaggcuucaaagcuuucugggccaagacgucaauuuaacugcauccugggucaaugaggcuuuugcacauuaagcaaauaaaucaaauuacuagaguuuaagcuguguuuucuuucaguauuccaaugaaucacuuuuugaccuuuggaauuauuagguacuugucaagucugauaaaauuaagcuggagauauugcagauaugggugacaaauaugacugaauaaagucugaaaccauucaagacuauaaaauguguuugagauuuaggggaagaggaaagaccuuuuaaaaauuaugaaggcuauuaacaggcugaagaugacuucaauucaccauaucucagaaucaguaggcacuccuauaaaagugugagcgagauaguuaacucauauuaacuuacguuaacagacuccauguaaggaugcacaaguucacaguagugcuggguaugcggcacaucaaaggcccaaaugccuuuuauuaucaaagacaggccaaaucuagucaaguuuuagaguuaccuauacuuacuguauuucuauauuagguuauuucaugacauuuauuucaugacuuuuuuuuccuaaaaaugaauccgaauagcuuuauuucauuucucuuucuucuugagauguggucucguuuuguugcucaggccagaguguggcaggccagagugcaguggcacaaucauagcucacugcagccucaaccccccaggcuuaagggauccucccaucuuaguaguugggaccacaggcaugcaccaucacgcuuggauaauguuuucauuuuuuguagagauggggucuuguaauauugcccaggguggucucgaacuucugggcucaagugauccucccaccucagccuccaaaaaugcugggauuacaagcaccagccaccaugcccagccuuuauaguuuaauuucaugggaacuugugggggaaaugcuaagaaaggaaaguagagaaaaauacacuuuauuuucuauuuaaguagaccuuauuuuguuuaacuauacugauauugauaggacaaguauucuauuauuaaguaacaauuaacauucuuuuuuuuuuuuuuuuuuuuuuuuuugagacggagucucgcucuguugcccaggcugggguguaguggcgugaucuuggcucacuggaagcucugcuucccagguucacaccauucuccugucucagccuccugaguagcugggacuacaggcacucgcgaccacgccuggcaaauuuuuuguguuuuuaguagagaugggauuccuacuaaaccccguuagccagaauggucucgaucugaccucgugauccaccugccucggccucucaaagugcugggauuacaggugugagccaccacgcucggcaguaaguauuaacauucuauuaacuauacugauagggcaagcauucuauuaaguaguuaugcauauucuauucaaacaaauuagaagccuucuagauuaaaaaaaauauagguuuaaacugcuugaaaauuaaaggguacaugacaaauacuuacauaucauaaaaagaauauucagauugugcacaaagaaaauauaaacacagauaauaguaagauacaaaaacaucaagcaaacaaagauuaauaucuucagaaauguuguauguuuggcaaaagcuccuauaacaaauaguaggaggccgggcacaguggcuccuaucuguaauaccagcaguuugggaguccgagauggguggaucaccugaugucaggaguucaagcccagccugaccaacauggcaaagccccaucuccaguaaaaauacaaaaaucagcugggugugguggcacaugccuguaaucucagcuacuugggaggcugagacaagagaauugcuugaacccaggaggcggacgagaucgcaccacugcacucuagucugggcaacagagugagacuccgucucaaaaaaaaaaaaaaauuuuuagauguucccacuuuauaccaaaaacuauguggcuacacauaccaauaaagcccuuuuuugcuagcuccauggugaaccuccuugugaucuuuuccaauucauuauccuguaaaauaagaaaacaaaaacaaaagaaaaaauugauauaaaaaucgcuugagauuauagcuagcaucuuauuuucuauuuauaguacauuuucauaugucuucucauguaauccuuagaacaacucauaaaguaggcauugccauuuuaaaggugacaaaauaagggaucaaaaaaguagguuauaaaaacaagauaguagaacuagggcucaaauucccauucuauuaauuccccacugaaaaauacacuaaaucuuaauuaagauuaauuuaaauauaauuauauuccauuuaaauggugaauuuuaaagagaauaaaaaucaugcauuuauguuuguauauagauaauuuaguauuauguaaagcauugugacaaucaguuugaauuaacuuggaacugacuggauaaaaaguaagguuuuuauagucuuaguuaagauaugugucacuagaaucagauccugacauaaaaacuucagaucacaguaauacuuuuuucuuuuugagacagagucuugcucuguuacccaggcuggaaugcaguggugaaaucucagccaaccucugccuccuggguucaagcaauucucaugccugagccucccgaguagcugggauuacaggugugcaccacuaugccuggcuaaucagaucacaguauuucuuaaauauggguauaagugucuaagugaagacauuauauaaauauggguauaaguauauaagugaagauauuaauuacguuuuaacuaaguaagaaaauaauaaaacaaaaagcaaaaaaguaaaacaaaagacucauaaaaacaaaaccaaaugaaacagaaaaugauaaaggauauagauauuaaguaggugaucuuuauauggcaaaacacgcuaugaguuaauucuuuacauuuuucuauuccauuugaaaagcaauggggacuacugaucucacugauagugggggauacagagaagcccaguaauuucaaguccuucauaaaugcacugugugcacaaaugucacuuugaggccgggugcgguggcucaugccugcaauccuagcacucugggaggccaaggcagguggaucaccugaggucaggaguucaagaacagccuggccaacauggugaaauccccucucuacuaaaaauacaaaaauuagucgggcaugguggcgugcaccuguaaucccaguuacuggaucaaggagaacugcuugaacccgggaggcggagguugcagugagccaagauugcgccauuguacuccggccugaacaacagaggaagacucugucucagaaaaacaaaaacaacaacaacaauaaaaaacaaauaucacuuucauacuuacaguauaguucuugggauugaucuuaacaccagcuuuagcacccccaaacggcacaucugaaagagaaggcugaugguugcuauuccauauaaauguuaaaaaaguaaaaugacagaaagcaccacacaauauuagagaaacgugaugcuuuaagcuugaauuucugaaaauucaagaaauaaaccuaccaucauuuucuaaacuguacuuuaaacaacauuuuguugaacagaaauuguucaauaaaauuggcuagccaaguucuaauauauauuuaaucagugcucuuuaccacuucuaaaagauaauagcuuauuuacucuccuucuacuauaauuuggucuuauuuacagaauguguugaggaauugaaaacaaagaucuagacuuaaaauccaauuaucuccuauuuuaaaaaaucccccauguaaaaaaaaaaggcuauaucuuaauuuagacuaauugaaaaaugaugcaggucuuaaagauuacaacuugaaaaaaaaucaguucugauaagguauauuucuacagcaucuuaacaguaacauguguguaaacauauuuccccagaguucucauuaggcagcaagaaaggcgaucacuuaccaaccacugcacacuuguaugucaucagagaagccaaagcuuuuacuucaucuacacucacaucagugcuguaacggauaccuggugguguuuuuaaaaaaauguguuggggugggugagaaagaagggguuauauuuagaacaaacuuaaguaagcuucaaaaaagaaagcuacaaauugaaaauauccacuuuuuacauuuuacauccaagcuauguccaaaaacacuugaagcagcuuguacaucagaacaccaugaaaaaugaauauaaaacguuaaaaaaaccugcuaauaacaguaacuaugauuucacaagacaaaaaucacccugcaaugaauuucuguacacuuuccagaaggcuuuuuuauguuccuuuuaccuuugguuugggugaccugguugcagggaguucaagaauucagguugcuuuuuuuuggggggguaggggugggaaacagggucuugcucuguugcucaggcugaguguaguggcacagacauggcuuacuguagccucaaccuccuaggcucagguaauccucccaccucagccuccugaguagcugggaccacaagugcacaccaccaugcccagcuaauuuuugaauuuuuuguagagacaggaucucaccauguugcucaggcuggucucaaacuccugggcucaagugauccucccaccuuggcuucccaaagugcugggauuacaggcaugagccacuaugccuggcaagaauucugcuuucugauaauucacaaacaugggcaaugaauaaucaccagguucaaaauaccguaugucuaaacagagguuuuggcuucaaauggguauauuaaaagagauccuuaccuguuauucuccucacccacugccaaccucuuucaaucugaaaaugagaaagccauuuucccuuucugagguugagugauucccuucaccacuucugcaaagagggcagguagccaagcagacagguagguacuagugccccuguaucuaguagccauuacguguugguacaggguauacuggaaguggggaugcccacagcuuuggcuuugggggucuuggucaauuacucuucaaaguuuuggagugcuaauccaccuuucuuucucuauaauccauugcuucucaaucccaaggaggaaagucugagugggguugauguuugacugcacagugcuuggggcacuggguguuugugugugaaggauacccacaagaagcugcagcauuuuuucuacccucccacucccaacagauucagccccucucgaggggcuggguacgauuuccacugggagucacaaguaaguaaugggagccccagggagagcucuuuuaaagaauucugagauuaaaaguuuuucagauagaaaauauacaauaucucauggacuggcaguuugagagaacuucccuagucaauuuuaaaagcuagcuuucuuacauguuucugaaaacaucaaccuuaauauugauaauguuuuaagauaauuuauuuauuguacacaugaccauaaagagcauauucuaagcugaacauacuuauuuggucuacuguacaaacaaaucauauuuagaggaguaugugcuuagaacuauaucuuguguauaacugauucucaaauugugaaauaaauguagucauuauuaaacuuuuggaaugcaaaauuacagguaauuuuuccagcacacagcagauaucuguauagcucacucccccauuucauucaggucucuguuaaaaacuucauucugagaggcuccccuugaccacuguauuuaaaagagcaccucuuucucacucccacuuuccugccucuccuaccuuguuucuucauaucguuuauuauuacugacuuugcauuauacauguguuuauuaucuggcuucccuaccuggcaaguuagcaccacgagggcagacuuuguuauguucacugcuuuaauuccugguuccuaacauagaaaauggcauauauuaggcacucaaauacaugccgaauuaauauacgaauauucugacucuuaaaauuuaaaaaagaaagaaaagcuauggccacaaaaauauuugacauacauguuaaguuuuaaauaacuuaccauaagccuccauaccuaucaugaaaggacucaaaguauacaaaacugggaaugggggugacggggagaugauggucaaaggguacaaagccucaauuagaaggaauaaguuucuucgagauagauugcacagcauggugaauacaguaaauaauaauagauuauacauuuggcccaacaugguaguucaugcuuguaaucccaacacuggaaggcugaggugggaggaucacuugagcuuaggaguuugaaaccagccuggccaacauagugagaccucauuucuacaacaacaacaaaaaguacugcacauuucaaaaucacugaguaaauuucagauguuuucaccagaaaaaaugauaauuauuugcaauuguuuccaguggugaacagguuaaucagcuugacuuaauuaugcaauguuguauucauaaaucauaaaauuacuuuguaccucauaaauauauaucuacaauuugucaauuuaaaaaauaaaaaauuuaaaaagaauuuccagucagauaaagcccacagaaaagggaaaaaaaaacuguaaauaauauuaagaugaaucauuuguaucuuaaaaaaaaaaaaaaauugaguugggcgugggggcaugugcguguagucgaagaugcucaggaggcuggggcaggagagucacuugagcccaggaguugcaggcugcagugagcuacgcucaggucacugcacuaaaccccagcaacagagccagaccuuuccucaaaaaaaaaaagaaaaaagaaaaaaaaaauuguuuaaacacuaaaaugugcuuuucaaauuauucaaaaugcuucuaaguaauaccacauauuauuuaaugauaacuacacuaagccagggaaaugguaaggcgcugugcccaggcgacccagccugcaccauccgcuugcauggaggggugcuaaugccacucuccuaggaugggugucacgacugcgaggaacaucgcacauggggaaucuggcacggugcccugcaaguggucaaacaggcaaaucucaacuauuaccacugcuauaacaaguauuacaaaguaauggcauguaacaaagcaauuaaaaagucuaaacugacaggaguuugaaaaaaugacuuaauaaaccuugguuucauuacuucuacauaaauucacaggaaauaguaaaacaauguauuaauuaagaacuagugcucucccucucccucccccucccccucccccucucccucccccucucccucucccucuccccacggucucccucuccccacggucucccucugaugccgagcggaagcuggacuguacugcugccaucuuagcucacugcaaccucccugccugauucuccugccucagccugccgagugccugcgauugcaggcgcgcgccgccacgccugacugguuuucguauuuuuuugguggagacgggauuucgcuguguuggccgggcuggucuccagcuccuaaccgcgagugauccgccagccuaggccuccggaggugccaggauugcagacggugucugguucacucagugcucaauggugcccaggcuggagugcaguggcgugaucucggcucgcuacaaccuccaccucccagccgccugccuuggccucccaaagugcccagagugcagccucugcccagccgccaccccgucuaggaagugaggagugucucugccuggccgcccaucgucugagaugugaggagccccucugccuggcugcccagucuggaaagugaggagcgucucugcccugccgccaucccaucuaggaagugaggagcgccucuucccagccgccaucccaucuaggaagugaggagcgucucugcccggccgcccaucgucugcgauguggggagcgccuuugccccgccgccccgucugggaugugaggagcgccucugcccggccgcgaccccgucugggaggugaggagcgucucugcccagccgccccaucugagaagggaggagacccucugcccggcaaccgccccgucugagaagugaggagccccuccgccuggcagccgccccgucugaggagugaggagccccuccgccuggcagccaccccaucugggaagugaggagccucuccgcccggcagccgaccuguccgggagggaggugggggggucagccccccgcccggccagccgccccguccgggaggugaggggcgccucugcccagccgccccuacugggaagugaggagccccucugcccagccagccgcuccgagagggaggugggggggucagccccccgcccggccagccgccccguccgggagggagguggggggucagccccccgcccggccagccgccccguccgggagggaggugggggggucagccccccgcccggccagccgccucuuccgggaggugagggggcgccucugcccggccgccccuacugggaagugaggagucccucugcccggccagccgccccguccaggagggaggugggggggucagccccccgcccggccagccgccucuucugggaggugagggggcgccucugccuggcugccccuacugggaagugaggagccccucugcccggccagccaccccguccgggagggaggugggggggucagccccccacccagccagccgcccuguccgggaggugaggggcgccucugcccggccgccccuacugggaagugaggagccccucugcccagccaccaccccaucugggaggugugcccaacagcucacugagaacgggccaugaugacaauggugguuuuguggaauagaaagcggggaaagguggggaaaagauugagaaaucggaugguugccgugucuguguggaaagaaguagacaugggagacuuuucauuuuguucuguacuaagaaaaauucuucugccuugggauccuguugaucugugaccuuaccccgcaacccugugcucucuguaacaugugcuguguccacucaggguuaaauggauuaagggcagugcaagaugugcuuuguuaaacagaugcuugaaggcagcaugcucguuaagagucaucaccacucccuaaucucaaguacccagggacacaaacacugcggaaggccucaggguccucugccuaggaaaaccagagaccuuuguucacuuguuuaucugcugaccuucccuccacuauuguccuaugacccugccaaaucccccucugugagaaacacccaagaaugaucaauacaaaaaaaaaaaaaaaaagaaaaaaaaaagaacuaguauuucuucucccacacauaaaucacuuuuuccauugcucuuuuagagccuguggaagucaucaccacauuauuuuuaauuuuccuugcuuucuuaaguggaggaaauguuacuuucuuuuaacuuagaaacuuaaaaauuuuaacuugcauuuaguggggagcuaaaaacugcuggaaccaaugauauucauaaaucaaacagaagcauucaaauggcaagccuaauauucuagaaauagauguuauuaaaaauuagaaaccagaccccuccuuccacacaaguguaaacaaaauguccauuuuaucauaagucauggaaugacaugagucagaaacuguguguguauaacaaaagacauguuccgcuggauggaacccaggaauucuuguuuguaaaguuaaguuuucuuucccagcuacacccauuuagagagcucaacugcuaaacagugaagagaagcaguuucacaaauuaccucucacaccacaggcauuuucuguaggcuaugaaccaauaaagguuuagugaauggaagcacaggaggagcuauaaagaaaguaccagcuuaguggaagaagccccagagccaacagaacagggacagggaggggauagaaaugaaugcaagugauauugccugggcuaaagaagaaacauuuucauuuuaaauuucuaguuaaccagugauucauacauguuuuuaauucuagaaauuggcaaauauugaguacugggcuaccuaaacugguagucugaaaaacaaaaaauuuuaaagugcacccauuaauaaaauacucugcagcaauacuugagacaaaacaaucuccaauaagacacaauguacccacacacagaagaagccaguuacucuuccuucucuggguuuggaaaccaaagauaacuaucaaaaauauacugucaccugaaaauaagucuuaacuacauucuaagggacacgaagagauuuauguaggggccagaugugguggcucacgccuauaaucccagcacuuugggaggccgagcugggcagaucacuugaggucaggaguuugagaccagcuuggccaacauggugaaaccccaucuuuacugaaaauacaaaaauuagcugggcaugguggcacauucccguagucccauacucacaaggcuaaggcggagguuacagagagcugagauuguaccacugcauuccagccugggcaacaguuugagacugucucaaaaaaauuaaaaaaaaaaaaaaaaguaagaauaugacugcaaaaaggaagguacucuacuuaacucaauggauugggaaaaauuagcacaacuggagaaugugaaggacaaaaugaugugacauauaccucaaaguucugaaaggcagggaaagccuagcacuuuugaaugccuacucucguucaaauauacucaauuugaaguuguucaaaaaagucaaauaauaggaaaauacauacacauacaagaaaaucagaaaaucuuaaaauauuuaagccaaaaugaagcaagaaggaucuuaugugaucugaauauugucacuuuuuauaaaaccaagccuuuccuccuucagcagagaaggcugaaggugaacaggaccaacagagaucaaacaggggcacagaacagaaacuagaaggaggaaggaagagauguuuuauuccagaaauggaggaaaguaaauuauauuuuuguaucccaaagucuuagacaguuaggcaugguggcucaugccuguaguccuagcacauugggaggcugaggcagaagaacuugagcucagguguuuaagaccagccuggacaacauagugagaucccaucucuacacacacacacacacacacacgcacacaccgcaucuuaaaacucuguuagacuccauugaugcauuacuaguguuugggaucaacugggucuuuggucaacugugcuaguaggaaugaagguaaauacuuuuaacaaagagcaggaguccacggcuggcuaagcuagacagugaaugggcuugguacacaggugucagccacagaacugaugccauuagaaacauggccuaaaaaucaaggccacccugcugacaaaguaaucugugcacucagcucaccagaggaaacuaaagacacaccacccaugacguuuauuauuuaucaaucucaguaaagcuggaggaagggcaggggauagaaugacguauguacuacaaugggaacuuuuaaaucauuccuucuauucugaacagaaacugacuaaacaguuauuuuauguuaacugguauccagauguuuccaaagaauauuagugaaaugcagacaucugcaacuauauacaguacaaagcacugaucugauuuuuaacuuaauuaccacagauauuccuuaguaugcucaagucuaaugagcaguacaugcuaaguuucucuaggagaaauaaaaaucaaaagcagaaacuagcuuaaguugcuauagugaugaagaaaacaaaccagcucauuacuuuaaaaaagauucagugaaaaccacaauugacuaagcuugaauuuuuuuuccuuuuccuagcugacucaaaagcaaacacaaaagccuccagcuagucacuguuuuuuauaauuagucauuaacaaaacauuuaugaaaauucaagugguuuuaaaauuacuugaaccugguucucuuaauaggguuugauuuauucaucagaaaucuaauuuccagcugcacucucucacuuuucaggaacuauuuauucaguaaccaagaguucuaccagaagcacagaaccaccagaaaagcaaaaaugccucagaacaacucuuaauauuuauaaguuaacacucuugccacuuacucaucagauuauauuuuuucacuuaauauuaauguaccuucuaacccacaauaauguagcguaacuuaauuuaaaaugaagagaggaagguuagaagcagggaggaacucucaaugaccacccacaaguaaugaccaccugaaauacuacgucucagauaaaaauucagacauucagcaugggaaggagcacugcauauaggagcuaagaaaaaguacacacuuuaggcugggcgugguggcucacgcguguaaucccagcacuuugggaggcugaggugggcagaucauuugagguaggaguucgagaccagccuggccaacaugaugaaacccugucucuacuaaacacacaacaaaauuagcugggcgugguggugcacaccuguaaucccagcuacuggggaggcugaggcaggagaaucgcuuaaaccugggagaccgagguugcaaugaguggagauugcaccauugcacuucagccugggcgacagagagugagacuccgucuccaaaaaaaaaaaaaaaaaccagaaaaauuauacuuuaauugcuuuagcagcaucaauguacuguuuuguauaaaguaggcaaauaccaucuuagauuuuuaauccagucuaaaucuuuuauuuuaaccugaauaaauuuugaagagguaacuaagcuuucugggaagcaaauguuuagcugauauuagaaaaauauaaccuauugacacaucaaagaaaaaacggaagaauacuuuuuucauuaaaaauuuaaaauuauaacacauauguauguauuucuaucaaaauuuaaauacaaaaagaaagcugaagacucccuugacuuccacuuaugaccccagucuucuccuuaggggugacuauucuuagcaauguaaguguauauccuuccaaaucauguucccugcaauuauauauguacauauccauaaaacauacagcuuuguuuuguguuauuuaacuuacagccugacagauggaagauuauacauuaaaagggggauuuuguuaauuuuucuugguagauucuuuuauucugaucuugauuaacaguaacuuagcugcacuuucacaccaaacaggucuuggaaucggaaaugaugcuaguuaaaauggugaauauaaaguuggauuuaguaaaagguaacaauaacuuguuauuaaaaaguuucaaagggauaaaggcuugaaaccucagcuauccaguuucauauaaauuauuuacaagucuacgugauaauuugagaugggucuuaagagaggcagaggaauccuagggagggggaagugaggcauggacaggcagagggacugcacuauucaagggcaugauggagagaaguacgugccuggauuuccaauuucccuaaggauaauuuuacaccagaucuucuuuauuuuaaaaauccaauccuuuuccuuaauaaccccaucugucccugauaccaccauuuuuuucuaccagucucucaggcuagaaauuuugugguuaucuuugccucuucucuccuucauccuguaaauccuaccuguugggaauacauuacuguccuuucuucaaaauguuuuaucugucuuuucuuuuucauucucugcuauuaacuauaacuucauucucaguuccacugcugccuagcuuucugugcccugcuagauucaucauuauucauccaacaaacauaaaaggaaaaaauuggccuggcgcgguggcucacgccuguaaucccagcacuuugggaggccgaggcgggcggaucaugaggucaggagaucaagaccauccuggcuaacauggugaaaccccgucuccacuaaaaauacaaaaaaaaaaaaaaauuagccagcguggcggugggcgccuguagucccagcuacucaggaggcugaggcaggagaauggcaucaacccaggaggcggagcuugcaguaagccaagaucgcgccacugcacuccagccugggagacagcgagacuccgucucaaagaaaaaaaaaaaaaaaaaaaggaaaaaauuguuuuuucucacacauuucugacaccaaauguguggguuuuccacacuaagcaguucuccaguucucugcagauacaaacuggguguccugcaauucaguuaugacacugacuaccaggguuagcacagaccccacagcucaagggcucagucgcacaagacuguucccuacuucagaugccaguuccaagucuugggugcccagggcacccacacuucuguccaacuuggcuaccaaccaggggguucccauggcccccuccucagguucaauaauguuauaaaggcucacaggacucagggaaacguuacuuauguaaaggauacaaaucaacagcaacaugaagagguacacagggccaugucuggaauguccccacugcaggagcuucuguuccccuggaauuuggaggguaccacccuacccauacauggaugcauucaccaaccuggaagcucucugaacucuccccauacuccagccaucaguuaggguuuguauagagguuccauuaugagggcaugacugauugcugauuaaacucaaucuucagccccuuuccaaucuccagaggucaaagggugggacugaaaguuccaaauuucuaauuauggcuuggucuuuuuggugacuaguccccaccuugaagcuacccagaagcccauuaagaguguccuaguuagaacaaaagaugcuccuaucacucaggaauuugcgacauucaggagcucuguguugggaaccaggcaaagagaccaaauauauuuacugucacaagcccuuauuucucauuauuuacaaauguaguuuguccucaugacccccuuacacacaguuccacuuccugccuugggugaagccacccccucuuuaucugaaauggccuuauccaacuccuauccagccuucucuguucccacaucaagacugucugucugccaggcacgguggcucacgccuguaaucccagcacuuuaggaggccgaggugggcugaucacaugaggucgggaguucgagaccagccugaccaacauggcaaaacccugucucuacuaaauauacaaaaaucagcuaggugagguggugcaugccuguaaucccagcuacuugguaggcugaggcaggaaaauugcuugaaccugguaagcagagguuguagugagccaagaucgcgccacuguaugccagccugggcaacaagagcaaaacucuguuucaaaaaaaaaacaaacaaaaaaacaaauaaacaaacaagauuguccuugguuuccuugaacuccuacugcaacaacacaugauuuacuuuguuuuguuuuuuuuuuugucauuuauugacugguucuaggaaaggaaaauguagaaauggaauacugagcuuauagcaaaacaaaaaagacauaggguacaaaggagauuugaaucugcucuacuugggagaaaucaaugaaaaaaaauauuccaagaaauaaaaaaauucaacuuuguuuuuuuaaaagaacccucugcauaaaguucagagaucuugccugcaggaacaaaaaacacauaauagaaaaauugauuuacuuagaauauagacuauaguucauaauaaaagcaguccuuauuugguaaaccuucaauacgaguacaucacccuugguuauuucuuugcucuuucucucuuggcauaaaagaaaaaaaaaauucaugcaaaauccuacuaaggcccaauauguacaaaauaucuuuuaaaaguccuauguugauauauuugugauaaugacaaacgauaaaagaagucauacuacugacaaccuuugaaauuuucauuugucaucuuucacauuuuccucuagccuagaagcaaaucagaagaauuacgucugauagacuuucuccaagaauaauaaucaagagaaauagcaauucauaauaaacaaagcauuuucuuaguuuuuaaugaagaaaacuaagaaaguaauuucaaaauuauucaauagaaaaucuuuaaagauaaauggacuacacacugguagagaaaugaguuguucuggcuaacacauuaaucucuuaaacaccaaagucuucaaaccucuuuugauggaaaacuguuuaaaauguuauuucaggucuucggaguuggguguaggggaaaaagguuauuucauuuccuuagcaauuagaauaaauggaccucuagagauaucaucuaugcugaguuuuauaugcaaagcuguuugaauauguauuuuucuaggaagaagguaggucuucuaauagcuuuuaacagaaauuucaaagguaucuaugauccaaaguauuaggaagcauugugucaauggcaugaagugguucucaaucagcgcuuacaauuaaaagccuaagauacaauuuguaacuuuuugcauaaauaaaucccagacaacaaugauuaaggugggugcuggaaucagaugcccagaaucugaaccucaacuccacuacguacuagcugugucacccugccaaaggacacuucacuccucaaccuuaguagccacauuuggaaaucagggacaacaguguauugcaugaggcauaaaagcaaugauacaugaaaaguucuuacaugcauuguugcuauaaggcauagaacugaugaugcaugaaaaguucuuaauaaaaugccuggcacacacagagcugaauaaauguuagccuuugcuaauaucugaccuuggugaaggcaguugaccucaagugaaggcagaauguguguggcugcagaaucuucuagguguaguugccuuuuuguaaagauaaucggaaggucuugaguagcuccuucuccuaguuugucuucuuguccuuaauaaagccuuuccugccuuuaacaguaguauuucacauauuaacaauuccgacuugauagugaacacuugaaucuguauuaauuucugccucuggaaaggggaaaauauugauucauuugaauaacuagucaguuuuagacagcggcauuagauuuaagacuguucaugguuauauugggggaaggacuugggguagagcugcuucacuuuucauuuuguaacuuucguuacuauuugauuaugugaaucaugcauguguauuuuauggguugcugaguacaaaauuuaugggcuauuuaugaaucaaugugcucuaaagugauacuagagauuuuucucuuuauuacuuacauuguaaaagccuaauuauuggguaaaauaaauagaaaagaagaacagucacguggcagagacuagugucuaggauuuuuucaacaucuacagguuaguauuuuaguuuuuaaugguuacagaacccuuaguauuuuuaacauaaguaaauaaaaaccgauuuuccuaagcacucugaauuauuaacagcgguaaaccuaauuucuucccacuauaugccaaaaguucaggcucaauuuuuauuucuuguacuuaaacacuacaaguuguacugaacuuuaauauauauuggugcuuaggauccaauuuuugaugcccuaauucuuacaaaguauacuuuggauaaugagugagcagcuguuugucuuccugcacguggggcuuuacugccaaaagcaaacuugcuaaauggauucauacacgcaagugacagaaagacugaaaucugauguacagaucacuaccauuaccaagcgucuucauuuucuaguauacuuugggagaaaagacgcauuuggcuuccaugaaauaaaaaggcauaagggcaacacauuuccguauuuaaauaagauguauuaaaaacaacaaccucggggcuaagugcuuuuaaaagacacacaaauuaccuauccucugacugaacuuucagaaaaguccuaaauuaaauucaccuacaaagguuauauuuuaucuguggcagcagaugcagacacacagccacuuaaaaauauuagaaacugugaguuuauuaaaaguuaccuaaguuuugaugguugucaauugagcacagcaaaauaagucagaaacauuuuuucccccagugaaggcagagaaauaucucauuuuaaaucaguaucagugcuuucuauagucuucccuuaagcgcuaaacaaugacaucccagaggcugagggcgucuuuaacacugcauugacuccggucuucccuugcauuaugucaucaagauuccacuguuuccuucuggcauuuugacuuuuaaaaacuaguuacuggauuaauauaggguacacuuuuuuggguacuaauauuuguaauuaaaagacuuagggucaauguaugagagaacuccaucuacgguccaucaacuauauguaaauuaugauaauuuuagaaaauuuuaugauaguagcaucagugauagggaauuuuaauaguuuuaauaucaagacaacugggggggggcagacuggaagagaaaguuaauugacuccuaccaucaauaaauugcuauuaucaaucuguacuuucccuccaaacugacuuuaaaacaauaaacuuccuucuaaaaagguagacuggucucaggcagaaccauagcaaaugaaauacagauaauuuacucugggaaaguuaauagaacaaucuuugauaauauuuccaaacccaccagaacuuuugaaccagucuucucaaaucagucgcauauucucacacuaugccccuuugcuggaaauauuuuuaaggccucacuuaaacuucccuucagauccuuuagcuuacccuuucaaauccuuaacacagacaaaucuaacggccucagguacauguaguaacugggaaaagaaaagcacaaaaacaguguguauuauuaaauauuuacuuggaaaaaguacacaucagccaccaagucuuauaaccaucuguuucccuuagagauuauugcuagauuguugcuuugcuucaaccucaagaauuuuaauuuagaaaacucagggauaagguuguucuugagggaaaaugagauacagaaagcugaagguugguaaaaggguggagagaggcagaugagguuuuuuuuuuuggcaaagaaccaaugggagagaagacagguuaguggggagagguaagaagaacguguuaaaauauguuuaagagggaaagacagaauuucauagggauuauccaaagcauuuaaaaaaaucucaaucaccuaauauauucuguguuucuaagacuagagugggacuacaaagguuaacaauuucuuagacguuaaaaaagcuuuaagaaagaagaccugucucucuuacaaugcacauucucugcaaacaagggugauaaauggguagauagaucuggggaugucuugaacacaaagcauggaaggcuauaguacccaaauuuugcugaucaucuguuuaguauacuguuuauuaagcaaacuaaaauauuuaagggcuuucauagcuauguaaucuuccccaauccagaaagccuuucaaauuccugaagauaauaaauuugucacuuuguagaggccaauuuucuuugauguucuaucaaugcuugcaacaguuuacuaguaacaauucaguuucucccuguuuauaugcuggggguuaauagcauguuuuuuuguaaaugggauaaacggaacagaaaauuguaucuuacacucuaguacaagcaagugcuacaguaacagugcuuugguauggcugacccaauuuguugcuagguucaauauuuuggcauuaaaacugcuguggcaacaagagaaagaggacucacaaacuaugguaaacgaguugcuucagugaguuugcggagcugcgacuuauaaaaacaggagagagcugggcaucugaagaaucgaagaaaaaggauuucagagaccaaaucauccugcagaaaaccacauacacugauuuaucuguacaccuuuuaaaggacuggcaaaugcugccagcaagauaguaaaaaauaaacuugauguccguuuuaagaaaacgaugcaacucaauauuugcuaaacauugccugaacuuccuccaacauccuuauuugccuuucuuuggagucugaacuuguuuuccugguuuggauaauaagggagugguaggaagaaggcaggcaaauguaggagacugacgguguguacauuuuauacaauuuugaagcuagaaaggaaaucagaggucaaagugguucaaacauugguuuuggcugaggcaaccagagcuaggggauaauuaagcuccaaaguuaaguccuagaagugggcggggucaaugcaaauuuaguaaaucuuuaaaaacaaccuuuguccccccugcugggaacaccagcaccgcucaaguuuuuuccgguacagagaggauuucuaaaaauccucauaagucagcgggcauaacugaaagaccacagaaccagguuuacugagacaugggucuagcccaacauccucugugcuucucagccaauccaccuccaacaagacuccucgccucccugggcucuuuauuccauauaauuuuucuuuuuuacaguagacaaaagugguuuguccuuuccauuuuauguuacuaaagagguaugaugcaauguauuggggggaaaaaagcucuuauuugcucgaagaaagcaaucugacuacagaggccaaaucuacagacauuaaaugauuuaaaccacaggauaacccagugacuaccaaacauuaucugaccccuuucuucacguacuauauuuuuccugaagcucaaauucagggcuagccaggaccaguacacacccccagagcuauuucauuccauuggcuggcuggccauccgcagccuacaaccuguaaauuuacugucaggacgccagguguuuauuugucagagauauuacauugcuugugauuuuuuuguguuuuuccuuuuuuuugguauaaaacagaacuugucagaaugggaaaauuacuuaauugaaacgauuaacgcgugauuaguaaauuccuuugguuaauaaaacugucuagauuucaaacuuagaagccaagucauuuucuauguucggauaucaucugucacuauuggaacaggagugaacaaauaccagaaaauaauuugacagcuugcauuuaggggagacucacaaaagcccaagaacacugacgaggcauuaucacacgggcaggucauucccuuuccuagaagugcauuucggcaggacccgccgugugugacacagacaccgggaccaaaaggagaccggugcagcgucuacucugcaugcaagaucagcauauacagaggcccggggugacggcgcgggggagggggcaggccaaucgcaugaugauuuuaaggcggaaaaaucaccauccacagagccggccacauccgaggcggggugacccgggcggggacccggcccgcuccagcugggcugggcugggcugagcagcggccccgcaccggcaggaggccggaggggagggccgcaggggaggcagggagggcgggacggggcccggccgacgcucaccucccuugcagggcgugcggugcuggcugugcugggcccgguagccuucgaugaccucccaggagccgucgucgcgccggauggggaaggagagacucagcacaugguugcagggcuugaugauccgcaggaugccgcgcacccgguuccgcuucugcuccucgcucucccggguccucagguccuccaccagcuuguccuccacgaugcuggcgccgcgaucgaagaagcccuccaccaucuugaagaaguuggggucguccucgcggucggccaccgccucgcuguaguggcgccgggcggccaaugccagccccggcugcggggcggcggcgggcuguccccgggcccagcccagcaacgcggccgagucggcggacgccgagcccagggcagcgggcccggcccgggacagcaacagcgcuucgcccagguagcgguacauggccacaagcggaggggaggugcgugauggucgcgaaacaggcgcgcuuucucagacuccccgcgacuagggaggaagggucccgcgcggguugcccuuuuaagccgcagcuuccugcuugcccggcuguccccuccccucgggcgcucgccaccuaacggggaggacggacuucggggacagggcgccgcccagggcgccgggccuccgccuccgccgcggccuccccgggccucgcuggcggcagcgc
